United States Patent 11,180,807 (METHODS FOR DETECTING A GENETIC VARIATION IN ATTRACTIN-LIKE 1 (ATRNL1) GENE IN SUBJECT WITH PARKINSON'S DISEASE) - sequence listing, part 31

SEQ ID NO: 387 - DNA, 1195733 bp, Homo sapiens
tgtagtacggttccaactcccagctcgcacaccgctggcggacaccccagtaacaagtgagagcgctccaccccgcagtcccccccgcctctcctccctgggtcccctcggctctcggaagaaaaaccaacagcatctccagctctcgcgcggaattgtctcttcaactttacccaaccgacgacaaggaaccagcctcaaccttttaatgcacagcccggccacaggattgccttccatctcctcttggtccctcctggatgtggtttattgatgacttgcgagcccctcagagagctgtcttccctcctctggctccctccgtttccttgagttagttttctaaggttttaccggggctcgggatctcttggaccgaatggaactttttgctgcctgcttttgctgctgattctgtcagtggacaaggaaaaaggcttcgaaggcagcagaggcgcaggggaggtggagaaagaggtggaggaagaggacgaggaggaggaggaagccgaaggggctcggcgcgtgtgtgtgcatgtgtgcatgcgtgtgtgagtgcatgtgtgtgagtgctgccgctgcccgcgacccctggccccgaaggtgttggctgaaatatggagaatagtcttagatgtgtttgggtacccaagctggcttttgtactcttcggagcttccttgttcagcgcgcatcttcaagtaaccggtaagtggctctttcctttcttctcgtcgcacccccttccgtaccccacttcccttctcatttcatttggcgagtagtagaattggggtgggggatagcaagagatttggcgcttgcgctgcccccatttgcgcaccgatgataaaagatagaagagtttttttcttccctgggggcggatgatggtgggggggtggtacaaggggcgccccttcgctgttttaaaatctgatgcttcacgcatttttgcttctgcaaatacttgggttggtttggagagccggcgggctggggcaggtgctggggatatcgttgaaaggaactgggctgggtccttaaagccccagaaacctaccaagtggggaggattggggcaacaggagcaggcgaggaggacatccaggggctttgaggaagtctgcgcagaatgtagatggtggggctgagtcgttggtgtgtgaatacatctccttttggtttggatttttggacttggtgattgagaatagggaaagggacagctaatatgttttggtacttccaaggaggggatcctggtactgaaggaggcacagagttgccaaggaggaggggaggtgtgtttaatattgttttattttttaacggtgaatgtagttcgcaagctgagtctccatatagctccaggacacctccaaactccaagtgattgatattccagagaaccggcgccctgaccctggcacttgcctagctcagtttctaattaaaaatggcaaaactgtttggggattggatctggctagtgcaggagaaagagggacctggaggctggctgatcaggactgctgtaatctccgaatacggagctggcggcttcgacggccaaaagaatagaaaagagcaaaatgactcatgataaggtccacttgttttgcgggacctcaccgcaagtgtagatgggcactggggtacagtgagcggtcctggcaaagaaggagaggagagcggctggatgagcattcagagagcccttcggaaacgacctttttccaaatccaaaggaaaaacaggctcaggcagagaccgggcgttgagtaggagctccccagttcgtgcctgggaaattaacagggaatggcacatcaatcgcggccaagcccccagcctccccggagtccgcagctccggctttctcttctctgctaagtgctgcatggccaagggttgcgaacgcgagcagaaaatgcgcctctcactgtcgcgagggattcagacagtcaagcgccaaggcagcccgaggctccccaaagcctcgctcggccgcacgcgggcaggaatctgcgcttgcactcgggctcagctcctcatcttcctttggccagagacagagagagcaggcaggaggggtgtgtgtgtgtgcgtgtgtgtgtgtgtgtgtgtgcacgcgcgctgtcctgtgatgagcgcgtacccgcatccccgcgcttagccgctggtgctccctccctccgtctgtccctcccgggccggtcccctcctcccctggctcttctctcccggagctttgtcctcaacaattactctcgcaaaaggtgggtgggggtgggggggtgggcatctccacagtaatgaataggtgtctgttttaaattgcctcctcgagaccctcaaatgctagaggctgcggggaggaggaccctccttctgcccagaagattgacttgggctttctatagcagtttgggagacctatgcggacgggaaaggggaagttcagggggcatcccttactgggtagaaagtctgcctaacagcagcactgctgacctgaaatgtgctagctgaatgcactgcatgaagcaaggtgtacaaaaatgaacaatgatgtcttgtcaattacacgacagtattttaaagctattactcaagtgacttttgtctggcatagggtgggggtagattaatagagataaatttatgtgcgttttattaatgtctaaattaattaaatattctctttgcatttatttacatttcttgtccagagagtcagggccatgtattactgcttcattttaattttctcctcaacagacagatctatgcttgaaaaagcagatgtaaggaagggatacatacacacacatacacatgggttatgttggtggataggctaacggatctaaatctttaaacttttctgcacttctaaatctatatctgttatttgcaagtgagtcgtgatgcagtttgcgcagctcgcaggaaagtggatggtgcatttttaagatattgccaattcacaacactctggcctttgctcattaatctgagtatcacttctttctcttagtaataatttcccctgtttaggaacatggcaggaaacttacaacgagaaagcatagttcactctataaaaggaccagtaggaggtgcccttaataaggccaagtgtctagtttactggcagagaaattcccattcagccgggtgttttaaagactttgttgattggtaacaaaggattatggagactagcacaatagcactgggccctttcccactttctaggtaaagtctgaagctgctgtagatttgtatgaaactgtgatgatttaacaaaggacagccctgaaaagtgtcagtagagagtgaggacttgatgttgggggaggaggatggtgactttttagttggcttctgtaagatgtcatcttcttatatatttgacatgagccacaggcacaggaaccttatagagtctcaggggatctcagataagataacaattttggatgttggatgttaatgagtgaaaaatgaggcatacatattaattaattcttcatacatgtttgggttccattgcattgaaaaaaatctgtgagtgtttaatgtagtctggatatgctgaaatgaggctggtcgccctccctaggcgacctcttctcattcccccaaccaaagcagatcagatgcccccatgtgggtttgcttttgagtggcgggagtatggcagagcctgagggctcggggtaggctggcagtccactcctctgtgagtgccgcagtataaatcaccagtacctgtcagtgtccatttcccacacagcagcagctgccctctgagttataaagcatgggaaacggccaccacatgtgttatatgtgaatatattaggcttagtgcctttgctttaatgctcttaaaagccaggctggcttgagatgctgataggcatttttttctggggagagatttataacttctcagtgtgtatgacttaaatttattctctggcaagttaacctcttagcaaacttccttattgttttcattgaagaggaagagccttaatcctacctaaattcctgaatgaagctctgctgaaagtttctgctagagtacaggatatttgcaggctgtagtatggtttcctaaaccaatgggaagcttgacaagatatatggggaggtgattttttggtggggaggcggggatatttttacttgtttttagagagggaagttgtgatactgcatcttctaaaggaattctagcaactcagttatctcaaaagcatctttaatgagaggaaatgtttctcgcttccagtttcatacatctaacagtctgggattcttcaaatgcatataatatgctcctggaatgtttgcagctgcacgcagtagggtcatctagcaggatcactgtcatttggaaatgagccctgatttaaattttgacttgcagacaaaacacttatctttacctggtgcggcatgtttaaaagcagtgctgaagtttctgaacagaatatttctttccatgggagactgtgccctaagattacattttaaagtaagtgttcttaccatttctttggagaatttgccatcccaaactttgcatgtgaaacttcttcttcatgattctaccagtaaagataactatttaaagagaatgcagttgtttccgggtatttctttaaaattaaaattcaatgtccacatccacacacaaacaaggaggatttccaccccctcataccttctccttcaaatagctgactttggtgtgaattatgatagctctaattacataagggcacttgcaatttccctagagaatgagttcttgcctgattacagatcttcctactttccataggaagtttctggcccacactactatcagaaacttgcaccaaattgggaacacattgctctgttttggtatttgctacccagctatacatttttgaaggattaatctacctcagatgataatctcttagatgaactatatacataaatttcaagaaatcttagctttgcctgaggccaaagaataatgtcacaaacctgctgaaattacttgattaattgattgattaactaaggataaaaagtcacttggttctggaaaagtactgtactccctaaagagttctaaagaggaatagtaaatactatgcacatttacaattcataaaatgtaaacgtcaagtcttcttccccctctttttccattccttccttataatgctctggaggaaaatttaagagtttcatgagttgtcacaacagttatatcttaaggaatcatagcttggaatctcactaactcatgattaatagacactcaattaaatagcaacacaatgtccggtgaatttttcggcagcctgctgtgggctgcttgcttgttttcagctcgtttctaaggaatcaaaactctcatctctaagaggtgtggcatcaatactgcctcccttgacgcagcccaagaaagcctttctcactctgaaaccaaggctgtgacccacaggcactgtgtttaatatgctgtgttccactttgcaaggtcagggggatttgccttaaaaataaatttttaaatgttcatgcatgctgcttttggtggagagttaaactgtactctaaaagcagctaaatagtgttgttatcttaagacattctaacttgtggcctctcagccaatattattgaagttctagagctcacaatctttaagagagacaggagtgagctctataagataataggttatgccaacctagttaagctacttttttccccaaaatggtgttaccaggttggaataatagaacgttaacctttttcaaagttactacttttcagaggaaaaaacatttcttaataatatcataatatcagtagcatgggactgacccaatgtatttaagatattgttcttcaaaacaagatatcaaggaaagccagtgttaaacttgtcaagaagaaaggatgaacaatccagattattttccctgcaggccaataaaaaatgtgcaagatagaattacatgttgcatatgccaaataggtaatagcaaaaaataaaatgtaaagtattatgcacctttatcattgcaggactcaggtaaatgaaacacaatttagtaacacactttttctttctctcactctagaatgttaattccttatcttatatttctctggtttaactccaaactaagatggagaaatacaggttggctgactgatgatcaaaattattatagtgctccaaagttatttgacaaattttagcctgaggtttaacaactaaatccctttaattcaactattaagtgaaagtgttttctttggtagtttagaaatacctgagctttgtcccaatggtgtggtttagaaatacataataatgcataagattgaatatgccttctttttcaatattgatgggaatttgccaatggtaataccagtgcatattgctcttttattaatagttccaaacaaccatattattcacagctttcatttcttggggggaaaagttcaagtaggaaacacacaaatcattccatatttattgatcatatttttaaggctattcttatggcatgacttctgtaggaatgtttctcttttctagtaaattccacgagcccagtgtctatgatctacttctacttcgtgatatactttagcttaatttcactaatccaaattttttgacttttagcttgctcagtcatttcaccatggccctccagggaggaagaccctttaaaaccatttgtggttatgatgatgaaacttaacaggagtatttattgcaatttggagatttcttcctggttcatcctttaaatattggttcttgcctgaaggctactcctaagagtatctaggacaaacatgttccactgaattaactgaatctttaggatgttatctgatgaaaataccaactggttagtgaattgtgttctgataagaggacttgtcaatacaacattattctgggccatctacaatgttcttaaatctgtgtttacattttgacaagagaaaaaagaagttaagcagttaatataaatgtttttaactcaaatcacatttttagattttacttatttttctatagtcttttagaaatatttctccactcacttagctgcctctttaaaagtatgtagaacataatttaacctgttcttaatagatacaatacatcactatgacttcattatagtattatgtgattttatagggataatttttgaaggcattgcatcatacagaactgtttatttttcccatcaattgaccatggactgttactattgttgagttttatctctggctataaaatatattttgtctacatcttgtgttcagctgaaacttctccctgtataaaacttcctcaaagcagttctctcttttagttttgatgttaagacataggggactaagttttgttggggttgtgtttaaagtaggagaggagattagaaaacagcacctgaatcccttattagaggaatatctaattagttttaactaatgattctgtagcatctgatattaatttggatgtcacttgtactttgtacaacgtatttttccttattaaatgagaatgtggactagatcaactctagttattagtttcaacactatataatttatttaaattatgaactgtactatacatatagtgtttggtataattaataatacaattcatgatcatgataacaataataataatgtaataataacaaatacccatgtacccactagcagttttctgatttttgtattaaccccttgccttttgtacagtttttccacatatgtatacatctttaacatgttactttacttggctgttcttaacagtaataaaataaatataatgtgtatattctctgacttgcaattttgctgaacgttaagtatctgagtttcatctatgtggattcatattgctgtatttcagtcactttctctggtgtataatacttcatgatattaattaaccatagtttatctaatctattgttgatggattttgaaattcagttttttgctattgctagtaaagttggcataaacattctggtgcatgtccaccagcacaaatttgccaccatgtttagggtgcatacctaggagtggaattgctgagtcatagaagggtatcttttcatccgggaggcaaagacatgttgcagttactgaaacccccaccaggggcagatgaaaggcctctttgcttcatgcctctgccaacacttggtattttcatatgcttaatttgcccgcatctggtaacttctcattgtgggtttaattcgcattttcctgattgcttataagtctgaacattttttccattaatttgttagctatttgtgatgtcagcaagacaattctatgattctgtttcttcaactgagcaacatttgcttttagaccttaatattattggtagttattctgtttcttctactaagcaaccctttgcttttaggcatagatgttatcagtagtctaatgttcaggaagttgtcgcctaatactttaccatgttgactctggcctaggctttatttaagcaccttcccaaaatgtacactgattttgagttggaaaagacattcttagtcactgtaacattgttgattaccctgagcaagtcctgccatgttagtatcctgccttatcctgtttattgtgtctttatagagaatcatttacagggaagcaggatgctgggatgccaggcttaatttgaggctccttatgaatcccctgaatataatggaactaaaggataacagaaacacagagtagtaatggtagacaccaaatctgagttaaaaatcttaatatgatcatttgaatttgggtatatttccaacatggtaaaatacataggcccaatatcattgttacatttatggcatatataactgtgggtttcaaacaaacgtatgtgctttgtgcaccatcccccccaatttttgtttgggtttataattttttcacctgctcccatgggacaggctaatgaagacccctgaatgaaataaagcctcagatgtacttgcagaggcctctgtagtgtgttgccttctgtgcagactcattagagatgtgagccaaggctgagacatctaagcaaaccctctgcacccagagtcctcaatccattgttcctgcatcttttttcagtctcatgggatcccagaagaatacaaattagagagaagaatctgcaaagcttttcctttcatgtttaatgtctgggcagagctgttccctgcaggacaatttctggttattttctctctctggtttgaggcatctccagggatggtttggtgactgtttcccttggggaagttttcagcagcatatcagttttactgttaaaagtttattttacaattcatctgagatagtcctgttctaaatgttctttccattacccttgtcatctggctcttgattcctgcatacccttttcagtgacactgcctcttctgggctgaaatgtgttcaataattcgagctataaatcactctcgcctccccatttggtctttacttaaccagattataaatatttaattcatttgatttttcctcataccactccagaagcttaatcatgtttagtcttcttactttaactccctctagtttgtttatatctttcttgtaatcaaggggcctaactctgatgtgctcttctaagtaagctctccagagtcatattataaaatacaaattcagcatcatctttagcttattgtacagccatagacaaacatatggtctctcaaaacttgtgttatcagttttcaggaaggactatcaatgcctaataaaatcattgagatattataaggaccaaataagaccaagtatttcattgaagatagtacaatagttactgagcctttaccaacgattacaaatagatgaataaaagatttagatgagtttctgccctgcaggggcttttcctccagtgaaggtgacaggcacacacagaggtaggtaggatacaaggtagaacaaagtactcaccgaaaagggacacaaacagttctgttcttcatgtggtttttgtcattggttctgtttatgtgatggattacatttattgatttgcgtatgttgaaccagcctttgcagggacatggatgaagttggaaaccatcattctcagcaaactaacacaggaacagaaaaccaaacaccacatgttctcactcataagtgggaggtgaacaatgagaacatatggacacaggaaggggaacatcatcatacaccggggcctactggggagttgggggctaggggagggatagcaataggagaaataagacaggctgatggatgcagcaaaccactatggcatgtgtatacctgtgtaacaaatctgcactttctgcacatgtattccagaacttaaatataatttaaaaaactcataatatattaatatttattagctaatggactgacagagccaattcattcatccttgtatccctaaattgattggaccaaaaagaggcaagggagtttaaagagttgtcaatcatgtttaaaccaaagtattggtgtggtaagaatgaggatattatggttttgcctacagatctggtggcctgttgctgtaaaaacatctccagactttcgtgaccctttcttcccatatttcttgaatgtgttccaggtattgtgttaaggtggcaatttagcttacagcccagtgagataaatatgctaatcaaatacatatgttaacaaacccacaattccaaatgagataaggctttaaagaaagaaaatactgtaggaaagggtctcagacagcagatcagagacagcttccatgagaaagtgtgactgagtttacatctgaagaatgagttaagaaggggatatttaggaggggcagacgagagaatatcaggtaaaaaaaagtgagctcaaaggccccatggtgggaggaaaaatcatgaattccaagatcagtgtacccaggaccactagaactaaacataataatggcttagctaaggctggagaagactttgggattctctctctccagtagtagctacttgtacttggtagatattgactgaataaattcaaatgagttcttatcaaggatctttcctaatctcagtacaatgattcaaaaatttctgcaaactacataggccaccttttccttgatttttttattagatgtgaatttatgaacctatctatcctatatgtttagagatacattatgaggtgttacggacatatgtatgcaaccgagagagggactttgaaaagtgtacagagctagaaaaatccaagtaattatcaattaacttggtaataagtcatttctcctttgaaagctatcactgaacagagggaaacaaaacttcaccttttctataaaaatagaattgccatggacattccttgttctggggcctccttcaaaatgtgtgcctgaacgtgtttagtaaacctaaacctaaattttttttggagtttttatagattattttctcaatatgatccttttctatgcattttgtccctattactatttcttaaaaacataaacgaatgttctctttgctttcagttacagttcatttagaagtcattgagcttgtaacctttccatgtcaccggacctggaactactgtaccacttgaatcaacctaccatctaccactggatgttgcaaagattgttgctacacagccctgtggtctttggtctcgataagagggggcatagcctagggggaaaaagcatcccagctattgggtttgattgagatccttaaaccactggacctcaactttcccacctataaaatggacacaaaatcaacctctgcttcccaactctaaattgggggtaaaaattactccagtagttagctatatacaatatctattccaatgcctgacttataataagtatttcataaatgctagctattgttagtattatgttagtatgggctacatttatcccgaggtagtctttacaaatagaaaatttcacaggcacaggccagcccttctagaacctgcctcaattttattgttgtgattttagagacttaaatataaattaaggtagtcagactccaatggcaattttgaaatcaatcacatcatggtttagtggaccctggtcccatgcctttgcttgatttagaggctcataggtccagctaagttagatctgacatagtgcaatactgatcaaacttggcagcgtatgacacacttcctgtggattttccatccaaaccatcctcccctattaactcttccctggttgaccatgtccattttctacagacccgtcatctactcagcaggcacacctagaagctaatacttgcttggttaatgtgcagtactgggtataattggtcctgagggtcttctctgtggaggagtggctctcatcttgattttgtgtcaatgcccagcccttcttcataccaattaatttagaatctcggagatgtattccaggcacaagtattctaaagtctctgatggtgattccaacatgcagtcatgtttgagaatcagtgtcctagggtctttctactccaagtgtgcagtccaggaatcaaggcatttgcatcacctgggagcttataagaaatgcagaaacctcaggccacacccagacatactcaattagaatcccaagtgactgaggaatactgctctagatgactgaaagcatcagatagggaggtgatccttgcctctattcttcacaattgtaagtaatcatgtagtcaatgggaaactgcccctaccacactagtttttcttagcttgaagcatctgttgcatgctttggcttcaggagttggtcttatagtggcaagctatgccaacatcaaagagtcttctggtttgtggtttagcggcaaatatatttcatggagaccatgacacgtttcattttccttgagattacaagcccttgaaaatgctctttgtgtgttccatctgccttttcccttcttttctcatcaatactcatataagaacgcatattttacaatggtctgctggttttcattccatagtttcccctccttcaactctctttcctccttaaaaatgctcagacccagggaaaaagaaagacacataaaagggacacagaggccctgggccctcctcctccctccctcctctgtgtcccaagtctgatgctgagagcacacacatgctcaaagtgagaccctgacgggggctaccccatactgaacctcgccttttgattggggatggtcttcagggcatgaaacagaccaagtgctcatttgcctgagcctctgtggcagggcagaaggggtgtaacagaggtttttgaagaagagtaaagctttacaggcagaaagctcagtgcagggttttgaagcttttgctctgcactgcctggcagagagagcagctttaactggcgtgctccaaatcagagtctacacgaagagaacatggggtctcagctgcgcagattggatcaatctgaatgaaaatcactagtgttcctcctggggagagaagtttctgcttagctcatgaactgtaggcccttctctggccctggtagtaaatgagtagagcttttgtgaaaggttatgtaaggctgctgttttctctccctgcctagagtaaaattctatttatagagggatgaactgcctctcagcgaaacatgcattttataaactatagcttaggaaagataatttaataaatctttaagaaagaattaagggaagagagagaacaaaatcctaggcagagagagtgggatatacagcaagaaataggagaaagagaaagcatcattgttctggacttagttactggagtagtaatagagtgaccgatcattcttgtgtgcctgggattgaggagttttacaggaagaaggactttcagtgctaacaataggacagccccaggtaaactggaatagtttgtcactcctaatttggtacctatgatggggaggggagtagaaagaaccctgaaagattttcagcagggaaatggcattttagataacacactgttagtcctatgaggaaacaattagagaatgatagcaaggcctattatgaggggatgttctaatcgtccagaaaagatgaatatctgattggaggtttagaagcaacttagatggaggccttaccctctaatcttgtggcaaagtctaacttgacatccaaaactgaaggtttttttaaccaactccttggccaaaacactgtcagagaacgcatttttgaatcaggttatcttttggacatgataggataatgtatgtattggagaagtcatgtctagcacttctgtgttccactgtgtctagtacagtgctgaatgcatattaattattcaataaatactcattaccaaattggtttttatataatgattattctcaaatttgcatgaaatctgaagtttctttctgcatgagcttcacaaagttcagttcaggatattgtaaatttcaggattactcagctattacttgcctcttctttagaggtttattctgttttctttttctctctccccttcttttgcctgatttttcctttacatgccattattaataatgttattggcagcatttcagagtgcttgtgagaaattcaaaattgaggaaattctgcaaatagcaaaatgtgaatgtataaagtctatagaatttgctatctctttaagccccgttacgaatgcatatagggcatttgtcaactcgcatatatgaaaatggaacaagataaagtaggtgaataattatttcctacataataatcccagggatagactctgtgtttgccttcagagcaccattcctgaagacttgagtgagtcaaagcattaaaatgttatttttgtagaaatcagtggaagtcaagacaagatgatggagattaaaaaaaaaaagcacatagaatgaaaagcacaaaacttcttgtgtttcaaagcactgatcaggcagaaaaggaccttggcaggtgtttgagaagacccttttctactggtaaggactcaggggcccagagaagctaggtgagcctctaaatcacaaatctacgaatgagttccatgaaacatattatgtacacgtgggtgcaaatcttggctctaccaagatgtagctgtgtgaccctcactatgattcagggtcctcatttgtaaaatttggaaagccattgctgaatggatgacatttttgaaaaacattacactcaaggattatcacagtctttggcacatattgagcactaaactgtttctatttttatttgttcattcgacagatgtttttaaaggtaatgtttcatgtatcatatttgttagcgcctgtggtgtatttaaacagcatataaacacactgcctctgttgttttagttaacaaaatggttggaggaataagacctaagcagtgcaagcatgtaagaaaaaaaaaggtgaccagagtcacaaggcaatatattattgtattattaagaaccaaatgggtgagaggtgcagttagaggagagaaacagaacatgatcagaaattcttccagaatgcagagggattgagtctggtaggtagggtaatttggggaccttacccacataggacctgaccctatgtggacactgttctttacatgttcaggctctggaagacaaaaaagaaaaaaaatgatggtgatacttcactgcagaaagcttcttagtccaggcaccagatctcatcactagcaatgacttccctggtcactagccttttcccaagcgaatttatgataaggctaggagaaaaaggaagagagatgtggcaaggtcatctgagaagtaactttggtggcatacataatgtaattttaaaataaagaggctttaccagtagggctttttataatagttttaaggaggtctcagaagctcagggaaggacagatgccatcacacactgcattttgaacttggaaatctagtggctgagaaagcatatttaggctcctgcactactggaataagtctgtgctggaaattaatgttttcatctttttttttcagccttgcttcaaaatgtatagaaaactttggttcaggatgccaaaaccctttattactaatgcgtaaagggtgttagctagttcatcaaagatcttctgtacattttgcggccaaagggcaggtagcccagctcaaaatttgcaacttaaatagcttttcctttgttctttgttccagagtacacagtcatatgaggttatgataattaataattgataaattattattaggatgatattgttccatgcttatctgagactttctgtcttccaatggcttttgaatcttttatccatattcatctctcaatacctctatcaagtgggcaaaatggctaagttatctcacatgtgttattagtgaggttatgagagtaggggccagctatttatttaagatcacacagaagttacctgttctggctggaaaacctaaatcattttttttttttgagtcagagtctcactctgtcgcctaggctggagtgcagtgatgtgattttagctcactgcaacctccacctcctgggttcaagcaattctcctgcctcagcctcccgagtagctgggattacaggtgcctaccaccacacctggctaatttttttgtatttttagtagagacagggtttcaccatgttggccaggctggtcttgaactcctgatgtcaggtgaaatgtccaccttggcctcccaaagtgctgggattataggcataagccactgcttccaaatctggcttaacccatgtactcaccagtacatattggacactttccaaaagcaggacattctactcttttattccccaaaaattcatgtactaaaaaaatgccacctagcactcagatcttgatttctaataccattctccaataaaagaaaccagagctcctcagggaaatagttgattctggaacttatgcagaaaacatacaagataaggctggagcatcttggagtgccagaaaggaagaaattctttaaaaaagtgaaaaacccacaaagatagagtatgtcaaagggacacagaacctaactgaaagcactctcaatggtcaaaactgcaacaatttgagcaagaaaatcaaccaagtagtttcctattataacccaaactataaaataaatgtccatgagtacatactgacataaataaataattgaataaataaagagaagagacttagataaatcccctatgcagaagaattcaaaatattatatatactctactctcgaagagtagatagagtacaacccatatccttttgagtgtgggctgtgcttagcgacttccttccgaagactatggtatacaagggggaggggaggaagttaactacagtagaaaaattggccggatcatgaggtcaggagatcaagaccatcctggctaacacggtgaaaccccgtctctactaaaaatacaaaaaaaattagctgggcgtggtggcgggtgcctgtagtcccagctactcgggaggctgaggcaggagaatggtgtgaacccacgaggcggagcttgcagtgagctgagatcgcgccactgcactccagcctgggcgacagagcgagactctgtgtaaaaaaaaaaaaaaaaaaaatctgacaaacactacctcagccaggtgatcaaagtcatcatcagcagtgataagtcatgttgatagcatgtaccccctgatatgatgtgataaggatggcatttcacctctgtgatcttccttttccaaatccataaccccagtcttacaatgagaaaaagagtagacaaaccccatttgagattctacaaacacctgaccatattccttaaaatgatctaagtcttcaaaaataaagaaagtgtgtgaaacagcacttttaacaagctctctaggtgattcttatacacacttcacttgaaaaccacttggctgtgcattgtccgtaaaacttaataatggtggctctctgcttattgagatggtctttgagctcaggggatgatctggagtcaggtgaacttgggtttagatcccaggcctacaactttctaattgagagaacaaagacaagatattccgccttttttgtgcctttgtttcttcatctgtaaagcaggaaaacaacacttaattcagagagtacttataaaatcatttcagaaaagccatgtaaattatttaccatattaccatatttccacattaccactgctcaacaggcagtgagcactagcacgactctactggtgttctattagcttggttatataaatcaatatgaacataaccaaaattactcctcattgttactgatactctccaccctctaaaacttgtctttggcatcctgcaatgctttccttacatgtttctaggagtcctaagagctatgtcataaaccagttatcttctgctaggcatcttcacatgtctggaagtctggtatgcttgctggctttcatgtccccaggcagccaccgtctcttgccagccatcctgctcctctggtagattgctgctgcagcatcaatgctttagaacgtttccagtgcctgagcattattactatgtccactgacaagactgtcccaatgttgattctccctctgttaaactctatcatactgcttgtgtcttccaatttataaaatcctccatgacaacaattcatttaactagggtctgtaatttttctctacatatgacttagattcagtaagagaagggctgatctggggacagatgttgcatttcctattccctgtctttagcctttctgtctccaacccaccaatggaacttcttccttaagtagtatttaaatctcccctacataaatgagttactgcagagagatgtctgtatttttagaccatacaccataggctgtttcattgggtttgaggtacacatgtggtacaaaaatgtagactaataataatggttaatatttatgaaattgtatggtttgaagtgatgtggtacatattgcttaagaaatacttattgcccacccatttttatatttaatacagaagaatatcccattttaagtagcaatgtgctagctcaaagactcgatttctcaggctcccttgcagctaggggtagttatgtgaaagttctggtgattggcatggtaatcaggacacttctggggatttcagagtaagcttactctcctgtcctaattaccacccccttcctccttgttgcttccttctttctctggaaagtaggagtgaggcctgaaattgaagtagccatcctgtgttacatcatctattatgaacaatgagaaggaaatgaggagaagcttgagtccatggtgacttccttggggtagctatataatcttgggattgtttctttctagacttctttttatgctacaaagtaaacctctgtttgattttaaaacactgtaatggggtttctgtcacaggcaatactcagttcaaactgctgtatgttcccatattatttttttcctcacagttaaacagtgagagaggaattaatattatgtccttttacaagtaggaaaagtgagacaccaaaaagttggccaatttttccatgcctccatgctagtaaattgcagacttatgatttaaatcctgctccataacatgtccttaattaagtctatgctataattcctagataaatagatgttgtagctattacactattgttgttatttttattgttgtgggtaattattacactattgctttttatttttttgcaaatcacattaattcttgcaatgttgttttatttttattattgttattctcctctctaaaagagggatcttcttctgtgaaccgtttattatttagacacttctagattattgagtatataaataaaaattcaattttctgttaatcattttcaaatgtcacagttttcactaacaagttataagacagcttcatgcactttaatttcctctgaagaagaaatccactgccaccttataaaagactaacattccaaatacagctttagaatgctaatgccttaccttaacaagccaacttaactctgtgattcacatatgtgctgcaatttctctcccattgtagtgtaagggaattttgcacagttttgatgtattgtgtaaattaggccaacaaagtgctgtgctatgtcttcattaaaataggagacggtaataatgcaaccatgtagcgtggtcttgcaggctttgagttatgaacattcaatagtgtctccttacttgtgcttaagttggcatttgtgagcagcatataatcaattaatcaataacccaattttctcttaaagagatggtgcatgatttaaaaaaatcagaaactactgtatgattttatgaaaagagccatttcagcaaagaaacttgttttgaaaacactgaaagtcttttttggggaggacaattttgcttaactaagccaaaaatgaaattggatacaaatgtttagttcctgaattcttttattgttttgcaactacagaaaggaaagggccagtttgggattgctagtaagaatgcattgtttttactcatgattggaggtgtgtaagtggacccatctatgaatgcacagttaaagtcaattaatcctcaaacttacagtttaaaactcatctattctattacttacaagctttagagtatactaagttgcctaatttgtctcacatgaggtcacagcagcgcaaagtgatgctttcacggtgatgaagctgacagtcatgttgagacaaaaacctggccttctcaaactttaatatacatttctatccttatctttattataatttctacctaaaaagatatatatgcttattataaatattcaaatattacataaatgtgtgagtttgagaaggaaattgttccataatcccatcacttcagaataaaccacaatttatttgttttgttcagtcttttttgtctctttctctacctgccccacatttactgtgaaatttgtggaaagttaatgtttatttttgcattgcattaagatactgagttgtgttttctttctaccaaataagtaaaaagaaatatcgtggaaaaagaaaacctcaaatatttgctttgttatttagacaacaaaagacatgattgagatgagaattgtctctataagacagatcaccttccaagagagacacgtgctaggcatgcctgtcttctaaaagtgtcagttccaacgcctccaaaatgttcaactgccctcttgaaccttgcctctaaagtgcagcctgtgggccagccaacctccatatcacatgagagcatattagaaatgcagaaactcaggcttcatccaaaatttactgaattcgaatctacattttaacaagatccccaggtgatggctatgcaagtcaaagtttgagacatatcattctagtaatagcatgtttcctactcaaattgctaccatattctaagagctgtgagttactcatgaattagcaatggtgtgcagggaaggaaccagtatcaccacagctcgttcatgtggcttctaaatttcctccaaagggttgagtgttgtgctcattaaacagtgtcaagaccagaataactgtccaagggctggctcacatctattctcttcatttaggtcatgacacacattctcatccatacctctgaagtcccaaggcactaaagaccacattgattggaataattgtgtcttctattccagtaattggttgctaattatgcatggcttgatgttattttgctaactcatatacaccaaatgaaccatgagttgcttgaaggaaaaggccagtccctgagctcttttcttcaaggatggcagtcctgtttccagacatctggccattcccatgaatgagtgaatgatggttattaggtatgttagctccatttatccaaccatttgtgctttccacagatccagatttgacggttatgtcccccacttggagctgggaagtcacaggacttacttgataaacagtcaacttctttcttgaatttatgccaagacctcatatatctatctctttatgctctacgaccaccagcattggttggtggcccagttagaaacaaaaagatcggggataagtgtaggacctgtccaatttgcatcaagtaatctttcataagtttgtaaggggaagataagggagggttataaaatttgaatgctataatagattttatcttgtagcctatagtttttattttttttctcttagcttctaaaatctatgattgagtttctgttttgggttattaactcctgaaaccaagaatatcagaggaaccttaaaaaaatagaactttggaatattaaatattgaagaagaaaagctgaataatctccctataggcaggttgggagtgggagcagaatcaaacaaaacttctctttgttcttttagccccccccactcccctcctccctccataaaccaaaagagcatttatttacttgggctgcattataaacatctatctttctttcgttcattcattcgttcatttccttccttccttccttctttcctttctttctttatgacagagtcttgctctgtcacctgggctggagtgcagtggcgggatctcggcttactgcaacctctgccttccgggttcaagcgattaccctgcctcagcctcaggagtagctaggattacaggcatgtgccaacacgtagtagagatggggttttgccatgttggccaggctagtattgaactcctgacctcaagtgatccgccacctcagcctcccaaagtgctgggattacagacctgagccactgcatccagcctataaacacctttctagggataaactttgttggtttaccatcacataggagactcagctcatcaagaagtctgtattcagaccaggttcagctcagactaattaatgaaatcatgtaattgatgggttctgtttctatttctagagctcttatattttgatatgagaatatggaagtgccaatcaggttcatgaggtcacccttcagaatccctcatttctcctttctctcctatcatgtagctgatgaaaaatatagcacacttccttcccctgaaagattcacattagttgtgtcttggacacaacacctctcttgctctttgcttctggccatatcttctttgactcagaaggctttatcactggggatatatgtcaggcaaagatgcagttctcagaaagtttgagagcaggggatgttatagcccataagaaagggcacaaggccaaaaaagagaactaggctctactggtcaattaaaaaatatatatttaagccattttcagtgttcagccaacaggaagcattatggatgttcaaattgctgaaatattagcatacttcctcactgattggtaaatatttgctatccagggcctcccaatgtgccctgcttcctccattctgattggtgagtgactatgccaatcagctcctaaaagtcctccttctaagatatcaacattggcttttttcttagtgactttggagggccagatgtactctcacccagtcctgggaaactctgattgccctttagcccttcagtctgccatctacactgtgcaacatggcaccccatggcccatgtgccttctgtgcttctctggccccctgagactgacacctaagcaggttggtgttccttgagtcaccctctcatggccatcagtgaaaaccgcagctccaaaagaagacaaggtcaggaatctccaccacactgatgcttaaatatgtttaatatttaaataccacacattttttttactctgttctgtggagacaacactaaatgtctttatggcctgagaaatgttcatagaataaattgcatattatgtagtgattggttctatgattgctataaagatttttaaaacttttagtatcttatttaccaaagaaaatatgttcaatgaggaaagcatttaaacaggtatataagaaaatataaatcactcatcgttacatgactcagagttaattactgttaaaattttgataaacattgcatgtgtttattcttaatagtaaataaattatattgcatatgctggcataacttaaaaaaagcttagccatctattatgaatgcaattaaaagaccaaagttttctaagagttgggagggaacttggaaatctgctagattcattttctggtgaggaaaacatttattacatagcattcctccgaagatcctctagcttcctccttaataccaccaagggcaggttccacagccttattatgcctctgccttaaattatttttggattagttattctagaactttctgttctactcttctcacctgttgcttactcattgatcctggttttgcccttcttagtatgagtggaagtgggccaggaagggcaggcttagaggcagtgaggaggtggcatggtgaagtcagtggccattgtctttcatgagcaaaacagtccttggtcatgagactgaatgagtttcttgggtgatccttttcacctcctactcccactatattttttcttcagagacttacattgggggacttatgccttttttgtcatagcagaaaactctaaatatgtagaaagtttaaaagaaataaatctcattggctgaacacagtacattttaggagacaaaaaaaaatagaaggatgtgtttgaaaataaattgagttggaaaatatctagaggtttcttcactatcatatggtatgtttaaacttgtctccttgtcatcttccttgctctctgatcttaagaagattaatgagatgatgatgtttaatgcttgaatgtttggaagaagagtgctttgcaaatgtcaagggttagtgttatccttcgcagtagtgattgaccataagactgttctcgttattgtatttcattaactaatgctctcatttatcaagtattgaggcaagggagatatagtagtgggcaacagacaagatccttgaaaactgtttaatgaaaaagataaacaagtaacacatgattacttattaaaggaattaaaatttatttaaaattgtgttaatatctctggaaaaaagaattccctttttctctatcttaacatatagaacaatgggaatcttgggagtactaatgccaattgcttgggtggggtttatggtctgaggtacgaggggagagtatggcagtgaaggaaagattactgagcaaagctgagaggggaggagggatgcagcaaagggatgctaaactgggttgcaactaagtcctccttctccactgtagtcagatattacttacgctgggaggacgtgctaatttttcaacacttacagtattgctacagatcagagattagcagaattattctgtaaagggtcagatagttaatattttaggttttgattgtcacacaatctctgaggcaactgctcaactttgccatagtagcacaaaacagccatagccaatacataaataaatgagtatggctttgttccaataaagcattatttataaaaatagtctggacttaacctgcagtccatagtttgctgacccctgtaccaggctcttaccgcttgatcacacacctgtgtttaaacttaaggcatcacgttatggaattgttcttagaatatagcttcttacaactctatatattacttgaattttatgcattttacaacctttgtaatgcctatcatttttacgtatatgaaggagaagagagagattttagcatgtgcttaatctgtttatgctgactcctgactttcctcctataaacatctatgtttaaaatattagtactaatgtgtccggaattggtgggttcttggtctcactgacttcaagaatgaagccacggaccctcgcggtgagtgttacagctcttaaaagcagcgtggacccaaacagtgagcagtagcaagatttattgcaaagagcgaaagaacaaagcttccacagtgtgcaaggggacccgagcgggttgccaatgctggctcgggcagcctgtttttattctcttatctggccccacccacatcctgctgattggtagagccgagtggcctgttttgtcagggcgctgattggtgcgtttacaatccctgagctagatacaaaggttctccacatccccatcagattagttagatacagagtttccacacacaggttctccagggcaccaccagagcagctagatacagagtgtcgattggtgcgctcagaaaccttgagctaaacacagggtgctgattggtgtatttacaatccctgagccagacataaaggttctccaaggccccaccagagcagctagatacagagtgtcgattggtgcactcacaaaccttgagctaaacacagggtgctgattggtgtatttacaatccctgagctagacataaagactctccacctccccaccagactcaggagcccagctagcttcacccagtggatcccgcaccagggctgcaggtggagctgcctgccagtcccgtgccgtgcgctcgcactcctcagcccttgggtggtcgatgggactgggcgccgtggagcagggggtggtgctccttggggaggctcgggccgcacaggagcccatggagtgggtgggaggctcaggcatggcgggctacaggtcccgagccctgccccgcgggaaggcagctaaggcacggtgagaaatcgagcgcagcgccggtgggctggcactgctgggggacccagtacaccctccacagccactggcccgtgtgctaagcccctcattgcccggggccagcagggctggccgactgctctgagtgcggggcccgccaagcccacgcccacccggaactccagctggcccgcaagtgccgcacgcagccccggttcccgctcgcgcctctccctccacacctccctgcaagctgagggagtgggctccagccttgccagcccagaaaggggctcctacagtgcagtgggggtttgaagggctcctcaaatgccgccaaagtgggagcccaggcaggggaggtgccaagagcaagcgagggctctgaggactgccagcacgctgtcacctctcactaattacataataatgggatctcctcttcagaaggacactgggagatttgatctaatctcaacttctctgaatatttactttgagtccttgttgcttgtgtcatcctgttatgtattggcttttctcggcagagccaatcttcttttcttgtctcaatactgatgatggtgtttgtgttttgtctttggctggtttagctaatctagtgcctaagtatggctgtttctcccagttagcaaaggttacctctaacaactttgatggggtgcagagaatctgaagcagtcctttgaatgagaataagcaggaaactcgcactgagggaagaagttgaaattggctgtacataggcaagtctgcaagtgtgatggtgtactgtgggaattataggtattctttctgcaattgaggcccttccatgctgctcagagtcacagaggtattgatcagaaaggctttgtacctgcttcctttttgtttggaggggttgttccagtccagatagtgacatctgtgaactcactaataagcaaacaggccacagtagttgtgtgaactttgcaggttttggaccttttccactcagaaagatcctgctgtttgagactgggttaaatctgctcttgtctagaggcataggaaagtaatttatgatcacttgtgcagctgtacaccctgtggctagagttgaatatacatatttaccttgaaggagtagtcacgaggtgcaatctgtttcatttctgaaagtatgttttgagtgtcttgaactatttatccccattgtttctttctttttttcatgaacatgttcttaatatcatgggtctgtgtttctttctatttcttttagaattggtaagtagttgttttgggggctggaggctatttgggataaatgaatgggggacaagaagacaaattaatttttaatctcaaagcataccctctgtgctctgaatgttgctctttccaccctgagaaaaaatagcaggtttcagtccatatccttagctccctatgcgtcattctgcaggaaaaatgatcctgtcacacttaagtgcctcacacagcgggtactgagaaagtactacattatcaagtcagagttgctgagacttacaagtggtccctgaccagtgctgatgggtgactttttcccactgttttggatatagtgactgggttcttaagaattagactacttgcaaagtgaagaagttctttctccatagctcccacctcttcattgtctggaaggcagtgtgaaagggttgaaaaaaactctagtctttgttcaggatcctggtaccttcccagacctgtgcactgtgttgcccagacattataccttgcaaaatgaagataagactgctagtcctgcttatgtccaagggagggctgagcatcaagtgatataatgtatgtataaagtgcccagaaaagtatgtatcatgatgcaaatcaaagttgttgttgatcctccatgtggtgagaaggatctggctcagaaagcaccagttctgagtgtgtttctacctgttatagtatcggagagactgagaatggcaagtctttctcttaaggttacaaaggtgtttcatgtaatttctttgtacgaaaaaccgggaaggaaattccttgtctctccaagaatgaatttggtggtatcgatgaagagtcttctcaaaaacgaggacaaaaaccctaagaatgtgtgctaggtgcttctagattctgtttaaattttacttctataattctttgtgggttttttttctttgtgggtttttttttctttgcaaatgggctattcctccccactttagatccttcaatagttagatttttatttgcaaattggttatttctccccacctcaggtccttcaatagtgggaataatttttacaaacacctgaccatcagtaatctgggaatggctgaacagattcaaagagaagtgtccatttcttaccatttgtgttgagtgtgcatgggtgtaggagccgatggaagagtgggtgaataatcgaagaaggcagccccggggatcatgctcatgatgttacaacgatgtcaccaaacactttgcaaatggaggacatcacaggggcttggccttgagacctttctctctctgcctctctgcttgttacatttatttttttctttaattgtcagtactgaaagatattatataaaccaaatctgtattgaaatatcagcatggtgtttataactcaaaggtgatgttactttacttgatcctcattgatgaggttatacagaattggtctgtcatgactatatatctcagagaaatttgaatgcaattaccagagtgaatgtaaaaagtttctgtgatatatacatgggcaggattactacgtttgagtcaacctgaatatgattgggaaaatgaattcaaaggattgtggcactaacagtgtctgacttaatttccctcatcttatccaaacatacagagctaattgcagaaaagaaaatacttccaaaatatgaaaattcaaaagtaatgggtgatattaaaaacagtaattaatttacactcccactaacagtgtaaaagcatttcattttctctgcaacctcaccagcatctgttgtttcttgattttttaataatcaccattctgactggcatgagatggtatctcattgtggaagacagtgtggcgattcctcgaagatctagaagaagaaataacatttgactcagcaatcctattactgggtatgtacccgaaggaatataaatcattctattataaagataaatgcatgtgtatattcattgcagcactatttacaatagcaaagacatggaatcaacccaaatgtccatcaataatagactggataaagaaaatgtggtacatatacaccatggaataaaaggaacaagatcatgtctttttcagggactaggatggagctggaagccattatcctcagcaaactaatgcaggaacaggaaaccaaacaccacatgttctcacttataagtgggaactgaatgatgagaacacatggacacattggggggaacaatacacactcaggcctgtcaggggtgtgggggcagggaaaacatcaggaagaatagctaacggatgctgggcttaatacctagatgatgggttgatctgtgcagcaaaccaccacgacacacatttacctatgtaacaaacatgcacattctacacatgtaccctgcaacttaaaataaaagttaaagaaaaaaacatgtagtaattaattcagaaagcaataagattgaataataattgaagaaaaatcaccaacgcttgagagaaattgtttaaccattttaaaaaatattttttgatggagaagaaaggaataagatggcagagtgtctcaaggaaatcattgtatttttttgaaatttttacaccaaataactatttggaacaacattaccagatggagataatggaacagacttcggtaaatacagagagcatgctagaggttggtggaaagcgggagttcagaaatcaatagaactttgtcaaatgtgaactccattacaaagagaactctttgtcaggggacaggctactttctccctggatgtcatcttgttagggcactggagagaacattggtaatgttgaaaggaccatcttttggctgatttaaaaaaaaaaatcatactagtctatcacttcttgaaactggtatttttatttatgtatttttatatttccagcagttagagcagtgcctaggtgccacaaaatttgtctatgtttgtgtatatgaatgaatgagtggatacaatctgggaaataccaaagtgaaaatagtgtttctgcttttagatcaaagttatccaaagtactaaattggacaatttttatcaaatgcctaagcagtaatttatattttgtgaaatatgtttaagtaaggaaaaaccctggatacctcctaaaatgtaatactctaattttttagagagaacgttagtgaacgtttactaagaggtttcagaacgaaaagtgtttgttagttgttaactcttttaattccattttaccctttttcaccttcttaaaggcttgaagttacttagcagccccgggaagaaggctttctaattagacctccttcccctcccgcctgcttcttctctgggtgtgcaaagcaatgtatggagttcgtttgtcatggaatcatgaaaaaatagaattggtttggaaatgactcttcgaatgaatctatcaattttctgtctggtttatgctagtttcctcatagcattatattttggacctaatggagtttcaggacctaaggaagaatgtgttcttaaatttggcaccctaggttcctctctggcctctgcctagtcctggctgtgggtgttacccaggcaatgctttgataataaagaagaccaggctgaagaagaaggagctgtttgcctggaagatccttaattgcattgtcttactctctgatcatgtcctccttttgatcagctactcatttggtagtttttgttcaccacattgtgaagaagggaatggaaaaattacagaatatcagaatatgtcaaacaagttctcaggttctgagccagtgagtattggggtgaacaatgctttagttatgccctcttcttttgcctccaactacaaagagctggatatctagcaagccactagggaagtttctgaatgagccttctttctgtacgagagtagtaacctctgcataatactagaccccgtgtagctgtagtgctgaagaaaccctctggggattggttgtgtagttggaaagtgtcagtttggggtgagggagtttattctctcttgcaaaaacacatgtgctctgtttgagagtccatgcattggctggttatgaggacagtgctgtaggctaaactgttccacaaggcactccctgtacactgggagtagggctggttgggtgtctgtgatgacctttagagttgacagcaactattacttgtggaaattagagctattttctagtgatatgttatatagttgtatatactacctattacatggcagtgaccctgaatatatctttatgtgtatataggtatgcatgcatcaacactttttgtcatttaacgtgagtgtgaaaccatgcatttgtatgatttagttgtgaatggatgtgagcacagatatgaatgtgcttacttcatctgttccctcacccaccctctttctcacctcctagcttagatatcaaagtattttgacggtgcaaaacccaagaagcaatgtggcagctgcacatgcactgaatttgatttgtatacctcggggcagctttgggatcacttagaggatgaaataacaaaaacccgagatgataaaagaagagacaaccattggaaacaatttattgttcgaatggaaaatgcagtgcattttgctaaaaacctgtccttgacaccattatcttgttagggatgcaggagcctctattcccacgctaggtttgattgtgttgacaacacacctgtggcttataatcaatgacccagctctcaggcagtgaaggtttgtttttcagagagaaagatacagattttttaaaaaaatgtaaacacatccagaagaatagtttaatgggagaagatacgtgaatttagtagaagcatcaaccccacccacaaggcagagtgaggcaaactaatggccatacagttttttttccaaaaaatgtgcatctttccccctaccctcaaatgtgacccttaatctaatctaccttctaaagtgaccaacaatgaatctgagagtgtgtgatgcaagcctcaaggtctctatgttctatgctgttctacttttgagggggctttcacaaataagtagtgcccacaaatcagcaatttttcagctgcttattaaacatagtagtgaggctggaaactatagatgtgactatattcaacatttctatttcttcagtggaataattttgctgtatatttaaaattatgttgttcttctgtgacatgtataccaactattagattttgcttcataaccccacaaggctctccctgtacattgtgggggtgggtgggcattctcttttgacctttggagttgataacagccattacatgtgaaggttagagctctctctctctctctctttttccttcacttttgaggaaagttaaccaagtttgatttcatcatctgaataatgccctcagtcaatgccctccttccatctgggcttttgtagcctaaatgatgctaacaccttagtcattgtttagcttaaaccttatcctctctctccctggatagatcacaggcttttgcaataagaaaacaatcacttgggatcaatgaagcatatttggttgcatcattttttttttttttttttttttgagacggagtctcgctctgtcatccaggctggagtgcatggctcaatattggctcactgcaacctctgcctcctgagttcacaccattctccttcctcagcctctggagtagctgggactacaggcgcccgccaccacgcctggattttttttttgtgtttttagtaaagacggggtttcactatgttagccaggatggtctcgatctcctgacctcgtgatctgcctgcctcggcctcccaaagtgctgggattacagacatgagccaccatgctgggcctatattttttaatctagattatcctttacaaacttgcagagttcactgagtagaacctaaagagagtgaatacactttctcaaatgggtttttggtttttactgaggatatctattattgagactttcttatttcccttacgatccaagctgaaagttgttggacacttttatctgaattttttaagtcagagcagctcctccagaacaagtatgttcagttccaattttagcccctcggtgcttagaagtattgggaaggaactaggtactgatgatgtttacttgaactgaatatatacagctataaatgctatatatatatatatattcatgcatctaaacaaagaattattgatgagaggggcaagatacaagagagatctaagaacacagatagggccaacattagactggctggaataggtcttttgaaaccaaggaaatgagataatttcctgtaatgtaaacaaaaaagagaaaatgtacaataacataatatcaactttgagctggccataataaattgtcttgattgaacagcctaagactctactggacccattagtctttagtcagagccaatcttttgttctggtctagaaagattaatacatgaaatggcttgttacctaaaatgttcatttcacacagcagatgaggagttttgtatgagagaagggaagttgaaaggtagaaacaaatgtgttacactcctttttttctccttctcaatattgatttcccagccattgacctctgtccaatgccatgtcactgacccagaacattgacttgtctacatgtcattgccatccctcgatttaacaatctgatacatggctgaaaggctgaaggagcgccatggggcttttttggtcttcttgatccccctttgtggtacgtggttgccttttgacaaaagaatgtgttaggactcttattaaaaataaacccagatttttagttatatatagtcttgagttctatagagacaaaaaatgagaagtcagtgactttaggattgtgaatctctttactatgagaggagccaagatatcaaagccaatcaagatgagggcaaaagtctgagtggacgtgaacttaagaaaagtgaaactataacactcacacacacacacatttaagatatatgcaaggttaaaagaattaacaaaccaaatctgctctataatattttattagtagtataatgaaataatgaaatgctggtactggtttagctctttggagacactaatcatatcatataattaatctttattattcattatgaaatttcaaataactcttagaaacaagattgtaggaacaattcttggcatgctgctaagtgtttaacacagaagtatcatgtctccgtggaccagctatgggagtcttgaaccttcatttgacattcttttcctgatttgggatgtaactttgtgaagtttgtgcagggaagtcttgtctcacaattttaaatggaagtatagtggccagaaatatagtatcacagcctttccaggataatattatacaaagcagtgtgaagcatccagtggcttaaaccagccagtatagttgtgaggcagtagaagagacatcctgtgggttaagtgtttctgggaatactgggagtaccaggtcagatcctgaccccaggctagaaaaagttttatgctatcaggatagctgttggggtgctaagtcacagagacaaatggtaaagactggtagtctgtagaattttagagagaagtcaaggtttcctagccctttagaagtaatcagtgagaaaacaacactacatgctagcccgaaagacctagatcctggaacccactaggctttaatttatgatttggggaaagttctctttcttgtgcttcctttcctttatctgtaggacgatggcttgaactaaatctattaactgtcatagggtgctgtttataaaataactctggattgtaagccttatcctagatttatcttttgcttaaaaagaacattgaggtcctcaattggaggaacactctgtacaatggcatgtcatacatactccaattaagaggtgcagaaaatagcactttggtttcaaatatgaagacatgaagtaatcctgactcatgaagaatgttcaactacccagtaagtaggcaaattcttcagaatttaattggaggaggagggaggggttagttaatttgtctctgaagatttctgttgtgtagccaagaatagaaagaatagacttgaatttctcaaaaataatagtatatttctatgtgtgtgtgtgtgtgtgtgtgtgtatatgtgtgtacatgcacatgcacaagttttcacttgcaaccttcttgcaatagaagaaagtatgctcaaaacaaataaaaatatctttagtttcttaacattccgggacaaactccctatctcatcttttacaccatttatttgtttatttggggattttctctgcaatcatttagtgaatatctactggggctaaagttccaggcactttacatacgtcatctctattaattatatatcttgtctccttcagcacttagcacatgctttgaatagatagatgctcagttaatatttattagaatacatgaagtagtagcaaaacaacattcaaagacgcaaatgtgtaaaagttgaggaagggaaggggataagatgtaatgtggttaacacgaagtcaatgcaaagccatcaaaaccgtgcctggagtgctcaggtggtcaggtcagaccttccagcagcggctacatctgatgcctatcacccgttgtttctatacaggtatcattaatagaggataatctctttcttcaggcataaaacccttttgagaaaagcgctgactgttcctattgcaatgctctttgagtgagcaatttcacttagaaaaattgtataaacaagtgcttaacttcagctttttttcttctctaattgatctaaatgtgaagttaaattagctgctgatgaatagttcctatgctgttaagattatgatttttccagaagagaggaaccagcctacattactatcctgagcacttctcattcaaaactttaatggatcacttagaagcatggccagttggtctttttctaatggtgacaagtaaagtgcacatcagcttgttatcagaggagtttatttacaaggattctacaggttaatattcccttaagtaattttgctcatgaatctccaagaatggccatgtgctgtcacattgctacatttttcattgttagtaagcccctgaaaaagccagaacaaccatggtgatttcactgctagcatttagatattgttgtcttttgtcttaaactatgagaatctgacttacgtatttatcttgtcttaaataatagtgaaaacagagtctttgccacccattgcaacaattatgcatttttttttataggaactgcaaaaatcaaacaaaacaacagaaaaaaaaaactattaagccacttttttttttttttttcttgagacagagtttcaccctgttgcccaggataaagggtaaagtgcagtgacacaatcttggctcaccacagattctgcctcccgggttcaagcaattctcatacctcagccacctgagttgctgggattacatgcatgcaccgccactaatttttgtatttttagtagaggtggggttttgacatgttggccaggctggtctcacacttctgacctcaagtgatccccctgcctcggcctcccaaagtgctaggattataggtatgagcctctgcgcctggccaagccatttcttttttttcttttttcccttggttttctaggattccccaagacctgatttcaagaattctggaatctgtattttcatgtagactatctgtgaagcaataataattgttttaaaaggaatagattaactagggactccaggtgaatttaggaggatagatctaagctactcatgcttatttaggaaagtgaatgtctttacttattttcataattatcccaatggaaataattaactgaatttggttagaaactgagaacactacaaagcaggcatctaactaatagagatgatctctaaagaaaaaaaaaaaactagaatttcacattgagaagatttgggaaaatgacataatgtcataacttaagcatccttacattgtaatccaacgagcctttgtttagcaccttctctacatgcaggaactacaaggaacataagataaatatatacagtggactttacacttcagggagtataatcttgtttgtgaggcaagatacacagccatgaaaaacagaattatttaaaatatatatactttttttgagagagagagagaaaatctcacactgttgcacaagctggagtgcatttgtagagtcatggctcactgcaacctctacttcccgggttcaagtgatcccctcacctcagcctcccaggaagctgagactacaggtgcacaccaccatgcccagctagctttttgtactttttgtagatatggggttttgtcatgtagcccagactgttctggaactcctgggataaagcagtcctcccacctcagcctcccaaggtgataggattacaggtgtgagccactgagcctggcttaaatatatatactattttaatattatcatgttacagtatgattattctcttagcaatagactctttccctcttcagagagaaaaataatgaattttggtttctatagcgagttttgtgtacgtgcccttgttgtaggaaaggtaaagtataggtacaaaccagtttatttggggacagaaaaatgaatgaaattgcttaaagcatcttgtgcctcattattaaagccatcaaatattgcgtagcaaacctctctcaggtgccacgggaaatgtgatgtttcatttaaatgtttcttattcacagactcatttagctttattttccctctgtctcaatttttcctaggtttatttgagatgcagtgctacaaatgatgaccttgctacaaaagcataatgttttttttttcaaaaacagattggatacatgcccattgcttagtgagaaatcaaagtgtagtagagagagttgaggctttggcatctaaaagatctgattttaaatccaggctcttctgcttattagcttgtgatcttagtatggttacttagccttgggacttttgcccagtaaaattatttcccttgtagaaaacacttttgaccacgtatttaatttgttctgttgttcaacactctcctctccactgccatgcttgttatgactgttttcagctataattaatattagcagtaatggccctttaattcactttcctagctgcaaagagtttatttaatatttgtgcatcacttaatggcagaaagtctttctagtaatttttgttatttttcttccactgcttgcagtgtagggaatgagcacttaaccaaaagttgagagttatttagcttcggcttagttatcaggttcctggataatttagggacagattgaacagtctgaagcagcttagaaatctggtactttgccttgaagttccaccagaagttaggaatctctgtctcttacccttgacttgaaaccttcttgaggtcctcacatttatataatgtccctgtcttaatctgtttgtgctgctataacagtatacatgagactgggtaatttataagaatagaaattgatttctcatagttctggaggctgggaagttcaagagcaaggtactggtaggtttggtgactggtgagggcctattctctttgattccaagagggtaccttttgccacatcctctggaggggaggaatatcgtttccacacatggaagaagatgaaaaggcaaaatggacctaagctagtttcctccagcccttttataagtcactaatccattcatgatggaggatccctcatgacctagtcacttccccaaaagcctatctcttactgtcaccacaataaagattaagtttcaacatatattttagaggagcgacattcaaactataccagtcccctagaataaagtttctgctctgagataaatgaggtattgtccaaaaccatcttgcaaattagcaagataatatataattaaatttcctgtttggtgattcttagtataccatcttaccagttgaaccaagtgtctctttagattgagcttgtggtacccaagcacctacgcaattagcaggaaaaaattgccagatggaaccccctcacaagacaaatctctccattccccacatctctaaactccattccccactttcgaaacatcaatggtcatttcagatgggcactttgattcagtagaagaacactggatttcgagatttaaccatgagttttacatttgtctctgaatatcttaggtgattttataaactttgtagactgtccttgggcctcagtttccatcattataaaatgaggatgttgagtcatgcaaaacagaaacaactggtaagatccattccagatctaaaattgtatgaatcaattacgtacatagcttcttgcacccaatgtattaaatggttctgtctgttctttctcacctggccatatggggctggccattgtagcatggggactctgcagcagaagagaaatgaaagattcttctttagtctctttcagctaggagcaaataatctctgtgcttacctagacttaaaggagctgttctaaagctatatacctgccattagggaacatactcagatcaattatttaaaaagaaaattaacaaagaacaacttggcattgtaacctttcttagcagcttgaatacaaggtattaattagacaaggaaaaaggggggcactaattatttcttaagtggaataattagtgttgctgaatttataaattaaagggcctcattaagaaaaaaaatcaaatcaagtttgaactatagtgatatcactgtgaaattataaactgatttttgaagactgcactttgatcctatagtagatgaaaatttctgtttcagaccatctggatttacttaagggggaggtgatgcatgtagttggtgcagcattttagaaagaaaggacaattttttagcatctaagggtggaatcttgttatgctgaaagaaaaccttatcaaataatacactatttctaagaatagagtatttggccagcaggctgatacatatttcattgggcacaaggtatgaattcaacatcaaagtagttccagttgcaaaacaggagcaggagcaacattgaggaacctgacccagctagagttgggccttctatgcctatgttatgtactcaatataactataccctagtcctgcccttgactcgattacagggctgacttcacttcctgtgtcccaccactgagggggctccagacctggtttgaggtgccagtgtctcaacaaacgggatcaatatttgcagatcctcaactctataggttttggcttcaaggtctgctttcactggggcggctgtttcttgttcctcttctcttttctgccctagcgagctcattcttaggagctgctgctaattattgatcctactctcatggtataagacatctttagcatattccaccccaaatgctaaaacatgacagaattatatcttggaaatttataacaagaatttggagttaaagttcagaaataaaatcatatttggaagtcttggaaaaaagctgtctccttggtccatgctttggagaaacaaataatgctgcctcttagttccttaaggagtcacatatctttggatgaggatctaagactgactccctaatagccaagtcaaagaagctgcatgctgcacacatgtacattttcatctaacatacattgaatggtgttctgtgctaagtggactttcatatgtcttaatattcagagatgtaaaaatgaataggaaatatctcttgctgtcatagaccacgcagtcattagaggaaacagacaaataaaatcacaataatttacgtgctataataaaattatttagaaaacaccaagaaactcagaacagagcagtgcctttcaaacttcttttgacatataattgaaacaaaagttttataaagctatattaaccacaactacatgcagtgactaatacttttgttatattctattctgttcctttattttaaaataaaataaatgccttaatgaagaaaataccataatcatatttccattttatagagaacattttggtaaaacttataggacaggttttactgagataagactggagtcagagagactatttgtggactattgcaagtatttgggctagaaagttttggaagtgaacccaatactctggtgttgtaatgacgacatattggagagatattttggagacagccaacaatgaccaatttgacctgagagattacagaaattaagaaattgaggatgatatcagggttctgccttgggtctgtgggtagattgatggtgactttaatggagatggggaacacaggagacagagtaaattgaatgggaatcagatagcttgattccattgttacataactcgtacctgtaatactcaggtgcctgtgtaggaggcaatccagaggtgcctatcagtcacttttacttctaagactgtattcttcactcttatattgtatgtcattcattatttcatcaaaataatattaccatgttttaaaaattatgcacaaataaaatttagattattccctagtattgtatgatataggcatattaaaatttatttaatcatttctctagttttgcacattcatttctaattcttcaccattacacacgatgctaggatgaatgtctttgtgctagatccttcttacacctgatacatcccttaagacagattctcaaagacaaaattcttgagttaagagcatgaacgtactaaaggctcaagatagatatcagcaatagttttccagaaatgcagtaccaatgtttacctcttactctaaatttataggattgtccatcttaccatattccatgcaagagaggcggtattacaagaaacagactggtgagaaatgttatcatttttaaaattgcatcttttattatcagagggattagtgttttatattaattatatttttatgtgatggttagacaactgtacttctgtgaattatctattacatgattttccagtcttcttccatttgtatcttattatttatctcattgaatgttatatggtatagcttattttatattatgtagcatttgtttatatacattaagtgtattatttttgttatattagtgtcaaataaactttcatcttttatggctagtctcttctttttatttatgtcattttgaaattttggagttttaatttttttatgatttcattcatgaattattcagatgttgtttttctaaaacaccttccttcattttcctggtttctctgtgtttcatatgattattgtaatttttcctctttctctcttcaatttggagtttctgttggtgtatgatataacaacatttcaaaacctcatcctccaaatcagtcaacgggcttctatacatttaccacagaaattttcattccactgaatttttctcttggtttttctttagctggaacagcaccaactcattcttgtatatgtatgtaagcaaactcatctgtcacttagcacttcctttaagaattgcttttctgatcacttaaaattcccctatcacaatcacttattttcttacttaaaattttgtttacattatttttaatatattaaaatagcattttaattctgtttatttcctatttgtcttctcaattatctaattgagaataataaatttcttatgactagaaactgtatagtcaacttgtttttgaacttctcaatagcagcccaacactgggcactcaagggaacataagattcactgaactgaggctgaatgattaatgtcacataacccctataatcattagagacctctgtgcactaaggagtgacacttcctaccgagcttccttcagaggttagggtgcaatcctggcatgcctttgctaaagctctttgtgtgaatcattttgttccctttatcccagcaataatttaaatctgcagcaacacctgaaacacattcatgaatgagtgatgtcaaacacgatgacattgtctcatctgtaaccacattcctgtggagaccattctctgcagtgtggaggaagagtccacagttctccaagggtagttcaagatcacaaaaaaattccacaacagaaatgaaggtaacaaaagcttttgctgttgtccctggggtggcgtggcggggtgaagaccctgtgtagcaggagagttgactgttcaaaaaatactcatcagctcttgtttttaaagttaccaagtcgtcttttttatgcccgcatttgtatgcctgattcagaaatggactttgtttcatttggacaattagcagaattgcatgacaattataaacagaactaaaagtacatatttgcatagtctattctgaaaattaaactacttcactgcattcatatttgatgaagagacctttcacaatccccaaggaaaagagtccattttttgggtaacatacacaagcaataataatgaaaagagagatataagccagtgtttataaaaacatgaagaactaatcttaattaatgggttcttcaaataattagttcgtggaatagctctctatataataatgaaacacataaccaaaactcagacttcttgagaaccagaaatttttatagaagctcagatgccttctagggtgataaaaagtgcatagagcaaaggaaaattaaatgtgaatggttcacaaccattgcttaaaattccctgaaaaagcaaatgtagaagataaacgggaatgcacttgtctgggtgctctattttcttgtcccaataaagtggaatgtgtggtatgaaatagccagcaaggcttcattttgaaattacacatttttatttttatttatttatttattttggagacagagtcttgttctagtacccaggctggagtgcagtggcatgatctcagctcaccgcaacctctgcctccaggttttaagcaattctcctgcctcagtctcccatgtagctaggactacaggcccccaacaccacatctgacttatttttgtatgcctcagcctcccaaagtgctgggattgcaggcgtgagctactgtgcctggcctgaaattacacacttttagagcagctagtttattcccagcttccaaagaagatcccattccaggggaacagttccacagtttaaaaacactcagaggatgaagtgattctatataaccaattgatagtggtagtagtgttagtagtagtagtagtagtaattagtgatatttttcagggaggaatgtaaattccttgaacttggaaagtcgaatctaaagtttaacctagctagaccaaatgaattaattatctttttctcttaagtaattccagtcatctgtaaggttttttaaaaaatatttaattattgttgtgtagtgcttggtatagttgacaattgttttcctcttttaaaattacctcttcacatattggtgctgcgagctataatagccatctaattagtagaaaataatatttgtttggtgtatactatgtcccagggatcatgctgagcatgatatatagatagcacagatgtgtatgcatatatatgtgtatacttacgcagatataggtagattcttattcaatcctcaccagaaacctttaggttgtttctagacatctagcataaggtcagaactcaatattagccaacattaatgttattttcccatttcacaggtgagaaaacagaggctctgggagcctaagtaacttttccagggggcaaaacagcatccaaatccaaatctttctgaaccgctatttcagaacatttcccatctgccagattaccaaacaacagtgattgggtttttagggggtttcccatattcaaaagacctgtattaaattccagttttaagatcttaacaaagatatagctttcattttttgccctcaaacatgattttaaatttaaaccttgtgatgaaatgtcattaggggattttggtaatcctcatattagtttttcaatcagtaaatgatgttttttcttgagtaatatttccctagtcatttattttcattccttttctgttggtccaataggccttttgtgagcataatgagttttgaaagaaatggagtgatatattaattaaccaagctaattatcttggagagccttgatttttaaaccccaaggtgtatacattatttctgaaaatgtgtgttgggagatcttgattgagatggtttaggcagagggaaagacagccaagtaatacacagcaggataagcaaattttggttttagaaattagggaaagagattgttgggaatttaattgctggtgctgttttgtttcccatatataatttctaatatattacaattgcacacatagtttgtacacattacacaacatgtatcatatatcaaaaatcacctttcaccataagctcaatgtcctcattgaaactaactctccagtctagtacctattacagataccattacgggagtagctctggtttttgatgccataagttgtagctacttaaaagccagtagtttaactccaatttgaagaacaaaatgaagcagaaagggcagagtagctaaggtgagatgtatgatgttttatttcatcagtagcaaattacaccgaattcagctgaaaatgtctttctcatattttcttaatagcactttcaattgaaatagacacatagaagaaagattcttaaatggcaacaactattgatcatgttctttgcttcctgtctaatgtactaagcagtgagttagtgctttgcagcaggtatggctctgccctccagcagcctgttttctatgagacttactgaaggtgtgtgaacaccgatgacatcatggacatcaggacaaaggataaatggatcttgtgggaagggagaagaaaaaaattggtaaattacaggagaccagagagcgagtctggatgatgacatttcccagctcttcagggcacaagaatggtatattgttttcacgtgtattgaagctgcagcaatctccttctgcaagcccttgctatgtgtttggacagagctactaccagcagcagagacaccagcttcctttaagatctttccaatgcaagggagggcaaagccaggctgttttgttttgtttcttccttccttccttccttccttccttccttccttccttccttccttccttccttccttctgtccttccagctttaatgaagtatgatctatgaacaaaaactgtctatatttaagaagaagaatgtgatatttctatttatagtttgttctggcctcattgtttgaggcctattgcaatgctctctactctttcaaatattctgctgcaatgaatgggattctcataggttacatccaaaagaactctttttctctttacattttgctttggataggaaaataatacacatttataaaagtttaaccaatatctagttttaaaagtaaaaagtaaatgttttcctttgctcgccaccaccaatcatgctccactgcccagagttgacccttgacaaccctggagggtgttcttcagcatggcacatgcatccatgggcatactaatcacatcgtggtctatgtgaggggctctccctggtaccaggcagggctcagcctgcattgctaggcatgaaagcctagaataacattaacatctgtggacccagtggcgagctttggaggcctcagtcttagttctgtcaccaacttgcttcatgttaggtgtgacgttcaacttctctattttttttttctgctaattgaggcattaggagaaggcaacttttcatgtgtctgaagaagacattggaaaagaggatttctaatgtctttccagctctaaaattcatagatgtgctatgtatctttctagtaatttgttgctttgtagccacagtccataaaccaggctgttgacacacagctctccagattccaggatcagacaagagaattaatttttatttattatttaggttctgccaaattactgttttctggttgcaaattaaactactattgcagaagcattttcctttataagtgccacttttttttttccccacggaaatctatactgtattttgcatggctatttccagtacttttagaatgtgtaggggaaaaaaaaaaacctttgctaggagtatttcagcaaagtttttatttgggccatcaactttctgtcagcttcctgcaggtaaactggagagagaaggtgagatgtattctttggacatttttccttccagggccttctcttctgctttcagcagccttcccacacacacgtgaaaatatgtaggggatgagtatattttggaaatgagttttccaggcatggtcaggtcaagctgtgtgttattaagtatatgatccacatggacgtataaatgatagcttcgactataagctcaagtgcatttgagatatttttgggcaaaagtgtctccacacagtggacacttggtaagaccaatatgtattaatagccagagatcgttcaggaccgaggatagccattcatcaaaaactatgtcttctgctgggtgttagttgtgtattctctgcccagtgtgtatggggaagaatatgtgtatccaccctccctggaactgctcagcgctggctgcatacgcacagggtgagcccacctgaagagtcactctgtgcttccatttcatcttgtcgatgagttcatttttgcagtggcttataaccagaagccagttttgcactcccagcatgtatttggcaatgtatgcagacatttttggttgtcacactggggaagtcctacctgccaaataatagataaggtacacacttaaatttgaattttcaataaacaacaaataatttttagtatatctcaaatatcgcatggaacatatttctactaagaaattagtcatagtttatctgaaattcaaatttaactggacgtcttggatttttattggctcattctgacaatcttatgttaataacgcagtaggtggaggctatggaggttgctaaacattttacagagcacaggtcaataaagatttatctgacccaacctgtcaatagtgatgagattgagaaattctgaattattgtaatactttatatggtaacatagtacatagtcatgcaaaaagcaatatggatttcaggagaaaactgatggcacttataaaaaattacttctatggtaggagttacatttgcaacaaggaaacagaataatttagcagaagctaaataataacttaaaaatcaattatcttgttggatcactgaatctttgaagctgtgtgcacctccctaggtcctccatcatttgatttattttacaaggacagcgagccccttctttcatgaaagtctggcatacagtgtatatctaattgattattgttgattgattcaatgaataaaaacaaacactttcttgtattgagaaactattaagtactaacctttcacacatattgcttccagttcaaacaaggagagtattataccaatttttcatatagagagactgagacttacattacaatatgccagaagttatagcactagtgcagggcaaaggtgggatttggggagaggatgtttcttccctaaggtttctatgctttccccgccacaaacagaagacccaggcagcaaaagatctgtaataggggaaacattcttccctctatgaggatcctgtatcagatcttcaggttgttggctctcccacaaacatttcttccatgaatgtatttctgttctttccccatttctcagtaatgaaacagtgactgcatatccctttggaggtaggtggatctatttccaaagctctacctgctgggagacatccacaaccttctcatgctgcttctgtcaatcgtctggtgagcacaccaggatgggcacagaagggacagctgttacagtcttgggctcctgggaagcctggcagaggtttaccctgcctacagacactccaatttagtagcaatcattgaacatttttaccctaataaatttaaaaataaagaagtttgcatcatttattttaaatttgtgggtaggatttcacactatagtcatttgtgtttgctgatgagtggaatggcttccaccttttatgctactgtgcagtctgaagaaacccaggttggcatctgctcttgtcacatggtggagttcgcaggtctccaaggagactcatggtctcttaggatgaaggaaagagaagaaatgcagcatcctgagtcctgggcaacagttttgtggccaagcatcatggccacttgtctcattaggcaaatattagttattcctcatatccatctttttccccagatcactaagtcagaaattgttagttgtattcattattacacttccctcagcatactacactctcttatacatagcgaacattgagtgtattagcacttggagtttatacagcctattttgcagaagtttgtcccctccattaccaaaagtcttatcatcttcttgcctttcacatctatgtaagggtagaacatcttgttacagatttttttttgtgtgtgtatgtgtgtataatattatacacacttttaggcttctacattcatgtatgctgtcatctggttcttaaaccaaaattataaagtaatatttccattttgaagatgaaggaacagaaacttggtgtataaacaggcacatccccaagctacaatagtttataagaggcaggatcaatttggagcctatcatctcttgacttcttcccaagggatttttcttctctgctttgtagctcatgaacacttagaaggaccctcaaatgttgcttcaccattatggatcttaatatctaaaatcagactgtgtgttttttaagccaacaagcatatagctaggcacaaaagagagatccaattttattttcctctaatttctggttttgcatcctctaactgaaatatatagtttaaacagattcaaagaaattgtttgaccagaggaagttggttttaaagtgagaataagagaaccagaaggaattaagaattcatacttgcttttctttctgagatgaagacaggctatctgggtctttgtcctgctttgagcattggttgtcagtgaaggttatcatcttgccatactcagagtggctcatagattcaaaaactgccctagttcaaggggactgggggaagggagcagaatacttgagttatttaccaaggacactggtcaaactttaataggagtcataatgcaactgagcaccaccttataatcaagcaactctattctatttgggcatatccctggatctattgggggtagggtgactggaaatatacttaacctgcttatgccatcatatgggcacgctgcttttctaccaaatctttggaaggcgtcttacagttgcatggctgggagaagtgtcacagactgcaccactgggacagctaatgtcagacacaaatctgtgtatcagctttaaagctgccagtgtagcgctatgtgtcaactattcgagtccacaaattcttggcataaatgccaataagtcaaaatcaaatctgcgttatgaggcgcacagattgcctgcctggtagagcacacatgctcattcagttatgtgtgaataagaagccacttgatctattaattatgcttcagaatcaacgtgaagctctaggtaagtggctggtagcagatgaatagatggctcatagagtgaagtatagtaattgtcttgaggttcttgatgtgcaatttagtaaactgaaatatggtatttttcagcctaataacagaaaatcctctatctgtgccgaagggtggcagttgcatgagtcactctcatgttcagtaaaacaaaaaggcaactcaaccaattagaaagcttggatgatacattgccacatgctaatgctattaataggatgactgcacataagctgtgactgaaactgtatagtgaagtcttctaatggcagttaccgatagtgagaaagggtagtatatgtgtaaacccaattcatatttactttatgtacaatgcaagttgatggaagaagaaaaacttagttctaatgggcagtgcattttatttaaggcactatcattcctcactaatatcaggggcttaagaatgtgtgtgtgtgtaggtgaggggaaaacttgttgcaatactcctgctgctaatgcctttgtctgtgatcccatgctccacttatgggtggtacattatttactttggtgtgttcctgtctactcaaaaaatgcagtgaagttcattttggtttatagaaagaaagaccaagaaaataaaatatggaaagaccataaagttgacttccatcttccactttttttcaggattggaatcgaactatgcaataccaatagcatcctgtttctggcaaaaaggaggaagaatataatgttatgtccctttaggatcttcttccaatcttatacagatgttatttttctttgcaatggaagctgtttacctttcattcattcctctgtggtgaagccagggccagtactaggctaatctgagaagtgatgaaattagactttcccctctgttcttctttggaatgtccatcagggctttcactgtgggatgagatatgttgcaggcactgaccacaggtacactcccaatatctgtgtgatcatggttcagtcattttcattctaaacctaaatatccttaactatgaaatgaaagaatgacatgcccattcataacagagggttattgtatcaatgatttctgacttggaccatacggaatctcatggaatgtagaggggacgatgcagatatagtttgaagaaagcacatcagatggttctaacatgtacttcctcatcctcgaatgacctgagtcagtggttctcacagtgtgggaccaatgggagcttgtaaaaatgcaaatcttgaatcagaaactctgagggtgagacctagcaatccatattttaatctctatattatttatattttcatgaataatcacaacaaagtttgaggaccactggcctggatgtggatccaagaatgtggtcacctaaccacctgcatcagtatcaccaggagcttattacagatgaaaattcctggaacaaaaccaagccctgctaaatcataatatctgggactaaagcccagggatcaatgttttgacaaacttcaggaaattctaaaacctgttcatacttacaacacaaagttagtctagaaccactgttccagaaaagtgattgttaaaactaagtgcacattaaaatcgcgtgtgagagtttttaaacaataccaatatctgggctccaaccacaggccaattacctagattctaatttccagtcaggattaaaaattactagactagattatttttaagacccctttcagattcaggttccatgatttttgcaattttgtgttgtttcctaaatgcgtattttaattctcaattcatagcatgcttttcaatccacaccatagttgatttgtaccacacagtaccctacctactggtaaattcacgataggctggtaaattgtcatcggctaaatccagcaccatttacaatactatgagctaaaaacaacaggtgcagcctgagaagctcatctctaaagccataccttcagaaaacttggtccaaatagatctcaactcctatacccaaggcatcctcgtctttctattgctgtgttgaatgacactagccttcaggtttcatttacttgaatactatttgcaacagaattaggatgatgattattattattattattgagacagggtctcactctgttgcccaggctggagtgcagaagtgtgatcatagctcactacagccttgaactcctgggctcaagggattctcccaccttggcttccaagtagctaggaccacacgtgtgctctaccatacctggctaattttttaaagtggtttttttttttgtagaggtggaggtcttgctacagtgcctggcctggtttccaactcctggtctcaggtgatcctcctgccttggcctcccaaatcgctgagattacaggtgtgagccaccacacctagcctcagatttgtaattattttccttgctgcttccaatgtttttaaaagcataagtcagtgggcagcaggttttggaggtcagacccttaggagttatttcctgcagcttccagagccccatcctaataatgaacacctgtactaggcttagtcaaattgatactgtttgccagtaaactctggttttcaaggaaactgaaaccagaggagccctaataatacatgtttttaacctgaggtttgggcttgagccaatggcatcagagagcagctcaaatgagctgttgcaaggaaggtttatctgaaaaatagttaatgaaagactttgagagctgcagggatgtctgacagattggcaactcactttgagaaagagactatttcccgttccaagtcccagacacacagcctgcgggtaagtcatcagaagtaaaataaacggggaaatgggagaggggaaaaacagtaccctgtaacatctatcaactgtacaagccaaagctactgatgaagttaaatagacaacaatcctttgtgtttattttctgttcagtgaagttgctaacctgagctttcagaggactaacaccacaattaaaggcaagcagattcaggggaacacagtgaaaggtagatcaagagtatttttatgtttagattgaaatttactattggctaggaaaggaggtgtttattgtgtctaaagacaataatactattatccacccagcaattatggtcacaagaccactcaaacaagtagtgggttgttttggttggagagaaaaaaccaaggctctgtttgcggtattgctcggtatgtgggtttggttttttttgtagtttagtgggctgtgggcttttgcagccaccctcaaaaggatgaagagacttttaaacagcttcggggttggtaacaggagtcccttggtcccttcagggaaaccaaagatactcaggccaataatttaatcaggagaagatttatcagttggagtgacacagttttaaaggtgcaaactctctgtgtgattctaagcagatatgaagtccagctgagaagccagtcaaactgatacttctcgggtttctctacccagctattctgagcctgagatctgccttcttcttactctggcaaatcagaaccaatgttattctcccagatttggggcatcacatctattacgggtcatggctcctcctgaagtcaaaggcccttcatttccatcttctacatggattcctgcctggttatctactcttccatttaatgcaacctattctacaatccagagctcaacctattccacaacccagagctctctggcctctcacagaataggtaagatttctaaacctttccacagattcacataagtcaggatatacctttagatagaaaacgttaagcctcaggccaccctccctgctgagttctagtcagaactcagaggccagctttcagtgtattctgaggaaggaaaagggaaacagactatcaaatgcaaacactaatactgacgctgatgggttgtatgattccaggcaaactgtaaatctttcctggggttctctatgtatttcccgttaaagcagaaaagaaaataaatgcctccctattctgcatgttatttgggcaataaagtgctactgatttgtgaacttcaataataataaaataacactggaaaaacctgcaccacaccccccccccaccccgccctgaaaagacttcaaacatttgatgaagcttcaagcaaattagaaaaataaaaaaatcaacaatttgagctcctcctaattttcctgacaatcaattttctcataggatgcttattttcagctttacaatctgccaactagctcctccaaacctcatttgtgacccctttatgggggaaacctagaggttaattaacagatgactgttagttcctgaaagtcgccctgtgatttagtcccgaggtggcctgagcatctccatcccttgttaggaaaaggctctctggttcaatattaatttctgtagcttttacaactctcactgggattaacatttaatcaacagagcaggttcctttttatatcattatagaaaagtttcaataaaatagaatggtgcattatactgtaatgaatgacaaacactggtaaattttcatttaaaatcagtaagttgaacctagagttgattcataacggatgggtcatctcaatttaatgaatagtaactaaactaaaaacacattaaacaaatgcctggaatgaaaagggagacatagttattgccccacgaggctgtgtgatcctctaagagagggcatatgttttcttaatttttccttagctgatgcttagagcaataccaagcatatagtgggtactcaacaaatgctttccagactgaatatattaataaatgtttctgtgtatagaaaggtattttcctttagaaaaaatgttactgcattttgctaattgcggccacctctcaatgaatggggatgatcacaagggattatgtatactacatctttttcttttataaatgtttatagtagtgattctcaaacttgtgcttgcatcaaaattacgtggggagcatgtaaaacagtgatttctgggccccactactagaatttctgatttaatattctggggaagagctcccaaaacgcatacttctaaattcctgggagatctgatgctgcattctggagatcatattgagaatcactcgcttatagcatctatctgtatggcattggtggcaatttccatttattcatgtacaggtgaaatcttccctagagcaggtcctcacacacagaaaatacctggggagcattcgctgactgcacagataattccaccctcattgtggggaatgtaacactattgctgctatatgcataaatggctttcattcctagggtcccatcagctatgaaaggaagcataacagtattgctgttggccttttctttcatgtgataaattgccattagagtgctaccctaggcatatatcaatttccttggggatctaactttgactcttccgaatctgcccacagttgctatagctgtgtgtatgactctttggccctttcacacagggtggctgtcactggagtaataataggagccattgccattagagtctgccagtggtattgactctgtgactctacctttgagtttgtataatattttattccaattaagcctctccatctgtatttgttttcatctagcaaactgttaattgtaggtggctctggatatatctgatggtgctggccacggaatatctgtccatctcatgtaaaaaatgtaggaaaatattttattaggaaaagaatggccacagtggtcatgcattttgattggggtgtttgatttgtttgcttttaagtaatagggctgggcttcaaggcctcatcaacagctcctcaccttgtttcctttctgagcagtagcaccaattgctatttaactctttaacttagggatacatatattggggtaatgctttaactttgacggtacatacattggtaatagaataggatagagctaatttactgatccagttttgtgggtggaggatttcacaactttggtcccattaccaacattttcttagcaaatgttttaaagttatgttaaataagcctgatagttggatattttcattcagatatcttagagcctaatacacctacacatcttttctctcctttcaaattttgatgcattcttcaaggaaaagttcattccactctcatctgtgggttttttcccaacatgaactcttaggtgttactaacttgatcattcttctggcactctattacataccattttgtgacatcctttgtattgtaactttttatgcgtataaactttgtctcctcaattagattgcacactttttcaatcatctctcattttactacatgattattcaacatccactatgcatagtgcaccaaaattgatgctggaagaatacagagaggcaacatatatggtcttatatctaggctcttaaagaatttatgatttagcattaaggccaagctgtgcacatacatacacgtgccataaaacagcaactttcactcacagtagcacatgagttaggagtgatataaataggatccatataagtctgtttttccactgggcttacatattgttttatagacatagtcatggagtgcccatttattttcttcatatgtacataagggatgtccttttctaattaggttcggtgtataccgctcaggagatgggtgcaccaaaatctcacaaatcaccactaaagaacttactcatgtaaccaaatactacccattcctcaaaaacctatggaaataaataaataaataaacaaataaataaatttgccattatgtcaaacctcagaagtgctatgaaaagagtaattattttgacctaatttggatatatttaaatttaaacacacttgatactgaaatccatattgataaaaaattaaactgagataaggctcttgacaaaaacaagcatctttcatagtaagatgtctttaaattagcaagctccttcacatatttaaaatatatagtgtttttttgtttcttttctggacaaaaggaggagtttgaggaaaaagttgagtatcagggacagctttactgatgacaatctaacttcctcctagctctagttgcccctagataactttccagcattgtctggtcaaggcactgtttaattttcatcttcgttctactgccaccattataagcagataagaaaatgtccttttgttatttaaacacatatctataattttctattgaaagagtgtaaaggggagactgatcatcatgaagcccaacatcatcttcccattccttctccttattcttcatcctaccacatcctttatgatccagtgttgctgatctacttataagtccctaaaaatctatttttttagagtcacatctggcttttcttgcctgttgaatctctgcttcatcctcaaggcccacctcagtgtcaaactctctgaaaagccttcctaaattttatgaaacagaggtatttgttctcacttttctgtgatgttatgatcactctatatgatggcattaattatagtgtttttccattataaagccgttattgacatgtctgttacgttcattggactgtaagttccctgagagtgagaacctgtcttattcttattaatatcgttagcattttctgagacagtatatcttgctgataattggatggccaactatatatttgtacaattaatatatgaatgaatttatcaaataaatgagtagatgaatgcctacctcaaaagtaacaaattagtgactacctcttagaaaattgaatggataataaataaatacaattataccaaataccattctatggaatttcttttgatcatattttcatgttgtgaatagaaatatgtttgaaagtagcatatcccatcaatagcaattcatagctcaacccaaatgtgtgacattaatttcaaaatatgtctgcttttgttctggcacttttcaagctgaatgtgtacccagtatgttcatcctgtcaattcataagggtagcaaggaatataaaatatgaaactgcattatgctataaatggtgatcttgaaatcaaaagtattggcagacaccaaaaaatatggatgatttctctagtaccttcaaatttcctaaacaaaacttcctataaataaaattatattttaaggaatcagttcaaaagtcaaagtgtgtcataaatttattagttagaatggcgattattaaaaagtcaggaaacaacagatgctggagaggatgtggagaaatagaagcacttttacgctgttggtgggagtataaattagttcaatcattttagaagacagtgtggcaattcctcaaggatctagaaccagaaataccatttgacccagtaatctcattactgggtataaacccaaaggattataaatcattctactataaagacacatgaacatgtatgtttattgcagcactgttcacaatagcaaagacttggaaccaacccaaatgcccatcagtgatagactggataaagaaaatgtggcacatatacaccatggaatactatgcagccataaaaaggatgagttcatgtcctttgcagggacatggatgaagctggaaaccatcattcttagtcaactaacacaggaacagaaaaccaaacaccgcatgttctcactcataagtgggagttggacagtgagaacacatggacatagggaggggaacatcacacaccaaggcctgttgaggggtgggggactaggggagggatagcattaggagaaatacctaatgtagatgatgagttgatgggtgcaacaaaccaccatagcatactgtgtaactgtgtatacatatgtaacaaacctgcacgttctgcacatgtatcccagaacttaaagaataataatgataaataataataataataatgcatgtaactcaatagtggataaattctgctggcccttgaaacccagaagaaagggttactatttgggaccggtaaagttcatcagaatgccatcaatcatatgctttcctaatgggcataactctgaccacattcatctagggatcactatctgaatttgcatggcatagaacatagcagaataactttccatttctccatctctactgagcatttacagcatcccactagttacaacttaacttggaatcttgtggttttataaaccccaggataaggacagaacaaaattcatattctaaccatttactgacgctgaagcaaattgacctttagcaagtcaactggcaatgcagagaaaccacaacaaactgtgacttaagcatttctagaaattactgacttaattgactcagtctacagctacatgtagagcaaaggaacagtgaaaatggccctgtcctcagcctttgccttttatagatttttctcaggtgcattcatttatgtagactcagtaatgataatttggcactctaattttgaatgctgttctaagtcctagagcagtgaattatgtcttttctttcaaaagtgagatttactaggaaaagaacaagctttttttctgttagaagttcattatgctcaattttaggaaggcttaacaaaatgataaagagttttcctaaagtaatatttctgacatagctgttctgtcataaatttttggcctatttaattctctacaaaaatgtaaaattgtgttttcaattatttttcctgatcaactttgttacattaatacaacgaactgccttttctggaagaaaatttcaatttataacgatattataggatgtaaaatttcacataagatggttgactgtcttcaaatcgttgcagctgtcttctagtaagcaagtgtattacttgtcaagggttgcatgtacaattcagtgcccatggacatatctaactgattgggttatactttagaaatccttttagttttgaagttttgttctttcatagtaagtgaaagtaactacccgatattaatggtatatatgaaagagttaaacatttactttggtggtagtatagtgtgataactcactctctgatcgatttaaatggatttaaaactgcatctggcctggttcattttgggtgatcagaatattttactctataaacaagaatgcatttgagtaagtaatgtgtagacatgggcctctatcgcatgttttcaactccctgaagtccactataacagttcattttactcattgtgtttgttctcttcatcttcctttctattttctccatcctttaagtgccccaggaaagtacccatcaagctgtgacttgaaagtttcaaggaattattatttcaactgctcttctaaaggttggcttcacttccaaatctccccacttaaagttttcttttttcttctttctgtctgtcatttacaaaataagttggttttttagatgtcgcattttaaattttgaaatgtgtaactaatgagactattttccttatctcctttctttaaccctcctttatatactgtccttatgggctagtgtcatcattaattagttaatgtttgtagaatttgtgagcaagaattagtgataatagggaaagtagggaatatttgggttgctggttggaggaggaatactaatgaatgttaatcctgaatgctcacatagtgccttttgtcttcaatatagttgaacgaggcactaattaattgtcatcctacaggattattattaaaacagtacagtcagtgttcaagtgtgcctggagcaaatacagaagtttagtcactgtataggctaagctgaagatgcatgtgttttctgtgcagtgggaatgactaataccaaatcattaacagaaggatttggctaagaaaacaggtgcaacggtgaaagttttgatggtggacaaaaagcatttgactatttgtttttttgagagtttcaggcaaaagctttgcctatagtaaagtttaccgtatgttttctagtaatttttaagaaacatctctacaagtaagcattcaaaagaatgatatgtggtatctacaaggtaggccagatcctggtgacatatctcagatttgtctttgttgttgtcttctggtctccctataagggaagcagagataagggaaagctgaacagcccttgatgctctccacttcttattttggtggtttcaagtctttcactgcccctgtcattcagaaagagcttactctggggcttcttgagggtccagactcatacttaacaccctgattaacagcccaattgtgttttgattcatggctagagtgtttactatcatctctcctaaagagccattggtcagtaaacatgggaataaaaagtgctgcttcttgtccatgaatcatctcattttccccaccacattctttatattgttcactagattctatgaaaaactaatgcagaggaaatgaaaatgaaaattattcaggaaagagcaactaaggagggaaggaggaggcaatgccttagtgcctttgtgtgtgtatgtgtgtgtgtgttcaaagcataacccttccctaaataatgcatttgctgctaattcaatagcatatttcacacttgagaagagcctcctcagcagcacttgatgccagccctagtgctcttaaaagcaggccttctttaatgtatgtttgatgagtgtattgttcactgagagatgaacaaataatgatttggaattctctgtgtcactagacattatgtagagctttagtcatgggcaattagtaagcattaaccctcctggtgatttacactgtatttcttagattcagaatggtcattttctggaaaaacaaaagtatattccaacagggcatgtctttggctagacagaaggttctgcctgactttgaggggtaggaggtgggattcctaaagacagcggtacaatgatacatggacttatcaggcaaaaaaatatggtgtcagctcattattaatatttccctgaactctagagacatcatttatcatgtattaaggagggaaatgattatgttcataatgtagagctttaatgaattgaaaatgtacagacatcattgagcaactcttccttccataggtcaggctgactatgcttttactgaagagaatgggttagtaccatggagaacagtcattcttcttagatggcgagcatctgacactcaacttgaaagataacataagagtaaaatgatgtacgctgactgtgtgccttcctcctgctgcatagtgaacacttctgtaacgttaaacatgttgagtttatattgcataactgaagttggtaaagaaagaaatctttccaaggacacacacagtaaacctgtatgcagaaatacgaagaaaagagtgactagcccttatccctatattggtaaaaatgggcagatttctactttgcagcccgaagttaagaatggagttttcttttttgttttcttttttttttttaaattatactttaagttttagggtacatgtgcacattgtgcaggttagttacatatgtatacatgtgcgatgctggtgcgctgcacccactaactcgtcatctagcattaggtatatctcccaatgctatccctcccccctccccccacccgacaacagtccccagagtgtgatattccccttcctgtgtccatgtgatctcattgttcaattcccacctatgagtgagaatatgcggtgtttggttttttgttcttgtgacagtttactgagaatgatgatttccaatttcatccatgtccctacaaaggacatgagctcatcattttttatggctgcatagtattccatggtgtatatgtgccacattttcttaatccagtctatcattgttggacatttcggttggttccaagtctttgctattgtgaataatgccacaataaacatatgtgtgcatgtgtctttatagcagcatgatttatagtcctttgggtatatacccagtaatgggatggctgggtcaaatggtatttctagttctagatccctgaggaatcgccacactgtcttccacaatggttaaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcgttttttcatgtgttttttggctgcataaatgtcttcttttgagaagtgtctgttcatgtccttcgcccactttttgatggggttgtttgtatacaccaacaacagacaaacagagagccgaatcgtgagtgaactcccattcacaattgcttcaaagagaataaaatacctaggaatccaacttacaagggatgtgaaggacctcttcaaggagaactacaaaccactgctcaaggaaataaaagaggatacaaacaaatggaagaacattccatgcttatgggtaggaagaatcaatatcgtgaaaatggccatactgcccaaggtaatttacagattcaatgccatccccatcaagctaccaatgcctttcttcacagaattggaaaaaactactttaaagttcatatggaaccaaaaaagagcctgcatcgcgaagtcaatcctaagccaaaagaacaaagctggaggcatcacactacctgacttcaaactatactacaaggctacagtaaccaaaacagcatagtactggtaccaaaacagagatatagatcaatggaacagaacagagccctcagaaataacgccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagttggattgaagacttaaatgttagacctaaaaccataaaaaccagagaagaaaacctaggcattaccattcaggacataggcatggtcaaggacttcatgtctaaaacaccaaaagcaatggcaacaaaagccaaaattgacaaatgggatctaattaaactaaagagcttctgcacggcaaaagaaactaccatcagagtgaacaggcaacctacaaaatgggagaaaattttcgcaacctactcatctgacaaagggctaatatccagaatctacaatgaactcaaacaaatttacaagaaaaagaatggagttttcagagtaggcctactaagcctatgacagcattattgcttaattcggactctggataatgggctccagattcttacatagtccaggaatgatcctctgcaatctctgtgcccttctgattaaaataaatgttcaaagatgataaagggctagctaatccttttacttcttactgtctctctgttacaacttgtatgtttgtaaattttatatggaatcttgtaaaattaaaacaaaacaaatgttttacagtttgggaggtaccctagaggttgattcctcaaagctccagagactgttaatgatagttacccagtgtagcaatctatgtaggtagattcagtatgatataagacagtctgaactaatgattatttgttttccttttaataaacccatgtgtgagtctgtatgtatctgtgtggttgcattctctgccaggtttgttttgtattttcaaatgaatatttttgttgagattcacaccggtgcttaaaaatcaccatgttgttttgtctctgacttctcctactagattggtgagtttgattactgtagtcttttctaaatagcactctccataatcttttcctgtggaaacatttggtggcacaattgtcactcctgcagctaggtgttgattattaacaaccacttatttttgctccatgattgctgtcatgtaaattcccaggaagtggggtcagccagtcctgagtctatcctacagtcagtgatgcttatgggcaaatgtcaagagaaactttgtaccttagcgttgaaggtgaagagcactcctgaggtaaatatgagatagttttactagaaacagtaaaacaaaagatgaaagatatgttgagtaatataaacctaataagagatgaatgtgcatttgatatattttcggttgtccaggtccaaaagaggtcttggtcttcaagacccaactcaaaataaattaataacctggtcatactccaattacttccttgatattgattatctgaatatctccaaacattcacgcccttatataagggcctcttaaaattattctttaattgtttcaactttttatgttctatttcaattagattgaaaaaaaagccaactctttgggatagaaactccttttcttctggtgttcttgcatcttcttccatctatctacacaatgcatcttcaatatgaagcttgttgaagaaatgaatgaatgaatggttaggttggaaagcagagatttcaaagtgttctctaaaatcataatacatttatagaaaagtacattctctatttctaagctagcagttttttctgtgtacagcttccctctccaaatattttgtaccaaaatacccatggcctacatttctgtggaggccatatatggaaagcaatgagataatcaaaaaattcctttagttattttgcctcttgccttactccatccaatactagcctgttgattttcattctcttagtttaattggttaatgtggttaagacttaagtataactgactcaggcaaactttgtatctacttataaatctgctgtttttatgagaaaataaatgacaataagtcttctgtcttacagaaatatattattcatccaataagcctatgaaaagtccaaaaacttcttgggacttactatcaatcacatatccaaatgccatatatgatattctaaaataatatactagtatgagactagtttagaaggtctagctgtcaaaatccagatttttttaagaactgaaatgagattagattcaacaccagttttttatataaaatgtagttagaagacattttaatttttttaagcttttttcatggaggaaagtctttttaaaaatttttattaaattttcttaaagaatatctacaatgacaaatgctgaattcaggatgcatgaagaattatgaactgaaattatacattttgaatttcattttagaaatatgagataagtttttatcagcccctgttggcaaagacaattcctgatgtggaccataaaacaactcaggcctacaaattaatttataagtaattacaccccaggtttttagatatttagttcatatgcaaaagttgactgcacattaatgcagtttggatgtatagtttgttattttatattcctctgaagcatcaagcatctatagctccagaaaactctggatttattaagcatatggtactggaaaaaatataatttcataccctaagcattttcagcttaactcatcattgtattaactattagattttctttcatttctcaaattgttgtgcattttgtgatagatttgtaaactatctgtaaggaatcttttcactggaaacttctgagttctctttaaagggcagacaaaatgatttgtgggagtttggggagtgctatttgtttttattaggttgaactacaaggctcatgtcatccttatgaggtagatccaaaagcagctcacttttgttcattaaggtcaaatgaatgtcttgggatatacccctacagacaatcctgagttctcatcagcacaaagcacttcttgttacagagagaaatgttttgattcattatttcaggaaaggatgccaaggaaaaaaagcagctgacttacaacagcagttcgtacatttcctggactgttgggatgtatcatgtattccatttacattgcacctgcctcaggcacaggatatcactacgtaagagcaaacatattggcaagtaacaatatggtgtatgtggttgtaggtaaggatgctatccaaaggcaactgattctgttgtgattcagagtagactgcagacaatgctcatcagccacaattcatcataataacttgtgtgtatctaaactcttatacattggtagagtgtcatattgaaccatatgaaattgctgatattcaactgttttttcttagcttataaaactggaattttatgtagtttaatctaatactttcacatttattattccccttcgaaaggctacctgccatgcttgaaagcacactggatttagagccagcggcctgggtccatgtcccaacttacatgccacttgcttgctgggtgacctttacaaatccattagagattgaacagtgacatgtgggaacaaagaaaaatctaattcatgagctatttatcagttttttgactaacagtttctggatagagagccttcttcacaggggtgatatgaagttgcagtaccataatgtattcaaaaaggctaacaattcaaaggtgaataattattaatgtcatgactggtcatcaagaggagattgtcaggtaggaagggcaagtatcattatccttattttgcagttggagaaactgaaagtaataaaggtggctgaggtgactcagcaggtcaacaatagaatctaagacgtgtcactgttgctcttttaagggcaccctctggtggttctctcagtgtcaagtgagtgtgaacactgctctaactgaccacagcagcatcaccaggacatccccaccagtgaaaatgcctgtctctgtaatgccacatcagtgttttgcaaagtcatgaaaatgtaggatacctgacaatgagttcttccaaaatctttgtttttccccttcaaaaacggtattaggctggatgctgtgactcatgcctgtcatcccagcactttgggaggctgaggcaggaggattgcatgagcctagaagtttgagaccactctgggcaacaaaataatatcccatctctctgaataaatatatcaataaaatatgagttggacatggcagcacacatctatagcaccagctactttggaggcggaggcaacaagaggccttgagcccaggagtttgaggtcacagtgaactatgattgtgccactgcattccagcttgggttatagagaaatacctcatttgtaaggcaaaacaaaacaacaacaacaactgtatgaaaagttttggtgtttttgttccccccatataaggaaagccttcacattgcaaccgtgagaggcaccatgtagggtggttgctgtcattcctattatatgactgagaaaacaggcccagtgaaatctgaaatacctggtcggagatgtggcaggtagggatgaacagctgtgaagaaagctagttccttccagtttgaaagcctgtacttctactgctaaaatgctctgttcattcaccttgggcctgaagcagctcacaacactagttaattggtttgggcaatcataatacccatgcatgaaacaaaacattattcagtggtaacatatgaagcatatgggtaagattaaaactgaattcagtgagatccagaatacaatattggatgatagagcaaatactcccttggagaaggaatacagtgactttttatagacaacttttagaaaaatctcagtacagtattaatctgagtctacttaaagcacctgacaactatttacattgtaatatgactggttccaggatattttttacttgggtaaagtaagccataaagaaagccagtttacttcggaattcatatataacattccaccttgaccacccaccactctactttttatcactttccctttttattcttagcggtaaacttcctgtgtaagatcttgaagttactacggtttgcatgcaacattcaaggatttcatatgcggactgctttaaggcagctccctcagatctcttcaggatgacttcccagttagtttcaatttctctccctgccttcacactgtgaaagagcatggcatctctcgggaagtctctgtaatgctaccccttcttcagctcttagttactggtcctgggtgaagatgacttgttccatttttgacccagatacaggctgttggaccctgcatggaaaactaaagcaagctatgccgaaactgtcattatctgaggcaaccagtgctctctggacccaaaagtaaagccttgactaactttgcttttctgttaatgagaaaattctcccagttacctggacattttctttctcctaagatttcatctagggtagggtctgtcttctggcctgtggctacctacttctggctataagtaactactaggaactttcctcctttcattcattcatcatgaatagtgaagtacttaagattgtggatccagtgtcagactgcctagttttgaatccaggttcttccacatattagtcaaatggctttaggcaattttctgggcacaaatgtctctgtctgccaaacggagataagatcctacctacctgatacaaatatcacgagacgaaatagatcgatagattaaaaatgcttaaaatattgggcttacctgtccccaacctcattgtcaagccacaagcaattcatcacttatgctgtgtccgtaacaaaccccaaatattccatgcatctcagcccacgttcaaagtgcctcattagcttggaattccctcttgccacccccacttattaaaattttatccacatttcaagattctattcaaatcccacatcttccttaaagaacttccaccttgtgcacacctaactcttttaccattaatataatagcacttatactgcaatgtataatgacatttatattaccaaaatgagtatacaaatgtatatcattacacttaaaggcacctcaataagtttttacacatatgtgagtgtatgtgtctgtgtgtttgtaaaggcatgtatacacatgtatgtatgtattatgtacctgtatatctgtctgtataccaattgatttgacagtcattccttacatgactatcatggttaatgtaccctgttacacggaggatatgaggtaaataagacatattttctgcctatgaagatttaatattatggaaggaagattttttaaaaagcaatatatactatactatactgtaaaactgacttggatgatatacaagaaatatctaacatatacacacatatatacatatttatataggcatgtatttataaatgtacaactaaaatttgatgaaacatcaaatttctaagataatttccaaaagctaattttatttcagaactgataactgtgatcagtattaagtaaaaaattattattgtatttctacatattctaattgaaccaaggcttgtgccccaagattgttcagacttgcatacttcaatggttctaactttaaatttagaactttctcattctgatggcatctccagatttctgcttctaagtttttcacatacctttgatagactttgttgactaaaaatgttctttgtaacctttgccatgtgtttctgcagcagaatcttttttattcttttgcattttacagataataacttcttgtctcttggtctgggaacaatgtggaataaaaattgtaacaaataattttagaagaccggattcatccagatttaactgaataggattgttactatgcatttatacactgacaattcaatcgattaagcttacttttgataaactctataggttgactttagattgcattatttgacatttattatctccattgtcttcagtaggccttagcaaggaagttgagtttgtttagaggcttatatgtttttttttcctgaaagatcattgctttggtttctctgttttaaaataatatatccacattacccagatgattagtaagaaaattggacagagtacatagaagtgtttgttaaatagcttactctaaaaattatgcaaacctcatagcttttaagatgttttttaaaagcctaactatactagatagaaaaagaaaacagctaacaattatttcagtgcaaactgaatctttttctgtagctatgtctagatgattcatatattagtaaaaatagcatgtataatatgatcatgtttcatatagttacttttgcatctatctaatctttctatctttctatgtatctgtcatctatataacctctcttctgactataaatatgtagagataaatatttgaaattattttcacaaaatgataaaagttatttattggtggttgaatatagagcaattatttttaaccctattaacatatgttctgatagttattattttatatataataaacatgttacatatttttattatgtattctaagaaaattagtacctttatctctatgaggtttttaatccttttcaaaggggaaaaacaagcatacttctttataacatgttagtatcgaagacagacacacttttgggcttgagcataagggagcatctagttttgatgagactctgagagaaatgtttgtgagtttcggtgtcttttctctttagaaaaatactcctttacataataattatgtacaaagcactgggtacttatgcatatgcatatatactgtttgctaggaagatgctctgcaaatagaatgatttgtcattacgtacacgtgtgtatctatgcttaaaaatagctatttgtgtttatcacacacctttcatctcttagatgcatgaggatattcacagtatctttgattttaagtcctttcctttgccttgaaatggagttgaaatgactatttatttatttattgagatggagtttagctcttgttgtccaggctggagtgcagtggtgcaatctcagctcactgcaacctccacctcctgggttcaagtgattctcctgcctcagccccccaagtagctgggaatacaggtgcccgccaccatgcctggctaattatttttgtatttttagtagagacagtgtttcaccatgttggccaggctggtcttgaactcctgacctcaggtgatccacccacctcagcctcccaaagtgctgggattacaggcatgaggaaatgagactttaatatgaattctcttttccatgactcaatgctttatcttgcttttagccccttctgctccccatctgattgactttctattagtaaacatagaactgtctctgcattccaagccctcaaatggccaaagtagatggaccagctccctttctcttttataattccagctggattctcccccttgttatcgttagtgggagaacagagatgtgcattaactgcatagacagctgtggaaaacaagaagaagcccagtccccatgacatctccaataaagccatgagactcatgcaaggtggagaatatttgtatgttgtggtcataggaacctgaatgacttatgagcagttggggaattctgtattcatttttattaactttaattataggagcactataaaattttctcattctgtgttgcgtgaaaaatgcagtagttaattgctcctgacatttaattggtttatgcttccctctaacacaatcttgtactgcaagagacagggaaaactagttggcatatttctgcaattgcagagtattacacaccaagaaattagtctttttgttagttctagcagtgaattacaaatgcagtttcagaagtgtaggtagagaaataaaatctgtgcgtctacattctacatatgctaaaagactgacatgggcttccctgaatgctttgtatgactttgccagaatggctgagattttttcattatcattgtacagatttaaaaatgacattttttatacccttgtgaacatgtcaggttgtttaccatttctgttacaagccatctggacccttcataaccttttcatatattttttcaaatatcatctggcataaaaagcataaggtaaccttgctgttaccaattataatacatgatggaagaagttggatttagtgcggcatagtgcctctgatttcaagagtggcgagacactctggaaagcatccatctcctgtgatatgttctaagcctgaagggagaaaatgatacatgaagtacaaaaagccaatgctaattgccatttgacacaattatggactaacggtgcatataccaacagcaaggcactgtgtaaacattatgggatgtgccatgatgaaggtggcaggcaccttgccctcaaggagtttgtaatctagaggagggaggaggccttacatggtaactaaatgcaaggctggaaagtgcataaggctgagagagcacagagggagagaattgcgagagtatggagaggtgattagggaggctgtacggtgctgccatattataaaaatagaagtgaactggcagtggggaacagctttttgaaacgtgaagcctgtttatcatttttattgcgtctatttgattcttctctcttttcttctttattaatcttgctagtggtctatcaattttgttgatcctttcaaaaaaccagctcctggattcattaatttttgaaggattttttgtgtctctatttccttcagttctactctgattttagttatttcttgccgtctgctagcttttgaatatgtttgctcttgcttttctagttcttttaattgtgatgttagggtgtcaattttggatctttcctgctttctcttgtgggcatttagtgctataaatttccctctacacactgctttgaatgtgtcccagagattctggtatgttgtgtctttgttctcgttggtttcaaagaacatctttatttctgccttcattttgttatgtactcaatagtcattcaggagcaggttgttcagtttccatgtagttgagcagttttgagtgagtttcttaatcctgagttctagtttgattgcactgtggtctgagagacaatttgttttattttctgttcttttacatttgctgaggagagctttacttccaagtatgtggtcaattttggaataggtgtggtgtggtgctgaaaaaaatgtatattctgttgatttggggtggagagttctgtagatgtctattaggtccgcttggtgcagagctgagttcaattcctgggtgttcttgttaactttctgtctcgttgatctgtctaatgttgacagtggggtgttaaagtctcccattattattgtgtgggagtctaagtctctttgtaggtcactcaggacttgctttatgaatctgggtgctcctgtattgggtgcatatatatttaggatagttagctcttcttgttgaattgatccctttagcattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcacttgagatgggtttcctgaatacagcacacgatgggtcttgactctttatccaatttgccagtctgtgtcttttaattggagcatttagtccatttacatttaaagtgaatattgttatgtgtgaatttgatcctgtcattatgatgttagctggttattttgctcgttagttgatgcagtttcttcctagcctcgatggtctttacaatttggcatgattttgcagtggctggtaccggttgttcctctccatatttagtgcttccttcaggagcttttttagggcaggcctggtggtgacaaaatctctcaacatttgcttatctgtaaagtattttatttctccttcacttatgaagcttagtttggctggatatgaaattctgggttgaaaattcttttctttaagaatgttgaatattggcccccactctcttctggcttgtagagtttctgccgagagatccgctgttagtctgatgggcttcccttgtgggtaacccgacctttctctctggctgcccttaacgttttttccttcatttcaactttggtgaatcagacaattatgtgtcttggagttgctcttctcgaggagtatctttgtggcattctctgtatttcctgaatctgaatgttggcctgccttgctagattggggaagttctcctggataatatcctggagagtgttttctaacttggttccattctccccgtcactttcaggtgcaccaatcagacatagatttggtcttttcacatagtcccatatttcttggaggccttgtttgtttctttttattcttttgtctctaaacttcccttctcgctttatttcattcatttcatcttccatcactgataccctttcttccagttgattgcatcggctcctgaggcttctgcattcttcaggtagttctcgagccttggctttcagctccatcagctcctttaagcacttctctgtattggttattctagttatacattcgtctaaatttttttcaaagtttttaacttctttgcctttggtttgaatttcctcctgtagctcggagtagtttgatcgtctgaagccttcttctctcaactcatcaaagtcattctccgtccagctttgttccgttgctggtgaggaactgcgttcctttgcgagaagaagcagcaggaccatagcgcagctctgtccgcatcatctgtcattaattcttcgctttcaaattttataggaccccggaaaattgattgaggaagatctaaaagaaaacaatggtcaaattttgttctttagttcacttgctccaggtcctgaaaattatttaaaaccaacagatcgtcaaaggctaagaacacttactggagctattttttaattcattaaagacttcaaaagctagaaatcacaattctgcaaggttaaggaaaaagagaaatcttaatttcctctgccattagttttttaataaatccaaaaatacccctggtgtatcttgagaatgtagctcttctccatttttacctagtaaaagccatgtaatctcatacatgaaatgaatagataaactaataaacatgaaaatggcctctgtaggcagacaaggtagagatcattatactagtgcaagcagtgtttttgaggctggagcaggcagggtggcttttccctcagaagttacgtacgtccaaaaggtttgcaatggccaactcaaacgaaagtaaagttatggccaactatctgggaaggcatttccaaatggctcaaagatgccagaagcaggaggcaggcccaggttttggttaggggagatggggacagaaggttgagtcaaagaccaaggtggttttcatcctatacagtcacaagcagtgggtccaacacattcacaggtgcaacctctcccccagattctcccctgagttcagagatacccaatagatccttggagctgctggcgcatgtcataagctccaatacaaaatatcctaggatgacgacaatgttgtatgtagtaatcctgttattatctagtgaaaaacagtatccgagatcctttttctttttctttctttctttctttcttttttttttttttttttttgagatggagtctcaccctgttacccaggctggagtatagtgacgcgatctcggatcactgcaacctctgcctcctaggttcaagtgattctcctgcctcagcctccccagtagctgggattacaggtgcacgccaccaggccaggctaatttttgtatttttagtagagacggggtttcaccatgttggccaggctggtctcaaattcctgacctcgtgatccaccctcttcagttccccaaagtgctgggattacaggcgtgagccccggcgcccagtggattcttctttgtgctgcttttgctgatcactcgccagtcacatgcatagagacaatgctatttaccatcatgttcaggatgcagcacagggtgttggagagtccagtgcatttaggagcttgtagcttcagctctgcccacttgaaattcatggggctgattatcttggcctgcaagatattcagaaagcagctactggcaatgcacatacctctgcccactctgtgaacatagaaaacaagttttcatccagtgtcactgaggaaatatttcaacttcaaagcagccattgtctgtaggacttgattagagagtacgaccaaggaattggctacagtcatgtgtttgagaatcaaatctgtggatcttaatgtgcacctggtgaaataaaggaaactataacgttaaagaagaaagacatttcctaggaattcaactataatctgagataagaagatcattccttttgccaaataccccagggcatttgtcattttttcagtgacttttatttccatttagagtgagaggatcctgcatagaaacatgaagtctgctttaatgtggaacctgaaattcacttgtccacttattgttatttccacctccttaatttcttattaaaacccattttttcttcctctgaatgtttgctataaaaataaatacatatatgggaattatattagtttcataagaacatatacataccatatcagagttttatatataacaatcccataagtaacaataatttcataaagtaagcactttgttattcccattttacaggtgaggagagcttaggtaaaggaagactgagtgacttttctaatgtcccctccttggaagaggcagagccaggagttgacaatgtatttaaccattgtgtgtttcaacctctgacaaagttgtatttttccaaatgtccacattatttttcggttttgcatatcctgtacatttttaaataatggttgtgcatttagaaaaaaacaaggcaccaagatggggatgttgcatagattggggaatcggttctcaaggaaagagagtcaagaggaatagagcaaggctcagagctggcacacaattgaagaaactcaatctctagacccaaggaaagccctgtgatgttgctgttctggaatgcccagactgtgcttaccaggatgtagtggctccttagaggcacagtgccaggcaagccatgtgatcttgatctaaccagttgaggatctaggggagcatttcttaaagtatggtccacagtctcctacaccagaataccacaatgagtgttaaaaatgcccatctccagacctgactgcacaccttggaatggattttggggcaccttcctgggggtgactcttaatgataccaaagtttgagaagctctcatttaggtcatcagaagaaatgaacacgtgaaatcaatgacccagacaaggccagaaattttacatgggaaatcatggggccagatagtaacaatagtaattgaggagaaataaagataaatttgagctaagaggttaaagcaggtcttgaaagatgtgaggaattttactcagtgaagaggtgggaacattcttggtgggagaaagggcctcaaatgaaaacccttggaggaagtcagcctggcatcatggaaaaggccttgagctaaaattaggtttaatgaggattgggtttagaggagagtgttagcatctggtgtgggcagaataaatgtgatggtaatgtttaaaagtgattcaggatttaaggacttattcagatcaattcactttcagtgctacaggattgcaagcccagaattcagtgaattcaggaccttggtattattacttttgctaagtcatattttcaccttatcgaataatgattctcttcagtgcaacagatacacatctaacattagtgctatatgaaataagggggaaacatagaaaagttattgaactgtacagttcctgtgccttgaatttcatgttcttatgagcccctgtaactttttaatttaaatgctaatgcaaatagcccataaaagagacaagaagagaaagtgcacatgcctctcagaaatcatgtagacaggtagaccaggtgtctgatgcgcaatcaagatatgaagggctgatggtgggtggctgccattagaggtgtcagggataacgatggcaggtccgatgacattcctagtaacagctgcatatggctaactatgaggagtggcccttgcagtgcccttcctttagaagtcccttattcaaatgtgagaacagcagagattcccagactccaagggctgaaagtcccttttgtttaatccctgtcccaatcccagccttgctgctgctgccccagccctgcctcaggctcttgagggatggtgtcttttcagcacaaaacgccacatctgctgcactttcttgaagctcacttccacggagcatagggaatcaggtgatcttggcacttgagccttcactgaatttgctttgaaaagttaccaagtggttctggcatgagaagcattcttgattaattccccaggttggtggtctcttgtatttgccaagaaccagagagagagaccaacagaatggtaaatgttttttgttgttgttgttatttgtttggtttgttttgttttagtgatccttgtagtatgtctttctttagcacttaccggcccaatggcccctgcactccttatcctgcctttatgcaaacttctaactgtccaaagcctcaatagtgaccccatgagaccctatcatttctagtagagccatgcgtttcagacctttctgaagtatcttcttctcatcatgttttaataatgttttcctaacacagaatgttttcctttaaagaaaactggaaaacagagaaaaatgagaaaatatttgccaacatgtagataaaatatttattgctttaatcttaatttttttaagcttaaaaggaagggattaacaaaaagaaaagtgagtgaatgcgtgaataaatgaatggacacaaatgacaaataaatgtttgatttcatctgcttaaggcctgctaagtgattgattggcaaatcttagagaacaattcacatccagatgtttatagctaaaaatatcctaatatattttctctgagagatacaaaaagaattctgagacttgtgataatatttgcatgtcagtggagctcttagtccccttaacatcacatcaggattgtccactctgttttattggcttaaatgtccagaacatggcccagagaagagcctgtgacatttatcttctgtattcaatcccacttcatctgcaagatcatagttgggaagactgtaggttgccccagagtaaggaaggatatacaaactacaatgaatgtgcctagtaatatttctcacattcattccaggatatacaaactacaatgaatgtgcctagtaatatttctcacattcattccaggatgacacaaaaaggttcattaccagatgtgcaatgcaaagacaagtgctttgtgaaggtggaagagaatagctaggagtcatgtagaagaaaggaagcggcaatggggtgggttaagaattagagcaacatagatatcctataaaatggaatatgtgaagaaggtataagtgaacccaaagaagggtgcaaagatacaagaatgaggaaggttggtcaacagccacttttctggactagtctgtcttccagtgcttctctttgccactgtttggagggcttgtgcaggtggtggcaggaccttcaatttgcagacctgtgttaggtaggacagaattggattagccacttagtgacattaatttattgaacaaagtgagtcagaaaattgaaagttcatcttaatcctttaacctcctttcctgggacacctggattcattcacctatttcattaaagcataagtgtatggtacttacatgtgtcatgctctgtattaaagcctatgggaaaagcaaggataaatgttgctcttctgcctgtaggtggctaacaatcctcattgaaaaaggcagaaatgcccaagaaacctatgcagggcactatcggctgtatacacaagtgcagaaaaacaatgatagagaagccctgcagaggtagagatatcttcaaactgggggatctgcaaagtcgtcagagtggtggggttgaagccttgactctggcagatgggaaggaattctgactgggtctgaccattggaccatgaaatgtctgaaacacctgcttcctatcctcgggaggtgactaactcagctcaaggcctcttgactacacaggctttcaaacctccagcagatgaacacagaagatgaagtggctgagatgaagcctgcttttctcctgtcagaaaaaaaaaaaaagtttccattctgtcagtaggcagagagggaatgagagagcaaattctagtcaaaaaatgacaattggtttctgtttacacatatgtgctgagggttgttttcaaatcaaacttctgtaatctatcctcagctgttgtggtttatggcattgatgagtaagagcttcttttggaaggaaaagaaatataatgcacaggagggatcttgaaatgtattttgggacagaaccacatttcctgaacatgtttaaagtgtgaccttttctaatctttaaaagtaagataactttttgaagattaatatgttatgagtataaaataaccctctggtaatgctgtgtgtgaatggcaggaatatttttttccaagaccctttcgcttccgttccgataatgtctctaggaccaagaatggtttcttgttcatcctttctaccaaaagtccaggatatggctcagagggtggtgcaagttcagtagattcttgttctgggctcctttgtggatgttgatgaacttctatgtgtatgaaaattggtttgcttattttatcagtcttctaattggatttgcattgcattggatctcactcaacaaatttgctttaaaactgaatattatattaaaacctaccatgtattaggcactcactgtgtatcaggtagtatgctaagtattgtactgcttaatttccacaatcaccgttcgtgctgggagctattagtaccagtttccagatgatgcatttgtctgttccccagagcagggatcagaaccagcacctttctaactctaaagttcaagctcacaaccagtaagccatattgcctcacgtactccttctcaaccatatcccttcttccctaagggacaaagttcgtaggggaagcacaagtgctagagaggaaaagccatgggtattttagatatatttagtgcttttatcaaataagtagggcatggtttttctcccaatatttcctgagttaaattatagatgttttgagccacatagagcgatgttagtggtagagctaaatcaggctttggcttctaatccagccctccaactaggcaacaggatctgcctagatcctaattaagaaagtgccacattttttctaaattgtgcaaagcccttattgagttacctctgccagttcacaatgggagaactgatggttggggaaattggaagtcctgatacagattatctgcatggggttcagacgatgccagtcagtgggtaacttccttctacgtatcaaacccaagattattgccaaagtatcttatttatgttatatttctttctatttttttccattcattttttattatctctcctgatttccttttcttttttattttctttttatttgtttaatttcatgggggtacaagtataattttgttacatgcatagatggcatactggtcaaatcagggctttagggtatacattgcctgaataatgtacattgtacccattaagtaatttctaatcatccatttttttcctaccatttgatggatagtgctgataagtttagatatttcctgtattagaaagttaataggctccactagcttaggcataacatttataagctatgttacaaaataatacactggcaaaactcatgtagttctgatgttacttgtcaattttctcctaaggaggtattaatgaaacacatagttgggtgtggctaaactggtgtccctcttctctttctgcttctgtcatcctcagatagatccctgagtgtcacggggctctaagtctcatgatgatccatgtctccttgcgttagactggttccctacctaaaccagagccattgctcaaattgcagagtttcagttggtgtctgaggtgatttcaaggttggtgctaccatgcaaagatggctggctacaagtatgccatgtgctatcagcacgttctatgtcccactacacatgcatttatacactgggaacgttatgactatactgcacagccagtagaaaattggcaacctccattgccaatatctgtaaaaatgcttgcttgtgactacagtcagcagggtttcgtaggccttcctgaagttgaataagaaaagaaaagtaaaacattttgggacttggaggattcttcccaccctcattcattgggatcccaggaaaaaaagcaaagtgtttggaggcaaactgagtttaaattccagctccactcatagaaattatgtgactttggcttgtggtgtattaagttctcatacataataggaagacaatacctacctcccatggttgttgaaagaatttaatgagtgtttattgcctatgcacatacattacagtcaataaatataatattctctgtcatctttgtggttttctaattcctgatatcaagtgttaccctaaacattaggctcaagatctcactgttgttatctcagtgaggttcttcaactcacacagaagcacatagcaatttctatttctaaggctcaccttagagatcatctaggattagatttgagtttatgactaaaatgttgtagttttgaaacagctttcaacaagcagcctgtaccagcctgatcaaagcacttgtgccttatgatggtggtgaaaagctgtgtcctccaccctatcatctccacggcaatgagaacataatgaaggtggctgattgtgcatgaatcattccttactaaagtcagctgtagtgccagaatttttttttttttttttggcatcgcttactccaacttgacagcttgagctaaagctctaccccatttgacatctttgagaatcttccttttccctttgtaaacttaaacatacgtggtcgtggtgtaaggacccagtgggcacaagagttatatctagaaaactgtgtgatgaccagttttatctacactgaaaaagagtctatgttttcccagaaataaacccccaaagaaagtggacagatttgcaaacaaatcaataatcaccccagcaaccaccgacaaaaacctacaaggcaaatatctgtttaataggcctgatattgcctaacatacactgatagttctgagaagagaattaattctgtttgatctgctttagttagtctttgtagaggataccttgttgccagcatgtaaataggtgaggatttacaaacagcttggtcattgtgcaattttatattactttttcaaatggcatgtggaatgtggcattattttttgttatcagagaaattgaatttgaagattagtaactatctgtgattataataacaaaaaatccattttggttaaaaataataataacgattcattgaatacttacaaggtttcaagcactattcttaattcttggtatactttatctcccaaatcctgacaatagttctatgacgtaggtgctgtttttaatttgcatttttatagagacaaaaactgaggtttaaaagttatataacatgttcaagatcatagaacaacttaatggtgaagtaagtactgtaatccagatccaatctccaagtctacattcttagccctttcactaagtacttactactggaagggaaattagagatgaactaatatcacctgctcattgtcatgaagataaaactgaagtccaaagagctgaagtgatttgtccaaagtcacatagctacctagtgccaaatccagaattagaactgagatctgctaatgttcgttaagatcaatatatccctttcccctgcactacatccagggttatttctctctgttaactctatgatcactttttgagaattttttttaaaatcttttaagaaggaaggaagagaaggaaaaaggaggatatggaaggaaggaaagagaaaaaagaaagttgaaattcagatttggatcagttatacccaacaagatgtcaggtttgcacagtggagggtctgagtctgagcctcatgacaaagcagagggtgtgcgactgcagatattgaagacaaatatactcccaatctaaaggatcatctgtttttaggatgattcctcttgtaaggaaagatgttggcacttgtcagccagtacctataaggccccctgaaggtgattttcttactcccatcatgataaattcactctgtttcaatcagggtgtgcagggtccaaggccaagttcttttcctcttttcaaagttcagtgccttcttcctcatagaaatcagagaatgaggtaaactaactttcttttcttcctttcttccttccttccttcctttcttccttccttccttccttccttccttccttccttccttccttccttccttccttccttggcacatcttttgaaacactcaaagtattatctcacgcagctgatctggagccaaaaggcaagcactccaccaaagtagctcttgttcaacaaagtcacgtctctaggaccaaattgtcttggcttcgtggctcatgtgtttattccccttggcctggcattttgaatgctactgtccttatcaatctctttaaaaaatcttcttgcatttctgttttatcttctctctctgcagccccttctttctcccttagttctacttccactaaaattgcctctctacatgcatattgatcagctttctgatttctttccctgagaatattcattgctgtcctgcttaatgacaggttggtgagcagaattatgtttaattcaagccattttcaccaacctgttctttgactcttttacatgaagccttcagagagtgtgtctactccgttagtacaagaaaagtagaaagaaatgtctgcccttgtgtcataataagattaagtaaaaatgtaacaaatgtgtttgtcctaattaagaggatacaacatcatagaaaaaaaggtcttaggcagacctacaaggagatacatttgacttggagaagatttgtgttttaatatgtaccatcgaaacccaacaacaataacttgtacacctgcttttagagtttaatggataatttaatcaaatgtggttttaattgtaccatttactgatataaattattattgtcatcattagccatattgttaccaaactatttcaggatctaaacttggtactaggcattttgtgtgagacagagcaagccatggaaatttattataatttttaaaatctttatttcactgaaataaatcaccagacaaactaacaggaggcccttgctcttcaatcagcaggtatgttattaatccaactgtattttctctaacccctggaaacactggtgaaatgcaaagcatataattaacactgtggctagtaaagctattaatatatatataatagaagtaatagactgcctttaaaatacccagcggctgaacttctcatgttgcagaacagaaaaatatgcacgtggatgaatacttttatccaatcatttcctgccatccccaactcctaccctctctttcgcactttacttctgctatctaaacatccccttgcctttctaagatctacgtacagttatacaacacaaaagtgactaatttttactgatgtccataactgtctttgaggcccatttattgagtgtctgttaagtactaggtactgcgctaagcattttaagcacagtatctcatttagtctactcatcaacctatatattaggtgttactatcactaatttacaataaggaaactgaggctcaggcaagttgtataaattgcatcgaagtacacagctggtaggtgacaaagctgagattcacactgaggcatgtgtgagtgtctttctgctaatagacattacccttgaattttctgaaaaaaacaaaaacatctgctgctttttaggatgctaaagcactctttacgtttgatgttagagtgataagagcatattaatgacttttcaccatctaacttttttttgacttaatttatttggctgtgtgaacgttttctatgtaatcagatgaatttgtcatgggcccctttgattttatttgtttctgtatctgaaaaacaaatagcaacaaggcttctctcacctgtttcaatcaactaagcctaatctaaagcagaaaatggccatgttcttaaatctctcctttgagaatattgtcattccatcagaataacactcatccaaacaaagctccattataacaaatcttaatttctatccaactcaaagaaacattcctttattaccagtaacagtcatagatatgctgggaattctaaagtaattaaaacctggctcctccttttaagaagcttatagagaaggaaaagcagattttgctctaacaagtcaagaggtgggtaaggtattggggctacagagaaataatggcttttgagctggtcatgggaggatcaacaggatttgagaggtggataaggtataagaatatttaaagtaggagaaagatacaagctgtacagagcataaagcagattttagcagagaataaagtatatgcaaaatatttgtggaagagaagttgtactgaaaaggtgagctaggatcaaactgagcctgaagagcttttagagctcccaagagacacccaatctacattctcttggtagcagagagcctagggagggttttagacgtgaaagtaataagaatacatctcttagaaacataactctgacagtcaagtgaaaggcaaatgaaaatgaagggaaactgaagatggcagcttatcaggagggtgctgcaatggttcaggtaaatgaggatgtatttctggaccaaggcaacggtggtgagggagaaaaaaaaagatgtgaatgcaacatacttttacagtacaagaaaaaatgcattggttaattggatgtgaggtgtagggataaggaagagtcaagtgtgactcggaggttcttgcctaaggcagccaagtagcagatgattctgtttgctagggaagggaaagcttgggacagtgatgagcctggtagatgatgaatgtgctggggtgctttgggtttgtggtaggaatctatggaggatgatagtaaaaatactcattaattctcatttcttacatacatacaaatgacaaagaggagctgtgcaaaaccgctgtggaataagccagtttatgtttgtagtgtactagttatatggcatttccaatagggaatttcctattgaagtgaaacacagttgtttaggaagaaataaatgctgaaataatgcacatagtgaattcagggatggagaaaacactctcaaataatttttttaactaagaaaattccaggcagcacctaaaagcatgattgctttcactagacactttaaattactgtctataaaacttcttgatcctcttttaatgcccaaaccttttagaggaatttacaaactctttatttttggcttctcagaatgagtggtttaggttcaccccacaaaactggagggattagcccatcaaaagatggacacatatggaaaggtacttccacttgcccttaatacccttcacagtgatcctcaaagtgtggttcttggaccagcagtaccatcatcaccagagaacttgttagaaatgtaaatccttggacactcacccaaatatactgaatcaagaatgctggagttgggacccagcaagctgcacttttacaagtcctctaggtgatttggaggcttgctacatttgtgaatcactgctctagtcccggaggtaaagattgatgaaaaaaaataagaaaagcaataataataaagaaagaagagaacatttagaaaaaaaaagatcagcattcactttctctttgaataagtgaatgaacattccttgggggtgtaatagttaggctcctatccctttcaatacaacatatatttgtcgagaatccaattagtgccacggactgtgctaagtgtagcatattcaaaaggggaaaaattctgtggattttctgtgttctcaaaagaagaagaaaaaaatgaagaaaaagaaaaaagtattgttcgtcttaaaggtaaataatatgttgtgcttttgaagaattagatgggcttggctgtttatggttccaatgccagatgaaatgctcagtgaacacccctgcaacaagtacagtgaagggtcgtagctccactcagcctggccatgcatcctaaattccgaggccacaaatgttccagagacactagccttttttcacgaggcataatcaccacttatcaagtgtctcaccaataagcttcatgtaacagaaatgtcaagccccatttgattcatcttgcactgcccattctctctgaaggggatggctttcaggccctccatccatctcgcctgatgatcccttggagctcaactagagaaatcatccctcagactctgacacctttgaaacccaagagcatttcagtaaagcatcggaaatgtcagaactccctctgctgattcttcttcctcctattttatctctagcacacactttgctgcactgtttgccacttttatcttctttccctgatggcttttatatattttttggtcttgttcaagctttgaaatcactgctgctcctttttgtcgcccctcatcactagctccctgggtttcattgaccactgcttatctccaccgtgttgcacgtgtcttgttggttatttaataatgcatggctctcatgatcaggagtggagaggctcaggtctcaggtctggctactgaaactggaggtttttcctgctgacttgggtctcctttgatgtacgaggacatttgcagctcagcggcggattggtagcttctttgatgtgctcttcttattctgatttgatgtatgttatattccttttatgttcaagagggaccaaataaaggaatgtccctcctgcttctcacatctaatttttgcctaagcaccctctgttgctcttcgtgcaagggagtggttcttttgacagtgtataatataattttattaaagaaaaacaaataatatcagacaggatgaatgtcatcatttatgaggtcttaggcagctctttatctctctcctttgcttcatgttgcatttgcataaatggttctttaattcaaggagaattggctgcggataaatacaagtcaaacttgaaaggagtttaatacttgataatcacttatggacattgcgattaaatacactatcactcttttatgtttaagctacatagcctaaactgagtactacgagtggatttatcttgaagcctgcagtgtgcaggagtgccgcctgagctcacctgtggcttatactggcccagatattgccttctctggagagttgatagagggaaattggcaaacggtaattctgtcctgtgcttccatctttcagtttccctctgcactctaacatctggcctttcatggggacataagcaaataaataaaacaacaaagaatctgaagagtgtcacaaatttatttattttttactaatctttattagaacatcaaatgagattattcttgttaatgaagtttatggatgatgtgagcattatattcatttttaatatccctgaaattatttaaccaggtatttgagagctgtatatttaggaaactaaatagaaaatctattaattagggttaatttgcgatcagtaatattttaaaattaaacccacttgtgttcattgaaaactttgggtggaaggggtttcaatttcaaaatcatgtttgaatttattaatttatatttgtttacagtactcacattgctttcatatccattcgttcatttgaatatcatttgggtgagaaagacagaatggttattattagtgctatattacagatgaggtaatgaaggctcaaagatcagtatattctgggactagagttttgagctaattcagtgctctttataatacatcaagtccaattttgtacctcttgcaatacacaacaatttggcaaataatgaattgttttttatatacactaaaaattggttagtcatcatgacagaaacacataatgggaaccatgtatgaattctaacacttacattagaagtatgtatttgttgtagttgatgaaaaaacaaagttataaagatattgtagtatacatcaagaggttattggtaatctattctttaaatgtaactctggattcccctttttaaatctgattatttcattttgttatcaataataattaacgcttttatacatgggaagtcctatttttgtcttattcaacactatgaatcaagtaggtttcttgcaaattttaggattcatcttttaataataattacatgcagagactcaagtgttgtctggtttccctgtgatatagaccataagagttgaacctaagaatgtcagtcataagaccatggtggttaaaaaaatcacacatgtaggtccaagggaaaaaagtgccatgtaagcagtagttcctaatcaaatgtgtggtgtaaagccatttcaattattgattagcaggctttcttgcataatcagagaatattcaaaaatccttagaaggggttgaatagttatgtaatccatattgtaatcaatgcataaaagtgtttatttctctaaaactgtaatccttggatttacctatgtagttagctggctataattagatatactttacaccactggtgtaaagagaaaaattttgctttcctgggtacatttggcaatgtctagagatatttttggtcaccacaactaggggttgcttctggcatatcatggatagagaccaaacatgctactaaacatcttacaacacacagggcagccccctgcacctaaggattacctggcccaaaatgctaagagtgcccaaaaatgtcaataatgcccactttgagaaaccctgattgagataaaatgttaaattgctacaattatccataaaattcaacttcctacaaaactatttttgagaaaatatactgataaaacagtggtgatatgctgcataaactatttttggtaattaaatttgttctccatttcacttttgcttatgtgtcaatgctaataaaccagcagtttttaatttttcttttttttttttaaaccagagaccctttggaaatgcaaaatagtttagggtacttggaaccatttggttattatttgctatttcctagatgtatcactataaatttctcttcaagattatgcccttttattttattaacactgttacatactagacacctagtcactgccccacacctccccacgcccgtccctctggaggcctccctgattctgcagtttcgataacattgtctgtacccccagaccacagcatatattcctcataccagtaaatctttgttgtacacatatgtcctgtagattgcaatgtttgcttttatttttacctttcttgcgagtaatcatagtgcctcactagggctaggtgattcggttatctcatagttttctattcaaatcctaggctgtttccagacttgagtttgtctctctggtatcattagcttcttcgcatgtgggccctcacattctggcccaaagaggccagtaaaaatgctggtgccttttcaatcccctctctaatctgctcatcttcctgcctggataacctgtcaggcctttgccatttataatatttatccttcagcagttttccctgttcccttgttgattgcttttctgcaccaagaaactcccagtccctcttgcctgtgtgtgtgtgtgcacgtgtgtgtgtgctaaatagatctgtcttccttcagcagcctcccttgtaccccacttagcccttctctatttcataatggccttttccatgggtggggtatgtagtaagatctccatatctcccgtctgcctggctgtggctgcctcctcgtcagagcctcgggtggatgggaccacacacacgctaatgctctctaatccctgcagctttgtcactttcaggactgctcagatgctcacccagctctgactggtttctcatcaccctcttgaagggttgagctgtctttcccatttatctcaacggtgatagtgacagcaatccaccttcctggcctttcctcctgggccacctgttaggctgccagccgcccttgagattgatatttgccatttctgccgccaggtttgttctggcctctgtgggcatgttcactaagaggcacatcagtctcgctgccccgtgttggggcaggaaactccattatagactctcagttgatcactgttcttctgcttcttccctgcatcagtttctatctgtgagtgacggagcacctgcccagggggagatctcaggaagtcccatctccaatcaaatatacacaatcctgcccgctgaaccaaacaggccttctaaacgatcagatgacccatggcaaccatctccccagtaggacattgtctctattcttcctctacccattcagcccggagttctccggaaactctgggatgcctatcacacacggatccctctgcccctcagatcttagttttaattcaaccactgattctctcttacccactcagagggctagacccgaaaagagaaaacacaaggactgtttttgaaatacgtggacatgagtgtcacaaagttcatctggactaaggagagaaggaaagagctaggggaaacccccaagtaatatatgtgactattttttatagtggcttctggaaagcctgctcccatgtttacgacttcactgaaataaatgattctggtcatgtgcattttgagacagacattagtggcaaaccttgtcatgaatgactcctggatgctagggaacaaaagggccctttatgcagttctacatgacgctctccattcttgccactcaacatgctgctcatgctttgtggcattagcatcacctggaaagcttgttacatatgcgatcctgggacccacctcactatctcggacctaccaacttaccatctccattgtaacaagatttccaggggcttcctatgtacattaaaatatggaatattctgctctttcttttactgtattaaattctcagaactggctgggcatggtggctcacacctgtaattccagcactttaggaggctgaggtgggtggatcacctggggccaggagttcgagaacagcctgccaacatggcaaaaccccatctctactaaaaactacaaacaaacaaacaaaaatcagctaggcatggtggtacgcaccagtagtccctgctactcaggaggctgaggcacaagaatcacttgaactcaagaagtaggggtttcagtgagccgagatcatgccactgaactccagcctgggtgacagagcaagactctgcctcaaaaaaatgaaaacaaaaattatcagaacaaccttctgagataattattaaatttcccattttatagatggagaaactgatcctctgaatggtgaagaagtttgcctagtgttactggaaattgatccctcctgtaaaggctaaatcttacttttcttcttttaactatggaccactactgtataggtattcacaatgaagtaggcattactttttaaaatataattttaaatattagaaagaaaaatgttccagtctcattaagatggcaaattgccaaatggggaagacatctccatgggagatagggctctgaaacatccagctgagcagaggcatgaagagagagtgcatcctgcctgatgtggagggttcagggtagtttatagtcatgtggcagaaagaggacacactggggctctccacaggctggcagtcttggcaatccaaagatggtcacagcaagataaattatgtgttaaggagataattactatggcctttcctctgaacagcagctggaaataggctgaaacagatggagccagaaatagtgaaaaggttgaggggcaacctcaaaagagagacagatgtcctcaaaggaccagtttaaataagaagagcctctggatggttaaagataggggcgcatattctgcagataggattgtacaggtcttttaattctccctctaactagagttttattgttgtaagaggaaagaagaaatgaatcaatgaggtttattttaaaattgtatttttgttgacatatcacaggggattgatttacatggttttttatgcttatcccacttgtctcttcccaggcaaaatttaaccactaggtcttggctatatggaacaggaaccactgtccacctatattcaagaagagttaaaatttagaacatcttcttcctctttcctttacagtggcagtaaatactatggtgcctccagaaatcactcagcttaagaggttatctatttcgattttcacctggtgagttttgaatgggtatttagatgccaaattttaagcttgactatccctattcactccttttcacaaatattagtattaagagccaatggaaaaatgaaggctttcaggtagaacagcaatacagatagattcactgattagatgccactgttattgctgctaaccattcccagtttcaaaaaacagatcccaggggccagagtttcttactgattggcagcttgctccccatcctcccattcaatatacacacacaattttcaccactccactgggttctcaactgggttctcgacatctgcagtgttgtagatgggcaattgtaactttgagatgtgcaaaagcattttgaaaatcaaggaattctgtcactctggtcggtctcctggctttaatcaagaacatcctaaagcactatttctctatgtggtgtttcaacagatgttatgttgggttactaagagtgctgtaaaatggagagtttcagttctattgacccacctggaaccatgaaagaagtttattaatttttcacattaacatagtctacttagctcatagagtatcttcccattgggaaattctgcaaaattttatcactaattgttccaaacaaaagttttaaaattatgtgaaagtagaatcttttaaaagttatatttgagcacttatataaacaagaaactctttaaaaaccaattctttatatagcttgagacataaattaaaatacttttttcacatctaaatagaatgaggctaccataataaagcagtgctatgtatgtacttggcactcaagattttcaagtggcatcactatttcattattatcttgcatactctaccactaggcacagcagacaatctaccactaaaattccttgagttgtgttatgcaataagagggctatgggggtacatttaggtaaattacttatagtcgtgactgaacagcagagaattgaagggaccagcaatttccacctttctgaagctaggaagacttgaaaagatcaatcaaaggcatatgaatagtggccaaacactttgcctcttctttttagcaaagggaataatgaattttctctatacttactgagctcctgttttttctaccaagtgtgggagaaaaaaaggtaaattcgaaattaatacacgttttcctccaggtttggtttatgaaagtgcagcaggaaaaaagcatggtaaacataccactgttaatattttggaagatatgttttgtgtgtgtgtgtgtgtgtgtgtgtgtgtgtgtgtgtagtttggtttccctaatcacagaaaaaaatacaggtaatctcttactacagtgatctagtagtataggttgagagtacacatcaataagaaaacttaagtttaagtgaagaagtatactacccacactgcaggaacacattagctgtagtttcacttttggcatggaacctgactccctaatttcttatggcttcacactctggtttgtatatatattagggtgagaaatggccttagggtgaggcatctggaccattgctgaccttgcctctgtgctcccagttccctcattagtaactccagagataagatactgaagcgccctgttaaaaagtatgaaaggattgaggttgtgggagaggcttaggtgttgacattttatgataacgaggtttgtttaagttttgacacagattaattcaacctgttaaatagcagacctcttagggacatgacctaggacaggatccttcaacagagagagacatttgtcatctttgtatcagcagaatctaacagagctatcaataaatatttacctagtgaataaatatttgtttagttaataaagaaacagagaggatggatactccatttaccataatgcgagtattacgcattgcatgcctgtatcaaagtatcttatgtacctcataaatatacacacctactatgtacccacaaaaattaaaaataaaaaaatgaataaatgatgaaaaggtataaggaaataaacggggcatagctgttttcccaggaaggaaggcacaacatgcaatgtcactgggacaagtttgcgggtcagggcacgagcagtgttcaggaataggggttggatttaagagaggagaatgtgacaaagaagagtggaataagaaccagagtttgctctttcccatgtgctgtttccagccctgctaagagcagaattctcagtagaccccaatttgaagcgcataccccttccatcgcagtgccattcatcagggccagttacaaaggatgggatcttcaagagaattccatctgagtaatctgcactctcacttgaaaaaaatctctcctgagacagaattcatgctcacgtgcttcagaatacaaatccacaaggatggttcttagaagcttggcaagactctcttgagtttctttttatcattttttctttttgtttttaataagtgagctcaatatttatagtacttccatagccatttatttcaggtgtgtgaaaggggctgtttgcctgcccactgagggtgaattatagggatgacatttaatggtgcaacttcttctgctcagtgccctcaacaatggagagatgagttgaaagggagtgatattgcatagtaaacagtaaatgcctcacacaatgggaactcatcatttttattttattttatttcttaaacgtaaggtttgaaaaaatagcatgtggtctcttgacattattctaaattgcactgttagaagaacattaactttttcatttcacactttctgagccttaagcaccattgctgtatggggaaatcagtcattttctgatgattcatgtgcagatttgtgccaatcagaattggccataattatgccaagtctcttctttcaaggaagttcattgagggcatagagaaaggaaagcaaaaggagaatcatcctctgtatgtgctctgtgtaaattcacaaaccataaaggtacaagtaatttcatagtgcaatggaaatctactttgaatagactacattgttataaaccacagatactggtacagctatctggggagtcacttgatagggacttaatggcaaatctgtgggtacatttgtctttttcaagtttgccttgaggctatggacataagaaaatagtcaataatatctttctatgattaacttcctatgaaaatcactgagaatttggaatcactgatttttatcacagattctagagtagctgaagttatgagagatgttcatttgtctgagaccatttattttaagaaacagcaattcttacagcatgatactgaatcaggaatgagactaacaggaggcaggaactccacaaaaatgagatgagtggctgagatattagaagtgagaaatgtttatattgatttttgcgtgaaaaagagtccgatatctgttttattctcccctgcttctcaagattccctttcctcaaagtctatgaagtgttgttatggatttgttgttatttattttatttttaccttatttttagtctgaagtacattattgttttaaatcctatcaccataaaaataaaaaagggacacaattattttccttggaacattcctctgccttttctctcctattcaaagagcttactgttgaatttttaaacactagcattttcatcttcttcagcctgacagagtcattttgggaaatttgtgtctatagaggtattttctagtaaggtttgatttgattactgaccttttttaaccttaaaggtacaaaagaaagtacttcaagcacctaagggactctgccaactaatagcaaacaaaagttcaagatgggtcaggtcccacaaaggaaaattaaatgtattattctcacacaacaagattagcaaatcatccataaacccagccactcttttcttctttttattctaatgagtttagtgtgcaataatgatgatacaggcttcatcagaattctgccagtgaaggggaatttgcaaactctgtttgcaaatgagatgtgcaccataaaccatagtcatccatcatagagaagtagcttgtgcctgataaaaggctgttggggctgagtcaatcaaatgagcattattagagcttggtattatactgtcctttaggtgatggagaaggaatgtaatacagttatggaatgtgatttttttatgcctctgtcccttttggaagactaaactctattctaacatgaacatctcagagtgacattcataatctatgttataaaaagagaccttctctaatttctcatctgtcaagaacagttagaactgtgtagagttttcatgatatagctaacaccatgaagaaatggtcctgtaactaaaattacagctcatacttgttgattattaatgaaaggtagactgagcacttgtgtcaattaaatgaagaccaatgaagatgataacttctaatgtcctttgatcatgattaaaaataataattataacaataagattttgagcttataggttacttagacaccatctgatgtagtggatttctaacttttatttagtattggagcccatttttcaaccaaacatcatatggcaccaggacatacaaaatgatcaaggtgtaggagttctttagaaagaggcaagggctttctcactctttcttagctttccccagtcaccctccttgatggacatctctgatattttgaaacacattgatgtaactcatttttctaaaatttacagattgagaaaataatatgccaaaacatttgtagattttaataaggctgcagaacttactaattacaaagcaaatataaagatccagacatctttacttccacacagatgctttccctactgtgcagagctccgccattaccttgctctacatcgggtcagaaagccaatgtctgcaggggccaggcagtcatggggatcaggggtaaagcaggtggtaagctgcaaagctccaacccccacatgaagagaacagctgtcacagtttcaggggatgcttctcatgaggaaaatagggcccaagattccttaactttctttctattttttttttttagcagaagttgaaaaatcagaacttcagtgtaacaatggtaataattaaaaactttaagtgaataataataactactatactgatgaaacaaaacatatctacaagacaaattcagccaacaccactggtcactataaatactgatgttgagttcaatattgtgatgttgttataagaaatattaaaattcaaacatccctgtaattagattcattggatgtgcccaataattattcttatgaacaattagtaacaagtcctcattaattttttaaataaatattgaggagcccctaagcactaagctctgctgtatagaaaggtcatattcccagacctttgagaacacataatctattgaagagagacaagcatacaagtgatatttgtaagaaggtgaactgagctaaaatagaggagaaatgatggtgtttgtgggactaccaacaacagtaaaaaatatttgcataactctgctcgataaagactctccttggggagtcatgaagaatgcataggagtttcccagacaggtgagaaaggggacattctaggcagaaagaacaacacacatacaagaaaggagctgaggaaaaatcatgtcttgatcaaggaactgcaagtaatgaggcatggctagagggcagagaggatggagaaagggaagaagagagagaggcagctggacatgtagacaaaagctagtcaatgaaatattataaaatatatgctaacaagttaggactttattgtgtagctgctaagatgatatttaaagattgtaaatgggtgaagtcatcccatttttattctagaatgatgattcagatgacatgtatgagttagagacagagacgggagaaagaagaaccagttcttgaaatagctcaggttatcattgatgagggctgcaaaggtgttgagattggaggaatgaaagagataactttgaggcagtagatttatagaatctggctgctgattggctgagaggaaaaggaaagtattaaggataacagatgcccgggatttctgtctcaagaacctggactgactgtgacccatttaaccaagggggagactgaggaagtggtaggtgctggctgcagcctagaaaggctgtggaatggggctacctgaaccaggtctggaagggctgtcagaacaccttggtgtatgcagttcctggcctgcagaattcacctctaaaatgaggtgtttccctaatttcctccagcacatttcaaatataaactaaaacatgaccttgaaaatccagaaatctaaatatgaatgaaaaaactactaatcttattagaaatagcccactcactggaagacttctacgtcaagaagcttaaaatcagctgaatttattttttttagcaaacacattctagtgctaaaaacaaacaatagtaaagccaataaatgcctgccaaatatgaccagtagtatttctcagctggtttaatgagcactgagctagaaggtcgagacaaaagcacacaagaatctctttttttcaataatacaaatttaacatgtttggcattttattttgcatttgaatatggaatagctgactttagtttatagcaggagggaaaggttaaaagatttgttttcctcctgctttggcctagagtagtattaaaccacattctcctgtgatctattgtttagaaatctaatttttttttcttctcaagaatgtattcggagtaatcatctcaaaatatcattgaaacccttcaggtaggccattaaactcagtggcagagtgaccagagagagagagcgcttgactacctatattttcaaattaaatccaaacctcaagtatggtgaaaagcaaatatagtcattctggtcatcaattcagcaattacagacacacagtggatcactatataattcaaaaatcatgtgtctcaatgaggtctgtggttattttctatgttaggtactaatttcttttaatttacaaaagcaatgcatttttcttttttaacagtctagtgggggtgggacatgcaaggtggaaacaaacacaggagctattgaacatccataataagggcattattaggagaataaaaggagagggaagaaaaacaatcaacctgaaaacttagtacaattcctaaatagtaattcctttcaagagaatttatggatcttgataactagcaagtggcagcacgctccattcaacataaaagtaatagcaactaataataataataatttccaatgaaagcagtggttaccacagcctctgatttaaaatgtaggttttggaacagcaggcgtattaccaatgatatttgattttccaagaggattatccataaagaatcctgcagctgcacttatttacctgtctcttcatagcatcattatgcagacagggatactgagaaaaacactgtaacaaaatttaagcgactgcataattctttctaaatacacccactttatatattcacatatattgtgtgctcttcaaatgcaaattttaagtgttgtttatctgttacttctctgcttgggtctctgtgtgtagtctttccttaaggtagtaatatattcagatgttcagtttctctaacacaaaacgaattttgaatatgtaagctggggatttttcaatgaagtgacaggacaaaagagacccagacaaactgatgctttccttgggaattaattaagattcagagtagccctcaaatatttataccaaactcttcattttttaataagtggcccctagtgtgggaatctagcattgctggtcttttgggggaaggtagcgttcacagatagtaactcttgaatcttctacattcgaaggatggagaaaccacagcatgcaaactccttaccagttttttgtttgtttgtttgtttgttgtttgttttttgagacggagtctcgctcgctctgtcgcccaggctagagtgcagtggcgggatctcggctcactgcaagctccgcctcccgggttcacgtcattctcctgcctcagcctctctgagtagctgggactacaggcgcccgccaccgcaccccgctaattcttttgtatttttagtagagacggggtttcaccgtggtctcgatctgctgacctcctgatcctcccgcctcggtctcccaaagtgctgggattacaagcgtaagccaccgtgcccggcctccttaccaggtttttaacttcaaaatctactttgcctgtacatggcaggttgttgttcattttaacctcgattaataaggaaagaagacaataaattttaggatgtttgaaattctgtatttgcttatctacaagctatgtgatcctccaagtccaaaatgccaagcaaactgggaacactgatagaagtatcgccatctttcttcttttcctggcttcaataacttcatcaactacttctctagatcatatcagatttttcattgactttggccttatgggtttttgacccttctatataaatgcattggaattgctttactctttagcagataatcctaaagaatacttttatagggcttcatcatgtgagtgtgacattacagtctactttgtgtttggattatgggtcttcatgtatcaatggtaatgtcatctggcattctccttctagccactacctttggtattgatgttactgtgatgatttgcacatgagtgccacagagttatttttgtgtgtgtgtattgctgccattgagatgaagagagtgatggaaccaactcaccagaccccctgggactcctgatccccttagtggttccttttgaggcaagttgaacagaaccttgtctccagttttaaatcttgggtttatattacattcggcataatgcccagagagacatttcaattcaattgattgatttttatgttacattctcaggagtactgtttgccagttttcatcctcagtcctgtctgagcagttctgtggagagttatactcttccacagtaatatcctcagaacaattttgaaacaattcttttctccatattcttaaacagacatcaaagactttagtcctcttgtgaaaacacaatatttcttacagataagacacaaggcacatcttagtctgcctaagggtttcaaaacaagaaaatatggcaccttcatgataaagataaccccccgtcttagtcgataatactctcactctgctaaccatttgatatggttatcaaacagtatcttcaacaagtagccagtgctaaagatagtgagggatcaaagaggtgtaagatagcttttgccttcaataaatcatcatagttgggaagactgggtatacaatttaaagtattactgtaaataaaggtcagcatgtgttaagtgcccacagtgcagtggcagatgacagttactatacaggttgagaaacatgggacagaagtgtgactgaccttggtgactggaacaggcttcacagagggagatgctactcacttggatacccaaggataggctgctcaacttcaccagaatggaggtgtgctagtctgttctcgaactgctataaataaatacctgagactgggtaatttataaagaaaagagatgtaataggctcatggttctacaggctgttcaggaagcatgatggcatctgctcagcttctgggaaggcctcaggaagtttacaatcatggtgggaggtaaagggggagcaggcacctcacacaaccagagcagcagtgagacagagagtggggaggtgccacactcttttaaacaagtagatctcatgagaactcactcactattgagaggatagtaccaaggggatagcactgaatcattcataagaaatccacccccaagatccagtcacctcccacgaggccccacctccaacactggggattatattccaacatgagatttgatggggacaccgaaccaagccatatcaggagagtattggagtctggagaatggtgagatattctagtccaggggtccacaaccccagggccacaaactggtactggtctgtggcctgttaggaaccgggccgcacagcaggaggggagtggtaggtgagcatttctgcttgagctccacctcctgtcagatcagcagaggcattagattctcataggaacatgaaccctactgtgaactgcacattcgagggatcgacattgtgtgctccttatgagaatctaattcctgacaatatgaggtgaaacagtttcatcccaaaaccatcccctggcccctctgtggaaaaattgtcttccacgaattcggtccctcatgccaaaaaggtcagagactgctgctctagtccaaccttgaagatagaataatgctttggtgaacagagcatacattttgttattagagtagaatgttaatgaaaggaaatactgatagataaatttatagagttttttttttaattattggctaagcattttgaattttttcaagggaaatgagtgcctttgaagacatttaaaggcttttgagacgagaagttttctaagatttatctgcccagaaccgattgaaatggttaggtaggtgggtggtggtggaagagggagagacagatggaaaaacacattttattagagatttacaagtgagatccaagtgctcagatcagtctggtaacagtagaattgagcagacataatccatatacagtttttacttagtggagacccaggtcattctgaatggagtgagtaacactttgtacttttaccttcccagctaatggccataactttcaccctagttgtccctaatggcttgccaaatgtattaaaatgattttggaaaatagtttcgtgggatgtaaggtgaagaaattaacatttgctagtttctttccttagaataatagtcttaatcttagagcttttattagttcattctcatgctgctgataaagacatacccaagattgggcaatttacaaaagaaagaaatgtaatggatttacagttccacctggctggggaagcctcacaatcatgccagaaggcaagaaggagcaagttatgccttacatggatggcaacaggcaaaaaaggagagcttgtgtcaggaaaactccccattataaaaccatcagatcttgtgagaattattcactatcacgagaacagcataggaaagacctgaccccatgattcaattacctcccactgtgtccctcccacaacatgtgagaattcaagatgagatttgggtggagacatagagacaaaccatatcagagccctttgaaaattagacaaaagtatggaatctcccttgcgggggaaaaatacacttatagacaagattgtgaacacagtttcagggatttgcagataccctgaaagatgcatagatgataacttaagagtccttagagcaatatttggtccttaatgatttagtgtaggcaaattctgagttgcagttacagtaaattcaggtagaagtgataacactatagcatttgctcattctgaggaaagggagataacaatgaaacgatgacacttgggctggcaaaactttaaaggaagactggttgggagtgaggttttctttccacttagtgccttatttgtcactcatgtactctgatatggtttgggggtgtccccacccaaatcttacctttaattgtagcctccataattcccatgtgtcatgggagggacctggtggtgggtcttttctcatgctgttctcatgatagtgaataagtctcatgagatctgatggttttataaagggcagttcccctgcacatgcgctcttacctgccaccatgtaagacatccctttgctcttccttcatcttctgccatgattgtgaggcctccccagcaatgcataactttgagtccattaaaccacttttctttataaattacccagtcttgggtatgtctttattagcagcatgagaacagactaatacatactctgatattaatcaagtaagaatttaactgaagggttaatttacaattgggaaaagaaactattatggaagacagaataatttcggaaataagcctgtctcaaaccgagacttaaatgtaatgaaactgcctttggtccatgtaattttcctaagtgatatttcaggaatgttcgccaacagccacttcatttcattatttttatagtaacataggcaggaagtaaccaaggtttgattaaacttgcttatatgaatggaagaggctgaaaagttggtcagggaataattgctgctttcattaataatttagttgggtggctccttgattcatacctttccagtttattcagtaaatgcttattgaacatctactatataccagactttgacctgtagacaaggtaaccatccatgtagtttgttctgggaaggtccagactaatggctattaactctatgcaattattctcaatatcatttttattctcaaaattgtcctgttttgaacaataaattaagtggttattctagctttaggctatttggggaaatgttatctctgggaaaaactgtttggcctgcccaaacgtttcttactcatcagtccaaattacatatgattacttgtagtatttggagtataatacaagcctcaggaagatagaacttcatccattttgttcaccaatatgtctcctgggcctagcttattgttgaaatgtagtagatactcaataaatacattttataaatgaatgaaccatgtaaaatacttcactattggagaaaatggctaccactataggtatccaaaggactaagaatagactatgctctgcaggtcaggcttaacttgaagaaaattaaccaaaaaaatccaaaaaagtatattaataattcaagaaaatgattttattatctgattgtattttagaaatacgatttgaatgtgtttattttggttttgaagtcaatttcttaagtaaatgtaaagatattaaaatgtttgccttggttatgaaaggttaggtgaccagctattgttgaagtaaccatgtagaacattagaatttcactgtgggcatgttgtgaggcagggattaaatatccatgactaagggaattagtgagcaccagacccaaagtatgtctttcctccctcccttctttccagttgtcaggatgttacagtatatagatattatattttgaagaggtgacctagggtatatgagccgtattcttattttacacagaaatacatcaagcttggttatcttgtttcccagcctccagaagattagaagcagaaagttagaaagaaagctgttagagtcaaacagatttatggtaatgggagagattgcacaaccacaaaaaggaggcaagggattcaaaaagcatcatttctgaggccgtttgggaaagagataaagagcctcacacgcccggtagccccagaaagcctcactgtgttaaaccagctcacagcagttgtcagtaatgatggcctcaggcaatcggaaaaggttaaagtaggtttattgtgctctgttcaataagaggacatagtttataatccacttcagtggtgctggtgttttatttaagctcttttggttgcaagtaataggaggaccaaaatacatcctaagagaagtgtgtgggcgtgtgtgtgtatgtatgtgtgtgtgtgtgtgtacctaatgactacaaattgcaagtaaaaaggtataagtggtcaagaactgagtcggctcgtagggctgggtcctgattttgcaggtccctggtgtcttggtttatgtatctctgtttctgtctgagtctgatcccttgttgcagctaggcattacctctttgggctcttctctctaggcctctttttagtttgaacttctgcttctgtcttctctctaggtgattctgataaaattccaagagagataatgtgatttttccagctcatctgttcacactggcaatgtcacggcttgttgattatcctgtgttttacctgctctgaatcagtccttttcctgccccagtttgcagatagagggagtgagtggctttggttatctggcctgattctgataatccactaagcagaagctgcagacaagctgttttcacaaggactcaactaaaggcattgcagatacctaaacaaatccaaaaatagatcaatgttttaaagttttgagatttagttcaatgaggttcagttacctgaaaaatatgctttaggtagaaatacattccattaccattctacaaataaaaccctactctctctatatttcatatcaattcagggttctaataaaatattactaactttattatgcattatgtgtctttttccccaaaattattccgaaagaagttctgtgttcttcctatcctatgttactcacccataagcacatttccattatcgtccttgatattcgagggttggatgtaattgatccatggcctctaccatttcctcctcttctccttattccctactcagacttagcaaaacaggggaagatgcttttacatctggagcagagcatcactgttccaacaatgggtgaacgtgagctgccgttgttgccaatactgggttttgcaataagtgctcagaacagtgattcatgtcacaacatagtacatgcaggaaattatactagtggtccagtacaataagccttagcacatgtgtcacccatttacacacttggttaaaggcatagaatgaattaaataaatgtaggtcagaaatctgttttcaacaaagaaccagggagagaatggcaattcttttatacctcaagagtaaagactaggtgggacacacttataaaacgttagtacaacttgtacagagatcctgattgaggctgtcaatttaagacatctcaggtaattttaatgacaagactagatataaaaacagaattagcattttgaaataaacaacaatggtggcccaattttgggtgcagcactgtgtgtgcatgtgcccagcgaatgtgcatgcattggtgtgtctgtgtacataggcacaggccaccctctccttgtcacagtacacgcaccacctcctctctatcaccaaaacatatagctaccctcaaataaaagagcagctaagctcttgtagaacatgacgtattatatcagcatagatttcagtatttcaaattattcctggaattaattcactaaataacccaggtagtcaaagcacagatccattaggctcggtagaacacattctttaaatgttagtaccatacaatgaatatttgataagtacatcattaataaaccttggtgtgacataattgatatgtggatgtttaatgacaattccaaatgatgtagcacatggcatccactcatccctcaatcatcacgcaggttgcccctgtaccatgcgatgggcacaattggaaaggcaaagtctgatcttcattagtggctacccataaaaggttttcattacaagataaatgattatagcctggctttattaattaagcatgcatttctgcagaccaaagtaattgaataaaatggctagtagcttttaaactacacaaaatcttaacatctcaagaatagattctactttcaatctgtgcctttaaccctctattatttgagaatacatggcaactgaatttaaactgttgccaaatactgactaaatttcacatacgagatttttttcctctaacatcttgctctgtggctgtcatgataaacggatttgtctttcctttcatctaataacctcaaattcatcctgaccctactctcagccttgaggaacataaccccagaatatgtacagattaactatagaagcattggtgcttacagaaatgaaatgacttgttacatcttgaaagagaattagtggctgaagagcaggtcactagaagtcctttattcagttgtcactgaatcacacctaggaaacgacctcatcatccatgctcaagtccttctttattttggggtcaggaaggatgcttcaaacgtgatatacccatgtaacaattccctttctatctctgactgcttcagtgagaaaaataagaattcttagaatatcaattttaaagtaaaaaatatatatctacaccagggaagacattttttgctataatttttttacatatacaatatcttggaataaaagagctctaaaacaaaagcagtaaattttgcaagatcattatgtttctgattgcttggcacataggagctgtgaaagcaaagtttaaaattcatttttactcaatgagaacacacatgacttagtgcccacaaaaaatccctcaggataacttttttaagtagagcaaaatgtatatgtatataatatattctaccatgaagcatctaaaattaattttataagatcagagaatattctggcaatgagacaactttttctccccaattctgctttgaactagttttttttttgtatgatcactaccagaaataattacattattaaattaattccactcctattgaccgtggtcactaaacagttcatcagcttacggtattaacataaaataggaagcttgaccctcaccttgtcgaaaatacttttatttgtagtgtttttacttgaatttattgataattacttttatactttatgagtatgctattgattcttctgcatgcctttcaatggaagcattaacaaacatttagctttgaaggtgacattttaatttcatttctaacatttgtaaggactttgacactaactcccaccataatattttcaatcccatgaagaacgaaacatttccatagtttattgtctacatttccattgtaatggccaggtggctggtattagagtagcatggcatacaattccagtattaactaaaaataccactagactattcaaatgactcgttttgcattagtgcaattgtttccaattgcgtttcatcatgttttattcatcctagtttcttcttgttgtagcattaaactatatattatgaatttaatgtatatagtaaagctaaaaattccttttatgaagtattaagtgctgccataattcttatgtttatttttaatcatttttaaacctaagattacaagcacagatttagagataattctgatttaatttaattaatttatttgttttgttttcaaatatgagaaccttcatcatcgtgtttcaatgagtctcctgaaataataaattcaaaaagaatttattttctcttatttcagctgagctctctttgctgcaagtcttttatttacatcatccatttttcatccttgattattcagaatcaccagagaaccatcttacttctgaaccatgaggttattattcaagacctactactatgctgaagaattcttctttcttctttgtcccaaccagatctgactctgtcactcaccagctacatgacctggaacaatggtttctgcatgtgtaacataggaaagcttgagggctcaatgatcctcagagaatcaaatttggccagtggcctccaattctatgtgttatggcaagactcaggtacaagtcaagacctttacaggggcaattcagcatggcctggttgtaattccagtttttctacttagtagcattgtgatcctcggcaacttatttaaactctatgtgccagtgtttcctcaactgtaaaatggggttattattattccatagagtttgttataaaaaccaaatatagcaagtactgtgtatccgaggtactaaaaacagtgcttggtgcatggtaagcatccaatgaatgttagcaaaggattaaacgtccctaaggagtaaaaagattatggcacactccatccctaccctacttccgtatgtaagttaaaatcaaaattctggtatctccatatggtgacttttggaagctttagttgaaatatgaaacaaacaaacaaacaaaaaaaggttaacttttggttttcctgccttagctttgctggtgctctaagccagaatatcctgtagcatgtgctgcatcgtatcaaggtatgaaagacaactatcactcccttcctagtcctctgttgaaaacagatttctgttttatatttatttaaatatattgtaggtgtccatttatgaaaataatatttatctaaggatgaagcttcagatatttctggaggtcttatccttatgaatcaagtttcagtcttatagtgattattattgctattgttactattataattgtggtttcaagtaataaatagacattatattgcatttgtcatcatttatcacaaataagtacccaggtatatattaatgaaatttcctgttgctttcctgagtgccttgttctctagaatagtaatgatggaaagcagaccctttcctggcacacatttaagatatagtaaaggttattcaaatgccagttattttaatgataactttgttagtgtaccaagtttatcacatattaacatggttatacaatatagtttaactatatctaacgatattaaggtttaaaaaataaatttgactttcatattttatttttagtaggcccaatgtatgacatgattttaaacttattgttgtttgaagatataaatatttgggcaagtaagaggatatggaagacacattgcttaaagctgatgacggtgtgttgaattacatatagaattcctgtggatagaccctaactgaagagatatctggtctgactccttattttgtagctaagccacttcagaaaatgtaactaatcagccacaaatcgcaaagctggaaacagaattccctgttttttgacaccaagtctgaggtctttccaatgtaaagcactgcttcccaaggtactattcccagagagaatttatctagtattttcatttttcatacttgttttttttttaaaaaaatagtatttccactctggtttgtattgaagtgaatagaatcccaattatacttcactttatggaaatgcaacacatgaagagctttttgtatgagcttttcatttctggttctctttgtcacaaaaggctcttcacttttgtagttgaaatcatttgtaattatgaactgtgcttttaaaaaattcatcaatgaaatctttgattttgaaatgaggtgccagaagaaaggcagaagtgggataagtggaatttaatgcaatatgatagagaaatagagaaatcacaaacgagaggcatctcacctagagcagtgtctcataaagcagctggaaaatgaagataatgcatttggtcatgttttggagtttattattcagtattatttgaggtaggagtgcacagaaaatatctttatgccacacattaaatatttttcatgtatcaaatatatctactatacaagatttagagatgatgggcacagggggtcaccaacacagtgatggaagacacacagttttaaatactcagctgtatttaattatattttattttgttgtctttaattctgacctgctatatggggttttatgtcagtatcataaatgtgccaatatctgttaataacatccttaaggtatatgttagtaaacggccaaagaaagaggactgaattaagtatatgcttaagatggtgagagtgagaagaaattgaacaaatatttttaaatgtggatttcaataaatgtacttccttacacaatacctgcaattaattacaactcacatgacttatttcaccaactcagaggtaaatatgatcatatgcacttatttaatgttacattatcactcaaattcccattgacttgggaaatccaagttatcctctcaaagatcttgcccacccctgacagtttcaactggttaaaacaagcaagcaagcaaacaaacaaacaaacaaacaaacaacaaacagaaagaactcagagcaaagtgggtctgtcctggctccaaaagctagtctctgagagtgctggagtctgatctgttcacttcagctacaggcgtggatgcggccacatggtttcactgactgagacaagcccagcactggcacacagaagcctatctctgatgtccttggtggtccaaattttgaccaaaccttggtcaaacctctccacagcaagtcccagggtttcattctgcttcatatctcatgttaacagagatcttggtcccagtcacacggctgcaggggctgcccctggggcacctccaccaccatcctggtcctgacagtagtttatcccatgatccttcagccttctgattgagccagggtcactgaccacatgtctttcacatacattatttcaggagactcattgtccccccctgactgcgtgtcttaggggtactgggtgcagtactctatgtcgttcaatcttaagcagcagaggttggatttccttcttcccacagctattaggttttgttatcaaaacataaatttcttatcccttctgagcactttgaaaatcagagaaacagagaatgcctatgagttcctctcttacaccctttttcttttccttcccccatcctactcctaacaaggggtttcttttgacccaaatttgcctaatttaagaatacagcaccagagattcattcagaataaagaatacgtgcttcaatgaaacagcttgactatattccttatctagaagatgctggcataaaagtctatattacctctactcactatttaatctttgctgtaacaggcattgtgctacatacagtttttaaaaattctcttctaagaaataacaaaaaaactcctttagagttagattagcctagtcagctcttattcttgaaagggaggagagttaaaaaataaaaacatttaattgtcttttattattggttttgactagaataattatgtcgcttgagcctgaaacatggaaaggggaagttcaaacctaacaacttcttctatactaggccatgtgatttgcacaccaatgaatgtgctttaactctcagccctgaagccgcctgtaaattagttctttttttttgccctatgggtacaaaaggttcataacatcaaaaccttatgccaccctctctacccacagaattctctgataactctcacatcatcaacttaccctttatactagatcgttgtcatttcttttctttagaattcttttttaacttttattttagattcaggggtacatgtgcaggtttgtcatataagtgaacttgttccatgtgggtttgttgtacagattattttgtcacccaggtactaagtctagtacccaacagttattttttctgatcctcttcctcctcccaccctccaccctcaagtaggtaccggtgtctgttgtttccctctttgtgtccatatgttctcatcatttagctcccatttataagtaagaaaatgcagtatttggttttctttctttctttctttctttctttttgaaacagagtctcactctgtcgcccaggctggagtgcagtggcgctatctcggctcactgcaagctctgcctcccgggttcatgccattcttctgcctcagcctccccagtagctgggactacaggtgcccgccaccacgcccggctaatttttttgtattttttagtagagacggggtttcaccatgttagccaggatggtctcgatctcctgacctcgtgatatgcccgcctcagcctcccaaagtcctgggattacaggcgtgagcaaccgcgcccaggcccagtatttggttttctgttcctgcattagtttgttaaggatgatggcctctagctccatccatgttcctgcaaaagacatgatctcattcttttttatggctgcatagtattcatatatatatatatatacacacatatatatacacacatatatatatacacaccacattttctttatctagtctaccattaatggacatttaggttgattccatgtctttactattgtgaatagtgctacaatgaacttacgtgtgcatatttctttatggtagagcatagatcattcttatcaacacacagcctgagatattttcccatggtaataaaatcaaaatcacactcctttgttctcacttcctgctttagatattgcccctgctctgcttctctgtatatcaaaacttactttaaaagtttgtcatactgtttctaactcatttcttttgattttttttctcaaatcatctgtagtcaggctttgcccctttctctgcaccaaaactattcttgataaggtttccaattgtctccatatggctaaacccaatactgcattctgattctgcttttagctaacctctccatagcatttgatctagctgatcactccctctttttttcaacactttctttacttagcttccaagatagtaaactcttctggtcctcctatttccatactggttgctttttagtttattgctggtgtctctccatctttctgatctctaacataatgtagtcatatgtcacttaacaacaggtgtaagttctgagaaatgcatcactcggtggttttgttttctgtgaacatcatagagtgcacttacacaaacctagatggtatagcctagtacacacctaggctatatggtgtagcctattgctcctaggctacacatgtgtacagcacgttactattctgaatactacaggcaattgcaacaaaatggtgtttgtgtatccaaaatatctaaacatagaaaaggtacaataaaaattctgtataaaagattactaatggaagatctacatagggaatttaccatgaatggagcttacaggactggaaattgctctgggtgagtcagtgagtggtaaatgaatataaaggcctaggacatgatgtacactattgtagattttataaacaccgtatactgaagctgtactaaatttataaaaaattatgtttacttctttagtaatgaataaatcttagcttactgtaattcttttgctttataaacttttaatttttttaactttttgactgtttgtagtaacacttagcttaaaacacaaacacattgtacaaaaatatttttattcctttggatctttgttctataagcttttctctattttaaaaactttttattcctttattttcgtctttttagatgaagacacaaacacacacattaggctaggcctacgcagggtcagggtcattcatgcccctgtctttcaccttcacatgtcttcccattggaaggtcttcagggtcaacagcagtcatggagctgtcctctcctgagataatattacttctttgggaataccccccgaaggacttgcctgaggctattttccagttaacttttctttttttaacaagtagaagtcatacactctaaaataatgacaaaaggtataatatagtgaatacatgaaccagtaatgcagtcgtttattatcattatcacgtattatatactctacataattgtatgtgctagattttatatgactggcagcacaatagttttgtttgcaacagcatcaccacaaacacatgagtaatacattgtgctatgatgttatgacagctacaacctcactaggccataggaatttttcagttcttgtataaccttatgggaccactgttgcgtacattgtctgtgattagctgaaatgtcattatgcaaagcatgactgtagctcaggactcagccttggacctcttctctaccaagatttatttgtggtgatctcctccagtatcatggctttaaatatgcttaagatactccgatttttatctccagctcagacctctccccgaaactacagtcattttttcaactgtgcactggaaagtctaatagatgcatcaaaggaaacctgtccaaaacccagcgccttatcttctttcctgaaactgctcctcctgtaaccttctctgagttggaggaaactcagtcctttcaattgcttagggcaaaactttggtaccatttttgactcttctgtttttttcacaccccatatctaatccatcagtaaatcctttggccgcaccttcaatttatacccagaattcaactgcttgtcaggatttgtcccaccaaggtaggaagttattgccataagcacaataagaagtgatagtgtatttatggcaataacctcatatgttgtctcttggcttctacctttggcccactacatcatacacagcagaacagacagggttaccctgtgaacatttacacgaggtcccagcatttcctcattcagaaccctccaatgacttcccacctcagtcaaaataagcatcaaagcccttccaatgccctaaagacatcatacaatctgtgtccccattttatctcccagcccacatcctgtaattctcatcctatttcattctgctcctgacacactgcctcgtgtcagcctcaggcctacctgcttactttctttttgcccacaatgctccttcccctcatattgcctcacagtgcaatatgcaacctcttttaggtctttgctcaactgtcactttctttgtgaggccgtccctgagctcccttttcaaaactacaatcctctcccagatacagtctctatcccccttccctgatttttctccataggactcactaccatgtcatacaccgtctgtttgtttatgtattattattaccccttgcctacttccctacactaaaatgtaagctccatgacacagggatttgtgtcagttttattatttgctccagcccaggtgcctggaacagagtgctggcacaggtgctggcacagagtgagtactctgaattatgtattgaatgaatgaatgaatgaatgacggaaatgtcctctccaatctctcctggccatttctgacagttcctaactgtaactctgcagaagtccctgggctgctttttcttctctgctgcctgatagtggatccatagattctcaggaaacccaggcctgtccactgcgatggctgccatgttctttcatatactcagcatgcagtaattgtaggcatagcatacttaccgtaatagctgcatttactgggtgttaagtctgccctaagtgctgcattaggctttatatatattttctgttttaatttgagcctcacaacccaggaacaaaagtagcaaggtttggtttcttgctcgtgtgatcctttcttatttctgattgtgacttcatgattaccatattatctagtagcttccagttaagccacagtggccttttcctcctgacttttttgaattctacccttctcgactgcactggccacctctctggagtgggcgattggaaacaataagaccagagataaagagtctagaaggatcatttggtcatattggttgatgctatgtttagggacatagccacaataattgtatgtatgtattaagcacatactaagagttagagactgtgctaagaactattatcttatattcaaatgctattcctatgtcagtgaaggaagtgaggcttaagaaggtaaaacaattggctgaagggcatacaactgagtagtaaatactggttttaggatttagaccctggtcattcaaactcagagcctttgatcataagcatcatggtcttaggtggaggtaactgtgggaggattaactggactggcatttttcaaatgcacactctgttccagtcactgtactaggtgctgaggatataacaaaaacagaggaaggacagattcttttctcattaagcctgcagtccagaccagctggaagatattcattatataatcataagtagagatatatacgttgatcacctacatttttaagtgttttaatagctataaatatgagtcattagaagccttggacatctaaagcctttggaagagtgcctgacaatccttcagtattgtagtctttatagcgtcccttcacagtagccattcaggcttgtgtagtgggtcctcttcagcctcatacctttaatttctattacatgattaacatttcattggtaactttgtatttttatgtatatgtgtttggtttgcttcaccatactatattatcagtctattgagtgcaaggatgttctatttatttccatattcccctaagattcttagttgttttatcttcaaatagaatgttctcagtatatgcttacaaattcatcctagttcgggaaacactttcttatatatactccttttgaatgggaagatgaaagtatcagtgggtaatttatcaaaaggcatgtagctgggggtggaatcagaacacccaaacatcagtgcttagaatataaagtatgtggtttagttccctgcatccttaagaaatatattcagatgtcagcagtagataaatgttaacagaataggtgtaactaagctctttgtataaagagctgtgttttagaaaattaggcaagcatattcattaggtactaaggattggtgactttcccatcagatctgcagtgaggatagggagcaacgcaaagcggtgattttaaaatttgcaattatctactttacacattcaacaggtgaaaatgcaggttccccagcatcagaaggtgctcagatctgtactggcatttctgaaactttgaatgcaaaacattcctttcaacttgagtttgaaagagtaggcagtgagaaatcacagggagactttctgcaggcagttggtactacctgttttgttttgttggttttttttttctccccatgggaaatttcatttattatacttacatttgccatgtaaagcgactttttcctggagcaacagaaaacctgcctgtgccatagctgacatttttggagagcaccatgatagaaggagactaatatctttattggttatctctccttccttaatcagtttaggtagatatatagaaataggtagtttttcaaaagaggctcagaccaaagatatttggtctgagcattaatttgacagcaagatattattctttagggctaggttgaacaattgtcccagttttcctaggacatagagatgttctgggactgccagagctctaaattaactagggaagtgatgggtatgtcagaaaaagctggtcatgctatttaggtagctcttctaagcttttaataacttcatcctacaaattaggagggaccacccacctagtaaagtactagaaattgctaaatatttagaattaacctgcctctgaggggcaatgtattctccaaaagttggcgatgaggtggaggttaccaaagattggggaactggtataagtgactctcagccaaagaatacatatttatctgttgctgactttttttctccccgtttctcttgggtaaatttccccttcaggcatcagagctgaaagaacagtgtcacagcaagtgtgctcagctcaccatggacctttatttcctgagtctcacagttattataggcacaatagccacctcatgccactgaatgcctaaagttttgtggagatgccctcagggacttggacttgggcttcacaatagatccccaaagaggctgcggccctttgtcccgacaaaggagcatctgttgaaggcattttgcttgaagtcattcaattcagtcctagaccactagcctggatcctttaaaaagccagctccattgttcaaggcatttcttgaaggaggagtacacacgttctctaacttccctcctctaacttccctcgtttagttaatgctgaaaatgtctggcctagggtctgtcactataagatgggtcacaataacaagagaaaccttatctctaacttaaatttgtatagctcttcctggctttctctgtacttgtcacaaaagttatttcttctaattcttatccagatatagggaaaacagcaatgattatacatcgtgctcattttataaatgataaaatgtgcttatttctccaagtccatatgagctgggttatgacaaaaattagttcaatgctggttgataaattgcattaccagaatggattattgaattgtgttttcttactatttgatattcaggtggtttcatagttgaagtcaataaaaaatagcgtttgagaaggcagatgtgtggcttgttgcaagtctctcagctccaagccctttaaagaacaatactgctttatagacgttttgtctggtctagttccatgctcctcaaaaagggatatgcggcagggggccacgaagacactggaaaatatgtccatggtgggtctaacataaaaatagtggcgttttctaataacagcagtatttttatgttaaatcaacgaagtacagctatgaaataaaatgaaagttcacataacatcataatgtagcatgggaaactcgaaaaacatttagccttataggggcctctctgcttgcccattctactttgttgtttggaggtgggtactacttcaggggatattttttggaggatactttaaaggaacagttgaagaatcattggttctagtctaattctgcctcttccacatgaatgccacattctatacctctcaaaagatttgctgaccttgactgagctcatagtatttatcttgtctgtaatagcaatattggctattcgaccaaaataaaagaattcagtgatgacttttcttctttatagcttaggctgaaatgagactacatgtaattttctgcaggtttcaaattagaacacactgcatagctagccttttgagtttccatgataaaaagaaaatgtatctaatgtttactgaatgctcactctatgccaaacacttagctaagcatttcatatacacttgttacaactgctataatttgcctttattattatctaaatttggaagatgagcaaatcataaccaacttgcccaagcttacacaggttgtcaatggcagaacccggatttcaaatctaggtagcctgagtttgagcccatgttccaaatcactctttgtgtggttcttcttgctgtaaaagtggtttttttaaaaaaaaaatatatatatatattttaagttctgggatacatgtgcggaatgtgcaggtttgttgtagagtatacatgtgccatggtggtttgtggcacccatcaacctgtcatctacattagatatttctcctaatgctatccctcccctagtcccccaccccccgacaggccctggtgtgtgatgttcctctccctgtgtccatgtgttctcattgttcaactcccacttatgagtgagaacatgtggtgtttggttttctgttcctgtgttagtttgctgagaatgaatttttccagcttcatccatgtccctgcaaaggacacgaactcatcctttttttatggctgcatagtattccatggtgtatatgtgtcatattttcttaatccagtctatcattgatggacatttgggttgattcgaagtctttgctattttgaacagtgctgcaataaacatatctgtgcatgtgttcttatagtagaatgatttataatcctttgggtatatacccaatagtgggattgctgggtcaaatggtatttctggttatagatccttgaggaatcaccacactgtcttccacaatggttaaattaatttacattcccaccaacagcgtaaaatcgttcctgtttctcaacatcctctccagcatctgttgtttactaactttttaataatcttcattctaactggcatgagatggtatctcattgggggtttgatttgcatttctctaatgactagtgatgatgagctttttttcatatgtttgttggccgcataaatgtcttcttttgagaagtgtctgttcagaccctttgcccactttatgatgggactgttttcttttttcttgtaaatttgtttaagttccttgtagattctggatatttgtcctttgtcagatggatagattgcaacagttcctatagagcagtgtttgaatgatgagccctattactctgatggacattttatgtgcatatacattcaccataaatcaactaagtaatagttatgttcattcattcaaaggttttagagccctaactatgtgccaggttgcaggggtacagatatgaggaagaaaagctctcttatagcagctcgtagtctagtggtacagatggacatataatcaaaatatgaaacaatcaaataatgtcaagataaaacagaatacagagcaggaatactttaccacatggacttagaatttatatggggaagcgagatgatgtagtaaccacaaaaaattgtccatcgaaaaagattgatgttggtagagcacaaggagcagagacaaagatgaaagtatgataagttccaagtgaatctttcaaactcattagataattttgcagggctctttggaaacatttaattgctaattcttattagtttctgaaatcaatttcattggccaacctcatcccatgcctccaagcaaaacttcaaattaatggtagcatttgtttctcattaatttatttggttttcttaatggccaatttgaaggcttattaatagttaatatgtttagcaatgtaaacatttgcattaataaaacagatgcaaaattactgccccagccaaccactgccatgctaaacagccaggagacataaacactagtagagttgaattgagcttatcctcagaggacgaataatgtccttccagattgtctgattttcacatgattgctgtctacacatctatttcaaaactcataagagatgttgcaacactaaatttgtgttagtttttttttcttaagatataattttaaaagtaaagtgtgttcttgtctaactgctcctctccttatttcaggaatagacatacaaccacaagtagtctatgactgtcttatgtttacctttggaccactgacatttttgtaaactgacaacaataagctaactaatatatgctgaatttaggcttttactcatcagtggaaaacaattttgatttatttatttatttatttatttatttatttatttatttatttagagacagagtcttgcgctgtcatccaggctggagtgcagtggcgcgatctcagctcactgcaaactctgcctcctgggttcaagcagttctcctgcctcagcctcctgagtagctgggactacaggcgtctgccagcatgcatggctaattttttgtattttagtagagatgatgtttcactctgttgcccagggtagtctcaaagtcctgagctcaggccatctgcccacctcaggtggccatccgcccacctcctaaagtgctaggattacaggcatgaaccactgtgcccagctggaaaacaattttcaagctatctcctaatggtgttgctattagccaacagtttattttagacaatataaccatcttagcctatagagaggcatttatatatatgtttgaatatttgaatatacttattttataagaatgagtggaaaatgggaggctaatacttatactaatgataaaaaagaaatacagtctaataaacattgataatcacagaaataattacattttacaaaaattgtaaaattttagctttaattgggtgcccacctgacttaggttggtatattaatcaggatatactaattgttgtaacaaacacaatctcaataaggctttttaattgctcatattacagtaaaatgtgagtcagtaagtatctctctttgttccatatagtgatttagagatccaggcatccttctcctagtggccctgcattactgggacctcacagtcctctagcaaatcccctgcctccagctgccagatgaagagtaaaacaccagttggaggaaggagagcatacagatttgaggagaaaggcctggaagtggcatacatcacatttgatcatattctttggacagattttactcacatggcagaagtgcctaggaagcagagcttggtcttatgctcaagagagaaaacacatgggatttgttgattataggacattgcctctggcacagtcagtcaaatatgtatttgattgtgaagaaacagataaaaagaatatttagaaatgtataaaatgccggaaatagatgggaaaaattatctttaaaaggagaatataaccagggatttgacagacttcggcaccttaggaatagccctgattctcctcccactgctccctggctcagttagctgtaggtttattatgagcttatgcaaatatgtacaaaagaacatttttagtaggactgtgaatgtctccccttttgcagaagttgggttccagagaatttaaagaagagatatgcattgtgaacattttccctgcaagacctagaatgtacctgacagcattcacctttctggtccaatatcctagattattctgtgtgactttcagatctcttgtaacattgaggaagggatctgagtcttttcacttagtctgtatactctgggatccatcagattagtagtcatgtcagagtaatgcccacagagaggcagaagtggattacagaagtatgacagaaaacattttatttgaggggtttctaagaactcagccaatggatgactttcaaatacataagtcaggaaccccagtgacttcctgtacgagtgtccccttttgtttgctaaatcccaacacacaaaataaacattccctaatgggaaacaaagtatcacattttctgagaggtttaaaacaatattaagctatgaatcatctgttgatctttttaacgcacttattgtctctagaattaaatgctgagggcaggggctgtaaccttcaaatcaaattttgtgtcacaaacacactaaacattaaagaactgccatttacagtaacagataggcataatctgctgtaaggcactgaaaaagaagaaactccactaatgctgacctcgaagtactgaggcaatcctcagtcttctcctgggcaatagattatgtgagttctagtctaataactgttcacacgctgagaatagaatatcaactcctggctgggcgtggtggttcatacttgtaatgccagcagtttgggaggctgaggcggaaggatcacttgaagtaaggagttcaagaccagcatgggcaacataccaagaccccgtctctacaaataacaaaaatttaggaaggcatggttatgcacacctgtagtctcagttgctcaggaggctaaggtgggaggactgcttgagcccaggaagccgaggctgcagtgagcctccagcctgggcaacacagcaagactgtatctcaaaaaatataaataaataaaacttactctgctggctgatttcatctttgatatgtaaaagagaacacgtgcagacctttttcatcagtttgtatcattatggagggttatcacttatgcttcagcattttgattagactaaacaaatcatgtaagaaagattacattctatcgacttaggtaaatgtaaatgaaaacaacaacagaaattattcttcttaagaaacttatttcagcagcacctaactctgggttatggtgataacttgaaatatatttctaagctgaaatcccggcatgagggacaaaaaattatatagagctaaaggaagtgaacctgtagtaaatatatatcagagtaatgacgaagaatgcagcttccgctcacaggtacttctaagtcctgcaatcagataagccttacagaggcttttaaaatcatggacaagactaataaagaatggccattctcaatggttttggaatactttgtgtaaccttgctgaaccttgaattctcattattgtttccctcatagagaaatgtttgatattctgtcttatgtgaagggcagaaaactgaaaaggagtctccaacaatgaagtcagttttcgctgctgaagaatgacctcactgcttcatgaggctgagagaagggaggaagggatcttcttgaagtcctccagaagttgcaccgagtggggttacataaagtatcctggagtctttattaactagattttcatccacaccatttcctaatttcatgccatgcaccctgagtgcaactttgtacaagaatggattttgagcaaggtgtgatagtctcacagggctcttccagtccagtgaaatgagtcaaaagtgagcttccttttaccctcaatagacaaaacctcctaccaccctctccccttccccttacggttcctagtcctgggatcccctgtctccccaccaacccagcttccttcccttttcaggcccaccatctgtgttcatctggcttcttttatcccatcaaaagcaattagtcttagctcctttactgtcagtgatctgcttggttgaccaaagctaatctgatggaggaatatgcagtgttactgttggagtacgtttgtctttgccatttatttcactaattcttattgcagacttactctgtgctattttcaacggggtatcaaaatgaataaggaataatttatttccagaatgcattttgtcctctagatctaaatatatgttctctctctgttaacatatttgtatttccaaggcccttaaggccagcagcagtggctcacgcctgctatcccagctactccagaggctgaagtgggataatcacttgagaccaggagttcaaaaccagcttgggcagcaaagcaaaactgtgtctctacaaaaaacatttaaaaattagccgggtaaggtggcatgagcctatagtcccagctacttgggagtctatgaggtgggaggatcacttgagctaaggggtttgaggctgcagtcaactatgattgtgccactgtactccagcctgggtgacagagcaagaccctgcctcaaaaataaataaattaaattaaattaaagacccttaatttcgtagagccttaaaccaaaggaacaaagagtatttcaaatttcagacagagctaatatttctgaaaattttatttagaaaagttcattactggtaggcaaacaggatttttgaaaaacacaaagcttgttttcaaaatcacctgttgattgaaatccactcaatgttttcattatttttagaagcttatttctgcctgctcatggtttagtggaaaggacactgaactaggagtcaaaacaggcaggctctggtctctgctgccaggtttgtggctgccaaagctcccagccattcattcattctaagacctcacatcttacaggaaaagcaggacaaagtggccttccatgttgcttctccagttaaaatgctaggattctaaacaattgtttgatgacactggtctctcaagtcaattggcatctccaatgatccattaccttcctccatttctaactcaatttcactgtattaatctgtttttatgctgctaataaaaacataccagagactgggtaatttacaaaggaaagaggtttaattgactcaaagttctgcaggtctggggaggcctcaggaaacttacaatcatagtggaaggggaagcaaatatgtccttttcacacagctggagaaaggagcagattgagtgcccagtgaagggggaagccccttatgaaaccatcagctctcgtgagaactaactcactatcatgagaacaggataggggaaactgcccccatgattcgattatctccacctagtccctcccataagacttggggattatgggaactacaattcaagatgagatttgggttgggacacagccaaaccatattagtcactttactttccctcaagacctttgttttattcctcagcagagtcattgattgtggccctagactcaatccctcctatcagtgactcttgaaatggtgataatggaaactccaccaaagccccttccaccttcctcttctgacatcctcaggagcagcagtgaccctgaactgcacttataggccacatttctttttttttactgctccttcttccaggcaaactttaaaaaaaataaatttaatcaagtgatataatgctgctaaaaactgcaatgtctctaaggtttttaaggataaatcatattgaaccctcagaatggctgacaactgagcccttccttaagctacattaacaacttaagcagaaaagaaatcacttcaactttccatacataattgtaacagacctagagagagagagagagagagagagagagagagagagaaagagagagaagcaattcatacaccattaccacactggtttaaaggtggaggggaagtcgggggagtaggaggctgtcattggtggcggagattttagaggccttataagactcattaaaagagggataaaggaaaagaaaatccaggattccaaattagccaacttttcatgcttaccctctgccttctccaagtcccatttgctgatttcaagcctgtcagaggcatcagttgaaggcttcaagcttgagataataatggatttaaaatggcaggctacgtggtctttctgcctggtgatgaaagcagaaacttctctcatgggctgaactcactgaggttgtgacttcatctgtccctgcaactgcaggaggccacagcctccattctgaacagtgattcctgtagagttgcaggattttataggtgaggaaacagaggtctagaaaagtaaagtaaattttccaagattatagaacttgttagagacagacccaggataagaattcagatctcttccgctccatctggttcctcctgtatcataatggttttctgtctcagagagcccacgggaaagactttctcctttatggaggacagtgaaatggggaccccaacaccggttatctttagaccattgttcaatggactttaccatttggtctttaaaattctcattccctaaattgtctaaagttttggaaagtaaatcactcctctgatattagttattctttggagcttcttcaatttgcataagaaaacacagataagttatgtgagaactgatcataatttcagtcatcatgatctcaacttcctacccccacattgacaagtgaagggcctgacatctaatcattgaaattctgagtggaaacccaggaaatgtttcatctatctgcattttactttcttcatgtctagagatagataatacttaagcaactttatggggatttttaaagccctttctactaacttccagatgggaaatagaatgttttataaaaacactcaaattcagtaggcactgtcagggtgaagctaatatgaaaataactacttgtaagaaaatgaacatggagctccaatagtggcagaaaataatgtgtacaatgtggataataaataataccattaaattcttgtatcattcctgctttctgtcaagataaaaaatgtgatatttattgcttggcccgtaattacttttatgcttgaaacaggaaggaatggagttgatgatacaggaaggtattagtcaagtgtctttttctatgggggtgggggacagggagggtttttatttaaaggcaaagcgagttcttctcatcagcatctcctttctaccaaccacctaagacagaaagggtttttgccatttcagctattagaagtgattgattctctgtcatacctttccgagctgtgtggttgtgaatataaaagaggaaagagggaaggagagagtgaccaatattaaggacaggcatgaagaacaagggatagattattagcttagagtaataatgatgaatttctcaaaacaacattttttgcctggttatatagattatttgctattaccccagaaactcagatcttgatttcaatcaggatttcaacctccatctgctcccattccaactctagtccatcttcttcaccttatatgctttgaagaaaatcttttgaaataatttcaccaagaagattagttcttttccagataacagctgcatgcactattttggaaagaactttgataccatcttcaaacatttgaatcctgaaacaactgaagcaaagctccagaggtagatacaaccagcagtctcacaaaaatcagcttctttacctacagcacaggctcaatgaaaatcaaaatctgtcctccatgagtttccaggctaaaaataaggtacttgcagcttcagcacctgagggcttaaatcacattttatattccataaatgtggccacattgtctcttttcccttttgttctttttcatttctgacagaaaccatttgaagttttatttcaaatcacctggctgtcggcataacaaaccttagatttagatttgcgattgtttaggggcgtgtgtgtgtttgtgtgtgcattcgtgtgagcgtttaattaaacggatgtgaaatgctgtctgagccgaaggcagtaatttttcttttattcatttaatgttgcgcagattatggcaagcttttcatttgtataatctgtcatataataccactgccttttaagcatgctggtctagtcaaagcattcatttagatgggaataaaagtttaattactttctttcacctttaaacatttgttacaaattaatgtggtgtctctaagacactgccttgaatgaacaagattcccattttagtccggggtctggttctaaggagctgtgtatgactctggataagtcactgtctgcaatagtcaggataggctaactgctaccaaaaaaaccttgcagttggattctatttcttattcaagtaagacttaaatttggatggtaagatgaggcacatattacctctgacataagtaagggaattttgtcgagcatcacttatgagtgctttggtaaaacaataggagagtaagctgaaagtgcagtattagaggattggctcctctgtcctagttgtatgcaagtcaaacacaatttagcagggagcttataaagcaattatatacaaggcagcccgtgcaacaccgagccatgggaaagaccgccagcatcttggcctcaaaaaccagaaccaggcatttgtgtgacatcaggattttcatcctctggctgctccctctgcaggacggattcatttcctctcactgtgggtcaacgttttccactacgttattatgtagagacatggtggtgatggcttgatttatgtatcatcaatctccatcttctgtgaaagaatggacttgactgtgggatcaccattccctgcatcatgcgaagagattggattctgatatggttgagtgtggttcaccaaagccatcaatactagccaagacacagggttgccctatagtcacataagggatgttggaggaggtatatgagtggaggggaaggtagcatcgttttattctttcccatctgaattaccatcttcctgacagaatgccaaaggtaaccagtgtgaaaattgtcggaatcaaaatgaagtcacttgtgtcaaactctgacaaaacaggttcagagaaggccatgaagtgagtgttctcatgcatgatttgcctggtaacagggacttccacaagaaattttcccaaaccatagctttctacaggagtcacacaagggctgccagccccacaaggctaggcagatgcttatgcagaacactcgcccaacaccccatctcacaaaccctcttccaaactgcaagggcctaaccttcactctaagatcacaggttctattgagcaattcctaatgtttgacaatcagaactctccagctcttgtgagacactgtgagcaccaataagtttgatttcaaaacagctttcataacctcctctttccccaataaaccctaactttttactttgttcccaggctggcagtggcacaaacatgtgtcactgcagccccaaactcctgagctcaagtgatcctcctgcctcagcctcctgtgtagctgggattgcatgcacacaccaccataccccgctaatttttttatgtttagtagagatgaagtctccctttgttccccaggctgctatcgaacttctgggctcaagtgatcctcctaccttggcctcacaaagtattggaattaaaagagtgagccaccaggtccggtccctggtctatatgtatatcctgggttacaatcctacattttatatattatttttgaatgaaatttgttacttagagattaatttctcttgattttttatgttgacatcagtaccctatggttgtgccctcaataggaagtatcctatactatcaccattatctttcttcctctcatatcaaatgtgtcttttctttgacctatttcctcatatctatgttctctgctaggttaatctgataaatgaatccctgctgaagggtttatgagtaattgtgatttaaggagttaatcttctcatgggtgcatttcacacaagtctccaatatctttaattgtagaggaatgttcagtgtttactgggcacttattatatgcaaaggcactgtattaggccattctgtcattgctataaagaaatacctgagactgggtaaattataaagaaaaaaggctttattcgctcatgaatctgcaggctgtacaggaagcatgctgttggcatctgctcagcttctggggaagcctcaggaaacttacaatcctggcagaaagccatgggggagcagacacataacatagccacagcaggagcaggagagatcatcaggggagatgtcacagacttttaaatgaccagatgtcaagaaaattcactcattatcatgaggacagcatcaaagagatggggttaaagcactcatgagaaatccacccccatgatccagtaacttcacaccaggccccacctccaacattggggattaccattcaacatgagatttgtgaggggacacagatccaaaccgtatcaggcactgtgctagatgacataggtaataccatgtcaattgaaaaatggctctgctggcatgggaatgaaacttgttgcttctggcattcaattgctaaaaagttcacctttaccacctgagaggtattatctttggacaagttagttacattttttagaatggtgggaataatagtaactacctcatagacttgtttgtgaaagttaaatgatatggagagatatgtacagtgcatattagtacagcaactggctcattgtaaagggccaatgcttcttatcttttaaatacttaagcacatatagattttctcttcttaagaggatggatttaatctatctttttaagccatatttctaaagtgaccttttgtgttactgcctgttagaaaaatcacttaccaccaaagacacatttcaccagcttgaaaaatttaacttagcactgtggaaacattttgttcatattcccttggtctttaatttgaaattttcatctgtagcctgtagtttgtttgtgaatggttttgggaatgttctttggacaattaaagctactaggacatctacaaaatctgtgtaccagtgtccctggctccccctcctcatctctctctctctctctgtctctctctctctcactccctacctccctccaccccccccccgtctcccttcctctcactaagttctatttcaagtggtactctcttccttacacactaattccaaaattatgattgttagctaatccattcaagtgtaatttgaggacaaatgcagacaacattttctgttaagtttgatcttttctgtaccaacatggctagaataaaaagaaaatcaataaggaaaatgaagacttcctacactgaagtgaatcttgggagacaatttctttttttctctctcgtgggttctgagctctgttttaaccatactaagagaagtatttcacggacgacttctgctctcagttccatgctattttttgattggtagcaaactatatcctgacaatagaccctcctactagtcctaagtaaatgctaacatttatggatcatcaattctatgtaatgccctctatatagttctcttgacaacacagtcacatttattattaacccctaagactcagaatgatgaaggaatttgcccaaagttgcacagccagtgagtataagagctgacatttggaactgggttagcttaaatctaaaggactttctctttctcttctaccatctttactattcaatattatattagcctaatattccagaaagaaaaaacaaacaaactgctaaataatttattaaataagaacaggggatagatctacataccttggttatctacttattttaataatttttggcttaaaatgaggattcttttcttgtttctggacattattaaagtgagacaaacaatagaactgtgaatgaccacatatacccctagaacatacgttttcttcaaagagaaagatcttatgaggtctgagttctcatatgtataagcaaacctattccttagaagtgcattggtagagaaccagggatctatcaacacaagtgtcccactgagtttgtgcatgccactttgtataaaaacagtgataaaattaatagcaccaatctcataagcttgtaagaaacaaatgagtgaatatatttgcagagtaattagaacagtacgttgttcctaataaatactcataaaatattaactatttcaattattagaaatgcaagaaaggtgtctttgtgttttctggttgaatttgcccttttggcagccacagatttaaagaatctatagtttttgaagctgcaataatttaatcttatttggatttcttccctgtcatccaaattagccaattcactatggtatttgagatttgaatataccccccaattttttttcaacaatctaattctaaactccaggcctccttttcatttgcctgttttgagaagtccaagtatttaggaacatctctttaaaattactaagagtaatttatttcctttttcaaacatttctttcaccatgtacatcttagagattaaatgaaaaaaactattacttttaacaaagatgtccttgaatacctcatctactcatttcatatataatggagataatttttgtgtgtaaactcaggcacaactaaagaaagcaaacatacttattgaggtttaaatattttacttcattttcatgcaaattaatttcttcaaattcttaaactttctcaggcttaggtattggttcaacccatgggagtgaagtgttgacacaagaatgcaaatattgtagaggtgcgtgccagcctggcgcatgtggctgcaaggctgtattccttttccttttgggctcacacagttggccaccttccggctgtcacctgcaatcctgggagtggtgctttccaccttacaacatttgctatttaatctaccaagggtaggtgagactgagattttacctggccagggaaacttacattccctctattgctgtactacccgccacccccggccctactcgcagatttactctgattttgaggcaaagactcaacaccaaaaaatgcatagacacaactttcatcttctgatggagtatttccagcagttttttttttaaaccaaggttacgtgcatacataaagagtctactagttctacaggtttgttaaacagcctgtccagattcccttcctgatattttctaagaaatgctgaggttaatgttggaactctaacagtgacgacttagggtccagatctggctctgacactgtctgctgtgtatgttgcctcaaggtcctcatcagcaaaatggggataataacacctccccatgagatcgttttgaagaaaaataaatgagtaaattatcaaaaaaatctgaaatgtatgatcatgtattactaaaattatttagctttaaaattatatttatttcattaaatattaaatatcttattaaattattataaaatgtattgttactttccagaggatccatttgatatttcctaccatatcactaacatgcttaaatagtgttttagtcaactttcagcgtcagggatttcgttttatcaaagaggaggcttttgctcattccccacttttgccccgccatatccactcacccacccatatgcaacgcttaataccaacccagctgcacaccacacaaacacttgcacttgcacatgcactcacttccacccctaatcctcctaatagagttgtatcataattttgattagaacaatactcactatttacattactatgactcttcactaatctttatttactttttcattctaaattgtatttgcttaattacctaagtacctcaccccaaattatttgccagttccctaaatctccttttgcaacattagttgtcaccaggaaggagtctattaatgtcatagtcttagctcaggctactataacaaattaccaaatactatatggtgtaaacaacgaacatgtacttctctaagttctcgtgtctgggaagtccaagatcaaagtgctggcagatgcagtgtctgatgagagctgtttctgttttagcagatggccttcttgtatcctcacatggtagaaagggagcaagaaagctctctggggtcccttttataaggacactaattccatttatgaggtttccaccttgcacaatttagtgacctctcaaaagctctacctcttaatcccatcacatttggggtagaatttcaatatatgaatcttggaactacatagattctcaatccaaaacagccttcttgaagatttatcttccagagccaattcttaacttgctgcagttattttgtgatctctcttcacctccatcctaatgattctctttacccctttcgtatgttggatgtctcattttccatatccccttgtattagggctgctgtcctagggctgctttaacagattatgataagcttggggactaacaataattgaaatgtatttattttcagctatggaaaccagcagtctcaaatggaggtgatagtatgctctccctcgaaggctcctgggataatcctcctttgcctcttccagcttttggtgactccagacatgctttggcttgctgttatataactctaacctctggctccctcttcatatggccttctctcctgtatctctgcgaaatccgcctctgccttcctctaataaggatgtgtgtcattggatttagggtagcccctaaatccaggatgacctcatctcaagattcttaattacatatgcaatgactgttttccaaataagatcgctttcacaggtctagggtggacatatctgttggagggccatgcagccaactatatctttagcttctattctcattttacttcttcagtttattatacttcagagaaagtagaacactttctccaatagttggagaaaaatttaccttgcacttttttaatgaaaaaaatgcaaggtaaattttctgaaacatcacatgtccaaaatgtccttattttacttataaatattattaacaatttgtcttgaaatagacttctaggttgtaaatcatacttcttgaacgttttgaaggcattatattcttgtctagcttaaactagtctaagcaattttcatgtcagaccctttttatgtgatcttttccctctctggagtcttgtaaattctttttgcctcagttcatcagtctttttagaatcatgtaagtacttttaatctaactgtactaggcttttcctgggtttctcaatctggaaaaccatgcttttcagttctgtgaaatttttttcaatttattgatgattttctctgttgttctgatctctctttctggagatcctattcttcgaatgttggattttctagtattgttctgcttttattatcttttctcacctgtttactattctttgatctttgtgcactactttctgagagatctcttaagttcattttctagctatttctgctaccatatgtttttaatatctaagagctctttctgttctctgaatgttccatttttgtagcattatgctctgggaaaaaataatattgatttaaattttattttgttttgacttttcttccccaccttaaacttatgtgaatgggctaggaaataggaatcaagaagccaaccttatgaccatgtaccttctggcaatgggactttttctttttgtttaaaactgcattctattttcaccatcctgctcaaaggtaatttatcaagaccatcctactcagtctgcccattcttagagtacagtagagctttgtctgagtctcatttagattcagggcagagagacatttgcttttggttggtcatacctcctctggccattattttccattttattatatctgttttgcctgaagggagaggcggaaactgtgataagccccaatccctacttcaggaggaactctatcattcttattattttcccattcagcattccttgatcagcttctgattttgtatgatttagtagaaaaatcaatgaactgtgaatcagacacatggaaactggtgaaattctgttattaataatctttgaggctggagtgcaagtaatttagctcctctaggtctcagttttcctcatctgtaagatataaggagttgtactaaactggaagtttctgagctcagctaggtactagttcttctatagaagtgcccaaacagattgctaccaagagcaaaaagaaattgagtggcttgctgcacctatcaaaccaccatggcacaagaatacctgtgtatcaaacctgcacatctctcccagaacttatagtaaaattttttaaaaaggaaaaaaaaaaaaagaaattgagtggctctcactcccttctctctccagtcacagaaggacacttttatctgtttctacctaagtgcctaaaacttttgttgtctgattgatatttttctggagaccaggctttcctgtccaagaaattgttttaaaatcatccggtcttagtggtttcaatgtttctgtctctaaattctgtgaattgatatgatacttttgtcttcttgcctttaagacttggagcatgaaggacctacatgatgactgctgatctatagcatttatgagtacactaacaatctctttcataacatgacatgtggtttcttctgtagttctcgaactggactgtgtatggtgctgcagagtcttggcaaacagcttaaattaataaagaaatatggaacagccaggaggtcccacactgaaggcttcaaaaagattattatggttctgacagcatagaaattgttcttaacttcttaaaaaccatagaatacctcagcaggcagatacttgcagattaataatcactttacagcactgttggagatcagttatccatcatcgcaatatggactatatcgccggagagaattttaggaggtttgaatgcagaatgcacggcaaatacagcactaaaagagttatttcttccatcttatgaaatgtattttagtctagcagataaattgtgttattagacatttttatgcactgtctggctgtgtactggcatcaacagcttttatccactccccaccccaattacaaaatacaggagagcaaatggcaactcttcttgagtaccaggagacctgttgtacacgtattatgagtgtttcatttggtatattttattatattccagtgtaatttccagaataaattaaggtgttaacaaataactagagttcaaagggcagaaaacattgtttcaatgacagaaagagaatatggttaaacatgcaaagcaacctcttttaaattcaaagaataattcaacagtggaatatgatctgtgaaattaatcaaaaataaaataatttttatttgaaaaacaactatatttttagatcataaatatcatataatttttatgataaaaaaagcatgcagaaaagaaaacaaagacactggtatgtttctatcctttcccagctgatatttatttattttgttttattttagttttagagacagggtcttgttctgtcacttgacagacagcattcgtgcagtcatagctcactgtaaccttgaattcctagtctcaagagattctcccaccgcagcctcctgagtagcgatatttattttatcgccttatttttcaagattatagatacagtttagatcacagtattttaaactttagtgagcatcagtatcacctgcaagacttactaaagccagatgaagagcatcccatggttactgattcagaaccctggccagcgtttagaaacaggtcttcaagagggtccagtttataacatgatccaactaatgccgtaatgtttactgaccagccatttgagtagtagggatagagttcagggatatagattcctgaacagctagacctgatatacaccttatagcctccaactgatttcacaaaatagaaagcagcttatttataccaactagtcaaatgaattcatattacttgctgtaacagattgtgtgatagcaaagaaacaaacaatcactgaagagatttgtttctcttttaatcaacaaagatggataatctagttatgctgctgtacaaagcaggaataacacttatggccctggaaaatttctccctggctcattttctttcatcgccatgttttactcatcgtaaagatagaatacgaaccacaaatctgcgagtcttatatctgttaattattgactaagagaaagctttatggcaaatggtgggtttcagctttaataaataatggggttgattctgcccaatgacagatgtgtgtaattctcattaaaatcagtggcagctacacaagtgaatcaaagcaaaatggtgtcttttacagaacgttctgattttgtaaattattcactatctctcaaacatatgagacatatgctattgttctctgtagggaacaagaaaaactcttttaggcagaatgtagtttcaaattttagacttagaatgtgcaactaagaaaagatataaaatgtttttacccacagcctttaaataaaactgagttaataatcgtttttgaagatgcttccagatacggtggaatgggaagtgttgaaaatgcttccaatgctgtggactgggagggttggtggatgaagatacctgcttatctctggattttgcaaatataaggttagtctagcagtctttgccaaactgtggcaacaatcaatagtatcacaaccagtgactaagaaatataaagggcacctcattatcgtaaaacacagatgcaactagaagggctcaaagtgttgaaaattaagcaatgagttaggaggctgttaaactgaactctggtctttgttctatcattgagatactcagtacctagaagtgcttcagttaacacatctataaaatcgagaaaatactatctgctcattttgcctccctgggatgctgtgattaacaataatgaaaaacttgaaataacgaaaagcactaaattaattagaagaataaacgttagaggaagtagaccgggcacggtggctcacgcctgtaatcccagcactttaggaggctgaggcgggtggattacctgaggtcaggagttcaagattagcctggccaacatggtgaaattccgtctttactagaaatacaaaaattagccaggtgtgctggtgtatgcctgcagtcccagctactggggaggctgaggcataaggatggtttgaattcatgaggcggaggttgcaatgagtttagattgtgccgctgcactccagtctgggtgacagagtgagactccacctcaaaaaaaaaaaaaaaaaaaaaaaaaattggaggaagcacactaatgcccactgtagcagctccttgacaaatacataaacctagactctctgattaacaggataatcgggatgagtctccttcaagatgttcaatctaatgcctgagatctttcctaagccacagatttatgcactaagaaagatgatggcaaagcatgtcatatgatcaattgttcccatcccaatcaaatgttcccttaattcttggtcagcaatacatctgcataggtttgggaagaaaaagaaagaagcactttaaaaggaaagaaacaaaatgatgttttgtgtttattcttggttggttcgttccaccactgttttgttttcccagaattattcctcattttttgcagactcttctttgattagctatgtttcttaaaatgctccaatagtctttaattgtctgtagttccaaatataaattttaactggaaattgttgattaaatacaatttaattgaaaaaccttcctactttaatgaacttatagcacttgagaagaatgtggaaacaacgtaactgggttttttcctccaatattaatgtgcttgtgtataccattaggataggataggatagatctgaggtaggactgtatgatgaggaaatagaatattcagtggattgagcacttgcattagtgtaggaaaatctgcaggtagaaaggagagagaaaatgcataaatgaaactagatctgaccgctgctttgtcatttctctagagatcttcttgtgaactggcattgaattgacattgactgctctctaatttgtgggaccttccaagcttattctaaaatgctgtaaaagtctcaccccatagacaccaagacttgattatttaaatgcaacgtttcaagctacattgaaaccacctgccacatcttgctgtttctaggcaggaggcatctataagactgttttattaaagcaagatactagggatcaaataagttcattgtgttctctgcatgccctaaatgtgaaaagaatatccaccataaatttgatgtcagagatttggttcaatatagagcaaatttgggaaggaggagttttgcaacataacttcaacaaaccacctttccccgcctcttcccccttcttctcttcactctttttcttcatcatcttttttagagttatggtccttgtggtatcatgattaaagtttcctgatacacacatcgatctcctactctctgtcaaccctttattaaaatgtttctcaaacattaatgtgagcacgaatcctctattcagtgtgtactgaatctgaaattgcaaattctgattcagtaagtttgaggtaggaagagaacctgcatgtaaactggctcctagatgatactggtgctgctggtccaggaagctctccgtagtcaactttaggaaaagtatagatttagattcctaccaactttctggctacatagttgtctcaaaaagatctgaaggcaaagattcatattttaacctgacctcagttttctacaattattattacacactacagaggttttgctgcataatgaagtatgattttgatagtaaacctagaggacttagagattgctaaaggcaaaataaaaccaaacacacagagggagatagaaataaatgttatatgctgagatctcaaaaacgtgagaggtaaatctttctgttgaattagaaagattgattctcagtagccggtggcttggagaggggaagcaataatttctggccttgattctactcactgctgccaggagacctttgctttgttgctattttatccacaatggatagatatttgtgttaagtccccacattgtttaaaatgcaaaagatggtgcttccctcactctcccccaggtgaagatcagatttgcctatcactgtcctagacaggactcacagaacatagaagcttcacctgggaatgaaatctctttcatctgaatttgctgggttgacaagtctaagacccgacaccactcatcaccctgatctgacctcatctgagcccattatctttaattttatatgcagcttctacagtaaatatgaagtggaatgttcctctttttacaaacatttattgtgagtagcataaacattttgacactgtattattttataagttttctgatgcatacaattagtgtagatataaatcaaaatgatggcagtccttctacggttttttgaagttcccaggagagctgttgggctctttaattgcttactaatgtaaaaatatcattgttagtaaagcataaatcatggcaattttgccccactagaggctaaaagcagcacaagatgtggtaattaagatatactaatagacctggcaatttctataataggagcttttaacaaggtaggaaaagaatgtcatctcttatgctgcagtgaggcaacaaataaaataggaagttttcctcttgcaaaagagatgaccctgcttaagaaacaatagccagaaagcaggtaagaaagtgtttttttctttcttattcacttgttttcctagtcacatggcagcttatgaatataaccttagggtgagaattagctttgtaaattttaaagatgagaaggatctttggaacctactttctttgttttcatgacggggaaactgagactaagacaaataaaatagctggttttaactaattgggagcagagctgggactagaaaccaggcacttgcttccccgtgaagggcgctttctgttttgttagctttgtatgtcaccaaagaccttcaaacgttttcaaatcttgaatattctttttcctattttgtagtccccctcctttttctgtgatgtttggtgtatctcctttgaagaatccttgaagttgggcatcattggtaacatttggattgcatagtaggaaattatttgttttggggtattagggacagcaaagaccccacctcttgtgagggataagaaaaagaatatgtctccagaccaatgctaaagcttacctatggcttctaaagtgaaacaagagtctgtgttaaaataaggagttgtgcttttcagacacgatgttcaggagctgtatgcaacaacaaaaacaatcaatttcttctttgacacaggtttaaacccaattagcattaattagaagtaaatacacacagaaggggggcccacattgcaaaggcaagcaacttcagttccatttaacacctcttcactcttatatggagccttccatcaaaggctttcaagatgttttcagacctagaatgttcttttcttattttactaagttttttcctcttttctctttatcttaccccatttattcattgatccattaagctagaacacctgcaatatgttgtatgtcatgctctctactaggtaatagggatagaagatgatcaaaacctctattttatcctccctgatggaatttgcagtctaatggaggagaaatacaggaatcaaacatgcaaacaaacacatatataattgcaaactgtggtatgatacataaaagtaaagttggttgcttaattttttatggggtgacctggacataatatgtgagctagggaagaattatcttaggagatagggagaagagcatgtgaaaagtgtgagtgattggcaaggtcagtatgtttattttatttttcaaaataaaaagtttttaaaaaatagatttctccagatactcccagagaatgcattatcatggcgtaagcccagagagcattgaagaaggcatttcaatagtgctggtgaaagagggtagtggccagaattttggtggtgacaatgaagacagaaaaatggagggagaggagatgtattttgtagatacaattgattggacttagctgaaacatttgatgtatgcaatatgggagaagggaaactcacgaatgcttaggaagtttacttgagtagctggtttgtttacaacgttgatgtgtattaatttaaggatggccagggaagattgggttagtggaaactgggatgtttggggtgtatctgaggtacataggtgatgattcctgtctggagcgcagaggagtggtcttctaggggtggtgtgacataaattggataataggatatgatgagacaaaaaatatgtgtccctaataccatgtcctggggaaatcagtgattagatgttaggggaaatatcaagggccacggatatagcatgaagaccaggaaagaaccgtcgtttacttcaaggggggaagtaatttcacaaatgagagggtggtgaaatatataaatatttctgagagtttgagtaggaaatttgcattcattagatttagcaacacaacatcttgattgccttgataagaaacttggggggtagtgggactggtgaacatttgagagaagacattaagtagacgattctcgagaaggaaacagggaaagatagtcacaactggagatagatgtagaattaaaatagttattttaagaaaaccagggtactctacaatattgataagagtggtcaacgaaggtgtgggagacatgatggagagataagatcactaaaggaacaaggttcttgagagaaaaagatgagatgtggagtgagtggccttaaatagaagcaggggtggtttcttcattgagacaggagaaagaagaaggatgtttttgcaggtaggtgtgagttttgttggttggaagatgaaatgatttgagtttcatgatttctccttgctgaagtgtgaaaggaactataagaaaaatagggaagtggatatggggcaagtttaataggaagaaaaaaaaagacataatactttgccataagaactgagcaactgagacttccccaacacgaaagctgtgttgccccgcagtgtgtgtgatttttctccagaaatgttcagctactcaggtgagactcattaacgaaggtacaaggtagagtatgtacacccaggatttggcttttgccagacatggatttctgtaaaagaagagaggagcatgacagttgatggtatttgcaaagttgttactatgatagccaatcatatgatagcgggcagtcagggttcacttaagaccataatgtgaaggggcatgttgagataaagttgaagacataggctcatttgctgcctatccagtggcaattgcagagcatgcagaagagggtgtgaaagaggaaaagaaaggatgcagatatacataaatgtgtcagattagaagataaaccaaaccatagggaatggccaaggaaagtatgacttccagcaaatggctgagatacacaaaaatcctgatgggtgtttggagaaaaggatgtgtacattttccagggagtgatagaaattccagaatggctgctcctcccagacttcagggctagcaccttacatttacatgagctcacaggaagattagaggattgactctggcaagtaacatgaccagagtcaaagaagtctgcaggacggttgttttgtaaactcatctttttttcaataaaaagcactagtccacaaaatacaagaaaaattaaaaaacccaaagaaacaattgaattctcttttctagattggcttatattcctggaaactcttcaaacagaaaagtgaaagttctgatattattataatcgtaatagtttatgttggcaatatttgcatggtgaatcattttcaatcctcaaaatgcccaggtttctgtgtccttaatgttatattggggttcatatatattattttatttgttttctatttgcctcaatgatttcagtgctcccatttcatttcatacctttttaaaattaatcattttataacttcgagttttctccctattaacttgttagtgaccgattaatttatgattttttgtggataccttagagatattaacatgggactttgatttattacaatcacattgaaattattactgtcagtaatggtagaatctgagaatactttactgcatttacccttttttgtcctctgatatgtgttatgtactttaattctaaatatactttaaaggccataaaacactaatttcccttgaaatataatcacatatttattctttctgtttctcatcattccatctggcattttcttgtttccttctgcttaaagaactgtttttagaatttccttcagtgcaggtttgttaatgacaaattctcttgctttctgtttttgttaaaatgggttattttgccttcacttttgatggctatttttgctgggtatagaattctaagttggaatttattttctttgattttcctcatttctgttgagaggtcaactattatttctcctttgagaaaaatgcctgttttctctgtttttaatatggttttcttggttttagattttagcagtttgattatgatatggtatggtttgtgatgtgtgtgtgtgtgtgtgtgtgtgtgtgtctgtgcctgtgtgcataggtgtgtgttggtgtttatcttgcctggagttcacttagattctcggatgtgagagttgatgtcattaatcagtttggaaagtcctcagccattatgtcttcaaagattgcttttgcctcattttctttctcctaatagtattccaattacctgtatattagatatttatactgtattccaacatcttttatgtactttccgatatttttcattttcaattaatgactgggcttttttattgacttccttcattttactaatcctgttttatgcaatgtctaattgtctgataagcttatatattatgttcttaatattagttattatgttttagagcttcagcattttcattggattctttttataaattccagttctatgatgaaattattcattctttgcatctgtttgctccagcttgcttttcttgtatgtatttgataaactcttcgtcttctaattaaaatacctggctcactgtggatctatttgtgtttgtgttgtttttattttaaaaattgcatgttagtaatattatcctgtatcttgtcacacctagtaatttttttattgaatttatttactatgtataaaaatttagattattgagcatccactgtcttccttcactcttttctctactaggaagataaagtgggagctcactaatttaacccaataagggactgagctgaatcaaggctggattatatttctctcattcacctttgtttctaggatggagtcctcaatggctttcaaccaagagcctactaagatcaactgggcccctcccctgatgggtctcacactttaatccttgtctccgtcaccaaaggactgtcagaaaactccattctgcttctcagaggctttgtaattagctttttatcctctcgtgtagcttcagaatctggcatgtgtgttgagaaaactggcagtatttggttttcatttccctcttttaagtgggatcctgacagttcaagtcttcgtttttgtctctgcagggccacaaaaatatttcttcttgtttctctatccccacccatagtctctgcccaagtgaaggttggattcttaagttcatttcatgcaccaagaattgtcaaatgccccaagagagaagtttctttagaatatcaccccagctttatgaagttcttcctttctctgaaatcttcaccccttagttctcactgcttcagcaaaaatctgatgtctttaagcaaattttggcaagtacttcctacttttctagttcatcttggcagaaaccatggtttgctatataggctactccatcttgcccgaaacagcagaaatttcaaacaatgtcattttacaaagtaaatcatcttaagggtgtttgtctttcaattgagtgagcttgagaagctgtaaaggctttgaattctggctgcattttttatttattttatttttttatttatgtattttttttttttagcaatttggagtgttgtgatgcattgttctgagacaatattattagcagctaagaatggtggctttgacatcagggaattctaaccctggctgtccgatgcaatcttggccaaagaattagatctctgtagacttcatttttaccatctatcaaatggggaagaaaaccctgctttctatgtttataaggaggattagatgatcaaatatttattgattacttactttagctatactaaatgccttacatatattatctaattttaatatgctatgtaccatagtacacactaaggattcagtaagggatagcagtgttattacttatcctgattacaaaccacaccctattttggcttcaggtaaaatcacgaatccccccatggttcatttctcatcccctgcccttttaactacagaatatcgacaaggtaaatacaggccaaagataattttttagcttataatattcatattcatatttttgtgctgcagttagcaatcaagagtatgtacatcaataaaaacaacaaaaataaagcttaattattaataaccatgagcatcgggacaatgtagaaatatgaaacatgttttcccatgtacttttaaaaatagcatagctagttttatatgtgggttgaatatagtcaaaacatcagaaaagttattcaggataaagccttaaaatgccaggttttactttttggtgaaaatgacatgttggactgctgcctgatgaatttaaacctagacagttgcacatttgtagttcacaagttggggagcctgtagctttgggtctcagtagctcctggggtagtatttgcacttcatttctggccctgtatatctgatttgatgacatctgttaaggagacagtggagggaagacatgcatatgaaatttcagtgaacacagcctgcatttcaatgatctgaggctgctgttaccttgtcatttattttgtagcctttggggctttgacaggcaatacccaatctgtttctcatcagtttaaatctcaatatttacttttagatgttttattttaaaatctttaaaaaatagaagattgtgcttgtccatatcatacagaatttgcttctttcacatgaaaaaaaacagatttgaatagaatataatcaaggagaaaagagccactttacatataatgaaaaaaattatgaccaggcatggtggttcacacctgtaaatcacagcactttgggaagttaaggcaggagggtccctcaagcccagaagttcaagaccagcctggacaacatgacaagacttcatcccttacagaaaattaaaaaaaaataattagccgggcctggtggtgcacatctgtagtcccacatattcaggaagctgaggcaggaggagctcttgagcccaggaatttgaggctgcagttaactatgatggcgccactgctctccagcctgggtaacagagtgagaccctgtatcaaaaaaaaaaaaaaaaaaaaatatatatatatatatatatatatatatatatatacacacacacatatatatacacacgtatgcatatatatatacacacatatacatatgtgtatatatgtatacacacatatacatatgtgtatatatgtatacacacatatacacatacatataaagaggaacaacataagtttttttaaaaaagcagaactattaacaaactatgaatgctagttttgcttgatatagttttctttccacaatggtttgcaattgccaacacctaaactggaggatctttttcttttttattctaaccatcccctaacaagtgatttttaaattttaggatgaatcccaagagaattgctattagtagtaggtgctgcttatgtaatcgacaagatcattaaggcagatattcttctaaatgaaagtctagatcttatataacatggatcttgatatctccctcatcaaggggtggtctatacacagtagcagcagcatcaccacggggagcttgatagaaatgcacaatcaaaaactccaacccagatataaggcagcagaatctgcattgtaacaagatctccaggtgatccctatgcacatgaagttttgagaagcttgccagactagaacagggattgacatatttttgctacagagggtcagatagtaaacattttaggttttataggctattcagtctatcttgcaattactcagctttattgtgcaaacagcaccagagacaatacaaaaaggaataagtgtggctgtgctataataaaacttcacttatggacattgacatttgaattttgtataatttttacctgtcacaaaatgttcttctttttttccccaattatttaaaaatgtaaaatccattcttaactcaaaggccacacaagaacaggtggtgggccagacctagtttgctgactcctaatcaagattctatcattttcttgaccttgacctttcttgggttgcccttggtgcttgtcttaggctgcttgggctgccataagaaaataccacagactcagtgactaaaatgatggatactggccaggcacagtggctcatggctgtaatcccagcactttggggggccaaggtgggtggatcacttgaggtcatgagtttgagaccagcctggccaacatggtgaatacctgtctctactaaaaatacaaaaattagccgtgcatggtggcaggagcctgtaatcccagttactcaggaggctgaggtaggagaatcacttgagcccaggaggcagaagttgcagtgagccgagatcatgccactgcactccagcctgggacacagagcgagactctgtctcaaaaaaacaaaaaataacatataataaaataaaataatgaatatatattttttctcagagttttagagaccagtaagtctcatattcaggtgccagcacagtctggttctgatttcttttcctggcttgaaaaggctggcttcttgctgtgtcctcacaggatatagaaagaaacctctgatgtctcttcctcttgtaataaggccaccagatttataggattagagacccactctcatgaccttatttaaccttaattacttactttacttatgtaaggaccttatctcctgttaccttgagaattagggctttaatatgtgaactggagggtgaggaggcacagcgcagtccatagcagtgcccacatcttctctctgacatcttctctgaccgtaccacccggaatcattttcctgtccatgatgtcccattgtcactgttaactgcctgtcatctttgctgcttaaatttggccttatacatttatgacagcacattctgttccttcaaagaaactgcaagctccctgaatgcagatggtgctgatcaaggatctagtgacaagttcaaatgactgcgttgagcttagaagttaatgattgactgatagcaatgacgcagcctgactttttctgctcttgagtctcccagtttgttaaatgattacaggatccttatgcatccttttgggctattttctcatctctaaaatgggggaaatgtggatgtgaagatacatccagcttctctacggagggatgaaaattacctattagcggcctgttttgaagagccagtcctctgtagtatcaggcacttagaagtggcagccttatcttcactatttcatctactttttggatgcaataagaccaactatttcatttcctgatcttctgatggagtgtcctttcttcccttccatatgctttctcccatcatatttctatttggcagccatcattaacatgaggtccttgcttaacaaagacctttcagtgcattttatttacctttaatgtttcaacattattcactatccatcttaaatatgaggtcactgtgagttgattccctagagagccattctattattcctcccttctgtatattttctagtgtttttcctagtccctttttaatgactacccacacagagcttccttcatttgctgtggaaatgtttgcactagtgactcatggtgcaaacagatggggactcgggtaaggtcctcataaatcattctcaaggattatctatgtcacaatcacaatttaaagctttaggagagactgaatgaattagggataaatcctatatatcatctcatatgctttgcaggccgttggctgaaatcagcacggattaacacctttcccagcctccattcttctatagtcttaatatttttagctaggaccagggtccctgattttattacagttttagacatacagtgctgttctggaaacgttattttcactagtttttttttttttgctcacaccaaggagaaatgcaggtgacaggacacaagtgttcttgatgtgttacaaacatttgccacaaactggttgcaccctatatttcctggttgaagtgagctcttgtcaaatgcctgcaaacaatgcacctcaagtcaggggagcaaggacgcgtgtaaaggattcatgaatggcaaatgaagactgaacagaaacactttgagcagagctgttgattagcatcctgaaagagtgatctcttagggaggaattcacctcttgatatttcattgactctggacttatcatgtgtggaatcaggcagtcctgtaggatttaatttggaataagtgaaaaagaaacaattagaaccattgtaatacttgttgcagggaatgccaaacaagcttcctttgttgtacaattattttggcgctaataagtatgtctttatgccctctagattggtgtcttggatatttctctccctaccttgtctttccgtgtaaaaactttagatgaatacaattttctattaaaaattaacttgtatcatttgaaattagcatacattaacatttctttaaaactagagctctgcaaagctttttcataatgtctctctcatgagtgtgaaatgatttttgatttttttttaatccagctgcaaggagagaggataacaacatttctgcatttctgagttgtgtgacttagcctttttgattcttaatttcctcagctgcaaaatggggataaaatatttactccctaaggtattgaaatccttaagcaatgtacacaaagcatttgaccaagtaattgacacgtggacatataagatggtcaatattttttctttgttattattttgaatatttgaagtatgcacattaaaattatagtagtatccactggttataaaatgccacagattccctcaaataactgcgtaacattgagaggaaggaaaaaatcatctcttagtgagagcatctttatttgaaatcttcgcacgttggtaattttatattagagattttgctcatcagtttctgtacagccaagtgcatggctttacacgttgctgctgaaatgataagcaacagccgtcttattcctaaagactctcagcacaattttattaaagatggagcaggtatctggcacagaattggagtatagtaaatcgtgcaacaaatggtatgccagaatcaatttactgcaggcccccaatacagtcgctttctccttaccagtttccagcataaatctctgtgcacaccttatatgaatgtatcacaagtagctgaatgcctttacgttgtctctctaagcagaagtttatgccataaaggtaatgtgaaaaatagagaataactatcaagtttcagtcttcctgaattgtattcagggaaggggggagaagagggaatcacaggatatcagtgttgggtcagtgcttggtgattgctgctgacttttcaccgatgaggaaactgtatcacagagtacggaagtggcatgttggagaacgctacctgagaatgaaagagtcagaatttaagcccatgtcggtcacctctgaggtccctttctcttttctgtataatatattgctgtcaaaatttctgagtggatattttttctaattagttgttgcttagggcacatatactttcttctcctggagcatgtgatagaaaacagactaaggtatcttcatctactatgtgccatttgctttggatgcagtttctcattatctgtgggcagtctctggtatcctgattacacggatagtgcagttaaaaattaaaaatgttaattctgtctctccagggcccacagttcgtaaatgagaagggggcttaaaacttgtctcagatccactgattcttggggtaaagttaatggataaatagaagttctaaatatgagaaactgtgaaatcctgccttccagctctgcatttgcatgcatgattaaaagacacagcacctcagaaacttgaatttgtacttcatattgtatataagtttgtattatagatatatattccaatggataacttggttctaagcctttttgttttggtaaattagaattaaagaaattataaactagaagaggaataatgcagtaaataaagaaaaaaatgttcaatccacctctgcagggacaagaatattgactatatctcaaaggttatgagttataaataagaacatgttaattatttctgtttccttggggtggatgttcatttctaccagcctttcctacgaaactatgcatcttcaaatatctttgattctcgacactatttaacattttttccaaatatgcacattttcaggaaagatactgggtgatatccttgcctgttgggtgggactctattttagattttctgattgttataatgataagatatactgggccactgaacatctagaattgatccttccatccattacacaggagtaaaggatattgtatcatgcctatagaaatagcagggttgcaaatagccaatccattgctggttccaatttggaagctgacaaatacttactttattgccctgccacatgcgaagtctatctttctgcctacacagcacaagtcagtaacctacataattcttccaggatattctaaaagccccgaggcgggagttcatactctgtatatttggcatttggaatctcatatggaagtgcattcagtgacatcgtgggagaatttccaaatataccaaaacatttattttgcagttcttcctatttgcattatttaatttgtgctgtcttgctaatatttgcctttgtcatatatttgtcatattatacatttgccatttaaaaatttgacgcagcagtacaaacgtatttaagctgccgtgctgctcagaagggcctattatatatcaggagtctgaagagtcaaatcaaatcacagaggatctacttttatactcttacttattttactgaggtttttcaacataaacaaccacagcaacatcttaaagtcatatatatctctttgattccaaagtgaaatactccattcataagacaatgaggagaaaaagagaattagaagccgaatgactatacaagtcactgttaaactaggacactctcgagagtaaaagggagctagtagtcatcacactgcatgtgttttatgcaaactgggactcagagttacccttgttaaagatgtgttatattgctgatctgaactgagttctcaaaaagaagcccaagcaaagtagtctatttgttgtgctaaatctaagcccctccctactcaaaaatccctgaaatacaatatatttatacatagataagtatacgtttacctatgaaaaaatatacagtaggaaaagcatgcgattgtgctcagagtttatgttcctgagttcagcatattttgtgttctccgtagttctggtgacagaattctctccttgttccagtctgctgagatgaccatgggtccatctcttcttggccttgtcactgccccatggtaacatcttctgaggtggtctcatgctcatctgaatcttaactagccagtccattcctcttgattgcagggtcctccattataaccaagagaaccctcttgtttcacccaggttgggtgtctcatttctgtcacttatggtcacttgaagaagatatttggctgcttcctgagccctgatggggtattcagcctactcagggaaacagtgttagatgcatctacccaaccatcctacacaggtgactctactgcacccttctctgccatggggaaatagagaactctttaggggtatgtatgccataaatgcttcaagtgggaagcagaataaaaacaccctctactctcaaccttataaacataaatggagcatttctgccagtaagatcccaccactcttttcagtcttagagatactaaccaggatctcactgacccttctttcccaccccttccagcttcccgttcaaagaggatgcgttggggaggggggctggtacgggtgattgctgggtagcctggatcatgtattctcttaatactctactctatatctgtatcatggtcttcccccaccaataaaagccaagactttgacagatgtattctctggttctacttttagcatcatggaggccttgagtctggcagtgtcaatgggagaaggtcacagcaaagtaaaaggatggggatgacagggaacatactggtaactagtgactggctagtacttcctgtccttctacccctctgagtttcttgagggagcaggaagcaagttcgttcagctttgaatgaaagctcgcagctcacaaaagactgaacaagctagggcctccttagactgatgttaaacacaagtaaagcacagtggctgtggggtctttccttagagtcatattggcttggttgggatccctggcccctgccagcttggggtgactgtattttataggtcaaaatctattggaagatagagcaaaatgaattaagtgatagtcagaagtgggatatctcaaaattatgaaaagtttatctgctcgggtgttaccacactctctcctcctgcttcccccctcaacttcttcctatgctctacctttgtgccgcccctccccccggccacctcagtgtaaaagccaccaacctcagcctgcttctccagctctcacaacttaaatcccacgcactgtctacagcaatccgacaattctggttttggaaagaccatcaatgtctgtcttgacatacagtgagcaccctattaatacctactgaatctctctcaacctttttgtatatttcaaaaaacatttgaaatgatcctagaaaagctcagaataaagcagtcctaattgtttttctttctaaagacacagctgaaagcctcaagagtttttacagagcacctattaatttcagggcaattagaagggaggggaaagatcagagaacgtatcaacttgctgtaagaggcaaacctgtgcaaattaagtttgtcgaaattatcagcaaacagttggtttctgtctgcccctaactggatttcagcagcattttattcagtttccacctcagtattttcatctaatgctctgtgcttttcaaataatattcatgtataattttatttttagaaaatcccatgagttaatgaagatgattcctatttccacaattttgatctcaaggaaactaagacagagagaaggtaatggaattgcccagtttacatggctacagaatagttaagatttcaacacagttcttctcccttggtctctgattcttctctaacacatttaatttttagaacaaaatatgtatttaaagaaaatattgaatcttcgctaaacggcacaaaagaagttatatatatatacacacatacaatatcagaggaatttagattatttaatcactttctaattgctagagcaatcaaaaaattgttgacatcataattaaagaaaactggtagaatctgcccttttctttaagtccacaccatctgagaattgagttaaagttgaaaaattccaagactcctattttgcctatcttgtggacacattacttgtcataggaggggtttacttgaaaattaaaattgtaaaaataataaaatgaaaattagaagaatggctgcccctcatgggcacatctgattctgtcagaatagcattgtttttttcaaagaaattctgaaacagctgtaatatttttgaaatacttgttagtgcatatcagttgtgctaaaaaaggtcgtttataaaaatctgcaaattttatggaaatatttcctttggttgtgagaaaacacatttccacatgtcaccatgttcacagagctggctgacagggttaagaaaagtgtgaatttattaatgtgatcatagcatcatccttctatattacctatgccatgccaaattcccataggaaaagtattagggtaatagttgtcttcctctttgttttacagctggatattttaattttctataattataatttggtgtgtaaattatttgcataatcctatactatgtcatacatttttaaaagacttattgacaagctaaaatttggaaatatcagctataatagaatacctttttaatgttcacgattcaatataaaatccttcatgtgaagcatatgatttataatctattagattttttaaaactatttaaggttgacctgtgaaaacccatataaacacaatttatgatataatagggtttagctggatggaatacagtaataaataaaaggtacacaaacaccgtttaaaatgcatatccatataaatggttaggttgtgttatgatattgtctttgtagattctggttgtatgtgctcaggacaaataaagcaatatctattgtctgataaaagaaaattattaaaccaaaggtatttgcctatgttacttcaatctgagtcactatgattaatgttatatgatatttttctttaaaaatctatttttatgtctataaatcctctctttccccactctggaaatagtgtctttctaccaagaaataaatattcagcattgctgttaatgaaaccatgattactgattattgttattttatcatctctactgtcactgctggtcatagatataattatttcttcatttcagtaaaatgtttgaagaataattttagcaatgtagtatatggggaatttaaagtgacagttgttacggatattgtgtatcattgatagttgtagcattgatattttaaataatcgtatttaaagttcaaattggtgatggattctattgattaaaggcagaaaagtgaaccttaaaaaagtttctaaaagagagctttggaatgaatccaaagatgatatattgcaaaatgcaaaatgggcaccaaatagttaaaaaaagactaagaaaatgaggctgtttgctaactcaagataagatgctaatcctttatagcctaataggaatctcatatcctcccctatgagtcttattctctgttgagctttagtatttggttcccccttgttattattattaatgtgagccaatcaggttgaactaattaatttctgtcaaatgaatcaaagtctggtgaacaggactaagatgttattttttctaatcatttcaaatttctccgagtcaaatatattaacacagtgcttgtaagtgtattagtataaaactgattgcactgaaggttgatgtataaaaagctttgaccaggaagagattaagcatttgcattcttaatatgtaaatcatagataaaagatggaatagtaaaatggctaaaactaaatcagagatagtcctgtaagaaaacttccaaagaaacagcagtttcttttgctgaattcaacaattaacctgttctttgccaaactgtacatttacatgagaagtaaaatattgtatctcctgtgttcccagcatgagccacaaaagtgaagccagtccaagaagtgtctcttttgtccatcaatgtgtccccagctaaaccttttcttttgctttctcaaatagatcaaaatctaccatttctagagtgattgaatcctcagagcatcttttggtatcaaaccgttttttctttttttctggtttccctctgctattagaaaatacaataataatttcaggccaggcacagtggcttatacctgtaatcccagctctttgggaggccgaggcaggtggatcacctgaggtcaggagttcaagaccagcctgaccaatatggtgaaaccccgtctctactaaaaatacaaaaattagccgtgcatggtggcaggcacctgtagtccaagctacttaggaggctgagacaggagaattacttgaacctggaagcggaggttgcagtgagctgagtttgagccactgcactccagcctgggtgacagagcaagactctgtctcaaaaaaaaaaaattattattattatttcatcctaatctacggggaccagtatttataaatgaccctcttcaattagagaagaaagatgtctgcttttctgttatgtctcattctgcttagggcagtatttcacctactaacagtttgtgctcagttgaggatctccttgttttagtgtagttatagatgtattgggtggagtagagaatcatctttatacattttatcattaatacaaacatacctaattctccacaaaagctgagaaggttcagagttccagtctaaagaaagaaaaataaattctttctatagatacatataatttcagattacacagcatgcctttatattaaacagatgttgaaccacacctataatattattttcaaattttatcactgagccacataaaagatatgaaaaaagctggagaagtttcagagaacagtaactcaattgattggggctgtaaagtaattccacacagcattgactttaaaagattggggatttatattcaggaagtgttcagatttagaaatgatatcattgaaaactttgaaagcattcctaaagaggagaaaaagttacttaatcccagaatactagtgcaggaaatttcttcttaaagtttgagaggagaaatattcaaacaaataagattctactctacacataagttataaaagagatgtaacaaggcagtgttctgatttacacaatttacagatgaaaaaaggctataagagggaagaagatgatgacagagttcacatgttgcttgagcagagatgcagcctagatttgcactgccaagcacagtagccactggccacgtgtgcctgaaatgcgactggcgtcactgactgaaatgcgggtcttcaattttatttcactttaattgattttaattttatttaagagttaagagtttaattattggaaagacgtttttgaagtaagtgtggaagaacttgaatatgtaaacctattttttcaactgtaaattttataaaatctagaaatagataaaatatttccaatgaaaattttgcatttgaattgaaatgtgttgtaaatgtaaaaatatagtaatacgaacaactaatttatttgtaatgtggtattactattttagctcattggtaaatgtttaatattgatagattttgaactgataatattttgataatttaggttaaaatattttcagttaaaataggttagtgaaaatattttcacttgtttccctttacttttttcatgtggcagctccaaaatttaaaagtacctctgtggctcgtattacatcttatatttccattggacagcactgatttgaccatgaattgatttaagtgattagaccaattaacaaagtgtttagacaagcctatcctaagcttacccacaaaactgagggaagattccctttatgagatgaatgtcagcccacagctcattgccttcttccatctcatccagaacctcatggctacataaacaaatgtcctacaacagctggttcactcctaatttcttctcctatctgcactgactgtcacatcctgcacccacttacccgaaggcatttactgcgatttaggatcttgtggccttatgtttctccaaattactttgaaggcagcaagatcttagatgctacacccccacggatgaaccgagttgcccctctcttgattaagtctagtcagcatgagctgggcacggtggctcacgtctgtaatccagcactttgggaggccaaggcatgtagatcaccggaggtccggagttcgagaccagcctggccaacatagtgaaaccctttctctactaaaaatacaaaaaatcagctggcgtggtggcagacacctagttatcccagctactctagaggctgaggcagaagaatcgcttgaacccaggaggcggaggttacggtgagctgagatagcaccactgcactccagcctgggcaatgagagcaaaattctgtcccccctgcatccccttcaaaaaaaaaaaaaaaagtctagttagcatgactgggcttctgacttagggccactccttggtccattcagcttagcttgtcttgtaactcaggaccctttgaagacataagcccttctctgaatgtgggctactgtccaaagtatatgcatcctgtcattcattggctagcactctcccagtggctggaactggccttgcttctctgcattccagctgcgggctcaggtctttatagacatcagtgcctgtaggatccgtggcagcctgcctgtctcctaggtagatttgcgatcttggattccccatgacactgcttgccttgcctaacttaactgatgctgaagacatttgggcttaataaacactgggttgccccttagagcttgatactttaatgctctattttcctggagaaagcctccttacccatcaccccactcaccatggtgcccttatttccactcattcctaactctgaccccatcttccttcttgagccatagagagtgaactgaggaaacctctaattaagtcagctaatatcatggagtgttaacaacaatatatttttgtgaaacatctttttgtgcccttatcgtagggaatgtactctattagaaatatcatcggtcttccctggaacactacttctgagcgtgaaagggtcttcccagaatctctgacggtgtcccacagagataatcacctattgtatgtttctgtatggtgaactcagctcctctcttaaatgatccctgagagagttatcattacagtgtcctgatttacaaacttacaggtgaaaaaaagctagaagagggaagagggcagtgaaggagttcacttttctcacatagctctagggtaaactataaaaaactaatttgtctctaagtttttcaaggtgaatacaacagaccaggtctttaacaagagtctagaaggatcaggagatcgaaactatcctgactaacatggtgaaaccccgtctctactgaaatatgacaaaattagctgggcatggtggtgcatgcctgtagtcccaactacttggaaggctgaggcaggggaatcgcttcaacctgggaggcagacatcgcagtgagctgagatggccccactgcactccagcctgggcgacagggcaagactctgtctcaaaaaaaaaaaaaaaaaagaaagaaagaaaaatctaggagaccttagagcctggtttgataaggggaattatgtagataaaagctctgggaaataatttgaaagaagagaataaatagtctctcatttagtattaatgcatgtacctcttcgacgtggaaaggaaagaaggtaccaaaagtgtgcagcaatggctttcaaactgggaaggggttgaggttgtactccccagggacagttggcaatttctacagatatttttgaatgaggacctggggggcagaggagtgctactggtgtctaataagtagagaagagagttgctgctaaacctcctacaatgcacaagacagcccccataataaacaatcatccagtcccaaatgtcaatagctccaaggctgggaattctcgcgttaaagttcaccgacattttaatctcacaacattttaatcccacatacaaatagactgaagctcacagatattaaacaatttatttaaagtattaggactaattagaaatgtgattggacgggaacacagagagtttcattttcaggactggctttctcgtgctaacatgctgtctttcccattattcacatgttcttctgaatttattaagaacagtttcatgaaacttttcaagtttgatgaagctgttgaaagggtgcggctgtgtttatatgatgtgtaaagcctgcctttcctgaaactgaataaataacacaaagacagctcccatttgacaatgctggccattaagcaggatacaagaagtctaagttattattcttactttacctgaaagaagctaatgatcttagtgaggagactgagctcagcattatgagaatgtgtgtaatagattaggggcttaggactcaccgatccaactataaaagggttgtgcaattttattatttgattagttcatcttagccttgtgtactttcctctaccattcctgtggccaagtcctccatctacatttcctccttagctgctgctttttatcaagggaattatttaatcttggtgccactaacaaatttggccattactttatggcttcctcctccacataatcacatgattacatcttattagaagggtaagatgttcagtatcctggacaactgcttttaacttctcgcccactgaagttctttctttgctggatttagctaatttttaggccataagaaaacatttttggctttaaattttaattaaatttgataatggatgttctattggattttaattttttcatggtgacatgcattcaaaatccattgtcatatttcttgaacacctactatgtgccagataaaaattatgagcgcttagtattcagtcatacataccataggcagaagccctgtcctgatggagcttacatcttagtgaaggatacagatggtgaactagtaaatatacagtagaacatcaaggtatgataaatgctggggggaaaaaagaaagcaatgtaaagggatagggattgacagtggttactgttttgaatgagatggtccacatctcattagatgtggtatctggaagagtgctaaggatgatgaacaaaaatatgaaaaaccctgaagcagaatgttttttattcattcaagaaatattaggaaggactgtgtggcctcagggtggagagaagaaatgaagatggcttataccaatagagagggagctaggagtagaaaatatagatccttgtgggcctgtgatcctgatcctgtgatccctaaagagaactgctcttgctcctctgagttgaaaaactataggtggaacaagatgggggcaggaaaaccagtgaagagtctattatagttctcctaggaagaaatgatagtagcttggaaagaagggatagtaatagacagtttgcttgttttgttttgttcttttcctaagaatgttcataatacaaacaccttacatttaccatttgcttttatatttggcaatgcaccattctaaaccatgagacacgacttcctgagtttccatcctggatccatcacttgttagcagtgtgatcttagatctataacctaatctctctgattcttttccttctctgtaaaacaaagttaatactggtacccacttcaaggactgtgtgagttgaaatctgtataaagctcttagaattattactggcttatgttaagcattatggttttttaaattattattatttgttcttcaaacaaacctataagtatttgttttccttctagaaagcaggtcagtattatttaaaataatatatgttatgtacatttacttatttactttataaatgaagaaacttaatcaacagctaatagatgagtcagaatgcaaaccaaggtcttttggctctaaaactaggtccctttcctccaaaactaggtccctttcctccatactacatgatggtcaggttgtcagatgctacccaaagctatttatgggcctgcactcctcagtctgctattaaatatctcaatcacattcaacagatgtccagcaaaagttctttgaggtttgtttcatttcgattaacagagaagtgctgcagcagggatcaggatggtgagaagtaacctaaaagccacaattccatcatgccatttttcccagtatttcaccttcacagtctataggtatcatctgttcctattgctttatttatttttggctttctcagagtaacttattacttccacaagatagtttggactttaaaagcatttttaatctattaaagaaatttttcttaagagttgcactcttctcttgacaatatagggtaatcatttaattattttttgataaaatcctctctctctgtatatatgtgtatatatatataatgtatgtgtgtatatatagtgtatatgcgtacacatgtgcatatatgtgtatgcatgtatatgtgtgtgtatatgtatatgtgtatagagagagagatacaaagttatagttgggaatgtattgaaagattcaggattgctgcttagacatggttttttttattgatatttgaggccagataatgctttcctgtgaggtgatgtcttgtgcattgtaggatgtttgacagcatccctggcctctaccctctactggataccagtaacacagattacctctcccccagttctcaaacaaccaaaaaatgtctccagacattaccaaatatcccctatggggaataaaaattgccttcagatgacaaccagtgggttagagacttggaaatgtgattggttttatttgtatgcatgagactgctgatttgtctccttaaaatgtgaactctgtgcctttttagaaaagtctgtgctgcttattatcaaatgggtatgttatcaactgagtataattttccatatgcctttcaaattttccaggcataagaatagaaatacaaatgtgattggctcattaccattcaaatgggaaatgagaagatcaaagctatatgaaataagtagcttgatcgaaaataagtggaaatattgccatatttagatctaaattttagtgacattgtaccctatcagtaaaaatgtttgaacatgaactcctcatctatgtatatttattggaaaacaaatactcagtctttcccagcaaacagaaaaggagagaatattccccaactcatcctatgaggctagtattgccacgataccaaatccagacaaatacagtaaataaaaactacagttcaatatctctcatggagttatctgcaaaaatattcagtcaagacaatgtgatattagcagaaggatagacatatagaacaatggaacagaataggaggctcagaaataaacccgcataaatatgctcaactaatttttgacaaaggctcaaagccaattcaatggagaaaagatggccttttcaacaaagggtgctagagagattgtgtatccatagccaaaaatataagaaataaaaaatgaacctccacgtatatcttataccttatacaaaaatgaacataaaaatagatcatagacggctgggtgtggtggctcacgcctgtaatctcaatactgtgggaggcccaggcgggtggatcacaaggtcaagagatcgagaccatcctggctaacacggtaaaaccctgtctctactaaaaatacaaaaaattatccgggtgcagtggcaggcgcctgtagtcccagctactcgggaggctgaggcaggagaatggcgtgaacccaggaggctgagcttgcagtgagccgagatagtgccactgcactccagcctgggcgacagagcgaaaccctgtctcaaaaaaaaaaaaaaaaaaaatcatacaggtaaaatgtaaaagaatacaaaaaaaaataggatattgtctccaagatcaagggctaagccaagagtcctcacactccaaaagaacaatgcataaaaggaaaaattgagtcactgggtaacatcaaaattaaaaactgttgctttgtaaaagaccctttgaagaagttgaaaagacaagctacagactaggagaaaatgttttcaaaccacatctctgaaaaagaactactatgtagattatataaggaattctcaaaactaaacaatagaaaaaaaatccagttagaaaatggaaaaaaaaaaaaaaaagaaaatgggcaaaataaattaagaggatacccagatggcaagtaaacacatgaaagattttcagcatttttagtcattggggaaatatgaatggaaaccacaatataatgtcactacacacctaacagaataaaaaatagcaatgactccaaatgcttgtgagggtaaggagaaactggatcacccctagattgctggtggcatgtaaaatggtacagccactctgaaaaacagtttgacaggttaaaaaaaaattcaaatatcatacagttcagcagttgtactcctgggcatttatttcagagaaatgaaaactcatgttcacaaaaataaatatataagtgtttatatcagttttatttctaacacacaaatctttaaataggctatgtgttgttcagcaggtaagcggttaagcaaattgtgatttgtgttgtggaatactactcagcaataaaaaggagaactctgaataagattggtgggccacaccaaagtcaatatttgtgtgtgatactttattatagttttgctaaatgttaccattaggaggaactgaacaaactgtacttgatcttctttatagtatttcttacaactgcatgtgaatctacagtcatttcaacaaaaatacgttaaataaaaatgaaaaagataagataaaggtgaaataaaccacgttatatagtattaatgataatggcttaatactgtcatatacatcaaagtgcattaaatacctgaaaaggtcattattgccttattagatatagattcatagttcaaatagtcttcttaataacctttattttttttcctggcttcacatcagatctgattatattgtcttttgagaagtaagttaccttgttaagaattcattctacaaagattggaaatgtctattcttctattttcctatttgcttagacctgcatattacaataattattttccacctgccatttatttgtaggaatctttttgaggcacttgttcattttaagagggatttttaacataaggtaatctgtgtctgtgtaaccaggcacacgtaagctaccagatactgcagcatgctgaaaacagtaaacaaaccagtaagagctccactggcttcccttggcatcttaggactctacactcatttcaggaagctttgcatgtggaccataagtgacacccaacctccgactttcaatagaggaagggtgccagaagcaatctgtgttgtaaacattaatagagttaagtgtctttcatatctgttctagatgaaattattattataaaaagaagtccaacattttcatcttgaacactaaaggatctttctcgatagctgcggtggtatttgccagttcagagaccactagtttaaagaataaagccatgtgtggatcaaaaagacttgatacactgcattgcaggtagaaaggaccaggcagtgagaaagccagcaaggtgctgcgtagaatttaggttaactgaatgctacaggccttctgtatcttgcttatgacccctaaacccagttactagctaattgagaaagtcctagaaatgaagacatcatcatatctaaacatccaagttgtaccaaatagcaactccttaggtccaatttatctctttcctttttattaagtaaacatttccttaaagtataacacacagatggaaaagtgcatatgtcataaataaacagctcaatgaaattactaaaaaggaaaacactggcataaacggtccccagatcaagatatagaatgttactagcacttgtcaggccctcttgttcccacttttctaattctgttccatggagaaccactatcctgacttctgataccataaattaatgcttatttgggggtttaattttaaagggattaggaaatacatagtgttctgggtctggttttatccatgccattgattatgcttgtagttcattcattctcattgctgcatattattcttttaaattattataccacaatttattttattgttgatggacattttttccttcacttttgactattatgaatagtgctgttaaatacattcttacattctcctctattcttattccagattgtggcattgttttcctgtaaactgtggtactaatttccctaaaaaatctttgataccttatattgaaaaaagaaaaagcaatcctcctagaaacaattagctttcttatctatacagtaatacaaataattcctgatcatctatagagtttgagtccaaaggctatgatagcatgaggctgagtaaatatgggatgttgaatgagccctctaggtctgagattccgtaagaaaaagccattgccatgtgctgggaggggtcagggtagagttcccaaggaaaggtggaacccagagtttggaccttgcaagttgcaatatgtatttacaaggaagagtagtggttcaaagcaagagaaatataaaaaggcatggaatgaaaatattattggcttgggttgaacggattagaataggataaagtgtaaattactccttgtgtcgtttcctctttgattctccaatttacaggaaggtagtcatagaataacactgaaatccttctgacttggtgtatcttagaaaataaaacaaaactgtgctagtctcagaaaaagggcagtgcagaaagtagatctgaatacatgtgaaatgagccggcatgatgaatatttgtctgttctcactttctcttctctgttctcgtgtgtatgtgcccacttgcaaagtgaacagtgatggtaattattaaaaccattctttgctcataaactgagaatgtttgaaaacagagccagagagacaaaaatgactggacccctatggtgcatttttgttttatttgcttttacgaaaatatctacctgcctctacatactgggttgaggctccttctcaccttacccttctctcaggcagattaatcacctgtctaagcatttgaggtcctgattaatttgtaaccctaaatgaaggccagagaatgctaaccatgtcctctgagttgaaacagttttcagtaggtggatgaaaacccatcttgctaattatagttttggataacagattaaaatatgtagaaaggtttcctccttagatgattagatctttctgaatgacaacttttctatttattagctctgcatgccttagaaaaaatgtgcttgtgtgggagagctccagaatgtagctgccagattgggagcagaccttgtattcacgtgtgcctttctgaagctcagtttacagctttcctaggtttatctgttctgtgcctgggttttgcttataaagtaaggtcttgcatgcctcaagaagtggactttgttaagtgcagtgcagttaagatctgcagtgcagtggggacttttttctttatataattttttaaaaagaagctgatgggagaaataagagccccagggaatggatgcttatgtgtagattttgctgatataggagaagaaaagataactgtgttttgaaaagacatgtgcaatagtttaatcatttccactagctttactagttaggatatctggataagttgcaatgagggacaggcaatgggatgggggaaagtaagagaggaacaggtaaagcaaagttaaaagaaatggaaggaatttggttatgtttgcctctttgtgttgaatctttttgctctaaatcagggtttttgcaggtttataaagtggagcccaggagggatccacctcagctgttatcaggccatgactatgtaatgtggaactgaggatggaaataataggatggctgacatctggctaattgccattgcaattgaaagctgcctgacagttgtgtgaaaattgcttggagatgaagaactttcaatgaaccatgatggacagaagtatctgagcaaagaaatagtgggcaatgaaaaagatggactggaggacagggaggaaactgcctgtcatattctctcctctcttgtcttctcctcccattgtatctcaagagtaaaagcttactcagttaatggcaagttattttcaaagagaaaacagaaagcagaggtttgcaagtctggagttacattaatttcccttaattttgccttcacccaaagcctactgaagcaccagtcatccaagggtctcttcctaaaccagtgcttccaagctgctcagttcccaagccctcaaaacatgagcccccagtgctgccctccacagtgacaactccgtcgtcctcctccaagcacctagtgctgagaagtgacttctgaattgtcaagacatttcctatgaatggtcaagacatttcctatgaatggtcactcccagaacaggcttgccgaaccctgtagcataagtggttactgctataatcagtaaatccaagttaacttacctaatcaacattgtctccttcatctcttcccatcctctcaacagaggcttctcaggtaatacatacacattttaattttggctgtgtggaaaccattgttgatcattaaatagagtaatattaatggtagggtttcccggagatgtccaagattgtggataatggtcctaaagaagaaatttgcggggaggccttgctttatgaaacccttcacaccacccctgacttgtgaggagggaatagctgcctactgcctgatccagttctttttatgtccctataaatacagtcgttcagattgagttttaaatactttttgttatattatgacaaggttttttttaagaatttaggcaatgattttttttttaatttagaatttcctaatagtgttaagggccagagaatcaaagtattctttccattttataacattggttaaaagtgccttacaataatagtttgtgttttgctgctttagttagtgttctcatgcatgagttacactgctgtggtcaaaacctgtaaacaaattctttggacttacaaacagttttggaaattgccatatactgtcctgacaagtaattttactttctgtttaattatgcaaacttaaggggactattgaagaaaaatagtgtatttttcaggccaaaaatatacatggtggtatatttaaagccaaaaattctgttgagagaattcattttgtctaggaaacattcgtattctttttctcgctttgcatgtgtacattcagactatgatgctcaggatttgaaaaaaaatgcatacttgaattgtgaatttttttttgagatttaactaagttaatttttgtaattagaggaaattaataaaatattttggaagaaacttaaatttatatgtcaacctctgggtcaaatagattcatttgaggttcacatttaaactcccatcatgttcactgaataattttaaggctgttttagtcatcttgggctgccataacaaaacaccatggactgtttgctttaaacgacaaaaatttattgtctcagttccggaggctgggaagtccaagatcaaggtctggtagggttcagttttcagtgagggctttgtttctggcttgcagatggccaccttcttactgtgtgcctacatggccccatcaccaaatgccatcactttgggagttagaggttcaatatattcgtggcagggtggggcaggggatatcaacattcagtctataacaaaggccttaggactctgctgataaactctgtatttgtcttcagtttgggggaggtatacaggaatctgggttacactagtttgaggaagttatcgtaattttaaaactaaactggaaaaggtgaatggttttctccataggttgtttattaataaacagcagctttctcttctatgttgactaaaggtgacataaaacttcatattgattagtagctgagtttctatccctcatcctactactgcctctccagccaaagcaaattgcagagttaagatggcactcaataaatatttgttggaaggattaatgaataaatgaataatttaggcaaaatctatcaagcctaaaaaaataatcctcaatcttattcagtaaacattgtctgcaagctgactttgaaaaagagcaatggaatagaaatgcccaaattttaagaaggtgatgacttagttgaaaaactgagagatagaataaaattactaaataatcataaggcaataatagattaagacatagttttgggttactcatggataattacatggtccagggataattatctacagatacatccatggcagtatctacctgtacatggttttaccatttctatggcataatttttatttggttcaagataaaatcaaataaatttttacaggcattttgtctagatctagattccatggaaattatggacattcccatcgttagacacaataaccaagctgagagatgcctcctcttgttctcttccaggtgtagtatcttagtgctgtccaaggactacaccaaattctcaatgagaccccctgatccagaactaacaacactctcccgaaaatctctccttttttctttctctaatttcagagtgccagataaaatataggatacccagttaaattttagaaaacaagtactgcatattgcgttatttacttatatcaaaagtatcctatttttatttgccgaattggcaacctttctctaagcctgtcccaagtgccactttatcattgcattgtaattttaaccacccttcaaaacacagtctatttgaaagaaaggattgcagtcatgtataaatgtctcatagctagattaatgtatagtcattaaactaagtatgtttgtatatttatccagaggatcagtcttctggaggttaattttgaatataaatattttatagtaccccacctcaagagagaattgatactttcttctcaagtttgaatggtcaagaagaggttgggtgtgacaatcattgcagatctgtaagagtggtaattctagcaccacagtttgagaacgggacccagctatagaaagcatgtgatagtcatggccacagactaaaattattctggtaatattggtatgaagtgattgtctgttctgatgtgcagaaacatttatctttttatttacttactgtcctctgaaatgtggatgaagaacactgggttaggagtaaggaaacctagatcttattcccagatctgccattgttttttaggtggtctcaagtgtactgggccttagtttctcacttgcagattctacatgattgcatctcaactttatataagaagcagctgaggtgtctaggggaacatggagatttctgggtttcccatcagacattttgattctggcaccctaggagtgggccaggatgatgaatatttttaacaagcacacaagttgatcaaatgcaagtagttctgtaccatgttgtcaaacttagagtagatgacctctcagtccctttctatttagttttacaaatgtggacatctgtgattcaaagaaataaacaaacttgtttatgtagaagtgtgttttcactttttagaaacaaattgtttattttagaaaaatcaaaaaatatagaaacataaaaaagcatccattagaagtttaaatgtcttataacaatcccacaaaatgcacaaaagctaatttcaaaagctgcattaactctacattgtgaatgcctctggttacttgtttattgggcaacttaatctaaaaaggttctttcatgaattttcatcaattttgcaacaaagccctgttgcaaattgtgaattatgcattaacatatgttcatgctaatttatacactggtgacaggtttttggcatgggatcaataacttacaattacaatttttaaagtttgtttattaataccagcagggacttgggattatcatttagttaacaatgtgtaatttgaacccaattttttaaaaagagcaagttctgccgttgtcttaagtcagtatatttgtccaaggaacaacaaatgaatctgaaactaacaagataaatgcttcctgctcttctcaattaataatttttatagttccgtaagattgtctgatgttggtgtcttgtcatcagacgtaaatgtggggtgttgttacaccaagtttctctaatatctaaataattataggcaagcctatttaggtcacaatacttaaagataaaaattataatttcaactagctgcttctgaaaatttaatgtgatgcttcatttctttatgcatattctttaaagttaagacaaaaaattcctaaaaagaaatcagaataatcttaagaagcttcaatagtatgtttctctctctccagcatgcttttatttaaacacattggtttgtaaataaaccttcttttgaaaagccctggtatacaaaaaatattctaacaaaacaagtaaattagaggttgattatttgcaatgcttcaaacattttctgctttaaaagtataactgcatttcccttgaagaagctcctgcttattacactgaaatgggatttgtctcaaataattttatgccaactttttggaagcacattgttatgtaagtggaagctcagcttttctatacacagcagcaagtatttgatcaatcactattactaatttgtagagcggttttagctaccacatctgacaattatatttcaatatttattttataaaaatgaagttactaagaataaatcaattatatgctcactttatccctctggtgatgaacagtggagccaaagggagtgcatgagctttgagtatgcctgctgttcatccttattaacaactttgcaggtgcgccttgctggtggtgggagaggtaggaaagaaaagagcatatttttctaattagcagttctatatcagatagcatataatagaaggccaagggtaattattcctatgcccacaataggaatttttaggtttttagatttttttttatttttggtcatagaaggaatacaattttgaatagcagagagctgattttaaatcttggttctctccattgttaatagtgtcaaggtatgtatcttctctgagattttgcttcttatctttaaaataaacatgataatgctctgtttagtgggttcttgtaagaataaagttaaattatcctcatatatatatccttaccattctctcgtatttaggaggcaattaatcaacatttaagtgcacatttccatccactctgaaataatgaagctgtctctgtggtcctgatttgaaaccaaagctttctatgtcccctatagccactaggatgtctagtctatatgatatcattctgtatctgttggtaggttgctttacgtttgttagtaaacctatatggtcatccaaactagcctggtagaacctttagcccctttcatgcccatcttccaccctctgcaccacaacttccctactcctacccatctgtagcaatctgtcacaagcattgtcaaactgtggcctgtgggccaaatccagccactcacatgcttttgtaaataaagatttatctagatatagtcatccccattcatttacacaaagtggatggctgcttttgaactgcaatggttgggatgagtagttgtaagaaatctgaccgcataaagcctaaattattcactatttaaccatttgcagaaaatgtctgtagactctggtcaattacctaatagaatataactagggtttttaaatatggttgattaaaaattaagtacttgttgacaaatagatgctgattaagtggagaacagaaaaatgtgatagttattgtcatagacagatcttaactctcctactaagaatgatgacaataaggacagaaagacaaagtaatttaagagaaataacggaaagatggaagccaaagatgatgaatcctccattaactgctattgcaccttatttgagttatgttatctttgttagcctcagttttcttatctgccaaatgaaaataataatttctgctcaacctaacaccctaaggtccaaatgcacattgcactaactaatgatattcttacattatgtaacctttattttctttatataataatgactcctaacttaaatttagaattcaagatgcattcattcttcttttctaaaagtttcataagaagtggtggttgtccttgtaggaaaagctaggtgtgagttgagcaaagacaaagaagtatctttagacagtgtttgaggatttagtaaaccttatctgacagggaacaaaatttctggcaggcccagtggagagaaagaagggagagtgtgtgtcagataaaagaaagcagagcttggagaaagaggaactaaggggaggagacagatggccaatggccttgcaatgagaatattgagtatggtgaattattagctgttcagtgttcccaacaaaatcagtgacagcagcccctgatatataggcaatcaaaggcaaggtcttcagacactgcaaggggctagaaaacctggtagttggtaaacaacaattcagaacatttgatctttaagaggtttctgagggccacgaaatgggcactgatctagaatgcagaaaccaatagatttaaggccagccttttctatctcatgtcatcatgggtaagtctcagtttcttcatttgtagatttagaatatcttccttaggtacttcatgagacttcaaagaattcaatgaggtaatttgtgtgaacatgttttgaaaactcaattataggcccgtattattattttattgagtacaatagctgaataactacagaaggacatgggcttttaatgtatttctagaaaagttgatagattttctgcctgcacagacacagttacacacacacatggtcagacttatttcatagatccatctattttggtgatctggaagtaggaatatagtaaaatgctctctctgtattaatctcatgggtaattattttcctctcatcaggttacaggtatccccagaaatcttcagaatacaatctacaggtggtgtttaaatatccaaagtcacacgccaatgctttcttatccagtgagcaaaaagaaagctcaatgggaaccttttggtaaaactgatgcacagggatgacattattcttacaggtgtgtaacctaaagcttttactgggttccatctatctggattaacaaagagccacattacaaatgattctgttccctcggtgataaaagaaaaaattactgagaggggatatcatgtcataagactagaatactaggtttagagcaatttgttcttctttttttcaattatgcagtaatggtatccacatactgtattcagtctacaggcaatgtgattagaaagaaacaaacatagccttttttgaaacaaagagatgttatgcattaatacatgaagtggtggttcttttgctataataaatgcatagctggtgattccaccaatgagcaatttgttggaaatgttttattggttatgatttatggatgacaagtttgagtaattgttaagcttaattgcacttaaatgatggattttttcctcagttgtttatcttcagggcatggatgaaagcaaatgtgttggaaaaatgcagagttcagtggttgctaaatgagcttattaatgtttacatatgtaacaatttaggccattagtatgtatatgttggaatgagatgaccatctcatctctcagtctgcagaaattcctgcacaaactatcactattttatttttggataaacacacagctgttctatttcaattacaaattcaagttgtcctgagattaattttgttctatttgtggctggtaaaagtattttcaagaagaaaatgaaattactatacctatttggcatgtacgagggcattaggtcaagagcatctagcctctgacaactctggggagggagagcaactggtcagatccccaaagacttggccttatttccacagaatgattttctaggcagcccattttacttgtaatacagagggtcagcaaggcaaatttgcctgcctttccaaagccagaatgaaacactgactttctaagctctaaaatattcttgttgccctttattacagctaaatatgatatagaatcttgttatggactttatgtctgagggcacacatggtttaaaattctcaggtatgaatacttgtataatagatggagcatgagttaggttgacctcttgcaaaacaaaacaaaacaaaaacaactttctttcctctcattttcccagtatctcattagcttttcaataaatacttgttgcatgagttataacattcttcaaaaataaggctgatacatatgtgcatatatatattccaagatatatttcgaatataatgtgccagatgctttttgttgctaggaacagaaattcactcagttgaactaagaaatgagagatttattataaagatacatatgaaaataaggaagtaaggaattttgaccatatttctgagttttatacaagagtctagaaaaatctgcactactaggtttccaagaagagcaggtacactgttactgccaggttctcaaagactggagcctggattaaaagctggacctcaggaactgggcagacagcattttaagatccatcagccctggtgacctgattatcacattacccctcaagagcagggctgatcctcaccctaaggtttcatcatcagggagatagcacaactctccacacttctgcttgtctgctcctactgtcactgacttctatgacagggctctcctgtcttgtggtttctgctttctcacagtttttagtgcttcatggactctgcttactgcattaagtctacagatgctcaactttatgtttctgcacaaatttcctgggataaaaatacgactggtttagttagtcaccaatattccagttaggccaccagttatcatatagatttgctacacttgagttacatgcccaatacttatcaactggctgtcaccaagttgatacaaatgacaaactgtatgaccccctagtgccaatctatagacaagaggctggggactttctaagtctcaaccttttgctacaatgtggtttctcaactgactgtgacaattagacgtaggccaatattccagtactcatctttgtacctagttttctaagagaaaagaagacatggtttcctaaatgttattgctatgcaatagcaaaaattaagtatctacaaaaattaattggtcatcgtgatagaactggtctgtcatattaaagaaagagcaatcccattcctattgctccgacattttaagcagctgtgttttttggtttgtttgtttttgtttttgtttttgaaacggagtctcgctctgtcacccaggctggagtgcagtggcacgatctcagctcactgcaagctccgcctcccgggttcacgccattctcctgcctcagcctcccgagtagctgggactacaggcgcctgccaccacgcccagctaattttttgcatttttagtagagacagggtttccccgtgttagccaggatggtctcgatctcctgacctcgtgatccacccgcctcggcctcccaaagtgctgggattacaggcgtgagccaccgggcccgtgaagcagctgtttactgcagtaacacgctgttatttcctcaagttcttccaggtttcttcaaagtccatttccttttcctcagagtttcagactctgtccaattattacactcactcatgccaaggacttgcagatataagaattatccttgatcatataagtcctgcccttgaagatgcatccgcctcgagctgtcttcttatccaccttcttatctctcttcttctgtggatatgaagatgataatgtctgctccaggaacagttcttatgatgtgattcagaggaagaaatgcatctacttcctttaacccatttacatttctggaaaaaagtaccatggttaagtcttctctccaatgaaatagaaaattttagcaaagtctataaaacaaaaatctctactagaaagcttatagtcaagtcaaaaaccctcaaaattttgaatgcaattaaacgttaatatattttagtgaaactatatgatgtatagtatatatgacataatgaaatgtaaaaataatatagtatgtgttcaagcacttgtagtttataaatattttcatgtgaattgctatgtttcattcttgcaccaactctattaagtggacaagaataatctctcttcaaggaatggtacatgttttacacacacacgcacacacacaaacacacacgagctgaggcattttttggatgtggagctgtatgaggctgacagcagttaagtgatttgttcaagttcattacaagaaaaacagtaagttggagggaaaaaaacatgagcttttgagtgggtctgtctgtgggtttaaaccctacttttacactttcaagttgcaatgactttgtgatagttactaaacatttcttaggaagtctcagttttctgagatgcaaaatgagaattgttgcagagccataaagaaaacagagaatgcacataaaacatacttagtaaatggtacataggaggtgcttggtaggtaaaactggaacttttgtctttttcttcagtgttcttcctactccactgtacttcaagaattaaaaatatcattttttcagggaaaatgaatgaaattaccaaaaactgaagaagatatgtcttcattatctttatcccaaagcatttacttggcatccaaaaacatattcagaacactgtgctaggtaatggaaaagtcctaagacacccagagagagattgtttccttactctcacagtggatgaaaaatactgagaggcaaatgagagaagatgcctatgtcagcttcctgcagcatcagtctaaattattttaacaggctttagtgacctcaaaatagcaagaaagccttaaatgtaaaagacctagataggtgatggaagatagagacaaacactgaaatttcagcaagagatattatagataaataaggacaacttggcctctaaacatcttctatttactgcacagttcctgttaatttcagtatctttggggtacccttctaagcattcacacatctactctgaagcaggcattgcttataaacagccttctgtctgctgagctgtttcatggggaattccttatcaccagggctgcatttgaactgatgagtcaagcaagctacctggtgtattatcagttccttcaaacttgctctgagatgtgtgacatgtatagaaaataaaaacctaagactttgatctacaaggatgcagcatttgcttggctccagtaagaaaaagaatcctctagaaatccttaaaagcagactggaaaaggctgaagttctcttctacatttgccaaaacttagttaacaccagctttaactaaaagaaatatgatagtcaaaagacaaaccaatttaaatatatttgaaagtaaggcaatatattcattacagtatggtttgtatttggcatttaaaaatatctaacttctttgcctagagagatgtttactatttcatactatcttccttcttaaagtagacaattgaaatatgtttctctgtgtgtgtgtgtctgatctatagcctgtctggtctccatagttttaatgagttttccatttttttttcttaaactcttcttggctggtgaaaattactcaatactgctatcttagactatttcaacgacatcccttgacatccatattcctacctcccttttgtagtttcttctgcttcattgttacctattgtcattactttctccgaggctgaatatctgtactaatacctcctaaggtgttccggaatagtgaagccaattctattttctacgttcaagcatattcttgatcttaaaaacaaaaaaagatgaagagaaggaaattaaatctccagaagcaacccactatcttatgcaactattgccttctgtgagccaatctcatttccataaccacctcctctctttcctttgcacaatgcaaaaggtagagatttcatgcaatttttatgacagtgacttagctcccctcacagccatcatcaaatctacaggtatattggagtgactcctgtgcttttgcatgcatattaaggactgtgtacagaacttattctaaattgaaaaatgatgcttatcttctagtttcttctattataggaataaaatagttatgttggcacttagaaaaaaagttcaaaaaaagcatcctaggcatatacattttgcatgtgattaatgtgaggacttcttatcaaagttatatctattaaatctctcaagaattccttaattttgtttctttttaatttgtgcaagctggagagatcacatttaaaattttaccaaaataagttcaagactcaagaactcgatccattgttgccaattgttctgtgtagtatgtgttcaaagtacaaaataatattaacactaatttggattcaaatgatctttctccacaaggcaaatgacattttaagacatattctgggagctggatcttctgtttagatgctgctaatagggagacaacagctgagaaacgtgcatcaccattgactgaaggatatgggtgtgggaaacccttttttcaaatgagtaattcattgaagtttaagggaacaaatttattgtccatagggtacaagagagaagagagctgtctataaactgtttttttttctgagggcctcttgctttttttctgagggccaccttcccaaacctggagatgaactgtcatgggtggctgagataaaattcacataaaatatatccttctaaagtagaccattcagtggtttttagtatattcaccaagttttgcaaccatcactgctatctaattgcagaacatcttcatctccctaaagagaacaccatacctattagtagtcagactcattcccaccacctctcaccaccccagtccctcttctactaatctactctgtctttacagatttgacgattctggacattttatatgtacaggattataaaatatgtggcctttaaaatatttgctagaagtttttattgaaataatcatagattcaaatgccattttacagagaggtcatatgtaccctttaccctgtttcccccaatggtatcatcttacatcaccatagcacaatattataaccaggatatcgacatttgatacaacctgtcaatcttattccgacttccagttttacttgtactcctttgtgtgtgttgtgcactcccatgaatttaattctaaaaaatattgttacatgtgtaggtttgtgtatccatcactacagtcaagatacagaaaaatttcaacatcataaagatccttgtgttcttgtgtggccctttgatgtgcctgccttctaccatccctagcctctcgcaaccactaaaccgatctccatttctaaacctttgtttttcaatgctatataaatggaatcaaacattatttaatcttatgggattgacttttttttgcttatcataatttcccagagaccatccaggtggttacatgtatcagtagttcagtcctgtctattactaagtaacagtctgtgacaaataccacagtttgtttaaccattcacccactgaacgacatctggatgatttcaggtctttggctattgtgaataaagctactgtgagcatttccatatatttttgtatgtgtgtgaatacaagtttttatttatctgggataaatgcctaagaatgcaattactgggtgatttgctaattgcatgtaaatttcctaagaaattgccacactgttttccagggtggttataccattttacattcacatcagcagtgtataggtgatccagtttctcttcaccctcaccaagatttcatgctgttactattttttttattttagctattctggtaagtaggtagtgaatatgtggactttgtgactggcttatttcacctagcacaacattttcaaggttcagctatgttgtggcgtgctttagtagttcattcctttttgccaccaaataatgtcctactgtatggatataccacatttggtttacccatttgtgaattaatggaaaaatatgtttagtagcaggaaaaatgttttcaattttttttcatattaggatattatttatgtctaacatctattattaaaactatcaggcactgtattagatatttgatgtgtgttttctgatagaggttacataacaactctaagatccaagacttgatgggtaaactggaaactcacatattaaatcaagcatatgaaaaaataataaatttgttaagaatacttatttaacttggccaagtcagttttgagaacaaaattttaatacctccatttccctacagaccccaacataagcttccttacctgtcattagattaattcacacattttggccagcttgccctaatgagaaatttgcatttcccagaccctccctatggtctaagtcatcttacatataaagaaattaagatgtattcatttattgcgcaaatatttactgagagtctaatgtacattaggcccgcagtaggtgctgtgattcagaaagactaacatagctaaggtcacaaatttagcaaagcaatgatttaataccaccttgcagattgagagtaaaattttatttttaatacttattttctctggatcctaattaaagcaatccagggaaatattttaaagtacttcattagggatctttaatttttttacataagtgaactattaggcattattttgaaaacataatttctacttagcttgtcaaatgcatcctattatttaactttacagggaaagaatccaatagccaacctacctggcatattggcttcccattgtaacttttgtccaaccttattatgtatagctggaatacagatattgagcacaatatatcattaagtcactaataaacttcagttgcccctttaccactttcccccatctccccctgtcaatgagtaatttatctccagcagcaatatgcataagttgtctttgaaaaggtgggacatggcattatcagtcactgcatgaacgagttatagccagctccatcatggaagagaacagatgattacaatcaataatcaatcaaagaaccagtgacagtaatcatacatcactttccactgtggaatcttcactcactcaaagcttagtaatgcaaaatccactttctgggtatattggtgccttgcctttgtcctgaatctgctcctggtttggaataagcctggaacgtggagcactcctacttggatttcacccttttgggaaggttagcaacagtagagccaaactgaacgtgagagaagaaaagaacaattgttgtaatccttgcctaagtccttattactcattgtatcccattttgtatacagctaaggctgcactggctaaatctttgtagaatatctcttgttaatcaagtgtatgcattttgtgaagcttgtgggcagacattttataactagacgtgtaaatcatgtccagtaaaatatactgtccaataaaaggtataatctccataaaaccagaattaattgggaaaattgtctgggaggtttattggaaagcaaatgattttgcaaaacactaaaataattatttaagggaaacaatatttaaaaatacaaaagccattctatttgaaataaaaataatatattctgagaaaactgatgcatggggattttctaaactcatacattcaacacccatttgcttagcactcattaagcagtgggaaaacatagatctctgcccttaaggaacaaaatatctgttataagaaaagagccaaagcctgattacacagtgcagagtgctcaaggctgtaagagagtttgttcaaaatgctttgggagcacagaggaggaaatacaacaacctgagggagtctggaatcttccatgagaaggtagcttttacactgagaatggaagaaaagtggtgaaaggtcatttcaaacacaagatcagacagacgctgagatggggtaggagaacaaaaaagcatggcattttcaagcaacaaagtgtgtggctagaaagtagaggaagggaacggggctacttgcgggaggaacagtgatatgtggggggaaggaggaaatggaaccatgtgggtatatgtcggagccagattgtaaaaggtctcatataccaggctttcctagaggggaagtgaatagaccaacttggcacttcaagaaccacttggtcctgaccacagacatggagaaaagacaaaaatgggaagctgcggacagatggactaagtaggctgctgctcctaagttaggcattttgctcggtgcaactttctaatttcttccaaaaaaggacttttagagatataggcttcaccagacatgtctttcctcacagatccaaagaaaaattaccaaactgggagcaagacacagttttatcagcataaaaattctcagtaaatctcaaggtatcaatcatatgaaaacatcagtgtttctcaggaagaggtggcctccatcctagatctctaaacagggctctcaatcttcaagaaaggcaaggcaaaagttgctatgtttgatttaatcacatacctaaaccttccaaaatgagtttggcaaaaccccaaattccatctatcccctaggacatgtcgcccttttcttcaagctagcgtgacttttccttaaattttaatattgaaattgctcttatttgaaggatcctttcaatatttttatgcaagaagcttaattcctaagaagactctgataaatttttgcagagaagtttggatcttttaaaatgatctctttaaagttctgtattgtggccaattatattctttctgagaaccagtttagttattattttcttcatggaaggtttagactcagtgcagtgccttttttattttaatcatccttaaagaaatagaaaatgttaataagagagtgcagggagctagtgctgttaaagtggcaggctattggatttgattatttttgtaccagagagtttaattgtgaactctgatttttcttcatctgtttgatgatgaaagttctctctaggtccttatcttatcatgagtaaaacatctcacatctagaggacaaacagaaactgaaaacaataagttgctgtgcttttgcttcaggaaataaataaataaatgcagtaataagttaacaaatggataaagtaatatttaaaatctcctttatgatatatttagacttgggctgcaaaacataaacaagaaactgttgggaagaattttgaaattattagctttcataggttctaaaattaggctgttgtgggatgggtttttggaaattaagctttttcaaaatgatgttttccattcaatgttggaaagtaaacacagcgcctgttgaggctgctgcctggaggcaaacacatagttagctgaaatcctcctggatataaatatctcctgggatttctaacttggaggcttaaaattacagtctaggggaggcagctacagtccacagcatgtacacatttttggacctcctatagccagcttgtctcaccaactattacaagcagaaaaaaaagaaaacaatgacgacgaatgaaaggaaataacacaaagagaacaaagatgcagattccaagagaaaatggcatatggctcttcactgtctgtcaatgcagagtatttaacgaccattgagagattgtaattatgcctcatgccacttgtctaaagccagccaatgatgtccccatgttttatatctccccccataccttaaagtcctattttgcctctctgatcaagtacagctcttttccatgattactagaattttctgtcttctgcccttccctgcaggattaatttttcttgcctataattcaaatgttacactttttgtttaggctctagctgtggctacctaacagaacttcctaccctggattccacctgtgcatgaaccatcacaaagaggatctttctaaaacattccattccagcatgtaaacaactgttggatttggcacctcatccatcctcagcttggcatcagacctctacacctgtatcccaatcttcctccgaagtctcccagtagtcttgcctgcttacctccaactaccatcacacaacttggggctctgaaatttaatagctttctgctgcctttctgccttcttcacagtactaagtcaacctcaactttccaaaaaattatttctatccttttaaaatcctacctattgtaacattctcttctctcctccaacccactgcaatttatttttacttctctgaacatcataatatattactgttacagtaagacaatacacacacataaccacacaaacgctttcactaatatctataaactctttcctgatgtaccctgttcaaactttatttctttcttttctagtctggccacattttgtctctattatttagtacataataaatcctgccttattatttggtaggttttgtctatctccttccattcctccttgctccagactggatacagttcaggataccatgtgaatcttccttatcttcctatctccagtagccctttcacagggccagccttgctatcctaacacctcttcagagagctgtgtccctactacagtgtcctgcttttcttaatataattttctctctagtgttttcttacaaacatgtttttttttcttttaaccttgattgcaaattcttctgcagcagaagttatctgttctccttttgtactttcccacagagctgtacaaaatatcagccacaaagtagaatttgaatacagtgtatgaaatgaataaataaatgaatgagtgaataatgtgtggtggatgacatggcctcggtactgaggttggttagctggtctgaggctgatagacatgtgagtaaaaataataaaattagcctcttgttctttccagatggaaaggagtctggttgcagtgattacatgttaatcagcaatttgggtttggatgtttgttagaacatgaactggcattgggatttcattgtctctgagtcaatgtacattttgagtttcttcttcaattcaagattttgtggggcttaatttaaactgtagttaacttggaaccatagagagatattttaagatttaatgaatttctaggtaaagttctcagagttactgaatgaaatatcctctaccaagatctaagagggagttcaaggtaaatccatgaaaaaaaaaataagcttgattcaagatttacaggagatctattgttccaggagtccccaaacccccaggccgtggactagtattggtccatggcatgttaagaactgagccacacagcaggaggtgagtgcaggccagtgagcattaccacctgagctccgcctcctctcagatcagtggcagcattagattctcataggagtacaacccctattgtgaactgcacatgcaagggatccaggttgagtgcatcttatgagaatctaatgcctgatgagctgaagtggaacggtttcatcctgaatccatgcccccggcccatcccatggaaaaaattgtcttccatgaagccagtctctggtaccaattatatttggaactgctgtattatacaacataatgatgtagttaataacaatgtattctggaaaattgcttagagagtagactttgagtattctcaccacaaaaacaggataactatgcaagataatacatgtattagttagctcaatttagccattccacaaaacatgttatacatgataaatatgtataaattttatttgtcaattaaaaataaacaacaacaacaaaaaaacccacaaaatttaggtatcactaggtaaagatcagtgggaaatcctgctaattccagtagaattggaattctgaaagctgtattcatgtttttctggttgtgccatgtgatgttcagtggcattatcttgatacagtagaatgattcctagatcatatctcaatgttgggttttttcattttctttaaatgtacactctaggacattaatatctctctggatatcaaaactttatcattgcttggcctggagcagtgtcttatgcccataatccaagcaccttgggaggctgaggccagataattgcttaaggccaggagttagaaaccatcctgggcaatatagcaaggccttgtctctaaaaaaaatttttttaaataatgatgtgcacctgtagtcatagctacttgggagactaaggtgggagggtcacttgagcccaagagtttgaggctacagtgagctatgatggcatcactgtactctagccccagtgacagagcaagaccctgactcaaaaaaaaaccatattttaaaaattattgtccctttttattgacattgctttgtcttttgtttaaaagtcattcaattttagtggcatcaaagcatttgatattcagtatagttactgttatttctcgaaataaatgtgttattcactaccgttaggtgtattcaactgcctttttttttttttttttttttttttttgagactgagtcttgctctttcgcccaagccggagtgcagtggcgctatctcggctcactgcaagctccacctcccgggttcatgccattctcctgcctcagcctcctgtgtagctgggactacaggcgcccgccaccacgcccagctaattttttgtatttttagtagagacggggtttcactgtgttagtcaggatggtcttgatctcctgacttcgtgatccgcccgcctcggcctcccaaagtgctgggattgcaggcatgagccaccgcgcccggcctcaactgccttttattagagggaaatacgtgttctggggcctcaaacatgaggttgtattgcaattgggtggtgatagcaagaatatcaaggatgaaagtagtgttttattgtcctaaaagtcttctcaaagtcatggtcccgtttgattctcatagctatccggtaagctaagtaaaacaggtgactgcctctacagctgagaataagatggctcagtcatttcacgtgacatacccagataacatcgtatacaagtggataagtcaagacgggaagctggagcttaatatttctagtgcagtgttcctcttgccattcttggccacctcactcatattttatccttgttcaaggaccagatggtcttctccttctgctctattgagcaaaagcaattgagctcagagctgtgaagataattttaattatatcttctcattaccctcaacactgttgatgattctctttagtgccaaaaaataataataaacttgggtggattaaaatttttaacctctgttttctatgatgaatggagatagcattcataattctgagaagagaaaaatctaaattctactcccaggtcctctgtgtcctagtatcattacctttggaaagtcatttgggtgcttattcttagaactggagtatcaagggcatggacagataagcacaagcatccgttctaacctcaatattttataaggtttgggcatgagtttgccttgttcatggaacagcgtggagaacttcccctggacttaatccttgataagaagcaggacttggcttttcatccttgatattcttgttaaatggtgtcagtggttctgaaatttatatgacctggtccctctccactttataatgaatgaatctatggctttggtcttgttttgggaagctccttgtatggcatctagacatgagaagagtggcttaaaagtatatgatgtgtgtgtgtgtatatatatatatatatatatgtgtatatatatatgtacacaatccttttagaagcaaaagacttagactatataaaatatatacactatattatatcaaatatgtaatatataatatctcagcaatatgctagcaatatattatatataataaatatatatatttataatacagctgtccctttacatttatgacaccattacctttatacttaaaataaatctatactaggacctatcttgttatattcaattagctcctgaagtaaaaatgcaacaaaatgtatagtttttactacagaatgatccacctctcatcttggatgcatcctctgaatttgaaaaatttttctaaatatttaattcaatagtagccactcgaaaaatgctgaaaaaaaataaatgagtgtaaatgttcaacacaggcatggttgaaatacatgaccattttaaggtttgaataaattttttaaatgaagtaagtgtcagcaaaagtaatttaaattaagccacagaaccaaaatatctagctatacagttggagaatcatgtatgctgtgatgtcacaaacactgtagaatttctgttttaaaaaaaaccatcaaacattgtaatgaattgaaggggtcaggggtagttctttggaattctagtctaaaagaccaagttgaagagcagggccgggtgcagtggctcacacctgtaatcccaacactttggaaggccgaggtgggcagatcacttgaggtcaggagtttgaaaccagcctggccaacatggagaaaccccgtctctactaaaactacaaaaaaatttagctgggtgtggtggtgcatgcctgtaatcccagctactcgagaggctgaggcaggagaatcacttgaactggggaataggaggttgtagtaagctgagatagtgccattgcactccagcctgggtgacaagggtgaaactccatctaaaaaaaaaagcaactaggaacaggattgcagatttatcatagaaggatgagttgaagatgttgtgaatgtttatcctggagaagaaataggaaaatgtgttaaatgctattgaatattcgaagctgggcttaacctgccctttagttccatgaattcaaactagaggttaagatgagagctttttacctcagtatgagaagtagtagtttcttggtcagatctatcaggagagagcctgggctccctggggaggctgagttctttatcaaatagaggctagacagaatgtttaagagaagtgctgccaaatagaaaataagaatgtgaacagagaaagatgtgtagttttaaaatttctaataaccatattcaaaaagtagaagaaatagattattttaattgcattagtctcctattcaacccaatatatttaaaatgttatcatttcaacattaaatcaatatataattattaataagaagtttttacatttttttctactaagccttcaaaattcagggtgtattttacacttaacagctcttctcaatttgggctagcaacatttcctccatagctacttgtgtctaattcgtgctgtactgagtagtgcaattttagagtaagcaagaataaaaaccaaccttgaattgctgtaattcaagaaagtattcttatttgactatcacaggggaagaatggacatccttttccaaataaaggcactgtgtggtcaagaaacagatttgggctgatgggataattgtgaaacccttggggctgtggagaaaaggtgaagacaaaccatcatagatcatctttgtcccatataccactctcgtatgaagtataaaacagagccccctctgaacagataaaaaccaaaaaggtgcccctgacccttctcccataccaggacaaaaacttaaatagagagcagagctgggatccagccctagccttgcccattgagctgagcatcctgttgaggcacttcctggcatctgtgtacctgtgtcctatcagaaccagtttctgtagtagctgcaaactgcagtcttcaacaatgatactgcaactttaaataggtcacaggtctctctcagaatctgataaatgctatgaaacgcttacaaaagaaaaattgtcaaaaattcaaaactcatgaacactttgaaatctgtggacctgtgattaacaaaactggccacagtagtagctgactgtattttcttgtgaaagctttaatttggccctgttgttctgagggacaggagaacaggaacagaaagaaaaatgtatgcttatcccacccgtgcctaaaatagctttcatgaatgtgaattgaacgatatttgttttcctttttattttgccaagtcattattccgtttgaaccatctgaggatttttgtcctgctgtcattggctcttcccgacattttcaccttgtcatgctgggggaagagtacctggtgataactaaattgaagcactgaatattttgacaccagccaaggaacaagatggtcatttggtctatttttaatgtcatccccattggcatttccttccaggtagtttttttttctgtttttctttctttctttcttttttttttttgtggcaccacaagacattccttccctgctgtctgcttcctgctgtgatcaatgctgatgatcacacaggttacattttatatcaagaacagttgactcagtgtgctggggctgtagttcacacccccagttcttgctctcctctgctattccatgcatgtcaaggctttagaacagtgagcagaaaggaaacttgtgggactttagccacctgtatcataagtctacagtatcatctggaaaaaatatatgtagatatagatagatatagatagatagatggattgatagattgatagatatatctattctgtcttttaaaaaaatacccccttagtttgactgaatgttgtctggaaaagttaagagtttggcacaacaggtagcaggtttctctttccacctgagttataaccattattctcacccattaaacctaatgaaggttagattattgagagaaatactgcactgtattatgcctttgcaattgccactgcagctcagcttggagatggaacaattaagaactttttaagaatgcttagcagttcagaggtgtgtgataaatggataagaaggaaaaaatatagctctaagaaaccaacggaacatccaacctgcagggaagataagatgctcaattagatggtggaagcatggaccgctctcattcttagtaatttttataccttggggaagagttgcttttgggatttagtttatcaggatatgtgagatactgggtcagacttgatagcttctccctgggaactgtggggaagtactggcctggagggcaattctcgagattgccttggtggagggatgccttcttgtatcaggaagtgctgaagagagcaggcttttgcctgccctgatgctttcctgcagtgatccccagaagctggtaagtggacaggttctcttggttggtcactccacaactgtgagccaatcatagtgtaacttttttgaatgatgctcacagcctcaagccggttcagctctctcaatggtggcttcccagaacttttgttatgggaaaaaacaggtaaaaggttcagtatcaccatgagggggattggtccattggacagtgcttaatgaacattgaaggaaatagttcccttgtacccggataatagtataaatttacatatactgaggtcccaggagattatcataggttattgtaataagggtcatctttgaagaagggaatttttcttagtttacttctataaacagcttcatgggaagattattcatatcttgagaccaggggtcatatattttctcactttatgtgttagcagtagactggcatgtgccttctataagggagtgttgaattcaggaataaatagtactaactgtttgttattacttacacatccctacccatttggatacagtttcttacttcaatggccacttgttacacaacttttccaattttatattgggctaaatgcagtcaggagtaaagaaattaaatatgtaccaccaatgcccgtcatttaagtgtcaaatacacattgcttacttagcatgtctatatgtggaatactattttaggtcctatgaagaatttctaacaaaccaaaacaaaatgattcctaccctcatgtggcttgcacttgattcgagaggtgtcttcctaaatgtatatatgtatgggtgtacgtgcacacacacacacacagaggaaatccagatagctagaaaactaaattaatacaaaataagatcacgttagcaaagtacactggagatctatagttaaaacagagaataggagtggtgttgatggggatgtgtggatgcctggggatgtgtagatctggaatttgtagacgagaaccctagattgacaaagaagaaagatcaaagccacgacagtatacagcaaagaagtagaaacaaataacatatatgtagggagcagcacagcctgggttgtccagagcttatgaagtagatttttcttcctctctcagacaacacctacttacctctgacagttcttgactggggacacctatcagaaggggactcatagcctagcatggtaacaggatgaaaagatgttactgctggatagagcgtgggaggcatctgggcctagtccctcaatttgcaaacagagaaattgaagcccagagaaattatatagaatgtgatcaataataatatcatcatcatcatcatcatcatcatcatcatccctggtaaattgtaaagctggtattggaacccaggtatctcgagaccttgtagtgaactctttgtaccatgtcattctatttttcaattggcacttgggttgctgcttggccaattctcatgctctgtaaacctataaagcagatgggaactgcatgtagcttggggaaagaaagccaaagaaaaattgcttctaccaaattgtgcacgatggatccaatttagaagtctgtcagaacacgggcagctaatagagatatactcagaggctgtctggaccttccaagccactgaagggaaaagagcacaccgtctggagtcaggggatttggtgtgagaaactaactagttgccttatgagaatcatttaatctaaagttcctcatcattaaaatcattaggtaaacttagaatccctttgaaatgctaataaaatgtcactgaatttatgctgacgtgactataatcttcaagtcttatccaagacatccaattgcaggcacaaactgatattcttgccaaattggcaagctgctctatgcacttaaccatgtagcattatattttattgggacttttaaaacaaaattcttaatcttaaaagcgaaaatgttgttaccttgccttgatcatggaactattgtaaattgggagaaggaggaaaatatgtttatcaattgctgctggatatgcattaattttagtccactcattccactccctcatttatttgaatgtgtacctgcattcaatagctatttagtgagttcctattggtaaagataaattaggcagtgtgggagatagataggtaaattctgcccacagcatgttcatagttaatgtgaacaaagccagttacataaataactctatataccatgagatgagttgtttagacatttgaaagaccagtgaacaaatactcataactgaaagccttataaggctttatagggaaaatgaaagtttaaaagacctgttaggcatactgggatttcgttacacaaaaatgaaaagagggggcatgttaaggtgaaggaacagcatgagcaaaggaacaaaggcagggatgttaaagggaggaccataaattactaggacaatcatcgggacacatttttggtaaagggcaggatagtaaatattatagactcttcaggttataccatctctggagtaactactcaactttgccatgtagcccaaaagcccaaaagcaaccatagacaatccataaagattcatggctatgttccaataaagccttaattacaaaacaggcagtaggctggatttggccctcagcccaaaatttgctgatttctatcctcaggtatggagagaaagaacaggaagaacaggctggaaaggaagctggatcagaatatctaaaaccttctattagctctcctaatgttaacgtcttatttgttaacatagccttttcttttcttttccttttacaacattggactcaaatttccaatttgttgccttttgaaaacacaggaatggttgcttccatgattatgcaggcaacactttcttaaccatccttaatataggccaatattccaaataagttgtgaaagtcaccctgactcaggggcttaaatgtaaataattaatatgtgtttcccatcatatatatcagtgctggggtaaacaaccatcctgcttttcctgagactgaggggttttccaggagagaagactttcaaggctaaaacaggggcactgctgggcaaaccagtgtgcttggtcaccctaattagtcaacgttagcatctcaagtaggcaacaagcgtccacatcagttctaggctggttatatatccagttaaagtgggcaattgctaagctagccattgtttcacagaaataacttctagaaagagagagcagataagctaagtaagtggttttcaattcgaaaactgggttagtgtaatgcaaggcacagccaatacaggcatcagcgaaatctcccagaaccccagcctggagatcctgagaaagtgttggatggcatttcagcaaaaatgtttacattcagatggaatatttggggtctcaaattctggagaaatttcccatttgtagacaaaatgtaagtgatttgatcagtattacccaataaagtatctgcttctatataattactcatttctatgagatactgaagaaaatgtatgtttagacattgagattctaaaaagttttgtgaaacattcttcacagatttgactatacttggatctaaatatccctgcactgcattcttcctacacatatttcccttttttcttttagaagaaatcactgctgagatactgaaaagtgattagaggagattaagatattaaacacaatatgagcaattttctgatatgggactctgaatgcacttttcatggtctttacaaacttaaaccttcagtgatggaatttgatctagtatttgaagctcctaattggattttggagagaatatatagataaaaattaattcatgccatgttatacactgtcagttcctgcatttagcatctcattcctgatgtgacaactagagacaccctgtgtacactggagatacggacattctagctttgatacattccatctaaatatttttctcccctcttctaaccagctccttctatcacatgcagttgctattctcttatccccatttgtctcctgtctggacacttaccttataagcacagtccactttttgctcataagcaactttccccctccgactaatttgtctttgtacctccttcctaaagacccaacaaaagaagtgctaatgacttgtcctccacacggtgaaccagtgtttttctacctattcctgtagcctcattcctaccaccactactagagtgaataatagaatactagagtaataaggtaactgaccatggtctaggacattcatttgaattgttaatttcatctttttgtagtagcatctcctattttatcaagcagccttactaacacagagtttcatcttttgccatgcatgacattacctgatatttagaatataaactatgatttgtatggctaacatttattttatactttttttcttttccaggcactgcttttttttttcctttacagaaattgtctcatttattctttataactctacatgttatgcagaagaattttgaataatctaagtagatactcccctttctcaatgaggtagagcatgactctgcacttcctcagtgtagtgtttaattccaaagagtaacctatggaaagaccaaaaaaagtaactttatagtagagaaataggacacacatcaccttagccaagtgttcaaggtggatatcaacagcaataggtcatgttgatagtatgtaccctttgtaggatgtgatgagaatgacactttacctctgtgttctttctctctaaaaaaaacatcgcccaaacataatcatgagaaaaataacagaaaaaaacccaaatgagaaacattctacaaaacacctgaccagtcctccttaaaactgtcaaggtcatcacaaaccaggaaggtctgagaaactgtcacaggcacaacgagcctaaggagacatggggattaaatgtaacgtggtctcctgaacagaaaagagattaaaaaaaacaaaactaaggacatctgaataaagtatggattttattttaaaacaatatatccatattagttcgatatctgtatgtgttctatttgatgaacggtttctcacttggcattctttgttttagtgacttatttgtctaagcctatgggctttgatatctagaagtccaggcaaaatcattactaccttctgtttctcttacatgtatcaatactgccccctgacacacacaccaaatccacacaaggctccaaggtacatatcctaatacaacaagaggaagatataaactttgtctgcaacttaagccctggaatagacaatactgctcatgaggatagttgaaatccatgataggccaccaaagctgactgtggtacctctttccatctctcctctattaggaatagtaattcatgctgcaaagtgtgtaacagatgcactatactagtgtaagatgttaataatgggagaaaataggtgtggggtgtatgggaactctgtacgatcttcacaacttttctgtaaatctaaaacaatttttaaatgttattttttattatttttattattttactatttttaaaagtttatttttaaaaaaatgaatgctaatgataacctggaataagaggtacatgtgcagatgttagggacaaatgtatttgtatctttgtgaataaaatgtttctacttttcaaattcagaaacaatactgttgtctacagcataaaacaaggtcaaagaaaagagtattttaaaattatccaacaagcagagaatgtggtcagtggcaaaagtactagaactgtgtgccaatgatggagatcatggcagagcggacataatgggcacttggcaggcatgttctcttaattgaaatgtcagccctgttgggtacgatctatgtaggagggctcggaatagaaaagaaaaaggtagcaaggtagaatcatacttctgaaatattaatagtggcaatgaacttcaacttgacagtgaaattgatagtaaagcatttaagaagaggacacagcaaatggagaaaaataaagaaaacctcagtgacgctctaccatagcttgttatagtaatatgattacctttgaaggaatactcacacttcagaacataaagttgtgctaacaaaaacagaagaatcaacaagattaaaagcatttccatagataagacaatgatccagaagttcaaaagagggaaagatgttcttcctacatttttagtagtaacactgctcatttttacaagcaggctttgaataatgaatgagctactcaaattcatgaaatgataatacagaataacttatgaaaggtcatgcagcctccctttatcaccccttactctcctctacacacacacacacacacacacacacacacacacacacacactttgcagcatgaattactatttctagtagaggagagatggaaagaggcaccacagtcagctttggtggcctatcatggatttcaactatccccatgagcagcattgtctattccaatggttgagctgcagatgaagtttctatcttccttttgttgtattggaatatgtatattggaatcgtgtgtggatttggtgtggggggtattgatgcatgtaagagaaacagaaggtagtaatgattttgcctggacttctagatatcaaagcctataggcctagagaaataaatcattgaaacaagtaattccaagtgagaaaccactcatctaatagtagaacacatacagatacagagcttacaaaaagtggcggattgataggtaggtacatgaaaataggtacatgtgctgaaggtcaaaggcaggtagattctacttttaacattaggaggagacccacaggaattaggagggcaaagcaaaatgaccagagaaagcataggccattcgaaggaccttgtttccaagaaaaggaattgttatcacaggaaacctcttatgtgatttccggtaccattcaaaaccattcttgagatatgtgcatcctagggcctgagttgaggatacagttttaaagggaaggttgaataggttggaaacaattaaagttgatttgggtatgagaaaaatgtggcagtcaataaagaacagaattttttaaatgaaaaagttaagctgtttataaagaaacagaatggataagaagtgtatatttatcaaactatatgagttcatttttaaaaatttggggacagtaaaagcatctagcaagattcagtgcaactatttggatattttacctaattgtctacaaatttttccacgtgctactaatgcaatgagtaatcaaggcagttaattaactggcttaaggcaaaaaaattgtcttcatttattttagtaattaagataattctaattgacttgaaattatctaattgacttgataattctaattgacatgtgtagatgtaggctacatgtaaagaaataaatgggctaaaggaaaaaagaaaaaagtatttctcacacttttcactgatgatatgtatacaagaaaaatagcacatacaccaaaaaatattttaaacataatgtctatttgtacctaagcatttaagtggaggaaaatcatatgcagtttcacaggctgcaggttacagcattattgggtttaaaggttcaaagggaaatgtcttttttaattcaacattaagattttgacacatttagttcattccaaaacggcagaaatctgatagtaaagggttaaatattccaaatttgagtttaggtttttaaaattctcaggtcacttctgattagagagaaatgtatgtgtatatatagatgcacatgtatgtgtatatacatacttatacaaacatatatacatatacacacacacacatatatgctttaagcagctgatggtgtaataccaagggatgccagagagacagcagatcactcactttttcctatctgtgtttcctctccaagaaccaaaagaccttttgacttgaccatcatagaacaaatatctgtaaagacataggctaagcagggactgaagtgatggagtgggagggtgaagtggtataagttttgaagctgccctgaatgagttcaagtcagcttgaccaggcgacacaaagagaatggatcaatgaaccactgccaaacatgaatttctgttcaacaaacatttattatgcacctccaagaggcaggcactgtgtgaatttctgagaatacaaagatgaatgagtgaggaaccctgtcttcccagtgtgagtgcacactctgggaaggaagccaaaaatggtagacaataatgacagtgtaaggagggcaattatagagctcaaagggggtctagaggagagtaggggaggattaatagaaaggatgctgtttgtgctggttaaggatgaataggagttttccatatggaccagatgtgaaagccatttcagaggaaacaatatatgcaaagtcatataaaaacagcacatgcaaaggcatataatgaagacataatgatatatgtcacacagtgccacattacaagttgtcatgtgatagtgactttaagaaagagtacagagccaggaggaaataatgctaggttcaattccctctctatagtacaccagctgtaccatttgaaaaagttatttaccttctaattttcagtgttcttatccataaaatggggataataagggagactaggtcaaagatggttgtattaagtgaaacaagtgctctgtaaatgttagctgttactgttatcagggttaattaggcattgttggatcacaaagtagaaatggcctcaagttaaaggaaaaatggcagatataaactctaaagaaagataactagtgggttagtaataaaggaatgcccaaaggatgggattaatgagacattatccattttcatgacatgccacaggtttcctgtttatcctgattaacatttccatcaacctggatgaatgcttctgaaactcatagatgacataaagttgcaggggctgcacttgacttggagtgacattttccagcttccaactgatattgattgactagctgaaagaattgttgaaatctgacaagatgaaatttaaattttaacatgaataatacacagtcctgactttgactttacaaaagatcagtgacagatcagaaaaaggcctgtattagcagaaacgtgaaaaatcaatgattggggattttagttggtgctaaacttgatgttgttcaacaataacacagagctaatgtgatttagattacataaataaaggaaagggatacctagcatgatagagacaatggtctcattcttctgtgttttggccagaatatgtcttccatgacaaattctcagagacatttacagaccaattaaagtaaattcacaggctcactatcaggatggtgaagtaacttagtcctctcatttaagaaatgtgtataagatctgaaaaggaaaagactcaggaggacatagtttctgctcttaaatatatgaaaagtggtcatgaagaaaaggaattaattaatttgaatagaattgaagggtagacttagggtgaatgaatgaaagataaaagatagaatttaggcttggcataagtaaactctaagctaacttcttttgagttcaaaagactgaaggtggaaggtgggggtgagctaataaagacttgctggtctcattgtaccaggtaaaaactttatggaggaaactattgtcagtagagtgttgtgctagctggcttttaaagtgtcatcatacctgaacatttctgagtctgtcataataggttttgacaaagaaaactcacagtcgaagagcagtgtaggtattttagatatcgtctaaaagttggtcaaagaaaatttggactaacataaacctgaaggaggactaacaaggtttaaaattatcatccacagtaaaaacttttctagggtcatgtgctgtggagaatttcaggcaaatgttgagttctaattcaatttgctatgtattaatgatttgaagaatgaatagcatggacattagagtcagtcgatgtttcctaatttagtgaatacagaattataagaagaaagcaatgtacatttttttcttttgttatgccagtagagccctataagctgaaagaagaatgaactagatgatctattcacttctgttttgcacatctatatttctacagtggcaaaaagaatatagtgaagactgggagcatggatattttgatattggccattaataatgcacacaggaagcagaaggactcaggtttgctttttagtacagattttggtttggtaatttcgttctaagaagactgttttttaaaaaatctgttattatttaattatatcaaacaaaaggatagcatctgatttcgattcatttaaccttaatggaaaagaacaagtcattacttaaaggatgttttatagactgtgttatttctggtatttttagaaatcatttattcctcttcaaattgatgtaatataattattcattaataactcttcttgatgtctctggagtcatcccattacccacagtcattatgcatcattgtgtgaatgtttgctctaatactgagatatctatggctcattgagtcattacatccattggtgtctatccttttagtgaagaatatacaatttattttgaatcaaatttcattgaaatactttccaggaactgtataagctgctcctaagtccagggagaagaataatacagatgtagcccctaaataccaatcctatacattcctcatagaaatcgctaccttggctagaatattcaattcctgttgctgaggtggtgccccagaggagacttgttcgtaacttatgagtccaaagttgtaacacaaaacaacttcccgtagaatcattgccataactatattatacatttaatggtagtttgtactagaacccattatagatgggttcagtagccatgaaaatgtctaaaaacataaagacaacatagaatatgatttcctctggataatggtaggtaggttagatagagtggtcatagcttcccttgaaggagaacaaacttggtaaatagatggagagaacaaaccacattctgtgctcatggttagaacatcctgcagcaaggaggtagaagagcagaaaggaaaataccccaattcatgcaagggcagaactcatgattagtgtccttcattttcacagtaaaaatctcacccctggatggaaatttgagatgctaatgagacatgtaacgtatgtactagcatgtacaacaatagcacatgcacccccaggagaccacccagaacatgcttaatggcaacactccttccccccacctcatgaataattgcacatactcccataaagggagtttccccagtgtcaattggtgccgccgtctcacctttgagcagctccctctgatcagccatcagaatgtactttcgttttatgaggaattatttgtattttggactaactctcaaattctcctgtgtggcaaagtcaagaacctgaactggcccaatggctataacaacattttggataccaagcaaccacagtgtatttgttaaaataggaatacagacactgcttcatagattgaaatacgtagcacggtaaggataactttttaagttacaatcagctcaaactttaaaatcactagctattttctttaagttaatctaataataaattatatgctgtgtaaatatttacacatattcgccccatttcttagaaaagcacaagtataatctttcttcaagcaaatccagtgtatgaaaacagttaacaaagtatgttagtgtatggttattcatatcacaagaggtttttagttacaaaaggatagcgcctagggtttctttaaatgttgcgtcccattatgcatttaaaacagtacttagattatccaaaccttcaggaataaatctattatgtaaagtaacagatacatatattaccttatttgtgaagtttggtgaaattagttatttggtagatgattgacacaagtctggcagggagccagcgctgtgaaaaccaggaatttctgatccttggggttgttatataataatctgcttccattagaatatttatgatgagttattttaaataataatactattgatatactactttcaaaattaaagtataaagtttactttctcaactacatagaaactttaggaatagtttttaaaggtgagaagtctgaattcattcattccacaaattaaattttcaaaactaaatgtctctaattcttctacctaatttactctgtcactcaggctggagttcagtggtgtcaccctggttcactgcaacttctgcctcccagattgaagccattctcatgcctcagccccccaagtagctgggattacaggcatccaccaccatgcctggctaattttggtatttttggtagagactggttttagccatgttggctagactggtttcgaactcctggcctcaagtgatccaccctgccttggcctcccaaagttctgagattacaaacgtgagccacagcagaattcaatatcaaatatttttgttcattttgttttgctttataaataatgttgtgagtatattatatataaatttgtgttcttatgttttccttcagaattttaatttgtgagcttttcatactatgttaatacaaacttttaataattagcatttgaatgatcacagtttcttcatgtagacataactgtttattattgaaaatttaatatcattattggaaaaaattattgggaaaaacaatttattgagaaaaataagatttttgttagtgtaaataacatttattattaatattactattaattaacatttattatgataatacatttattacttggaaaaataatattttgctattatgaataacgctatatttagcaaagcttcgtagaaccattaagaatttctctacacatattgtctaattgctttacctactgttttctatacatacatattatgtatttatatgttacatatgcacacatatatttttcttatttatgggtgaaagattactagtattcctatcattggcagtgagatgaacatattcctctccagattgcatatttgcaggatactatgttcctctattttgccgtgttcatattgtgatttaatacaaaattcctagaaacttggtgaggtcagtagaacggggtttatcacacccatgtagtggggtctcctattatccaaagacaggcatcaggtcagtggaaggagaacccgggtctcctcagtcctggattaattacatctacccgaattttaaatgaaaaatgaaaaacaaagagtgcatctataatttctagccagcatctgagatggaaaaggcattttctagtgatgaataggctcattatgttctcataaattaactggtgaacacatagttagaaatatagaattttagagccaaaggaagcctcagctaaccccatctcccatttgatagacaaggaaaccgaggttgggacgggtgatgtagtttgcttacggttatctcatgaataattgcagaactaggattaattgtctcgatttctaactactcgtttctccactaccccaaacaaactactgcttttgtttttctttaacccaaatgttaatttgcttcattattaagacaggtttttttgttttgttttgttttgttttgttttgagactgagtctcgctctgtcacccaggctggagtgcagtggcacgatctgggctcactgcaacctccgcctcccaggttcaagcaattctcctgcctcaacctcccgagtagctgggactacagacatgtgccaccacatgtggctaaatttttgtatttttagtagagacagggtttcaccgtgttagccaggatggtctcgatctcctaaccttgtgatctgcctgctttggcctcccatagtgctgggattagaggcgtgagccaccatgcccagcctaagagaggttatttgaaatatataattccatctctattaatttatctcctgtaaaaagagattccctctcctttttcatgccataaaggatccagacagccacaaggcttagcatgcaacactgacaaaatgcacaaaagaatcaaaatcgaattaggtaatcaaaaatgaaaaccaaggtactgcaatatgaaataatgtaaatcatgcacagcaaacctatgtataatagaaataccatgttcctgcctgtttctctaacccaccagttattcagtcacaagtaatttactcttagaaaaaaaaaagggccccaaatttgatttatttccccatccaagtaaattttaaaaggctgccaaagctttctacataaatctcaaatatcttcccatattgtggaggagagagagagaaagagagaaaagagcttattatttatgaagctaatcaggcaggcagaggaggagttagcttttaactttttcatttattatttcctcggagttaatatttcattgaaaagcaatctataaacaatatctttgggagcttatacagaaatgacttaaagattttttacattgtaaatgagtacctcttattgcgtatattccatgccccaccatttttattagcaaggttatttaaataacaaagaaaaagttccaacttttagttatttattggtttaagccaaggatcagcaaacattttctgtgaaaggcaagatagtgaattgtatatatttctggctgtgggcgcatgatctctgttgcaactactcagtggtgcctctgtcgcaggaaagcagccattaaaagtatgtaaataaatcagtatgtttgtgtcacaataaaactttatttatggacactgaaatctggattgtatataattgtatataattctgtgtatcatgaaacattgttctttccgtttattcaactattaaaatatgtagtaaaccattcttagctcactgctgtacagaaagagctagacttgccctggggccatagtgtgctgctctctggttaaactgaataccctcattgcaaggattttggtatctatggcctctctcataaacaagtgagcctgtttatgaactagtgagctctcccagatagtctcccacttcatccttctgtagaatagaaaaacaaaaaatgaaggaaagcaaaagacacctcttaaatactctttgatcttgatccttgttgagtatgtatagttccacttaaaaacctatacaccagtccttgatgcttttatctttttaaaataaactattactgtgcatgaaccccctttgaaatgtatcattttctgccctagagatgtttgtatatgtgtcttttatttggatgtgagaatgtggtatggtgtgtgaaatatggcaattactggatgtgatataaagtatttgcttattttcttaaacattgtaatataaacattttttgaattcaaatgtcttaacagaatgattcagatattgcattttatgtaataagtttctgtatcaatttttccttacattataattttatgtgttcatgatgctaaccatttggatatttggaagcatatggaaggttgaatatttcactttatatccagatgtttggtgttattcaatactgatatataggaaaagaatatgctcagccatctttattcaagattttttttaatttctttattgcccataaaagtgatgatttacaaatgtacaggtattatataggagtttggttaaatatattttattggtgtgaatgcctaaatatgatttagaataaaatatctattcatattttagaaacattgaatctgtaattctagagtttttatgattttatgtgtgtgtatgtgtgtatgtgtatataggcagagatcaatatgtgtatatataatagatatttaaatacacatgtataaatatatacattgatctttacctgcatacacacacacacatatataaatatatacatatatatatgtttgtgtgtgtatgtctatgtgctacacacacatatatatatatatacatatacacacacacatctggcagttttggaattgatctctgcctgattcttatctgtaccttagtttatacatactttaaatattatgagtgtgctcgaaaaagcgaatgtggaaacactaagtgaatgaaactttattttttgagctggtaactattgtgaggattccctcacttgcctactgtaacaaccaatccagggctttctgctcaaaaaagaacttcatccttagagctatcatgaaattatatggtgatattcacttcgcggtgggttttacattaaatgagaaaatgtgtgtgaccagtgctttgtaaattgaaaaatgctatacgcccattagctgttacctgttcaacttcactgaaactcctcaatccatttttctccatcttatttcagaagctatttctaaatcagaggataagtgtttttatcactggcttttcttttagtagcccatggatgcattccaattttattatttcacaagtgttaattaagaatggttaattgtctgctatccttagccctacattaaagtgctgtacagaagacagagacatagcaaagtacagactctcaggagactgacatctagttagggaaataaaaacaatctagttagggaaataaacacaccaaaaatgcattggtacaaaatgggatggtgttgagcacaagttcactaagctctcagaggagggatactgagtatggcaaaatcagattcactggtgagttaggattttaccttggccctaaaggaggggaagagttttggaaagtgctatatgaaccgacattctttaattagtaatttggcacattctcctgaaacggtctcttgttaaggtaacagacatgaattttatatggagctaaatgtctaagtcagcctttctgacaatcaacattcatgggtcccagattccttactttatatataaagggattagatgacttgtatcaaaccactgttcttactttatttagccacatagagtttgtttaatatttaatttaatggaaaatagcaaatagaaatgaccttgccaagtttccaagaaatgaagagtggtcaatcatcatgttaactttcagtttccttttcacctttttgtgaacaaaataacaatattcagttttgcatctccaaacactgttgccgcacactatgatttatatacgagtatgattaggaaaaaatgaagagttgaatattgtcagttgtatgaaaaaatggtgtgagctttatgtctatctgaacatattagagcacataaaaagaacaattttaatcattttctttatttttttatttttattttttatttttgtagggacagagtctcaccatcttgcttaggctggtctcaaactcctgggcttaagtgatccttctgcctcagccccctaaagtgctgggattacaggtgtgagccaccgcacctggcgttaatcattttattgaaacaacagcagaaaaattgacttctgaagttagcatctgctatgcatccattagagacttacattaaacattaggacaaaactctgatactttttgaccagttcaaatatcagttcataaaaatgaaattcatcatctctccgttaggtagaagtggcaattttcatcacatcctcagtaattaaaaagtgtctacacaatgggaaaaggaaggaagtcaagattggctatctaaagctgggtctatctggataatcaaagctacatgtaaatattagttttttgatgctgacttttattttacaataaataaaattacagccatcactactgtcaactcataaacataggtattagaagaaataaaaccctcttcaactcttgtcagaatctataagtatgaaaacatacaccatgttttttaaacactaattgacaccagagacaatttgccaaattcctgctcgagcgtttcattcaaatctgaaggagggatgtgtctaaatattagtatgaactctgcggtgtcttacatcttgtatgaaacattccatcttcagcaggcacacataaggatgggaaaaatgatcttttgacataaagttttggaatctttcaggaacactaagtttaaggtcagttgtttcctagtgactgtgccttggtgactatgcctttttgcatttgtatacaattaaaagggccacttgtcattaaatagagtatacacagcttttctatattgctttaaaaattatgcaggtagatttttccctggaactatatagaaccctatctttaaagtagtctcctcggaactgcattgtattagcacttcctgtttcctggtgtcttatttaatagtttctatttagcacatctaattgaaatctgttgtctgtcatttggccaaagccaggaatgccccttagtagggttctgtgccaaaatccctgagtctcacccactgtgttctagtcaattgacttgcaaaagcaaagctttgggaacttatgtagaaaagtaggtcaccggtccaatatagcattcctaatagtaaaaagtagaagcatgttgctggttgttacatttcatgccaattttcatccagttcaaattatggcactcttctatgtttcttgtgacctgctttaaattaaagatgcttactaatagtatagattctgtaccattttaaagtcttctccttggattttcttgtcttcctcaaaggattcagggttccaaaagtaaaagatgacaataaatgtagaagaggtctatgagagaatagattctccatttacatacatgtgcatattatttgctttatagtcattgttctaactttcagagagatgaagttattttgaaagaaattactgggctgagaatccctagctcttctttaagtttgttaaatgtgtggtcctcttgttcagatttaaagttcttaagcatgcactaatagtcatcgtgttttcctcatgttttcaactgtggcagtaagaagtaatatatacctaatctcataattttgtcctctaggttttgaaagacattttgacaaattacatgtgcattttaaataggtttcttcaaacagaaattttaagaataagtaacttcagtaatagaaggaaacaactcttccaaatttagatgtctcttctttcattgatctttgggcccagggtatgggatatcttttattataatattgggggggggggtgttaaaatgcctctttcagcacttgatgacagttggagagtcacttaagtaaaatttacctgtatacaaatacataaaatttcaaggatttcatggaactcatgaagactattcaggaccatggaacccagtaggaggagctctttgtagtctagagagaataaaaatctctgtacatgagcgcagattgcttaggcggccttacatcaaaatgggtacctagagtgtgttgctggagagtaatactgacttcagtagaagccaagaagctgatctctcacactgcttgcgaaagggaagcatgttgaaattagagggaaatgtaaaatgtgtaagggactaagaaggaggtcttgcttgggaagaagctggacctagttgaacaaattgtctagctggaggaactgcagtgtaagacttctcttctaacctggacctcactggattctatgtacttttaaacatttatattttttcaaaacaaataaaaccctgtctctgttctatttgagcatggttaaaaatgataatgtgtcacattttctttatccagtctatcactgatgggcatttgggttggttccaagtctttgctattgtgaatggtgctgcagtaaacatacgtgtgcatgtgtctttatagtagaatgatttataatcctttgggtgtatacccagtaacgggattgctggatcaaatggtatttattgttctagatccttgaggaatcgccacactgtcttccacaatggttgaactaatttacactcccaccaacagtgtaaaagtgttcctatttctccacatcctctccagcatctgttgtttcctgactttttaatgatcgccattctaactggcatgagatggtatctcattgtggttttgatttgcttttctctaatgacgagtgataatgagctctttttcatatgtttgttggctgcaaaaatgtcttcttttgagaagtgtctcttcatatcctttgaccactttttgatggggttgtttttttcttgtaaatttgtttaagttctttgtagattctggatattagtcctttgtcagatggatagattgcaaaaattttctcccgttctgtaggttgtctgttcacgctgatgattgtttcttttgctatgaagaagctctttagtttaattagatcccatttgtcaattttggcttttgttgccattgcttttggtgttttagtcatgaagtctttgcccatgcctatgtcctcaatggtattgcctaggttttctttgagggtttgtatggttttaggtcttatgtttaagtcttaaatccatcttgagttagcatttgtataaggtataagggaagagtccagtttcagttttctgcatatggctagccagttttcccaacaccatttattaaatagggaatcctttccccattgcttatttttgtcaggtttgtcaaagatcagatcgttttagatgggtggcattgcaccatggaatactatgcagccgtaaaaaaagatgagtccatgtcctttgcagggacatggatgaaactggaaaccataattctcagcaaactaacataggaacagaaaaacaaacaccatgtgttctcattcgtaagtgggagttgaacaatgagaatacatggacacagggaggggaacatcatcacacgccggggcctatcaggggttgggaggctaggggagggatagcattaggagaaatacctaatgtagatgaggggttgatgggtgcagcaaaccaccatggcacatgcatacctatgtaacaaacctgcacgttctgcacatgtattccagaacttaaagaataataaacaaaaattgaaatttggacatttaatgtaaactgacccaggtcacgttgcaaaccacagatggtggtagttttataccaattttgtatatacctttatgtgataaaaattaaaattttaaatttaaaaaaatgatattggggctacagcagctttttgagaaggctggaattgggaaaacaagattcacgagactgaagaaggcctaaaaaatgacttcagactctttggggtacagcaaagaaggagtttgaagctatgagctccctgtgcagggcaaagtaaaatggtttatttgggcttgccattaatacgctgtagaaatttggattcaacctagcttggatacatttgacaactatatgacgtaccataaaaatggatgaagttataaacaagctatatgataaaacttctagaatgcctaaacccatgtaatagcatagcagcaaaaagcagggacttttcatgcatttatagtgaagttaggttaagaatatcgttaacttttataaaatacctaggacagtaatacttaagtaccgattgttattaaaattatattggaccctatgaagcggtgatatccagctgtgttttaacacaaaattataatttcataaagctcaacttaacattccttgacagagctaagttttaattatccttccaaactttataggtatatacctagaaatattttagaaaccaatttgatatggtcattcaaatattcattaagttgataaatttattaaattaataaatataaattttatctcttaataagacaggtctaccaagtcacatcatctttagccattattataagtgctgccttgtgtgaaattgatcaaaatggcaggaaaatgtagtgtggtgggaacagaatggaccctggagccgtactgccatggctgacatcctggctccatcatttgccagctgtatgaattcaggcttagcctctactcaacttctctgtgtcacaggttgctcttatttaaaacagaagtgaggtctcaaactcgtggtctcagaaacagaaagacaaataccacatgttttcacttacaaatgggagttaaataatgtgtatgcgtcaacacagagtatggaatgatagacaacagagattctaaagcagggatgaaaggaggatgagtgatgagaaattacttcggtacaaatgtacattatttccatgatgggtacactacaagcccagactttactactaagcagtatgtccatgcacttgtaccccttaaatttatgcaaaataagcagtattgagcttaaaaaaaaacagagaggtgagggaattcctttatcaggatggagcagttctgtactttgactgtgatgataactattcaaatttatacttgtgataaaatgtcacagaacttaatatgcatgcacacacacagagcacctacaaaactgatgaaatctgactaaagtctgtagtttagtttgtcatattgtgcaaatatcaattttttggttttcataatggtttgtttggctaatgacagttctttaactggtttagtacttggggggtgcactgagtgatgggtagacaaggtctcactgtatagtttttctaaattcttttgagtttatatttgaaaataaaaagttagaaaactacacttatcttatgaggcagccgtcctattcttagttattttccttagaaaaataaaaacatatgctctcacaaaaaaagctacacaaatgtctacagctgttctaatcataatcactccaaactagaaacaaccaagatatctttcaacaaatgaatgaaataaatggataaacaaactgatacatccaatgtattattctttagcagtaaaaaaagaaacaaactattgccataagcaacaactaaaaaacaaaagataaaaatgaaaaaatggtgactctttacagagttgttaaatgagcttttatacagatatatgaagttcctctaatagagaccagcatgcagtgtgtgcttcataagtgcttgctattattatttcttcaaaaaaataattgatacttcaggattctaataaatattattttttttcataacttggacaaattaaagagtataattctgtgagtttcatatgtttactatatgtcactatgtgtgtgtgcttacacacacacacccccacacttctcatttagatgtacccatagacaaaaagcacaggtgagctgcgagaattcagcagtgaacgtgcaaggtgtggtctctgcaactatagaacttccactctagaatgatatttttttaaatgcctaagtttaaatttttcaaataagtgcttaaaattattccaatttattacagtttttaaaaattacactaattatgggattgtcttgtgcattagaaatactatgatttaaaaatatatttgtttgtatatatatctcccattgattgagatacaggactaacacttaccatacgtgctgactgtgtaaagtcagcttttataatggagttgttatattttgaagaacatgctttgaatcattgataagtctgtgtaataacaagatagatcataacaggatttaccggatgtttattgccagctacatagccgtccagcactttgccatcaatctgtactgtgtgtgaagcactgggctggataaaagaggaacacaacgcatttcagcccaagctatggagtaagacacacctgggtctatttcctagtattgtcgcttgctaggtgtatagatttgcacaaattattcaacttgcatgctcctccatttcttcccttataaagtgagcacagtcttaatgatcaacctcacagagttaacagtgaaggaaaaaacttgtcacatgaccgggcacatctaaagtgctcaataaatcttagctatctttattgctatgtatactaaaattatttgagggaaacatgacttagagatttaatgatgaagaaataaaaagtggtggaaaattacatactctatactcctatgtagaagcttgtgttgaagggagtctcaaatatattataggatacttgcattaacttcacaggcaatatggaacttcctctagggcttcaagtactgtaaggtttccgatgtttatctagtgactactacaattctggcattatgctaaaaggggaatgatatgagaaaaatgtgatgactgagtaaggtggggtggagttggtgtaccagggataagtagattagcattaaccatttatgttatagctagagaaagaaatgtgggctatgaaaaatataaaggcaatgtgtattacatatcactgctatttgtatttcccaatataaagggattaagtgcaatttgaattatatatatgtatactcaaaataagttagagaatacccatttgtttataatcttaaagtcgtagttgaattcaaagaagaaaaataaaatggagaaagtacactggattaggagtcaaaatactgggatcctagtatgagtgaactagttaatctcttatttaaggtatctagctccctcagttatatatagacacattggacattattaatttaatgttatttattaagcgcattttatttaaataattcaaactgcaagctgcctagagctagcaaatctctaacggcctgacaggtagtttgaagtagccgtaattacacacattctgcctattggattatctgctgtggcttgcttgatggcttaaaaatgaacattaaatggcacttaaatcaaaattcccagtggccttcttaggtggaagcagatgcttctcccgtttatatagaaatatttagatacaggaagcaaaggagatgtatagtttaaaatgtcaagttgatttgacatgtttctgggtttgttggttttgcatgaaactttaatgttaaacaagctttaaataaatcatctcttggtatttgagggggaagatgtactataaatatattgattccttttagtaaaatggtttatgggttcattagcaatgatgctgcaataacaacaatttttagggaatatcaaaagtgaaaacaaacctgttagcataattttcacatttgtagaaactgttttgtgtcatattatgatgtttagaatggatttagaaacttgagcctaagcagcagtttggtctcatgatactaaattcactttaatatgtgacataaagttgatatttttaaaagatttggtagacatgagcttgtgtttttggggcaataatgatcattattttgctgaattcctttccgttattctgtttctttctgtactgtacagttcaggaagttaatcctcaaaggtttggtatcattgttttattaatttttttggtcagagaataagactaattagtttttctagctggctgtgtcatgctaagaggttttagcttactttaggggttataatttgatctataggataaggaaatctatatggatgagtaattttgaaatgcacattctttccttcttttattgacttttgactctgtttttatgccacgattagttacaaggtgcacaaaaactttttctagcttgagtaaaaaatgcattttatttgaaaggcactagaaaatctgaggaacataaaccagagctctgccaggaacatgactcagctccccaaactccaatgtgtggagtcttatttgaaaattcaaaatattcagatggaggaatctgacagagaaagagagagaaggagtggtgactatgaggaggggtcagagagtagcctctatgggtgggggaatcaccctatatatattacgggtaacttccagagaaaagggcaagcatgggtcagtgtttctattgttaatggtcacctgtttttatagaaagaaaaatatcccagttgtccctcttatttcccagtattcttgcccagaccagcttaagaaaattgatagaacaaaacttttgactagtcttactcctgaaaatggcatgtaacttcacactagaattccattgcaacactgcagccttcaatgggctttgcactacttcccagtgtccatgagccctgactctgtgagcctcttgttcccatcagcggtgcacccctcattactaccttacctttgttgccacaggcacaaaacaggtcaaggctgctgagacagtggaggctggtgaggtcttgctatcagatcagatccataccagggactcagcttcaagcctgggagagcattccatgctgcaatcccttgggaaactggttcggttctggtctttcagtcgttggaagcactgacttcaatatgtccatcaattttccacagtagcaacatgtatggaaacatacaaagattccacaggatttttgtattaattattaagtggcatgcgctgagtttgctgagtggtcaatctaatggcaaaattaaaacacacatagaacatatatatggacatagaacatatgtaacatatatgttacatggaatacaatatgactgaagataataacaatactattttgggaggccttaacatttttagcagcataaaaaaataaatgtttggaacatccaaagtcatattatgtgtgtcctgtggagaaaattccatagaaataattcgggctttctaggcttttgcagacacccagcgcctgctggcaataaacagaggcactaaagcaaagcacaagtgggcagccagatataaatatccccctcgtcgacagatacagcgtgggacactgtgggctacagaatcaggaaggagggaaaggaaaaatctctagtcctaagtttttttactgccctgtcccatttttttttaaactactctgtttttccaaccctgcctaatcgagatttcaaggcagcttgagcctgtctttccctggttcctgaggtctccactgatgacagctgaagcatgtttcctgacagaattctgcctcctggcaaggtagacacagactccggggacatagtgtgtcagagcttctagagctcctggagtccaggcacctgcagttgagggccgtgactgtattgttgcccgtggggctttgctttgaaggcgtgctaagggggagagggagtggggccctgcccagaggtgcagcctctgcttcacctcccattcttgacgtggggatccagagcatgggcagaccaagaatcttgtgtacagttagaaaggtcaacgggaagaacaggctctcttcctgggagtgatataaagtgcggggagggagactccttacattaggaataattgaatgtggagaataatccctattccctcagggtacattttaataatgcaagtgactgatccacttaatgtctgcctgatttgaactgtacattgcctggcttttcattaataataaatccacaggtaaacaaatgcttcacattaaatgcctcttaaaagtgtttagtgtctactgccagaaaacctattaagcaccctggcctaagaaaggcaaaattgaacagaaaccgtatgtaatgtgatagaaacacctttgcattgtcttgtaacaggaaagttcacatatacctttagaatgcattttgggaaaattccaaataatggcttattctcttagttataaaataataaaaatgtaataaatcttgtatggttaataatacttgatttactatcaataataaaaatacatatttaaatgtatatttaaacataaatttaaaaaaaataaatgcatatgctatatacttctctatcctatggatataatgaagttagggggcaagaaggagagcttttattcttgtctgtcctcagcctttaagttgcctgaactaaatcatccttgaagttatttctcctgcagtaaaaaggaccatttagacaggtgtcaaggatttaacaataagtagcatttacttaatatatgcttttttattatgttctcacaacgaaattaaaatgcaactttccttaccagatggcctaaaagtgttctaaaatcagaaacttagattttagtgttcttagaatttcatttgtggtgttttcatttctgttcgttctcttttaattaccaagggctgaattaacctctggtgagatcatctgctgtctctttctatttcactggttgacctagcccactgactctttacatctaagatcagagaattttctgaatttggaaaagcccataaagaccatcttgagcactgctcccttttttaactggatgaagaaattaagtaactgtattaagtgacttgtaacagatcaagttagtatcagcagtttctagattttagatgtccagattcctagtcccagactgttccctcttaggatgaccacctcttatcagtttttgccctatcaccatacttttcatgggtttctacatgctctgcctattttccttctgcttctgatttctaagtagcctatccaagtatttaaccacatgcatagccagaaaatttattcttaagtccaacacacatctgtataattgcctccacctcatcttttgtagtctacagcatgtcaatcattcatccatttgttcattcagcaaatatttgaatttctatgatgttgtttaacgtttttaaatcactttgttaaatcattttaaaaatgtaaaagtatattgattatatgcttccgagtttttgatctcctgtgaaatgtcaagcctttcttttcaacccattgttattttggctaaccatttatgaggaatatgtgagtgtggaagcctgcatttatgaatgtggatgtgtataaaataaaagtgcatactttggcattgaggacaaaacaaaatttgatataagagaattcataacagctgtgagaattctaagtcaccatcaataatagcaatatctctttccagcaacacccattttccttaaggccactgaagcataatattataaccttcttcataaagctgttagatagagctatggaatagttctttagaattaaatgtagaaaactccagaatttcggaagtgaattataaagccagactgatttaagtgtaagaagaaatttcacttgaataaattctactcgctgagtcattgcaatcatagatttaatgtagtttgaaaccacaaaacttttatagttttaggccatgaaagtaaagaataaattcccctaaacaactttgttgttttctttctttttggttatagtccactgttgaagtcactctttgtccctttctttcaacatggtatatgaatgttttctttgcctcatgcatcaactagtaacaaaggtgagttgactgtgagaacagtgtccaataacttgtcatatgtgaataggcttccatacaaatgaagcaaatttaacacctgtttagaaatgcaaagtcatagaccttctgaattaggtacactgtactttcaatgacttgagcaagtcattggaactctctgaggctcagatttttggtcactgcaatgaaaaacagcatctgcctcgtggggtttttataaggattaagagtcatagctaatcatgacatctggaatttagcagcccatttatgttattactttttgttgttgctgatgtcattaagatgtgagtagcccaagactttaatgagttatatttttctggaccaattctattttataccacataccagaaccatcttctctctgtatccattctgtagaaaacctgagaacttcttcatagctttgggcatttaaaattagtaaattactaaaatatacatactctatgcttatactaaagaggcaaacctaagtgatactgagaagaagtgctaatggatagaggtgcgttatactcagaaagatagatggtgtaggatatttattactcacgttattcactgcatttacgtggtcaggaaggttctggaaataaaatgttctattttgtacccaatcctaatgtgttagtgtatcagttggacagaaattttcttattctttcttaagatcagttataggtctggaagtcactaaacatgatttcctaccattctttgactatttgagttagtttcttagttgtttttttcctacctttgtagaaaaatcgcactcatagtgtgatttttaggatagtgataataatagtaagtgcctttgaaaaaggaaggcaatttatgtttccatagttatttcatgtgatcatcacaactgctccataaaatagaaatttcgttgtaatttattcttttaggtataacttagggatataaaaaataaagctatatctgccccatctacttgagtcaatacactctttgcccttagtaagtaagtaacctcattgaggaaaggtgctaaggtagtggaacaattgcagacagaatgtttctagcaataaatacatgccaaaaccaataaagcaggcatctgggcttttcattcagatgggtaagcgaaggaagatctctctccagacttcttcatcctgaagaggagattgttatggcgtctactgtttacaagtttaacaacttggtcttttgtggttctttaagatttttgcggcatgaggtttaaaaagatcagttaatcatcttcatggcaggcaaattttgaggaaaagagaaaagataccggaaaaagaaatcaagtttcctttgctagacgccattacagaatgttcctacagagaagaaatggcaagtgcatagatgtccgcaatccaacaacaaagtgtgaaactgggaatggctctgtactagagttagctatcttccagtctagcaatttccgtagccctgctataattgactagcgggattaaggacaaatgaagctgcctggacttttatttttttatcgtgactaagagtatatatgtagaataattttaaagagggcacctcggcggtccattctgatcagaaactggaatgttgccagctctcagaacttagtgtttgcttcctccaacctcatgttttactacctctggttcattcctaaagaaaataatgtagtttccgccgggcacagtggctcacgcctgtaatcccagcagtttgggaggccgaggcgtgtggatcacgaggtcaggagatcgagaccatcctggctaacatagtgaaaccccatctttacgaaaaatacaaaaaaattagccgggcatggtggtgggcgcctattgtgccagctacttgggaggctgaggcaggagaatggcgtgaacccgggaggcagagcttgcagtaagctgagattgcgccactgcactccatcctgggtgacagagcaagcctccatctcaaaaaaaaaaaaaaagaaaataatgtagtttcatctatgtttgtaatcatgctttatgcatccttcctgtccttccttcaatgagcattatatttgtgaactctacacacatttcatgtgcagttttatttcatttttcttactgtataatattccattttatgaacatatggtaatttatcaacatagtcaatatttgggtgttttcaatttatagctgttacagtgcagctctgaacatcttctagcatgaatcaagatgcacttaggcaggatcaacttcagttatacttaggagacacattgcagttgtttagaatatgtgtaacttcctatttatatttccattaacagcaaatggcagttcctatttctgcacatccttgcagtcacctgcattgtcagacattttaatttttgctaatctgatggaagggtaatgatatctctaggtgacttttaatttgcatttactaatcactaatcaacttgattaccttttcatatgcttatcacttactgggatttctgcttttcatggtgtcttttcaagtattatagctatctttccattggatgaacagaattatttttaaaaaatgaaataaaatgccacttgagagtttctgtgctaacgtttgcaatagaaagttcaagcagaatcccaaagttgaattcttaagttgatggttccatagttatttttaactgtcatataattgaaaacctttattcccttcaaatttctttttcttttctagataaagtcttgacagttcttttttcttatcttcttattcatctcccctccccacttagatgaagtaatgcaaggcttgtaatttagagcttagagcaatctctaaggaaagaaaaatgcaggaagattgcccttggccttaggctttagagaatcttccattttgcattggaaataggcatattcttggcagagattgctgttgtttaaacctcttctgatgccacctaatgggaggctaggaaagggaaccttcaagagatgccaggcttaatattaaaaacaagtagttggacagcgatttagtgagcataaggaacataatgacaggtaaggagagaggagatgatttcacctacccgtgctaaaaatggctttggaatgatttatatgccatcaactcattacagccctaactatcaccaaggatcaccaaggcaacgaggattattcttcacacacatccctcaggctttatctccatcttctaaagcaattttgctattccttccaacctgattatttacacatggatggcagtatttaggtggggcaaaatggatatgctattgccatccacccatgtccagatttaatcttagacagtcatatgtctcttatgcagacaacaaaaactgtattgttttatgcttattgagagctgttatggcagaaatacagaaagtgaggtattccttgaattcaaacttggagtcagagattcaattttagttcttaccagctaagttcttatattttgcccacatgtatcactgagcagagggagtcaaacgtacgctgcatgagataatttcaggagctgatgatacattttatggatttaagtttccataacccttgatagacatttaggtgttgtttttaattcgaagtttttgttgtatgtgtgttatttgtatgaaatttttgtcctctgtaactctgagtatccatgatgtccagcattactttctgttttgttttctttttagcatcctttattttttcactttctttctttcaatgaagttttatttttgagaggtctaaggcacttgccttatgaaactatcttctgaaagcacactaaaagaaaattacttaaaagtgtattccaaaacaaaattagaggctgggcacggtggctcatgcctgtaatcccagactttgggagaccgaggtgggtggatcacgaggtcgagattgagaccatcctggccaacatggtgaaaccccatctctactaaaaatacaaaaacaattagcctgtaatcccagctactttggaggctgaggcgggagaatggcttgaacccaggaggtggaggttgcagtgagccgagatcacgccactgcactccagcccagcaacagagtgagactccgtctggaaaaacaaaaaatagaaaagaaatcaggttgttaagcaactgaactttaggtaatttaagcaactgcttataaattttcaaattatcctataatatgtaataagataaattcacatatttaaggccagcacttcctcttagtctttgctcacatccttaaaataagaataaattgattttttgataaagtagttgtaatcattttataagctgaaatgaaatgttctcgtttgctgccatgagtatttcaggttggtttcccattatttgagtcattatttttgcttgggagatttctttataaagataaatatatacaaagtattataagaaggctcctttggaatatgcaattagaaagttacagggtatcatagctgggatggtcttagaattcatcttctaactcttatttcaaatatgatttgccctaaatggcacagcataatatgcaatagggcaaagactagaacagtcttttttttgaaattcttcctcctagaatagtaataatagtgataaatcttttattgtgtagtttataagtgtgtgtgtatgtgtgtgtgtgtgcttctgcatttataatcctcacacctctgttggattaggctgaacagataagacctgtatcttataaaccaagaaaccaaggctcaaggttaagagcatagtttgaacttgaatcttcaatctgcatgcagttctgcactgcctttgtgtgttagtcttcttttaaggaacgttaggatggacctatctggaattgtcatgagtcaaaaatgcaaactaaaaatctggaagcaattgaattaaaaaggtacaactgattttagaaaaggcaaaagcaggaagttgccaatagtttcatttgaagagaaattatgtcaaaatcactaactcagtacatagaatcaccctagaaaattgtactggatcaagaaagaagggaaaattatggaaaattttaaatatatcccaggaaagaagaatgaattaataagagcacatatgctaatgtattggacatatgcttttgcaactaaaagttgctattcacctttctttcggggagggaatgccaggataattttcttctagataaatcacgacccgcactcttagcctctgtgctgcaagttgggctcaatttccactcaagagtggaccatgtgcctggtctaaacttatcacaatatcttgttttcctgacattatgcttgattcaaggatgaccttaaggcccaatcagaatcaaagacaaaatgagacttttgttttgtttgttttgttttgttttgagacagagtctcactgttgcccaggttggagtgcagtggcgcgatctcggctcactgcagcctcgaactcacaatgagacatttttagagacttctggataagagacttattactgaaaggagttgctgctgacatcttttgtctctgcagagaaggccagactgggaatgttgcaatttcaggttaagagatatggagcaagagaaacctcgccacagggacccagttttactccctgaattaagccatagctgaagccatctctactgcagtatttataaattacacagacaaattattttttgcttaggaaagttatctggtcacttggaaatgaaagatttatcacatcacatagcttagaaagactatggatgcctggaagacctggaccaacactgagttgggatgcgcacaccagctagagcagcactgttattgacgttgttgtcatcatcattctagctaaggttgccttttaagtgacatgaggaatatctgttttaattatctcagcaattctgaggctatgactatccccatttttcagatgaggacactaagccctgccttttaaccactgtggtattcacactagaaccaggtttccaagattagctatcagtagtcttttgaatcacattcagggttttttaaatactccagatttttccttcaagtatctgttcaatgtgttcagttctgaagctgttatcaattcaaccactgatctgctcttctttcccctctccagctgaaaagaatctctctctgtcctctaggctcatttagcaatttagccatcaattataacttacatacagatttagatataaatatagacagataaatacataaataaatatatagttatacacacacaaacatctctttctatctatatatcttatctatctatctatctatctaaatttgtagtttctcatatgttttaagagtgagtcttggtaccagaaaacatggattggcatcactgcttcataaaggcttgttgtatggccttaggcaaactatttaaactatctcatcagaaatatgctcaaaataatacccaagccatgatattgctgggaagattagatagtttgagaaagaactttacaacctgcaaaattctgtataagagattattatatttatttttactccccatagcactgaagctctagatgtagttggagctcaataaatatttgtggaatgggattcaattcaggggtgagtgacagcctatataagtaagaaaagagataagaatctcttgttggctttgatggcatcccaccttcccatctatacatgtcactttttcttttttgcctctttcttactactgtttacccttcatgctctatgttatatacctctgatttcttcaccccttcattttttttagcaaactccaggaacatgtcagagacatgctggtgactttctagactaacaggctagtgattctgagttaaactttgcaaattatttattcacaatcacaatatgctcaaactgtctttggaagttgcactaacaactttctgattgacagggtaggtgcctttgccaagtactcctatggccagaaattaatcaccagacttagggtgatgaactaactattggtggtcatgaatgcagttaacatacgctagaaaacaataacatgcactagaaaccaagggacttcattccattatcttctaccgtatgcaactttttatgattccttttttagtccatcaggataatgcactgtaaatcatctgctagacaaggcatctacaaagctctattaattcatcataaatacacacatgtgattgtgcacatagtatggttatcatttctgaactctaaatatattaagtttaactgatattcttcagcccaattgcccccatgcacaaatttgcacagtcttccaaaggtagctaattaatgaaggacatttttaatatttgctgagtattgctatttatgtgttattagaaaatgcacccctacctctgatttcccctttaataggaagatggctttcagtttggcacgcacaatttctctcatgctgatgtaaaaagtagttgaattatgaggcttaatggcatttagcatctttaatctccctactcacagttctgctggttatttagccaggggagttcttgtggaaatacgcagcatcttggtttatagtagcaaaccaataagcaaatgtacctgtatttgaagtgacaatgccattgaagttttggtcaccagctctaaagcttcaaatcagagaaaagggcttgtgcttggaatagtgcctctttacatttttactttcttattctccatcactttgtgggaactagataaaagatgactagggacagggccattactttctttgatggcttcaatatatcagaagggggcagcctttcgtgtaaagttcctcaaatgggaatactctcttttatagctagccaccagctgtgaaattgagactagtcaggaaatcagtgaagaagaggaaaatttaggcatggccctgggaaaagagggaagagaagaaaatgacaacttttttttctggtgtctttgacagtttaataacatctctttcatggtggaacacatgagctatctgtgccatggctccaggaaatatagtcaagtccaacatacgtgtttctgaacactagctttgagaatataatcaacacggcaaaaattatagagtatctgagagacagaaaattcaaatagggacctctttctatattggctctctacaatatcattaaaaaaatggtcctgaagcaatctctttgataaatcaacaactataatatctgatattttggtaagctgtatgaggatacaattttttgatctgtttcgttctcttttgccacttcagtgcctacaaaagctagcgtaagataggtactctgtaaatatttattgatcaatgtgcaataaaaacactggagagaagtatttcatttcaactccttccttctgaagagcacaaaggctttggagtaaaatacccagaaataaatctgcctttttaaaatcaagaattctttgagaagttgtcacaaaatatcagaaattaactgaaatgaatttaactgaaatgcatttttatttttacttttatacttttctagtaaaatgtaaagagttatacaaatttagaagaatatatctctttctatttatctatatctatttttatatccatccttttcaaatgataaattgcattatgacctattactaaatattccctgaataattagcttttcttggcaaagtttattgctgttcggtttggtttaacgtgtatatttcactttatactttgaatgataatttagaatcatagccataagtcacaaagtttaaagaaaagtgaaaaataaactgaataagagttaacagtaattctggttgttacagatcttctcaggtttaacaacgtaaaatatgacttaggttaggaaaggtttggaaaaaatgtttttaatttgacaagggcctctaaatataactcactttatatagcaatgtcccatttccataaccttaattgctttctctttcttccttttctttcactccctctcatctccgcattattctctttatgtattttgcattcaaagccacctactttcgaaacttactgcctagaagcagatagtgaatgtttcagaatttgtgtttcttgaaacagcatttttttcatagctgaattataataactggagaaatctgaggatctgaaggttgcagtaatttagtaaaagagatctggaatcattttcccagtgaaaataccagctgtactatgagggctgatttttcttctttgatgaattctacactgtgaaagatacataaggtgagtgggataccaggaaaggacaaggaagaaggaacgtggcttctagcccagcactttggtctcatttccatttatgaggacagagatttgtcagcacatcagcctatcttgggaagactgctcattggacgaatgtttagatacagtaagaacattagatccaacattatatgtgaagatattgatttgatttaaaaaggagaaagagaaagagagagagagagagatggagagacagagagacaggaccaagctgattgaagcaaagccaactggctgttagtttgcagggactctcagtaagctctttgcaaaaggtagcatagtgcagtggtttagactaacgcacagatatacctctgtcgatggacaactttggttcaaatcccagtttctctctttactagtattataaccctgggcaagttatttgctcaagagatacatctgcctcagcctcctgaggagctgggactacaggcacacatgcaccaccatgcccagataattttttttttttttggagagacatggtctcgctttgttgccgagactggtctcgagctcctggcttcaagcaatcctcccacctcagctttccaaagtgttaggattaccgagacgagccactgcacccagcctaaaccactactttaggcagtaatctacctcacttaatcacccaatgctatggcataaaccttgggcatatggctctagtcacattcctttaggaatattctcagttgcacttagtaccagaacacaataattactaaacatttagaacttcattggagagtaggtacatgtcttttccagagaatgtctcgagtagctaacatatcactaagacggtattttttacaaagcacacgctcactgggaaggtgttcactttattctcgaatgcttaaagaatgcattgaaattcagctttataaatgtgcctcaactatgggcttcctggtaaccaacatggaaaccaaacttgccaaatgaggagtgttttctttgggaagacagtcgaatgaggagtcaaaactgtggatgtgttaaagcatgttacatcatacatgtagccatgcccaaaagctaagcactacatagccagacagaaaacattttttccttcactttcagatataaattatcacctgtaacatttctgtagaaaaagagaactcacatacataagacagatttaggagcaagttgaaatagtcaaaggaagcttctgttcatagcagtaaaaataatgaacaattatacaagttaaacttttgtttatctttccactggaatggctaatagtttcttagtttaaaggaaatctttagattggtttccagtcaggaaaaggttgaccaaaggtaagcccctgatgtgaaatgttagacaaattaatgtgagcacttcagaattctttctttggtggacatgtatgtcaaagttgaaggtagttctttcattctccctcacccaataattaaagtcaaaaatagatatgaaagcaaacctaatcatacaattccctaagtattctactcttcttcagaatttaccagcattagggtggttaaattagaataccaacactgtcggccgggcgcggtggctcacgcctgtaatcccagcactttgggaggccaaggtgagtggatcacgaggttaggtgatcaagaccatcttggctaacacggtgaaaccccgtctctactaaaaatacaaaaaattagctgggagtcttggcgggcccctgtagtcccagctactcgggaggctgaggcaggagaatggcgtgaacccaggaggcggagcttgcagtgagccgaaattgtgccactgcactccagcctgggcgacagagcaagactccgtctcaaaaaaaaaaaaaaaaaaaaaaaaaacaaaaacactgtcacacctagcagtcatacacatggtagatcaataaattcttattgaatcaaatctgaataatccaacattaacaataataatgtttaacaaattcagtcattttcttccaattttcactgatagtcttgattgtaatgttttcattttgatattaaaaatatcctagttttattatgatttatatttctattctcagtagaggatgacaataggcttaaatttcatatagttgcccctgtattccatgcatgttcttccttacctcccttgtagagtagtagactgatttcatcttgacagtccagggcaatcaccccacccaacactgcaactcccttcttagcctgttgatttaaaggtaggaggagcccaaagtgtccaggtggcaatcttaacttccagtttaatggcatcattgttgtgtctcctggtggcagcattccttcctctggaactaagatctctaggccagcagaaggtaatgttgcaggaacaggaagcaaaacgtttgctaatggatcactaggggtgacggtgagtggtgccacttctacttccactccttgattcctcgaccctgaattctggctatgggagaaacaggaccatatataggatgctgattcagagcatacatggccttctggagaactttgtcccagctctgcagagtattgtcacatagttggcattgtaattgtgacttcaaaaggccattccaaaattctatcagtccagctccttcaggatgatgggaaacatggtaagatcagtgaattccatgagcatgagcccactgctacacttctttagccataaagtgagtgccttggtcagaggcaatgctgtatggaataccatgacagtgggtaaggcattccttgagttcacaaatggtagtcttggcagaagcactgggtgcaggataatcaaacccatagccgtagtaagtgtgtattccagtgaggacaaacctctgccctttccatgatgaaagatgtccaatataatcaacttaacaccaggtagctggctgatcaccctgaggaatggtgctatatcgcgggctcagtgttggtctctgctgctggcaaactgggcactcagcagtggccatagccaggtcagccttggtgagtggaagtctatgttgctgagcccatgtgtaacctccatccctactaccatggccactttgttcatagacccattgggcgatgacaagggtggctggggaaagaggctgagtgttgtccacagaacgggtcatcctatccacttgattattaaaatcctcctctgctaaggttgcccgttggtgagcactcatgtgggatacaaatatcttcatggtttttgaccactcagagaagtccatccacaaacctcttccccaaatttctttgtcaccaattttccaatcatgtttcttccaagtccctgactatccagccaagccattggctacagcccacaaatcactatataatcacacatctggccatttcttcttccatgcaaagtgcacaaccaggtgcactgctcaaagttctgcccattgggaagatttaccttcaccactttccttcaggaatgtcctagaaaggggctgtagtgctgcagctgtccacttttgggtggtgcctgtgtgtcgtgcagaaccatctgtgaaccaggccctagtcttctctttctctgtcaactgatcatggggaactccccatgaggccattggtacaggctggggatgagaaggtagggtggcaggagtggaaaccatgggcatttaagccacttccttatgtaccttacttgtgtcttcaggaactgctcgaacccgattatgtatatactacatccatttgtgatggaatgctgctgtgcatgacccactttatggctagatgggtcagaaagcacccagttcatgacaggcagttcaggttgcatggtgacttggtgacccatagtcaaacgttcagtttccaccaaagtccagtaacaggccaagagctgtctcttaaacagagagtagttatctgcagaagatggaaggtccttgcttcaaaatcctagaggcctcctctgtgattcacctatagggtcctgccaaaggctccaaacagaattcctactaccactgacacctcaagcatcattggatctgctggttcctatggcccaagtggcagagcaggttgcacagcagcctgcacctgttgcaaagccttctcctgttctggaccccactcaaaactggcagcctttcaggtcacttgataaatggactggagtaacacaaatgctattccctgactacaggatggtagactgtgatagatattgggcttacactagagaacaaaaaatcaaaatgctgcctactctcacatttcttatagactagtcaggaagacaaggcttaaataattacatgaatgaacacataattagtgctaattgctggaaagaaaggtacatatgagaagggaaccaaacttttctgagggtcaaggaaatattcttgtttaagctgagacttcaaggacagttttgggggagaaaagatgcccataaagagggagcagacagaaggaatatgcctgtataaagacccagtggaagcaggaacaggtgaaagaagactagaacacaagtcttagaccatttcctgactgagttttcatcttaaaagcagtgagaagccattaaagagctttataccaatgatatgccaacagcatcttttttttttttactggtttgactaatcagagactcaagttttttagttatttattgcttacgtaattccaggcaatatacaatatttgcctcatctttatggtaatttaacccagtaatacaacaatttgtatactgcatttgtattttgaatttgtactttgaaaagtgcatgcccatagaaggaacaggacatgtctcattgggttttagttcaaatgatctagctttaaaatatgttgaaaataatgtgactgatgaatcatatgtggtctgagcttcaaatacttttttagcaaattgcagaagggctattaggatctggggggtcagtgagacagcttgacaaaagcaaatgtcttgcaaatatatgtagaatgatacttcagagaaaatatagtctacagatactttttatttgattctgctaagcaaaaaagaaattccagaaatgaaatggtcacagaaacttatttctacttttacaaaatgaatgtagtgttctatgacacaaataacctaagtatatccaagagtgtcaaccttctaagcttttgggtttgttgaatttccctgaaggctttggatattatcagggtagataatccatatgcaatatttgaatgtgttctcaagctgtgtatgcatagtcctcatttatttcttgtcaatctgcaaagcagagagggaagagccagcctggtgtttagtgatgcctcttccatgggtttttgtacaatcctcttctctgttctgtctaataaaatgtagctaacattttacttattcttaaagacagctcagaaataaaagaaccatataagcctttttctgtttatagtgccaatcaattagagccttcaagcaattattgactaattaatagctgtcttagggaaaacagagaacttagaagggacttatatgtggaattaaagcaagttgactcgcacaattatattgctggtagagccaacatagataagttctgagatattgcacagtttgtataaattatttgagaaaggcttataaggaggaaagagagattcactgctgaattttttgttgatgatctattgatttgatttcaagtttacatttttgcatttcatggtaaaaatctatgcttttttttaaaaaaagatatactttccataataaaatagcatagtgctctgagaacattttaaagcccatgctttattaaagaaaagtgaaatgtggaattttgatctaggttctgtttatttttgtacataattatccactggtgtgccttggtataaatggtgtgtgtgtgtgtgtgtgtgtgtatgcaattattttaaatttggattaaaaactaaatttggtgcaatttttttcaagctgtatgttaacattatcatacagaatgagatctaaggacatccaatgcattagcctaaccaaagccaatgctatgcaatgtcgatgtctacaattctttttaaaattagcaaattaccagatgtttttggctactgaatatacgctcagccaaaagatagacacattagggagtaaaaaaagtataaaaaacatttttctgcctcaagaagttgtcagtctacatgaataaataatattttttccatgctgatcgtaatttgacactttaggagcctctctggtgttggcacagatctgtttgtttcagaagcactggtttgtctctgtacacagggtgcaagcgctgagagtgcgaagatgaggtcttgcagttgtgattcttggcacatttaagaaatagtgcagtgtgggtactggtccgtcagaatggatgttgtcatcaaccatccatgtggtcataccagtggcccgattcccagtgcccccatggtaacactgatttctgtgcttagcacaaagtacttgataaatacttgtgcttaattaagttctacaaagtaagatacacagataagtctttaccatctctgggtgaccaaaaaggagtttataatctgtatgttgcttttctttttcctagttaaaagaccattaagctattagagtaatggattacacactgtcgattacaagtagatgaatgtcttcacatacatttttcctttaaaaatcaatactgaatgcaattcagccaacattaaaaatatcctgcagttatattatcaaaaacattgaagttttaaccacactgccaaataaaaattttatctttttatttatggaaaatgtctaccattgcttagaatttgatgcattaaaaagcattgattctatcaggaaggaaaacctgctatgacctgagagggctaatccaatataggaaaattcttctggactttgagattttcataattttttaaaattctttttagcattcttttaaaaagcatgctaattatggaaaataaaataagtaatctttactacaattaaaaataatttttattataacaaaaatttcctcaatttaaaacatacaattaaaattaaattaaacaatgtcattttgcaaactgcttttttttcacttaaaacattattaacattgttcccaaaacataattcttatgggttgcatgaaagtcaattataacatatatttctaaactttccacttttaagtgtgaggtcattgtttatgccctcctgcttgtatgaccagttattccttaatataagttcatgaaaatgcaatggcttggtcaaaattatatctttaaggtcttcagtgcacattgccaaattacactgttcaaattattattattacgttttgagacaggatgatcacagctcactgcaacctcgatctcctgggctccagcgatcctcttgcctcagccttctgagtagctggaactacaggcactcatcaccatgcctggctactttttttctttttttgtttttctttctttatttatttcttttttttttttttttcggtagtaacggaatctcactatcttatccagattggtctcaaacttctggcctcaagcagtaggcttccaaagctctaggattacatgccccaccatggccttccaaaggtccaggattaccggtgtaagcttccgtgcccagcctcctttcaaattcttaagcatctcataggcagttctgtagtcactggatgaattggtaatagtcttatattacttggagaaaaagaaatggaagtaccttttcatcttctagttgaatttaaaagtaaacatgctttagtcttttatttttctgtttttacttttgccattattttaaactacagcgacaaaagtaaagagtttgtgataagtcaagaattgagctcccaatattttcaactctctttccagttcacatctggaattgtaacaataatcactaaaaatagccagatcaacacttctctagggcactgcagaagaaactttttgcagaggaaagaaaggagcatttcagaagtctcagaatttgattaatataattattcagctatttccttttcttttcttcaagatccttggtcaaaactggctcaaagaggacagaaatatgtatcacccaggtgagccatgcagtaactagtgtgatagaagtcaaatgctgctagttaggttgttggcggaattcactttacaaaggctcactctaataactcctttctcccggcaaaactggagaaatattgactttgtcggtgacttgagcagaatagccaaaggaactaggtgatatgcagaattaaacctctttgggttttctggtagaaataaggaaatgaaataaggatatggaaataggaaagagggctttcttgctctgttgcccaggctggagtgcagtggcacgatctcaactcattgtaacgtccgcctcctggattcaagctattctcgtgcctcagactcccgaatagctgggattacaggcgtgtgcttccacgcccatctaattgtgcgtgtgtgtgtgtatttttagtagacatggggttttgctatgttggccaggctagtctcaaactcctggcttcaagtgatcctcccaacttggcctcccgaagtgctaggattacaggcatgagccaccacacccagccaagatattaaaggtcaattttacttccactatcaaggctcgatttactcatggtgcaggaaagtttttgtcatatctaggattggccctttaccatgctcctcaggtagtaggtaccaacaaacaggcttattcaatagattcatggctgggtctaagactaagttgtatgtatttacatcatcttctgggattttttttctctccctgcagtgtgttatccaaaacatttttgaagctgaaaagttggctaagcttcttctctgaaccattttccaacttacagggtttttcagaagccaatgtcctgccagttttctaaaggtctaagtcagaacgtggtaaactacacaaattgattattcacgtggtgtgatctgcatcctcccactacgtaaaactccctcagcagcaggatcccactagtatccaaaatacatatcattcatgtcaagactttgggttgaagtctttttgtcaagaaattctcttttaaaatggaaatgggaagaaacaattaacagttcatttatctattgtctgtgacctgctcatatttttattttttggtgctttctgctttcctttattttttaaaaccgtgattaaatattactttcatggtttttaaaatttaatatttacatgtataacctaacatcaatgcattaatcttaacacaaactttaatcacttatgataagtttcatcagcctcacgacaatcgatatttggtgctggacaatgctctgtcatgtgtgggaaaggggaaggagagggttctctgtgcgttgtagagctctatctgctagataagagcaacagcgctcctttcccattttgacagctgaacatgcatctagacattggcaattgtcccctgaggggcaaaatcacccctctcaggttgaaaccacttatctataggtagtaaggcactgattcattcctccaatctggattgagctcctgagggatataaacacacagaagttcctgcttccaggtaatgcaattccagtggatgtaaaaacctcagaaagtcagagacctacaaggccatgtgtttcaatataagagggcaaaatagggagtaggcagctggctggaaggagaacccaaaggggcattctttcttctattcttttactcgggatttgcctcttcagagaaaaggctataataagtcatagctctaggaaaaaatctaaggaaaagggcacccccctggatggatatttggtagaaacttgtgccttctgggtgctttagattaagaactgatccacatatagctggctctttaaaattcttagaatgttctagatttattccatcattagtattattcagatcatcaccataagctgcaatttataattcttgtctcacattgtttaggctatttttccaagcccagtatccctgagtcctcctcttagttttggctattgatgcctctccccttcatgtctgggtgtatattagtgacctgctgactttggccttatactgcctattggagaggagacaggaactgaaacctcattgttccattttttgttactgccttcatcttaccttgacttgattcttcaacaacctatattacatgtgtttggtcattcttgtgttgctataataaataccagagactggataatttataagaaaagaggtttaattggctcacagctctacaggctgtacaggaagtatggtgctggcatctggttctggggaggcctcaggaagcttttactcatggcagaagatgaagtgggagcaggcacatcacatggcaaaaacaggagcaagagagcgtagcaagggagatgcaacacgcttcaccagatcttgtgagtactcactcactgttgcaaggacagcaccaagccatgagagatctgcccccatacccaaagcaccttccaccaggcccacctccaacattgaggattacatttcaacatgagatttgggcagtgacaaatattcaaactgtatcactacactaggtagtaatggaggtcttctatttgtttgacatttttcttttgttaagactacctgaaggatcaagggagagaagttttctactgtaaagactttagctatggaatgtatcacttccctctccaattctcatactggatcatcctgccaatgccttgtacatcacaaaaaagttatggtccttctcctggaaggatgagcaaattaaagcacaaaaacttacaggcatattactcagatgttatcgactaacaagtctttgctaaaaagatcaatcatatctttccaggcctttttttattccatccccaaagaaggctgacacctcccatcatttcctgacatttctgatgttctctggaaataaatagtccattagtctttgcgtgaaagaactttgccttgtctttaggtgggtaacactctgttcctcattataatagttttcctgggatctatattaacagcatcaaaccaaattattttctctattccagatattaaatttcctttttaaactgaacttgctcattatagacacatttattatgcctactgctctaagaaatacattcttccctcattcaaatccgcaccctcattttaaacatgccattctctccacttactacccctgtgtaacccttcacttggggatttagcttccctcaaatgaaagtcctcagtccattccgctatcatcgctcaatggggttttcttatagtgtttgcattttaaccagctacaatcacatttcattgattctatctcagctggtatattatttttgtcaatccacacatttgtgaagccatagatttctggggtagatctctgaaagcactgaactttacatacatgtaaatctgcaagcaagagcaagagaggacctaggacccaggtggcagatgccagaccaaaacttctgagttacagagctccaccatgagaaatctcagccaagacatggttttttcctttaattcttctttcagatgcttctcttaaggacaacatatttaatactagcatttgtatccatattcaggcactttaaaaaggttacaacctgtacagactacagcttttatggaatggtatgttttacaactattggctcctaatttagattactcagcacttacaatctttatggaatagatctggaaggtaccagtctcttgttcacttcatttatttatagtgttcacctaatagcgacctcctttcagggcagccttctacctataagaatttccaagtaatggaactaacattctgctactggattccagacacactcacacgggaaacacaattcaaatataatgtgttcaacttaaccaatctgtgtattgctacttcaagtggtgatctaaattagactaactcactggtgagttcaacagtggtctcagagcacagtgaatctacagaaatcttagagatcatttaacctgataattctcaaagcgtgatcactgaacctcgtgatcattgaatcagcatcactaggagctggctagaaatacaaattttagggccccaccccacatctactaaatcaagactttgggctgggtaatctgtattttagcaagcccaccagataattctgatacacatctgaaaccaatgatctaacttgttctgtttacagttgagaaactgaaacccagagtaataaaatgacctgctgaaagacagaatagaactatttggtgacaatatcagaatgagaacaagtcccaatcctctaccatttctcctacactgtcaatgaggttgctggctatacatatgcagggttaaaatcctgtaaatttcaacagctagagccaaatccttcctacatggcctctttcttcctacatggctcaggtcagcaatcttgcctggcttaagtttgaatgccttgggccattcaggagtctccgtgtttgttttttccctgagcttcgctttccttgcttggatattttgtgagcatctgaccagtacattcagccactttaaaagaatctcccaggccttcctttgcataggggctttgtgattttttttttcctgttttgtttcaccatatgttccccttttgaatctgagtctccacaagcatcaggaaagactcggtgaaattctttctatttttgccagaaaagtcaagctaaatgcaattccatctcctaaagtcaatttgcagaaggtgtctttgaaacggcctataaaattgtgagcaaatgaagtttcatcttgctgttaacgaggttgctttgccaaacctgtcagaactggatctgacccttttgtgttatagtgtctgctccagctggggctattggctgttaatcagaagtgtttacactttttcatgctcacttgatttccactagcctgcccaacttggtattcagagtgggttcattacaaagaatattgttgcagccctgtcctgacatttcactgtcaactggcagcgatgggtcaatattgcttttgctactcctcacaaagtagaaaatatgcgatcacaccaattaggtagtttaagcaatttttttctgttcaaccttccttttagctgccaaaactggtctagaatttaaggcgaaggcaaggaattattagagaccaaacccttggcatcgggtgccaaaaagattagcctagtgaaataccaacatctttagtagaacaaagatcaaagtcaggaaccagaggaaactgtgcagctctcctacaggcacgttggtgagaaatagaataattgatctagtagaaacaggtttcaggaagtcaaagaatattattaatgatcttcaagcaagacattcaacaaaatgctctagattcttctcaataagctcttctctgtttcatggttgcaagctcatttgcaaggtagagaacagtgaagatattctagagttggtttggtttctaagagcactgaatcatttaaatgtcctgtttattaactcagctcctctctattttgttttgatttattgtttttcctgaatttttacatctgcccctaaacagccttgttagttgcatgttaggcagtataacgttggaaaatgtgtacactttggagtcagtaaaaattggattcaaattctagcttgcttattttcatgaccttgtgtggcccttaagcaagatactatattgcacttagactatttatatctgtaaatttggaataaaaaggaaaattgataacgtttagtttttatacttttaaaaacaatttaccatttgcaaagcattatactaaataccgaggttaagagaataaataagagagacccttagtatgagagctaaggaagcaaagagaggggttacatatttttcattcaagacccctgatggggttttctgatgtaagtgagatattagctgagtctcaaaaaaggaatgaggtaggtgggtaagtatgttgagggaaagcatttctggcagaaaatagtctaagaattgcatggaggcccaagaatgcatggagtctcagatgaaaggagtgaacgcttttctatagacagcaaagctataactatggagcaccaggatgtatgatgggaggtaaacggtggccaggaataagcctagagagccagctgcaggcctcttgtgcatgtcaaggagctcaggctctattcttctgcggatcatagcccatgtagcaatttaaatatggaatttggtagtcaaatgaaaatttgcatttggatggtgtctcagtctgttttgtgctgctataacaaaatacctaagactaggtaatttatgaagaacagaaatttatttttttcatagttctgtaggctggaagtccaagatcaaggctctagtatgtttggatgtctgggagggctgttctctgcttccaagatggcgcctcaatgctgcattttccagaggggtggaatgccgtgtcctcctatggcagaagggcaagagaaacaaacttcctctatcaagctcttttataaggatagctaatttcattcatgagggagaggccctcatagcctcatcacctcttaaaggctacatctctcaacactgttgcattggggattaagttacaacataaattttgcagaggatgtgaacagtcaaaccacagatggatcaattaggtagcagggtgattagggcattagaggagagaaatactggagccagggagaccgttttacagtaatctatctgggagatagattttgatgccttccttaaataaagactgtcttagaactgatagtcattttaagaatgttgtgagtggtataaataatacagcagtgcagttccatctaaaaaccaggggtcgaaaaaccttttctgtgcagggccatatagtgtatattttgagctttgaggacatgtggtctttgtcataactattcaactctgccactgtggcgtgaaagcagtcatagacaatacaaaggcaagtaaatgtggctgcgttccaataatccaaatttaaatttcacagatttttcacatgtcaagtaatattattcctcttttgatttgtttataaatatattattttattttattttattttataaagcccaggctggagtgcaatggcgcaatctctgctcactgcaacctctgcctcctgggttcaagcgattctcctgcctcagcctcctgagtagctgggattacaggcgctgctaccacgcctgactaatttttgtatttttagtggagatggggtttcaccatgttggtcaggctagtctcaaactcctgacctcaggtgatccacctgcctagacctcccaaagtgctgggataacaggtttgagccaccgcgcccggcctgtctataaatattttaaaaagcaaaaaaaaatcttagcttgataaccatatgagaataggcaatgactgcctttgtgttgcgtgctgttatcgcccctgttctaaccattgttccttttttcctgttgtctctgggaaccatgccatcccctttctatggttcctaaaggccagtatttatgtaatggataacagtcatattctcaaccttttcaaatgagttttgctttatttctgccttgtttatgaaatccttttctttcaaatagtcattaaactattttactataatttattattttccttgaagtgttgaagttttgttcttcacattgaggctctcagtcgacctggaatagagttttgaatacagtgtgaactttgaatgatttgcttcccccacacctacattgataactagcgtccccagctctatttattgaaatgaccaggttttcctcacaattccaaaatcatgcttctgcatgtggaaaatctgcatgtacatgtgaacctgattttggatgcttttttcctattgcattggtcatttgcactcttttgctagtaccatgctgtctatattattgtagctttattataaatcttgatatttgggcaagaaaacacacctaacttattttttttcaaaaagttttttgcctttttaacattttgtttttgtggtatgcataccagaattagctcatcaagttgccactaaaagctcattggattttaatcgaattgctttgacttaatagatcgatttaagtacactaaacgtctttaccattgactctttttatagataatctttgcatttattacttcatttctttggatcttctttaatcactttcaataaagctttgtaattttctccttaaaaattttgcgcattgttgttgttggtgttgttttttaactaggccacttgtttttagtttttcctttccttgacatttagaaaattacaaaatataactgtgttcatgttaggcttctgccacttactaacaatagcttgaataacatttgtggcttgtaaaatattctttgagtttcaatgtgttaaaagtctcatccctagtgagtaaattgggatttactatataacccaaagttatatagtgccaagattatgaaacaaaagatctcatgtagatgaaaattaatgcagtaaaccttttcataaaaaggacttttacatgtgggtcataaactgcttctgagtcgaatttcaaaaaaataataaaaaagcccagaaatctcattatcaaaggcagaattatctaagttgctgttttctaaggaggtagacatctggctgtattaattcagtcatttttaatgaaacagtctcttactctctataaattcagagagttaatttatgtttacttaatgtttatttgcatgcctacctacaatctattatacatgtgtctttattatctagtttgtgatcatatcataaattcaaatttctattatttatctatctggaattttgactcaactttgtagtttacacttttttttcccctgttttgaagtggttatagattttcttgcttacctgcctttgtaaacatctaatctcctgttatcttactcccttggtcaggctgtcaataatataagcttattcagttttcctctatgtatcttgacttctacttccgaagcctctaattataaactgaaggagtttgccattttatcttttttcttcctcctaatgccacataaatatgaacttttcttttttgaactattaactccttctgaggttttcagttagcatggatagcttaccaaaattgcagccatccttagaaactgctctaaccctctctcctacatattaccaatcatcattttaaaacttgtagaattatcatgatgtaaatactagtgttcttagatctttttgcatgcctatattagcacaagtgtatatattgttctggtccaattttgcttccgtcttatgcaggagtaactctaaaacctttgtattccagggccaactaaatatttgagtcctgaatagtcactgggcacatttttctgtaattttcttactttttttgacttatcttcaaataaattgatgactttatcacttctctcatgcactaagctcttgctcttctgtgaatttccctgacttgggatcagtaatcatcactgcaatttttcaaagaaattaaaggtaagggagcatcacatattagatgaaataagtgtgtacatgtgaatctatccaacatatctttcattcttcaaatgaaaatagtcacatatttataatcctaaagagaggtctaatttctaatgagcacaaatgtgtttacttgaatatatgattatttcctgaaagtctctttggttaccagaatgcttttgtaggtattatgagtaaaatagaaagccttgatttgttcaggggaatgaggcattctcgtaaatatgtatttttatacaatgtagatagctgatcatatagggtcttctaccttatctcttatgattgctaattttctcaaatgtttgtgtctgcttccccttagtatcaaagtgtgtgtgtgtgtgtgtgtgtgattcaacttacaacatatttcttttaaatgctcatttttccctctcaacattatgccagcaggggatcagtgacacctggttcagtatacacattctacccgtcaaaaataactcataagtttaataaattttgtgcataatataaacagttaaactctttctttagtaatatgcctttattaaaatcacgtatattcaacaataagttgtctcatgcttacattaatactcaaaggaattacggtgcaaatacaaaagagacgactttttttttacaatgaaaaatactctagcaaacgagatttaacacaggttactttttatgccctattttgcaggatttagtttattttcaatgttaccacttgacaaaggaatacagtacctttttgccttatgccttaggtctattggtttaaaattgctttgcacaattaaaggtgcaggttattgtcacacttaacctggaatattacctagagttggaaatactgctgcctgacataatgcaaagtatagaggatagacgggcttttcctacctattgatcagtacaaaaagacacatttatgttgacaagaaaagagtatctaatggcctttccttggatgagtcaaaacacagtgcttttgaacatgtagctcacagatcactgcttcaaaatcacctgagaagcacctttatagtgtaatttcaaggactaattccagacctgcttgataaaaatctctagggatggagactgaaaagctgatatttacaataagatgactatagggaaaccaagacatactaaaatttgaggcaaccgtctaactgaaaagaacatgtgtgacagggtggttctagtcccaaatctagctgatgacagagaccttggcccattctattatttagctttgggcctctgctttctcatccattagaccgagaattaggagtaggtaatctctaattcccttctagctctaaaattttgtagatgtagcatttttaagacagtaaagaaaaggagaataggaaaactatcaagatgggaaaactaggtagaaagtaaatttcataaaacctataaagactaaagcaaaataaaagtttaacttaaaaagttgagattattttttaaaaaaataaacgtatttagaaaccctaaaatgtgaagttaatacacacacacacacacacacacacacacacacacagtttattctcttaaaacaaaaattgacaaagcaaggaatatgtcacagaaatctacagttaaataaagaaaaaaggaaaaacagaaaggaatgacactgcaaacattaggcctgaagagagaatttttttgattcaataaagagaaaacctaaaaagaagaagctaagctttctttagagcattttacattaaagagcatatgcttttccttcttgatttaatttacatagattgttctatttttcatttttcctctcattttatgtatgtttactaagaaatttatcactttgttttcttctgaattttgaaatttggccataatttatgtcagaacctatatttccttgtcaatatttgctaggtttgcagtagtgcttgggaatgtgtgaaaggttattttttttttaagtaaaggtggcatctaagatgataagtagaaaagttcttaattaattagcttgacaatccttctcacccaccactgctagattaattttattcgaatgtgttttctttatgtaactctgctgttcaaggactaagagcctcaacttggcatttgatgctctcggtattctggcttcatttcatcaatctgaccaaatgtctccttccttatcaacttcattaccccaattctgtcagtcccatctcaataatcagctagtcagaaagcttctcaaggaacagggaacatctgatagcttctatgtatatcagttatggtttcatttcagccacctaccagaaacagcaatggcttaaacaataggtggctatttttcttccctcccagtaataagtctgaaggaatgcagttgctgtaattttatttaagcaatgaccttttcctcatgtttgaaaagtggcacttcccattatttctgagttcaaagtagaaagaacagagaagggaggaaggttgcaccatctgtgcctgtcccttctttgtggggaaggaaaagtctttaccagaagtcccctccccagatttccactgacatctcagaggccagaatcacacatagtatgtccatttctagctgcaagggaagcttggaagtgaagtggtagcttccctgcttttatagtgcaaggcaaaggagaagagtatgagggaatggacaggggtcatccatctcattgtcatttatttgcttgattacattttatgcagattatacttgtgatatgatctacacagtcatcatataaattatctcctcaatgagtttgtatacttttcaagagcagaggatagtattcccagttggtatgcttcaaagtgattagctcaaagggggctcttaataaatatttattggcatatatttaatgcacactcatctgtttggggcaatatggtttactataaggagctgaagttctggaatctaaaaaaatggaatttgagtcattaatctcctatttaatagctatatcatggtcactgacttgtcaggtaacatctcttagactcatttatttttctgtgaaatggataaagataattaaatgtactttattaggtctgtttgagacataaatgtgaagatgcgggtggaagcctattataaacaattaagcactagattggaaaagttaagcactgttcttaatataatatttttaaaattctggaagaaaaattggctaagtgacaaatttgcaagaggcagtggaagttattctcttactgttatatgacattccttttaaagtggtacagctaaaccaggaaagagactgcaattacaactaagaagctactgcattcgatttgttaggctttcacaactgcttctacaatcgctaagattaacttgccatttgttctgatattattgcagctgcaagcagcatacaaagatgtggtactttagaagaaatttagaactccagaaaatattgtctaatcagcagtcctgctcagtagcggatagagaacagagtgtaaaacatttacaattatatgtggacaatagcattcagccatatattggtattctgatttagatactcattagaaaatgtaccccaccttgtctgattacagttggatgatattgctatccttactctttcactgagctacacttaatgactagactttatttgggatatcagagagtggatattacctgagtaagggcattacttatgaaggataatggaaataattatatgtgaattcagcacccaatccacagttgcttcctctgacaccagtcagtaatctcatgcagcttaatatggttctgtggttgaggttaggtgagtaattgtcgtatcaattaagtaaattaaactaatttttttagcttttattattcagatcacttatatttgcatactacaaagaatgcaatctttcaatctgggttaccctaagtttcactatccagtggaatgacagagaaaagagaaaacagtgtcatataggtggttttgatgagccaggcctggaagtgacccatagtaaattttctagaagtcagtgtgaaattgccacttctatcttcaaggaaggctggaaaatatagttagctctgttccccagaagaaacagaaatgcattttggtgaacacaaagcaattactactacacagtgctaccatttactatctatgtattgttggacaagttgcttaaactcccagacccaattttctagtctattaaaaaaaacaacaaaaaacaccataatacttgccctattggattttgtgatgtcaataagaatgacacatttaaagaccttatccagtgcctagtacaaagtaggtattctaaaacaatattatttctgtttagtactctatggaaagaaaacacataaacatacgtgatcattattctaattacttgacaatctagttgaagagcacattatatgatggcaggaaacatgaagggatatttgatgaatgccaaaatattctcagaagataaagatcgctatgaactaggattcaattcaggagatagttgtagtaaagattttaattagcccctgatggaggggtggaaagagaatttagatatttaatacttgatatcaatcattaaggagattttctagtttgtttctttatatcagaattgcttttgtaactggctcaggactttgcagatagattatgagagtaacatgtggggaagagcaaattaagtaagtatactggattaagtcattaagtcaatggaaatgtttgaaaaacaaagttatggccaatctatcagagctgtgatgacttcctgattaagctattatttatgacttccttctttttcaattccttttgaaacttctggaaattgggatagtgaagaagggaaaagaactttgtatgaatctatacattttcacgcatgttgaaatgctaaaggtcatttttttgctatatttgtcaggatggccaggaacaaacaccaaaatctcagtagctttacacaacaaagatagtatgtccaatatggaatagcaggaaatttgctccctatcgtcactaacagaggctctaggatcatttcatgctgccatgtccacatctcaactccatgaccactgtggcagggaaagagatgaccactctgagctacctcagactggatatggcatccatcacttttgctctggggccattaatcaggatttttcacttagcccctacttgcaaagggatgaacatgtctttccttgtgcccaggatattagaagatatccaggtacagtgagcacttgaagtccctacaacatcggggtaccacttaaagatgggattttcaagatctaattgggcaaagtctaaaggtaatgagcaaattcaaagtgaccatagagcgtactttttggcaataaaaatgctatctatttgactgtctgcctatagctcaaatctgaaccagtgaaatccgtggggcaaggaactgtcctcaccagagtcttctttagaggaagtttctcacatcttctcactttacaaagtttttgatttatttgattttagtgaaatcacttacataatcccttcattttgcgtggtatcataaagaatacaaagagtacaaaaatatccatctcttaagaagtttaaaatattgcaggtagagtttatattctatgacaatttgatatcaatgcaatgtaaaatgctgtgtaaaaatgatgcaaaaagcattaaaaacaaacaaaagatgattagagatctgggcttcagagaaacagggaggttttctgagagagataacacttgagtagggccttgaaattggatgagcagtgggaaagataaatgatattttggaaagaggcaagcaatgtgtgttgggcataaatgtaggaatgatagtgacttgcaacatggaggaacctccgggccctattttcaaggatttttttttcctatattttgagagcaacttctttataaagaaatggcttttctgatgctctatctcccttcttttctttctccctgtctctgccaccctaacctctcaacttctgtgtctgtgtatcacttaccattccctttataaaatcaggagtcagcatttctaatactctgttttaagtagtaggagttccgtcccacaaatattaatgagcatcatgtatgtgcaaagcaatggaatttggggataaatacacaacagaccttgttttgaacaccttatattcagcttgaaatctttacatataaacaatagatgctaatagtgaaagagaagcagagagaggagagtttggtttttgagaccactgaggacctggccttcccaaaggggacagagaagtgttctggagaagacgctctctgaaccaattcctaaagaaagaaggagatttatccacttggaaacgagaggaggggacctctaggcagagagtatggtgtgagtaaagatatagtagtgtgaaagagattactggaagttaatttcccagagatttgatattacttgtgggtacataagaaccacataggagaagtagtcaagaacctgctgttagaaggcactgagtgccaacttaaggaacaataattttataggtaagaaagatgccatttctgtcatgtctagaaagcaggcacttttatccttaaaccttgcactatgaactggcctaggtaaacatacattctcaaatttgcctgagggagtgataatttctaaaactaggagagtgggatgtaaaaaccaaacttggcttcgtgttgccatctgccctgagatatgtgcacaactcacataatttccttacatcaaattctaccatcagacaattgtccgtattttctcaggaaaatgaattcctgtgggtccagcaaatcccataaactccagtgagtatttgaagcaagcatccaactcagactgagagtcaatgcaacatgtttcagtaaaatgtgaatccaggctcacacagattgagacatattacttgtaaatgtaaataaatataaaggtgtgcttttctattttttgacaggaaggaatatttgattcatatgtttaatatgctttgcctcttttgccgaggtacaacataaggaaatgctattcatcatacagagaaatttcagaaacaaatttcttagaaataggaacaaccgatcagagagtgaaaggcgaaaaaaagtgaatacgatttatctaagggggaaatttagttgtgttgacaattctgtgtgttcagtagtttggaggtgttaggactgagacagacgaacagaggttttgatcttattacaatatagcagctagtatgccgggtggcttaagcaacattcactccatttgtaattaacatgtattaagcatcctaaggcttggctgtaatgttggattgggtctggggcaggcagcttcttcgttggatggagctgggtgttaacatggccaagattatttgcttggcacctataaggaccaacttttactgatgatatattctagaatttctggggcatcttgattttaaacattcctctctgttattacctccagcacaactttgctgtagaattttcaatctattatatgctgtggaattctgattacttcttatatctggacggggacctgaaaaaaaaaaatctttgtcaaattatgtgttctgaattttggtttggaaattataggataaaaaatgctagaagatatagatgactcaaatatcttgaactgaactatcttacaagaaaagcccataaaacaggagctaagttcatggtatgttgatgatatcactgtataaggtaggagtgacagccttattgtctggattttaaaggatttttatcttcaaaagggtaaaataggttaaatgtactggtttctaaaagaaatattaacaaatgtttattttctttgcttttaaaataccatctaagactgggcgcggtggcttacacctgtaatcccaacattttgggatgctgaggcgggtggatcgcctgagattaggagttctagaccaacctggccaacatggcaaaaccccatctctcataaaaaaaaaaaaaaaaaaaaaaaaaaaatatatatatatatatatatatatatatatatatatatatatatatataaaattagccagatgtggtggcaggcgcctgtaatcccagctacttgggaggctaaggcaggaaaattgcttgaacctgggaggcagagtttgcagtgagccgagatgacaccattgcactccagaatgggtgagagagcgagactctgtctcaacaaaaaaaaaaaaaaaaaaaaaaaaagaaaaagaaaaagaaaaaaaaaaacacctaaaatacctttggaaatactattttctgtgggggagagttggtgtatactgggtaagactgaccataaaactaaaggttagttttattcaaggataattcaaggatagacaaactcctttccatagaaaaatatacagcagaacaatcgttgaaattgacatggacccctctacacagggaattggcagcctttctcctaaaggatcagaagtaaatattttcggctttgtgagtcatgccgctttggtgacagccctgctattactgtctgaaagcatctagacaatatgtaaatgaatgggtgtggctatgtttcaataaaatcttatttatgggcccttacatttagatttcatataattttttaagttacaaaatcttcttttgattttttttctacccatttacaaatgtaaaaaaacattatcagtgcatagctatatgaaaacaggtggtgggctagattttccccaaaggctacagtttgctgacttttaagtagtgtaaattttggctttctttctcatgttccttctgttcagttttagaattttccccttttgacagagatttaggaatgtttgttgccaaagtggttagaataaatagtggtaaaatgttgtaggtatgtttaatcagttatgttttgtttttaattctcacttttattttctccacctataaaccttcagtgacccccccctcctgacaaccacatcttgtatcagtcactgtaaacttctgctgatttcagctcacagggtgtctttcccaggtgtgtgcctataccccgcacctggaagaaaactccctccctgccatctttcctctgaatagttcttaggagttcatcaaggtcccattcagttctcacatctagtagaaatctttatagccattccctaacatactgataggtacaaatatatagttttgtacctaattttttatacactctcacacatgtttttcagtactccgagaggcagatgaattctttcattaatacattgattaatttttcagttgccccttgatacaaagcatgtgtctgagcaggtgctggtgggtaaaatgtcctgactggctgatgtatgcagagatagtcctcttccaaaaactgtaagtaaactgtcttttagatcttcatgttgggtgtctcctattagctttattgaagaattacaaacagcaacagacaataaatagttcagtaattcaaatctactttagaattcccattctgacactaactgcttgattttagaaaagttaagtaaactgtttcagcctcaattttctcatctgtataataggatcactgatttctaccttgcaaatggacagaataaattacatgatatactacatggtttataatgggtactcagaaatggtagccattattagcttacttcagtgtgctgtggggtagtatgggaatatgaagaatataaatgattacatatgtgatttagaaacacaaaaactttggcatgaagtagacaataaactagaggagaaaacagagataggttttggcattggatttttttaaataagtatatgcttttccctacaagattttattgggagttgaggcattcatccacacttctgtgggttgatgactctcctgttgatatgcttacccagaatttcactccaaactgacataccccaatacttactcaatttctcttcagatctctcgaaattaatctggtataatttgctcttatctttgcaacaagccccttcctgctctagtgtctttggctcagtcaggtgatgccaccctgcactcagttattcaatccagaaacgtggggttcttgcctcctccatcttcctcatctctccccccatcccctgccaacatgcccaattaatcacaaggttcccatcagttctcctcttaactatattcttatcattttgtggtcatcactcatacctactcttgccttctacaaaattcattgctcccactatagtcagagtggctttgattttttttttttcatttttagtacaaaactggccatatcaatctctgcttaaaacccttcactaaagtttcatggctcttaggatggagtgtaaattcttcagtttgactgagcaggcattaacatgactgaacccctgccctctcatcagcctcttcttatctcacactctgtcttgctctctggactctagacatacttgtcttattttattacttctgtttctagagccttgatggttgttcctcttgtattgtatgctctgcatttacttaaatggatttgattgtggaaattgtttttcctttagaaaatatatctcataagtatatgttggtactttaaacattttgccatttttgccttatgtaatctcttgcacagcacctgtctgaatggttgaccagctgatgactgaccacttctgtcgaagagaaactaagaatccttctgcatgtaacatattatgttattttggggtgtttcacatcaaattactcaaagttcgtcttttgctttgttgctactacaaataagtctatatctgtcaggcattttgagtgataagaagctgttcttccttctctactttggatgttatagacaggatggacatcatgctggctgccatatctctaggcaagcctcctctggaaaatgttagtgatagggatgcttcatttgcatgatttttattattttcccctaatgtatctcatgggatgatcacaacagatctgtgatatacatgaaggaggttttcttttgtcttgtttttgtttgtttgtttgtttttgtttttttcttgttttgtttttgtttttgagacagagtctctctctgtagcccaggctggagtgcattggtgctagctcagctcaccgcaagctccgcctcccgggttcacaccatcctcctgcctcagcctcccgagtagctgggactacaggcacccgccaccacgcccggctaattttttgtatttttagtagagacagggtttcaccgtgttagccaggatggtcttgatctcctgaccttgtgatccgcccgcctctgcctcccaaagtgctgggattacaggggtgagccaccacacccatcctgtcttgttttattttatgcttaggaatctatttaatttaaaaacatgtgatgtaacctgtaaggtatcttcatagagttggtatctagtagacatcaatctatggatcaaataccctgagagctggtctaacacttaaatagctgtacccctcattctttcttctctcttccgcataggaaccatgagtttcctttgttatagtggtgaacttttttgtcacatccaggtggaggaaattctgggtattcgctgagagcaaacaaacggacacacgttgggtcctatactggtggtgttatatccaacactgggaaggctatttcctcatcatgctgctttcagggcacatggaaacactagaaaagaattattagaatagagttagaattccagttaggatagaaatgttgggaagtgtgttggtgtttgtgccgggatgttaagctcagggcaaagggattccagactgttctggaatagattatttggtaccaacgctttccaaatttttttttcttgcttctctgccagccttttggaatcaaactggaagttctagtaacacttgcttctgtcgctgccaaagtccctgctggtgaaattaattccctatgtgtttaatgcatataatttaatgttaaaaataaaatggtgagtcttaattgcttaggtggacgaagtgtactaaactgtaagttactgatattataggtctctttgaaggtgaccttatcaatgtgtggccttcagtaggaactctggctacttcttccaaaagaattgagtgttattctccagagatctgaaaggaagattgcatcgtgttcattagcatcttggttttctgacagtaaagaaatactttgtagcccaatctttttagttgcacctaaaaatattaggttggtacaaaagtaatagtggtttttgcccattactttcaaagttgcttgtgacagtgttgacggctacaccaacgatttgtctaagatacgcattttatcatgcaccttgaggataataccccagccttacattccttatagaacttgaagttgtgtctcactctttctataaatgtgtcagggaaaaaatagataaaaaaggaaaattggcaagcattttccctgtcaataataaaaacaagaccagaaagatagtcccttggtgaataaaatcttgaatataaagcatgttacatctgaaaaaaaaatctcaaatttcaacagcatgatggcatatgtgtctctataatgtatcctcagctgatggtatcaggggaacatgagacatttgagaaaatagtaacataaaaacgaacattggggcatgtcatccagagtggctactgagagaatactacttgtgagcaagaagctccctctcccccttttcactccgtttttaactcagcattgaattaaaatgaaagaaagggaaatatatatattttttccttttagcagaaaatgtcatggaaatgtcagagttctaggtgattacatctctcttaaaagtcgatagctgcaaatcatggaatcccttactacattggaaaatattaattttgagtaaaagcatcattttcctgagatgtgggcaggctctgaagctttggaaaggtgcttcagaatggagtgtaacccagagccactgaattctctgaatgactgtcaggttctgatcaatttatgtcagttgcagacagatttatgtaactctttctgtcctgccctcagatcacatcctttgagtgctctgctcattcctaagtgcttctgccgtttagatttacttgtattaataattctgttttcaagattcaaagcggtgggaacagcccctttagaaaatgacattcagagatgttacatggaaagaatggggcaccttcagaagcttctaagtctttttcctggctttaggcagaactgatcttgtgtcatgcagatcagtatctagtcaggctttaaagatccttgtcagtgtcttgatctttttgtacaagccagggtcacattccattccatttgttatcagagagtttctcttcactgctgttcctcagctgcaaattcactttctatatgtagcaggatggggaatagggctcttctaatcatcaaggaagtttggttaagtacccaaaattgagaacaattaaagacaagttcttctgatgatgaataagacccctcctaggagcctgtaaagattactgaaagggcaaaagtggtcagagctgcaagtgggagtagggtagggagaagcttagaaaaagatgtaatatactgggtttttcttagtttacagaaatttatgcttatcaatgtgtatacatttatatgcagatatataaacatatatgcttataatacagaataaaatgcataaaggtgagattttatatatatatgaatgaatgaataatttcaaatttataaaacatttgcaaaggtagaacagagggtttctgtatacccctcactgaattcccatattactagcaccttacattgtcatatgtctgtcagaatcaagaaactgaaattgacactggtatattagtaataactaaactctcagcattatttggatttcactagttgttcctctttctgtttcagaattcgaactaggataacacttggcatttagttgtcatggtgttcagtctctgctggtctgtgacagtttcttttggttaattttttttttctgactttgaggaatattggctaagtatgagatctccgttttggttagacgggactatcatattttaatacctgaaagtgaatcatagttgtttatataaataagattgttcttacaattcaaagtgactagaaattcatctatgccagagatgtcttcaaggagagattgagggaaatatggtagagtatgttagcaggcaatgtttgaagaaaaatagagtatttttctttctgtaacctcactgcgcttggcccatttgacaagccaattacatttgcatttgagaggggaaaaaagactgataactattccaagtatcaatgaacaagtatttagtgtctattaaaactatatactaagaggcattcagaaacagctcatccctgaaggagtttataatctagtagaggatataaaacatgttcccatgcaattcaaaatacaaacagataaatgctaaagcaattgagaaaaaggtgttatttgccctagaatcatgaaaatagtttgagaagttaacaatagtgaaaaaggactctagacagaagttggaggtgtgggagggaagtagaatgtgattctaaacatgggagcaacagaatactgggcttatttttggaggtaaggacaatactgcagaatgagatgcataaaggtaatttgcaagagaggagacaagaaaggtaaattgagcagaggttgaattaagggctgtaaataatacgctgggctaattactttttcaatttgcaaaaactggccttaacagaattagactaggtgaatatcatggtcaaagtattatccgacgaaggtgtactgtctggcagagggatgtggtaaggcttggtgaaacagattagaggctggagagaagacattaagagggacctacacaatgtatacatgtatggaagtatcacactgtaccccataaatatgtgtgattattaagtgtctattaaaaacaaaataaaacttaaaaggcagggggatgggcaaagagatagagaatagtggagttgagggcactcactcttgagagtccttatttattgaggagatgacattatctatagaaagagggaatggggaatattgaatgcttaatgttaatggctgtgaggaatgggataggggcttcgtcatccagaacttcaatgcacacactactgaatcgcattgagaatccatttgagatgaggacacaggacattttaagagatctaagcaatgcagttctttgcctctcactctttttcaagtttttgattcccaaggtgaaccttggttcacattcccctatgaccatatcttggagacaactttttatatgtttctcttctcctaacccagatttggaagggaagaagtggatcatttgtttttattgtcttatctttgctttcttaccgttctcttacttttttttaaatatcactactgaaaaatatgagtaaaatgttttttagaacattttagaaaagaaaaaaatacaaaagtaatgctatagtttatcagtgaagcatgaagagaagcttattttgcttactatttgaggcagttctggccataggatttaatggacttcattttgaaaagctgcctgccagatcaagtaacttctcattcatttgagccatgtctatatagcctaaggcctggctcaaaggtatgacagaaacctaatatgagaaatataattttattacagtgaatccatgcagggtattggacaaggaattatacagaaatcatttcaattgctatgttaaattagaaggttgtacaaatattttacattagagaccccttagtcattaaagccacaagcttgctattactatatatttgtgagcaaatatcatcacagacctgactcacattagaagggaaattctcatcacctctgtcatcctttagaatggaaaaaaaaacttattcataaactcataaaaatcccaacagaagaaagtttaaaaaccatggaatatgacctcctggcaaatcaacaaatttgtttttaaaaaaaacaaatcatggtgactgccttaataattatgcagaataaactatttgtttctatataatcccctccatggttgaagactgtcatctttagcagcctctttatcgtatttaaccaaaaaatgtctctctctaacttcgacccattggtccctagctgtctctgggatctgtacagataaatgtaataactatccctaaaactactcatcaaatattataaaagtgcttttattcacttactgggtcatttttgcaaaccaaacaccatttcctccaacattactcaaatgacatggctttgtttttctcactgtcctggtcatcttgtgtgaaacaatgtttaatctcttaggtttcatacaggaatttaatgctcaaaaatgacacaattcttcagctgtattctaatatattttgtactataggctgtattttatcaataccacctattgctttaccttcttttcagaagcgcccccagacttttaattcagacagagctttgggtcaacaaatttcttagatagcttctatatcaactgctgtcaagacaagattctcttgattatacttgtcctattgatttttttaactctaagtttttagacttatctctgctacatttcatctttttatttttttaattgacacagagtttgcatttgtcgcccaggctggagtgcaatggcacaatcccggctcactgcaacctccgcctcccaggctcaagcaattcttgtgcctcagcctcctgagtagctgggattacgggcatgcaccgctatgcccagctattttttgcatttttagtagagacaaggtttcaccatgttggccaggctggtctcaaactcctgacctcaagtgatccacctgcctctgctacctttcaacttcttgccattgttttaatctactaagagatactcctggccattctattttgtataaatatgtttgaaaattttgtttaggaaagatatctagctagtatccctgctagatatattagatatacatcccagactgtttttccccacccactgatttgatcatattccttttgaaaacattaaacttgaacatggccaatgtcagagctctgtgccactccagtaggcaactgcttctggattggttttttggtttgttgttgtttgtctcttatttttgcccagtggtaacatttagagttcatggtgtttgaaacattttcccttgagtatgggtgatcccaataaccaatgttctttggatgcagttgttcaagttataaatccaactaattgtacttatattttaccaatattaggctataaaatcagacattgtcaaagacctttcaagattcaagatttatgtccttattatgtgtaaaatgaatgagccatcattttctgtcatattcagagtttcctaatctaatattctataaaattttaaccttacctagaataaagaatccacgtcaagaaagcaagaaatggcacatggataaattttccctacgcaaaatccagccccagtcaccctctctctgataaattgagtccattggaaaaggcaaccacctctcagtgataagcaccagtcataaattaatatctaggacttgattattaaaattactacgtactgtgctggaaggaaagattctagaaacttgatggcttagattaaattgtcactacccactagacttgaagaagccattggaaaggccattgaggccccctcgtaatttatataaaggaactgacaacctcattggttttcagatttgccagttaattaaatggctcaggcatgtcattttggaaaagctttggatttggagactgaatttacttctagttcttatctaacttagttttatgactttggacaaaatttttcacctctcaaacaatttctctccttatctgtgaagggaggaggttggacagttatgaacaaagcttgtagctccaactttctattaattgcaggaggcaggaagggagctacactaactggagagattcactagttgaaattcttggttttgctgcagaccatagcctacaattagggctttgagactctggctccataactaccaaaggatgatgtctcgaacaggtttaaattaacccatcttcaaggagttcagtaatagactctgaaccgaataaatctcttcctaagcccatttaaagttgtatatagaagagaactggcacaattatttggtgacggtcattttcttctcaaaatttttgttcttgaagtgatttggtttttactctaagtttaattgtagcttttttcttcattgtaacattttaaattactttttagttatagcaaatgtaaattggagtcatattcagttgttcctggaccctctttgcagttttccctctgtcttaagtagacgatgtcggaggaaaaaaataggtaaccataatatgtggccttattatgtacaaaatgaataagccatcatttccagtactatcataaggagctacgtgagaaacattatagtcaaggagtatacacaagcatggaatttacactggcctctgtgtatatgctgaacgctagttactgattttaaatttcaaggtaacattttctaacaagggagactttccccagaggtattgcttctgtctcccaactcttcatatttgagtgctggtcaggagaagcctgggtgaggggatggagaaatagccactctggatgaaggctgcagagccaaccttcaggactgttgtgtctgtgagtgaaatttatagggcatggctgctagccgccaaatccattgtctcacagtgtcaacattaactaccactgctttttatgtttaacttggttaatatgtttagacgctgctggggtccaaatgctgaaaattcagcaaactgaattaatcgatttttctctgacaggaatgttctgtagaaatagatattgccacaccatactgtgagctgcttaacacacacagctgaaataactgcactggtgatgaacttgaatttgaaacagggattagaactctgtgtctgaaggttgggaaaggaggtaggctatggcaaagtttgggtctcaggagggctcattagatgaagattaagtgaagaagtcttgcctttctccactgccttattccacttactcattgcacctcattcctttctacccggagcttacaacctcactctgatgtgctttctgtgcttcagggtttggccactggcagagcagatgaacaactagcaaagggactgtacttttgcaaaaaggaaattatactgcccaactcatcagcttaaagggagaaaggacactcactgtagcacacaagcttagtaaacatgttgggtctctaggtcctccttggcaattgattcccatctggacacaactcaaagtgtgaactcgaatgtttacaagtctctttgcttttggccaaggttgtcttggaactgatacttatgatacccgaggcttcctcacaacttccttttgaagaggtactgatgcttcattttatgttacttgctttgccatgaaggggaaaagcagctcatccagaatagtacacaactccagacttgctaatttttgacttagagtgaaatatacctcatttagtataaatttactttccaagttctgtttttatttactaataataagaatttatttgcattccgtgaacacactcacagagaaaagagagcgattaaaagaggatcatcgaacataaaagaaagaggtcaaaaactaggcccacatgaattttaaaatttgtcctcaagtataaataatctatagtcaggaattcacattaataatttaatttctgccaccattctgagtttttcttcattttttcctactagggaccaaaagttctctataagaatgtccaaggttctggaaatggagttatcctatttgaacacaaatactcaacagctaagaggcatagaagtttctctagaagagtacattgttctacaatcagaatgggtattggggtcatgtggaaggcctattaaatcacagatttctggcccataccccaaatattttagttcggtagtccggactgggtcccaagaatttactttgtcagcaagatcccacgtgatactcatgctgctgctccaggttccaactatgaggacaactattctattaaaagacttatcgacatcgttggcaccagcccaggggttcattcaggaccttctctttctttccatcactgcccctattctaaacacttccttcaccccaaatatttcggttcattaggcctgggtgggtcccaagaatttactctgtcagcaagatcccaggttatgctcacgccacttatccaggtttcaactatgaagacaactattctattaatagatgtatccacatggctggcaccagcctggtggttcgttcagaaccttccctttctttccctcactgccccttattctaatttcttccttcactgccacacttttgattttaggtgaccaaaaaaaatgatcatagaaggaatttttgttcatgattactctcactttcgtgcatctagcaaccttagtgacagctccatgttttaaattcacaaaggacatgtaaagaagttcaaactaaaacataggggcttattttatctaagatgcctcaaacacttgtttccacttttcttatcctctaaccagggatctgcaaactgtagcccacaggccagctgtttgtttatgtaaataaagttttattggcacacagtcacattcatgcattacttgttgcctctggctgcagcggcagagttgagtagttgcaaccaaaaaagaaaataaaaactttgaagggtatattggagttggacatgaggaagaaatactacaggacagttaaatattttcctcacatgtcatcttaagtagtaagggaagaaactccggactaagaaggaataatcagcagaacttatctttccctttaaaatggcaccattctttcatcacaataaaacgagcattaggaactgaatcaggaaaacagatgcattctcttcaaagatgtgcagctggaagaggcaggagcttggcatttgcattatcaggagatctttcttccttttttgtttctaaagtgtggggggagagagaggcatggattataattgtctatttattgctttctttgttttgttcttccaacaaggagcagacaaccatgttttcttacgtggtttaatctcattacacagtttctctctgactaaagccttaagcgaacagttcataacgggattacatagattggtttattttccacaattttctaaacaaggttattcaaggataataccttgtgtagcattttcccccttatgttctattttctttttctatctctgcatctccccctttcaacttttgcctcaccttcctttccttttcctctaaccttcattttaagataccttctataagaaaaggcaaatctctgtccctccctttccctcaggattgctttaaagcttatcataatgtcagcaaggatttgggcattaatcagcaatgcacatgtgtgtattgaatacacagggaaagaggtttatgacaagaaagccaaacaaggtttcttttgaatccgcttctttccctagaaattgtaggttacaaaagagcattggtttcatctccccaacccatgcaatggattcaacttcaagggcacataacaattttttctgtaatgaaaggaacttaacatatatccagacagtaaatcacacagataagatccctcaataaagcattttttcaaagtcactccattaaccaagtgcatcctcataaattgaaacaaaattaaattaattacaggcttgcatcctataattaaaatttcatatataaattaattcaaatataaatatccaaatatcaattaatccttctcgtctgcttttgcacccaccttcaaagagattgtgagtaaaatagtacctttttgttacatagttttactcagaatggaaagactcattaccttctaagcttcaacagttttaagataaaggctgtggaaatttagttatgggaaaatgtcttagtatcagctgggagtttatttttcgcacttaaacttctgtggggtttgttctccagagtccttttttctgttggaacaagcttgtgagtagttttcaagaatcacaagctagtgatttcagtggtattacaatcacatttgttggtttagtgatcaaaatatatgtttactaatcagttgcctgagtatcacagaatattagagctagaagtaatattggtattattaatggtattgtaggacaggaccttggaaaactgactcaattaatcaaacatatatctgttgcacttctgctatgcaatgatgactgtgctgagaggcacaggggcataggcaggcttttccatctcattaaggaggcaagacactcgtggtttaaaagcgcaactaggcagacaaagagattcacgtgcagttgcatttggcttacgcagatcgtaagccattcatagagttgcctatgaatggggatacattatgagaaatgtggcattaggtgatttggttgttgtgtaaacatcatagagtgtcctttcacaaacctggatggtacagcctactacacacctaggctgtatggtgtagcctattgttcctaggctacaaacctgtacagcttgttactgtactgaatactgtaggcaattgtaacagtggtttttgcgtatctaaacatatctaaacatagaaaaggtactgtaaaaatacatgataataatcttatgcagactccatcatttatgcagtctgtcattgacgaaaatgtcattatgtagcatataactacattatgtaaatttagagaagagagaaatgtgagatagggaatctttttgaatggtgtaaaacttaagagattctctaaattgttaggctgtgggaaagaagcataatgtaaccgccgtattgattcattcatttattcatttattcactcaacaactatgaattatcctgtccttgtattctttgttttccttctgttacaaggagacatgtgctttgctactattggggtcaatctttcatttgggaactatagtcctagaccatcttcattgactttactcctgtagttctcactccctctttcctacttcattaatgtttctctctctacttcatcattacattaacatgctttggtgttgtccaccaaagaacagacaagcaggcaaacaacctctcggctctacctgccaccacagacatctccttaatacctgctcctattcacagcaaagcatcttgaaagagctgagctgtgttcacagtctctatttcttcatttcccattcactctgagcccctctgatcagattttcacctccatcacttcatcgccaatgacttctgcatgctaaatgccaatgtcagttctcaggtcctgcctcatgtccaaacatgttttaatgcaggggattacattcttgtgggaaatctttctttggtgcttccctcctgtctctcaactcatcagcggctcctgttctattttctttgctggttcttttccttacacctaactcactcttcaatgtttgctgtaaacagagctggctctgggtcctcttcttttctcaatgtacatactctctctaaatgatattcatgacattacatgtcatttagaagctctaatgacaaccagcatgtttctctccagtcctgccctcatcccacatgtttgaagttatccaactacctacttgatatctctgcatggatgcctagtaaacatctcaagctctatccagagcacaattctttatttctcctcacaattttttcttcctccaggtgccatatagatggaaaaccataaaaaacttttgcttcctccttgacttgtgtcttccacacattcaattcacaagcatatcctcccagccctacttccaaaatagatctccagtctaactttctctattttatgcctagcctgacccaagctcttaattgttctcctggaatattataatagccttgccaattagtctctctgcttttttttttctgccctactgtagtcattcctaatatacaaaaaccagagtgatctttctaaaacctcaattaggttgtccctttcttaaaacttttcagtctctctccactgcacatgatagctaaagtcctagccaaagtctccaagtccctataggatctggcactcaccttgtaccttcccagaaaaatacagttagccctccgtatcatgggtttcacatccgtagatttaaccaacagtaaatttgaaacaaaaaaattccaaaaaacaaatctgaatttctcacatgctgcgtactatgttgagtctgtgtgaatgaagtaatgtgtaggtcttgtattaggtattatataatctagagaggatttaaagtatatgggagaaagtatgtagttagatgcatatatgatactattttttgtaaggacaaaaaatgtgagcatctgtggattttggaatccatggagggttccttggtatcatggaatctccagggatactaagggacagttgtactagccatttatttctcagtccatccctctcacactaccctcttctctgttcctctgacatatcaggctgttctttatttcagggttatgatcttgttgggacctcttttcatatgcctccctataagtaagttcctattttacatcttacttctgcagagagatgtcctcaagtagagccccagttattctttattgcacaaccctatacatccttcatagcacttttcctcctttgcagttacttcatatttttatttgactattgatcatctcctcccttcagaattaaggtctacaaaggtaaagacttggtctgttttggtcactgctgtattctgagcccctataacagtgcctgggtgagttgggtggtcagttaatactagggatgagtaaggttcctgtgcactgttagggatgtggagattcacaagacatcaacactgccttcaagttgcagacaatcacaaagggctaaaccattctccttaggccttgtttcttaaatgcaaaatgagaatagtgtgattttatgatgcgttgtatataaagagaggaagcaactaaaattattttgttttataagattaggttgttcagttgagcttccccatgttatctctgcagagaacaacttctttctgtagagaaaacaaaacaaacaaacaacagcaacaacaaaacattccacttgttgcttcttgaaggacagggaggtaaagcaaatgagacaactctcgctttggagtgaacagaggtggtcttcacaggcaagtgtggtcttcaaacagatttctacttttcttgcttgtgagccagagtttggaagtgtacctggtcatttgcttggtgttaccattccacataatgctctttctctctctctctagtttcattttgactggagagtgtctgcaatgtcacttcctgcttttccccacattttggtggccttcctggtgtcctgtatgttcatgattctttctagccctctctttttctttcagaaaactctgaggttctgtaaaatttgatgactctgccttgtaaagtatttgatgtgcttttatgactttctgggaaaaagtattttcctttaccctttccaattctcattctctatttccacatttgagatggcatcaactgtgaaaatggttcacatcttcccttttgctgtgaatttttcctaaattagagcatttcatgaccttgaaagacttttttttcatcaaagagcagaatcttcaaaactgtttgcctttttctcatagaaaatttatcatacttggaaacattctgttatgattaaattttcaaacataattatgaccattgtcaagaaaagattctgcaaaccactcacatccaagagacttagcatccaatgtgtctttcactgtatgcaaagtgttattttaaacatgtcattgctttcctgggtatattctgatatatagtatttgtttttcaataaacttggcagctggctgcaaatatgtgcctgttacaaacttgccttcatctgtgtgtacagccattcatccagtcatttaattccacagatttctgttaataactctgggcttgtaggtcaattataggcagtgaatgtggctttcttccaagttataaccactccctacccacacccctacctccaattcataaatggaagctccagagccctgggagaacagaggcctgcaaggaaaggaagtgtcctggcagttttgcaggtagcagcatgagtagggaggcaaccctagtgtataatggactcctgctggtgttattctttggaagagctggcctgagctagaacttctgtctcagattcagagtcacttcaccacatcacgtccctgaagctgcaagtgttattaacattaacctaagttgggcatctgtgcaaacttgttgccaggtgcttgttgtgtaccaatgatgacacaccggcaatctttgaccacccaaatgctgggaaaggatttgttacactctctgaagccattttcttagcggtgcatggctgaaatagtagatttaaattggtgcagccgtgaggatattactatgagacagaggagatctaggggaatgtctactcactttcaaaattattctgtcttttcaagaactggaagaaatttgaattaatcaggcttttcaagaatctcacggaagagcaataaataatctaccatttgcccatccgtatgttaggttcagtgtttttattttcttctggctcttttcttataatgatgaactttatatctgttgcataattctttattacaaaagacaaaaacttctacccacccacctccacctcttttggtttggccaaacaagtttctgacactgctgctggtattttttcattttttaagctgagaaaacaatgactagatccctatggaaatgtgggcattactaagtcttagttagttagaaccttactcagatactggagggtggattagggggagcaactagcaagtgttgtgagaggagaccacatgtaaaatatttctaatttaacaagtaagagagggccgagcatggtggctcatgcttataagcctagaactttgggaggctgaagcgggtagatcacctgaggtcaggagtttgagaccagcctgcccaatatggtgaaaccctgtctctaataaaaatacaaaaattagtccgggcgcggtggctcacgcctgtaatcccagcactttgggaggccgaggcgggcagatcacgaggtcaggcgatcgagaccatcctgactaacacagtgaaaccccgtctctactaaaaacacaaaaaattagctgggcgtgctggcgggtacctgtagtcccagctgctcgggaggctgaggcaggagaatggcgtgaaaccgggaggcggagcttgcagtgagcggagatggcgccactgcactccagcctgggcgacagagcaagactccgtctcaaaaaaaaaaaaaaaaaaaaaaaaaaattagccagacatggtggcaggcacctataatcccagctactcaggaggttgaggcaggagaacccaggaagtagaggttgagctgagatcatgccactgcactccagcctgggcaacagagcaagactccatctaaaagaaaaaaagtaagaaaggatactttaataaaacctttgcaagaataaaaacaacattcctatccaaatatacctttagaaatctgttagaaatgtgtcagtcgtgattgaaagaagatatatagtgagtgtttgggaactccaggggttcatcctataaaatgcttacacagtgagacagagaagggctatgaattctggggatcgaattccttacagcctgaatgatctaaatgtgaggtattatgaagaaaaagctcagtctttttaattagattctgagctatgctatcttaagcatctgacttcattttactgagtgtctgtttccttattcgtaagtaggaataacaatagtattgataggaattttagttaagataatgcttataaatttaagaagcatagtgcctggcacatagtaagatacatggtaaatgccagaaatccaagaaatgaagtcccatgcaaagctgcttagcccaaacaaaggtgatgtttactagcttctggacagacctttatgacggtgagatttttttttttttacaaatcttgcagaacacttgcactttcacctgcttagttaattcttatcatatctctagaaagaagcaatgagaagctaagacttggatcagaagatgatgatattgcaagaggttacacttaaacattactcctttgattcatgtgggcctactaccttgtacacagcaagtcatccacacatgactttaaaaagctgttgtttatgtagtgttccaggtgccctttgagaggaatcctcttaccaatattctagaaatacacacctcgagtactatgcccttagtatgccatggctagctgtccattttcaatcaatcccagtgctgcaccctggggaatagactctcacagcaaaacttttctcctggcacctctagcatcttaggtcatcagccatcagcacctattcggaggcctacttttctacacaagttttggccggaggggagcaagtgagcattatactttttctaataaaatcctttaaaaataaatccattcatgtttgggacacttttttctacctgtcatttatggttgctaatgtgtagttgttatttaattgcatgtttatgttaaacattccccatgccaacatgatagccgcaggcttgactaataaaaagagagagaaagaaaaaaaaataaaaaacagaaaaagcttagaggaaagatgcatgagtaaatggaaataaaatgggatatttcaataggaggtctccaaaattgatagtttctaggaaaacgcatcaccttgcactgccagtggttctttcttagcttccaactaatttatactctagtaaggtactgtccttttcttcacccagccttgctaatttaaagaatcttaactggggggaaaatgctaatcttattttgggcctacccattttcccaatctcagtttgatgtcttcctcggaatcggaaggcttccctggagcttggtgtgctgggcttgtctgtgctgtggctttcagtctcaggccaggttttacaaattttgtcgcattggtctggaaaagaggtagggtggttgacttgttttttaactcaatgcaaattaatttatgctttgaaatttgctgatcttctcacctcaattgggaaaatgtctgactatattgattggccaaatgaaggactcaaggactcaaggaggtcgagttcattttagaggcttcttaaattgtcctaaattatcccactttggaaagcgcagtcttgtgacagtggcattaaggtaaagaaaaacagcctctgctccagctctgattaggccctgtctccttccagagtctttctctccaatccaaagccttcgcatgtacaatttcccctggaaaaatctccttcacaacctcttccaagtgactcccattcatctttctgatgtcaacttcagcatcattccttcagagaacttccccaaattcctagtttctgctagcaattatcaatccttgttctagagctctgttcctttgagaataaattactcaattggtaagtaaatattcataaatattatgaatgaatgagttaggaatgaagtataataatgaataattcattcctatttcttcaactacagcgtaagttccaaggaaatagggactatgtcaatttttgctcattgttctatcctcagttgttaacacaatacttggcacatagtaagcaattaaaaaatctgttgaataaatgatcccaatgttcaacatgtacatagcccactggataatttagtgaaatttgacttgcatgcgtaataaagcaccagagagaatctggtccccactgggataccagcaaaatttctgttttgccatttgggaaacaccttgacatccaacaattcaaagtcaaaattcctgttccacgcaggtagctgagtaaatttaaggtcaactaaaactggactcactagtcatttcattcttggttgctcttttctcctgttatccttcttaatggatatatcctgccttctcatgacttcaaatttctgcattctgatcatgagcattcctgtggtttcacgctcctatttgttcttctgctaatgatccttataactgttttctgcttatttttatagattgcttgatcttctttactaggttgtttatatttctaaaagcatctgattgattgcacttctccttgcatccctgctaaacttaatgctttctattgcccttttcatttctaaagtttaactgagatgaatttcaatttcactttcaggaacggtttgcaaactgtggagttttctttatttctgaccaggctgttccccagggataattttaatttttcaaataattagaaattagtaacctttctgtcagtaaaaataaataaataaatcaatgaaaagcattctggacataaagacctaaaatttcatgtcatcctcagtttgttcattctttctctttcttcctttcctttcctgtcctgtcctgtcctgtcctgtcctgtcctgtcctgtccttcaattgaaggtctgtctatctaaacacattttgagagcttatcttatttggggctcatcagcaggatccattcattctgtttatcctcaaaatctagatgattttctcttctggtcctttgcaggaataaccagcaacaattggcaagagggctggttgtggcagtaggaggtacgctggcactgaagatgcccaagttcttctttttatttctttctggaggaaagccagtgccattgttggcagatcctgggctgaaaataaggagttgtcaccttacctctgccctaattagttgtgtagcctcagtcaaatcaattcccctttatgcactttaattctgcccatctatacaatgatggaggctaaattaaattaattcaaagaccccacaatgccaaagattccaagaaaattgatgaacttttgatttttaaaaaatcaaatgaacctcaatttgcaacaatattcagtggtttcactgtcaaattgtagtttctaaagaagaagtctaggtttagcccaacctagagtttggctgttttcccacatgactcctgagaatggaatagcctctgactctcctccaaacactgtaacagagacaggagtgccagatatgttagaaggtataagcataaaacaataagtcaatgacactgaaaacatataaggcactaggtaacaccaaactgagaacaggagagagataagagagtgctgtaacgctagcacagcccctgattctcaggaggaattgtctgtgaaaggacagactgagctatggagggacacacagcaaccctgctcatggcaggtggatggcgtagcactcctttgccagacatgacattcagggagatgcaataggagtatatggaggatatctttgttgggaggagtcactctcttcagcattaaacatctcattaagtgacttcctcaatttcagtgatgtccagaagctttcagagataatctgagcagtcagtgaactgatgtgtctgccaaggcatgaatagcatagattgttcagtgtttgccctgggtctatcagcagtaataaattttaatcggttaggcactttttaagcatgctactgtttgccaaacattatttttggcaggcatctgtaacaaaacctaatgcattatgcatattatttctatggtatttcattgtattagcacatgtagtatttgtatggaatttttgtaaattcattaccaaagtagtatcacattaattattctggtttaaaaagtattaggaaaaaaataatcctggggagcatacatcatatcatggggaagtgggaatgatctattgtcatttaaattgtggaaaaatattagcatgtatacgagaaaaataacttataaaagtacacagcaagtgtggaaaaagtgaattattaaatacattggtgtttccttaaatactgaatgcctaatttcagaattctaatgacaatcattattacagattttactgattggttttatttaacagtataacttagtggtagagacccataagacttatttcatttctctgtgtcgtatttctttggtatcttgatctgctaaatcatactttctcactctttttcccccttctgtttctgtccatctctgaggtgcagaggtcctgggcctttgaactttgtataactctttcttcttaaatccctagtatagggaaactataccatagtaaaattatctatcttggctggaaactactccaataattcagttctccactgaagtgtaagatttagctctattaagtgtctcttagtatcactcttctattcttataagatagggtcatgaaaattagtagtaaattattttctctaccctactggagattatattatttccagtggtttctagaaccttgatttgtcttgttcttccaaatttgacaaataatgtctagggcactcttccctttagaaactattttacaacacagtagtttatcattgtcaggaaatgttatagctattcttcttttcacaggttttgattcagataacacctctctccaagaaactcaaaaatctctgcaaatattgctttccatagcttcacaacagtcctttgatgcagggcaattctttctcactgctactaaaaaaatgaacaacctttgccctacgcaacactgtgctaggcaacaagtgactgaaataaatgctcaatttaccttttagaaatataaacccaaaggcatcatatttgaatagtcaggaaaataaaatacacctactgtattacatagtattaaaaaactgattatatattatttgaattacatgaaattatattatttaaattagaaggaaaaacgtatttttttaaagcagagacttaatacatttatcaggataatgacaatttataaggctaatggctattacacttataaattcagttatccatattccatagaacataagaatcgagtctttatttcattccattcagagctgcacagctagtgcaaacttttcttcaatatttctacataaatcctccttcctgactcacgttccattctgactatgaaaaatcaataagaccttgaccttgttgctttcatgtttcatgcactaattcataactagaattaaactccccccaaaaaagtcaatcaccgtgaacgggagccaggactagaatgcacctctagacagagcagccggcagcggctcgcattgtgaattttagctccagattgactacaagagcaaactaacaatcccaagaggacacacagaccctctgacggaagtggactgctcctgcaggacctgggagacaccgcaaatactgtgagcgccccaactgcggaagcgggaaaaggagaccctcctctcctgaacacacccccctaactggagaagctgaagttctgtttgcctgagaaatttctgactttacctggagctgagtcaattaggagagccaagggaaatacagaggtagaggaagcagcagcaaggccctgggagcccgctgggttctggagcaggccattcctgcttggcaccacagggatccaacgagagaggaccaggggctaaaactacacggggagaagcaaatctctagatgaactttgtaaaaatttgaacggggtgagaagcctcctggacagaacttgggggagggcacgaattggggatacagactccacaggcaggggaaaaccaagccctttactttagcagctgggaggcggatagcctggggcaggttttcaagcccatattgctctctgcctgggaaaggtctgggggctgttggggcagacacagtggaagtgagaccagccctttggtttgcgtccagagctgggtgaggcctatgactgccagctttcccccacttccctgacaacctgcatgactcagcaaaagcagctgcataatcctcctaggtatacaactccagtatacaactcccatctcccacagcagcaagacccaccccagagagtctgaactcagacacgcctagactcacccccacctgatgatccttccctatccaccctgatagcggaagacaaagggcatataatcttgggagttctagggccccgcccaaccactggtccctctccatgctacttacagctgattctttctggaaagcgccacctcctggcaggaggccaaccaacacaaaaatagagcattaaaccaccaaagctaagaactctcactgagtcctgcacccccgccacctccaccggaacaggcactggttccatggctgagagacccatagacggttcacatcacaggactctgtgcagacaacccccagtaccagcctggagccaggtagatttgttgggtggctagacccagaagagagagagcaatcactacattttggctcacaggaagccacatccataggaaaagggggaaagtaatacatcaaaggaacaccccatgggacaaaagaatctgaacaacagacttcagccctagaccttccctctgacagagcatacccaaatcaaaaggaaccagaaacccaaccctggtaatatgacaaaacaaggctcttctacaccaccaaaaaatcacactagttcaccagcaatggatccaaaccaagaagaaattcctgattgacagagaattcaagaggttagttattaagctaatcagggagggactagagaaagacaaagccaaatgcaaggaaatccaaaatatgataccagaagtgaagggagaaatattcaaggaaatagatagcctaaagaaaaaaaaataaagaatttaggaaactttggaggcgcttttggaaatgtgaaatgctctggaaagtctcagcaatagaattgtacaagtagaacaaagaaattcagagctcaaagacacgatcttcgaattagcccaatccaacaaaggcaaagaaaaaagagtaagaaaatatgaacaaagcctccaagacgtctgggattacgtgaaacaacccaaactaagaataatctgtgttcctgaggaagaagagaattctaaaagcttggaaaacatatttgggggaataatagaggaaaacttccccagccttgctagaaacctagacatttaaatacaagaagcacaaagaacacccgagaaattcatagcaaaaagatctttgcctaggcacattgtcattgggttatccaaagttaagatgaaggaaagaatcttaagagctgtgagacagaagcaccaggtaacctataaaggaaaacctatcatattaacagcagatttctcagcagaaaccctacaagctggaagggattggggccctatcttcagcctcctcaaacaaaacaattatcaggcaaacattttgtatacaatgaaactaagcatcatatatgaaggaaagatacagtctttttcagacaaacaaatgctgggagaatttgccattaccaagccaccactacaagaactgctaaaaggagctctaaatcttgaaacaaatcctggaaacacatccaaacagaacctctttaaagcataaatcacacaggacctataaaacaaaaataccagttaaaaagcaaaaacaaaaaacaaaaaaaaacaaagcacacaggcaacaaagagcatgatgaatgcaatggtacctcacatttcaatagtaacattgaatgtaaatggcttaaatgctccacttaaaagatacagaaccacagaatggataagaactcacaaactaaccatttgctgccttcaggaaactcacctagcacataaggactcacataaacttaaagggatggaaaaggcattttgtgcaaatgaacaccaaaagcgagctatttttatatcagacaaaacaaactttaaagcaacagcagttaaaagagacaacgagggacattatataatggtaaaaggccttgtccaacaggaaaatttcacaattctaaacatatatgcacctaacacactggagctcccacatttataaaacaattactaattgttttagtaatgagatagacagaaatgagatagaaatgagatagacagcaacacagtaatagtcagggacttcaatactccaccaactgcactagacaggtcatcaagacaaaaagtgaacaaagaaacaatggatttaaactataccttggaacaaatgaacttaacagatgtatacagaacattcatccaagaaccacagaatacacgttctatttaacaatgcatggaactttctccaagatagaccatatgacaggccattctctctcagaccacagtggaataaaactgaaaatcaactccaaaaggaaccttcaaaaccatgcatatacatggaaattaaataatctgctcctgaatgagcattgggtcaaaaacaaaatcaagatggaaatttaaaaattctttgaactgaatgacagtaatgacacaacctaccaaaatctctgtgatacagcaaaggcgatgctaagaggaaattccatagccctaaatacctacatcagaaagactgaaagagcacaaacagacaatctaaggtcacacctcaaggagctagaagaacaagaacaaatccaacccaaatcaagcagaagagaggaaataaccaagatcagagcagatttaaatgaaattgaaacaaacaaacaaacaaaaaataaatgaaacaaaaagctggttccttgaaaagtaagtaaaactgatagaccgttggcaagactaaccaagaaaaaaagagacaaaatccaaataacctcactgagaaataaaacaggagatattacaactgacagcactgaaatacaagagatcattcaaggctactatgaacacctttatgcacataaactagaaaacctaaaagagatggataaattcctggaaaaatataaccctcctagcttaaaccaggaagaattagataccctgaacagagcaataacaagcagtgagactgaacagaccaataacaacagcaagactgaacagatcaataacgagcagcaagactgaaattataatttaaaaattaccatgaaaaaaaagttcaggaccagatggattcacaccagaatcctacgagacgttcaaagaagaattggtacctattcttgtgacactattccacaagatagagaaagaagaaaccctccctaattcattctatgaagccagcatcaccctaataccaaaaccaggaaagggcgtaaccaaaaaagaaaactacagactgatatccttgatgcacatagatgctaaaatccttgacaaaatacttgctaactgaatccaacaacatatcaagaagatattccaccatgataaagtgggtttcataccagggatgcagggatggtttaacatacacaagtccatgtgatacacctcataaacagaattaaaaacaaaaatcacatgatcatttcaatagatgcagaaaaagcatttgacaaaatccagcattgccttatgattaaactctcagcaaaattggcatacaagggacatatcttaatgtaataaaagccatcaatgacaaactcccagccaacataatactgaattgggaaaagttgaaagcattccctctgagaactggaacaagacaaggatacccactctcatgacccctcttcaacatagtattggaattcctagccagaacaatcagacaagagaaagaaatgaagggcatccaaattggtaaagaggaagttgaactgtcactgtttgctgatgatacgattgtttaaattgaaaaccctaagacctcctccagaaagctcttagaactgataaaagaattcagcaaagtttccagatgtaagattaatgtacacaaattagtagctcttctatataccaacagcaaccaagtggagaatcaaatcaagaactcaaccctttttacaatagctgcaaaaaaaagaaaaaaaaaacttaggaatatacctaaccaaggagttgaaagacctctacaaggaaaactacaaaatactgctgaaataaatcatagatcacacaaacaaatggaaacacatcaaatgttcatggatgggtagaatcaatattatgaaaaatgaccatactgccaaaaggaatctacaaattcaatataatccccatcaaaataccaccatcattcttcatagaattagaaaaaacaattctaaaattcatatggaaccaaaaaagagcccacatagccaaagcaacactaaacaaaaagaacaaaactggagacatcacactacctgatttcaaactatacaataaggccatagtcaccaaaacagcatggtactggcataaaaataggcacatagaccaatggaacagaatagaaaagccagaaattgaaccaaatacttacagccaactgatctttgacaaagcaaacaaaaacatgaagtggggaagggacgcccttttcaacaaatggtgctgggataattggctagccacatgtaggagaataaaactggatcctcatctctcaccttacataaaaatcaactcaagatggattaagaacttaaacctaagacctgaaactaaaaattctataagacaacattggaaaaccccttctagacattagcttaggcaaggatttcataaccaagaacccaaaagcaattcaataaaaacaaagataaatagctgggacctaattaaactaaagagtttttgcacggcaaaaggaacaatcagcagagtaaacagacaatccacagagtgggagaaaatcttcactatctatacatctgacaaaggactaacatccagaatctacaatgaactcaaacaaatctgtaagaaaaaaacaaacaatctcatcaaaaagtgggttaaagacatgaatagataattctcaaaagaagatatataaatggctaacaaacatatgaaaaaaaggctcactgtcactaatgatcagggaaatgcaaatcaaaaccacaatgcaataccaccttattcctgcaagaatggccataatcaaaaaataaaaaaaacagtagatggtggtgtggatgtggtgaacgggaatacttctacactgctggtgggaatgtaaactagcacagccgccatggaaaacagtgtggaggttccttaaagaactaaaagtagaactaccatttgatccagcaatcccactactgggtatctacctagaggaaaagaagtcatgattcgaaaaagatacttaaacatgcatgtttatagcagcatacttcacaattgcaaaatcatggaaccaacccaaatgcccatccatcaacaagtggataaagaaactgtggtgtgtgtgtgtatatatatatatatatatatatatatatatactgtggtgtgtgtgtgtatatatatatatatatacacacacacacacacactcacacacacatacacacatatacgatggaatactatgcagccataaaaaggaatgaattaacagcgtttgcggtgacctggatgagattggagactattattttaagtgaagtaactcagaaatggaaaaccaaacatcatacgttctcactcatatgtgcgagctaggctgtgaggatgcaaaggcataagaatgatgcaatgggctttggggaattcgggggaagagtgggaggggggcaagggatagaagactaaaaatatggtgcagtgtatactgctcgggtgatgggtgtaccaaaatctcacaaatcaccagtaaagaacttactcatgtaaccaaacaccacctgttccccaataacctatggaaataaaaatgttgtttttaaaaattaaacttgctctgggcaaagacaattgctgtcttaagattttttccccaaaactaaaaacaatatgctgtgtacaaatatggcactcaggaaatattttttgctcatgatgttcttaatatttttttttacttgaaaatgaaaaaaaaatcttcaattttaatttaatttttttatttttatttttagagataaagtctcactctgttgctcaggctggagtgcaatggcacaatcatagctcactgcaaccttaatctcctgggttgaggcaatcatcccacctcagcctcccacctagttgcgactatgggtttgggccatcacacccagctagtttttcaatattttgtagagatgaggtcttgctatgttacccagtctggtcttgaactcctggtctcaagccttggtctcccaaagtgctgggattacaggcatgagacgttgcacctagccctaataagatttttgaggaagagctttccttaaactattttcctttgaggaaagttagattgttcagtcagaaattgaaaatggccacctatccaaacctctcaaattagtgtgttttataaatatctgaaggaaactttaatgccaagagaaaagaagaatgttctatagttaaaaagcttcaaaaaagggagaaaaatcaatgtctccagaccatttgacatagtctcagtgtttggttgtaatttaagaaagattgaatgcttaagttcagaaggttcagacaagaagattttctacctgccacattttcaagctgttgacctagtttccacaggtgtactgggatgcttcatcactgaccatcagaaggaaattttcatggttaagtcagaaaataccatgcttacattctccctggttctttgagaaaagatgggttgaagaaattagggaatatttgggaaatatgaagttgatggtaattggccatccttcgcaatgctcattaaaaccagcccacatgatttttgctcttctaaaatttttcctttcctcctgaaactatattttctaaaatcctactcatcagctaattatggtcccaagctcccaatccccctacagaaagaatgtccactgcttaggaactgattggttatttggagatagaagaaaataggattgaaaggaccagtctgtgccatggcccacattccacactattttctccttgtgaagttgaaactggatctaaccatttggaaattatttacctaccctctctcccatcaagagggaggcagaaaaacaaatggggtcatgagtgccaagaacttgtaggcaaagaggagaagaagaagccctccttgccaggataaaatgaccaacatttccatcttgtttgtcctgacaagtatagagtaccttacaacttttggcccttgctgtgccaaaacagagaaaataatgcagaagaaattaatagtcaagaacagtattttggttttttttttcttcctcttcaaaagtctatgcttttttgatcatatcagaggaaaggagtgaagatggaaggagtccatatgaaatccatataaggaattaagtcataatgacatagtgtattgtgtgtttcccaggaagccatttgctcaaggatttattaggatttactgtgtctgtttgggctgtggtatggggaaaatgtgttatacagccaaaacagatgagcatcaccagacccccttgggctgcatcaatatcaattcctggaacttgaatgtacagttagaggcagtgaactagttaagtggtcaagcccattaaaagttagtgtgtagaggctgggtgtgatggctcacgcctgtaatcccagcattctgggaggccaaggcgggtggatcatgaggtcaggagatcgagaccatcctggctaacacggtgaaaccccgtctctactaaaaaatacaaaacattagctgggcctggtggcaggagcctgtagtcccagctactagggaggctgaggcaggagaatggcatgaacctgggaggcggagcttgcggtgaaccgagattgcgccaccgtactccagcctgggcgacagagtcagactccgtctcaaaaaaaaaaaaaaaaaattagtgtgtagagtcagatgtggtggctccagcctataattccagttagttgggagactgaggtgggaggatcacttgagcccaagagtttgaggctgcagtgagctatcattgtaccactgtgtgacagagtgagatcccatttaagaaagaaagagagaaagagagaaggaagaaaggaaagaaggaaagaaggaaagaaggaaggaaggaagggagggagggagggagggagggagggaaggagggagggaaggaaggagaaaaaatagaaaaacaatttgcttgaggaagttgcttgatagactactctaaaaagtatattcattagcattgaccccatatatagcagatttgagtaggaggcagctttttctttgaatactggtttatctcttctatttagggaagaaaagggggaagtgtgtttttgttgctgttgtttgttcatttgtttttgtaagaagcggatttccccattgattttgcatttacattgagttttcttgagacattgtatttgagttttgctttccattgtatgtagatgagatctgccttgatcagcttttgagtaagattcaagtgggcactggtgtgatgaaaaacagagtattataaccttgagtagttcatcgcagctagtaagactggaaaatgcaaatggcttagattacaccgagaaaattcacaatagctctcagccttaaagagaaatggaaggttctaaggcagttaaattttatactttcattgacataaaccacctaactagctgttctgctttcatgccaaattttggctctctaatatttgtattatgtagaagggtactgtaaaatcttttagttatctctcaaaaatggcatgagataactggatattattactagatctgaaaattttaaaaaacagcaaagatacaaacaaaagaaatagaaagtcttggagtaaaagcttgtcctcaagagataacatttttacctggcatcatttcaaaggaagtgaaaggaatatcccaggtgcattgtggacatcataaagaataaaaacaaaagctcgttggtgtgaatttaaaaataaaaaaaaattattgacttctatcttaagtatacatctaccatgcagcccgttcagatgtagcagagagtttggtgagttctagacatggaatgagctctaacaaggaaaacttacctaaatttattaatcttagctgaaatagcaacacttttaaaatatgaaagacttggctgtatcagacttttctgtatcttaattagtttaagagcttcagctttcacaggggtgttattctcaaagcatttgcatttggaggttaggtgcttacaattttggaattactttcagatttttgcaagctacaaaggaaaaaaggaaagcattactttagagccatgattttgctttagtttgcatgatgacatactggagaggaggaaggggttagattcagacagctgttgggttgatctgccagggactaacttgtctggcctttggtgagttgctgatctctctgagtctcagtttcctgactgggcacggagtaaccctgcatgcattgttttatcccaagactgcaataataaatgcgctttctaatcatcctgaagtcccctttgaagttttcaagaaattataagcttaatttctacattttacatgtatgcattttgtaaaaacatgcttacaagagaacatgcttctctactcccaacacaatgtgtggtgtttttttccccacaccaagtaattctccaattctctgtggacaccagttgggcatcccacaattcaattcaattctgacactaatacctggatttagcacagatcccacagggtaagggtttggtcccacaagactgcctgttacttcagatgctaagtccaggccccctgtacttctgatcacccagctatcgattgggggttcccacaacccctatcctaggttcaataatttgccagcactgctcacaaaacttagggaaagatttacttatgtttgctggtgtatgataaagaacattataaaagataaagatgaatattcagataaagaggtacataggacagggtctggaaggatcccaagcacaggaacttctgtttctgtggagaaggggtgcaccagcctccagtacatggagacattcactaaccaggatgctcatcaaacctagttattcaaaagtaactaaagagcttaatctcgagctccctctcttttcctggaatcactgggtggagctgaaagttctaaccttgtaatcacttggtctttttgacgaccatcctaagtctatttaggaggcccactccaagacacttcgatagcatgaaatcaggtgtgatggaaaggggcttataatgaataacaaaagacagtcctttcactcaggaaattccatgggttttatgagttctgtgccaagaaccagggacaaagcccaaatacatgttctttaacaccacagtgttattctacatgtagtcaatagtagaaactctcagtattgaccttctcatctgaacatgccagacagtaaaggggttgtcatccacggtaaggccagacactgttttcttctttacatttctgtctcttgggaatgttgactttggtcctcactcctttaggcttatagctctcagctgcacctttccagccctttgcactggactaacacttctgtgtattgggttttccttcctcctacccaacttgaagcctgattacttctattcaaaaactacagtatggaggacaggtagtcctgtcttgccatctggtgataatggaggctcactggtgttactgatctgacctactgcagcaagttcaggttttgcaggcaggctcaatggaggagaggtagactgcactgaaatcctttgagtaagtctggaatcccatgctaggtgggccccttccactcccattccatcatcaacacttgcaacagccacttggaaacaccgtaggtctggttcaattcgcttagtactaaactttcttctgacccatacaaaaatgctaaaaatataaacatcaattaaagactctcctgtttttcaggtgttgtcagttcagggggaaaggtacttcttgatgataagactttgtaatgttttctaaagtagttttagtcactaacttattcagtgaagactgatcaaactactgctacgttcaagggatcttgctatgtattagcagggaatctggggagtagagtgtgtgctgggaaaagggggaacacggcaaacatggcttgtaagagctaataaatacaagaaaaactggaataaatgttagaaatctgataaagagagaattgattttgatgcaaaagattctaaaaaaatgtttatggatgtgctggcccttagggctgaatcttgaattatgagtaggaacgagatgttcaaagggaagagaaaagcattccagcttaagtgaaatatgtgagaagtttaaaagcaagaacatctggggtgttacttagatattgaggaagctagtggtgtactggaaccagctcctatcagttcacaagacttaacagtgcacctctcttctggcttggcattcagtgacagcactttggtagcttgaaaacagacttggtggagtatttacaccacagaaattgccaaatactgcaaatcagggcttcccctcaacgtgagaaccagttgttaaacacaagcacaggcttggctagagtgcccttttcctcaaagaatctcttagataagactgttctttctgccatttatgaaatgggcacactttggtttggttagtatagatgatttgcaaagtatcgcgtaactatgtgtggaagcagaccgaaagcacatgtaaatatcattctgtaggacttcaatgccaaagagctttgtgattctgtgtatgtagcacaattacaggagccagagaaaaaggacatcagtcctaagactgttagtggctgtgccaaaatcttttcatcacaagcgtcttttcacacacatgcacttgagactagattgtgtgcccaatccgaggtctattattacttttactagagttgagggaaaggggatgagaaataagaaaaaataaacttgaaaattacagccttaagggcaaaaataaggaaattttaagagaaaaaaatgtgtgaagattaacttcaagaccacaataaaagaaacaccttgggctctgagggccctttatcatgcaattttgccagcgtttctaggttcaatattctgaaaagggtggacgtttcagtggttgctctggaagcattattttctgattctgtatctttgctaagggtttcatatgcaatcccccttcccccatgcagaaaaatgcacatttctatttctacaacaaatatccatgtacttctagtgcattagaaatctccttaaaatacgcagaagaactgtaactaaagattaactttatggccgggcgcggtggctcacgcctgtaatcccagcattttgggaggctgaggcgggtggatcatgaggtcaggagatcgagaccatactggctaacacggtaaaaccccgtctctactaaaaatacaaaaaattagccaggcgtggtggcaggcacctgcagtttcagctacttgggaggctgaggcaggagaatggcgtgaacccgggaggcggagcttgcagtgagccgagattgtgccactgcactccagcttgggtgacagagtgagattccgtatcaaaaaaaaaaaaaaaaagattaactttattccaggtactagattaatgagattatatctttttttttatatgtgtaaatttaaggggtataaatgcagttttgttacatggctatcttgtatagtggtggcttttagtgtatccatcacccaaataatgtacattgtacccattaggtaatttcttatacccaccccctctcaccctcctgagtctctgatgtctattattactcacattatccatgtgtacacattatttagcttccacctctaaatgagaaaatgtagtattgactttctgagttgtttcaattacaataatgtcctccaattctatccatgttgccacaaaaagacatgatttcatttttttatgaccaaattgtattccagtgagtgacttgaggaagaaaatgtggtacacatatattaatttatgcagtcattcactgatgggcacttaggtttattccatgtctttgctactgtgaagagtactgctttaaacatatgagtgcagggatcttctttatataattctttcttttcctttaggtagacacccagcagtgggatttctgaatcagatgatagttctattttttttttttttttttttttgagatggagtatcgctcttgttgcccaggctggagtgcaatggcacgatctcggctcaccgcaacctctgcctcctgggttcaagcaattctcctgcctcagtctccgaagtagctagaattacaggaatgtaccaccacgcctcgctaatttttgtgttttgagtagagatggggtttctccatgttggtcaggcaggtctcgaactcccgacctcaggtgatctgcctgcctcagcctcctacggtactgggattacaggtgtgagccaccacacccggcctctatttttatttctttaagaatttctgtatacatagagtatggaataggcactggagactcagaaagatgagaggatgagatgagagtaaggtatgagaaattacttaatgggtacaatgtacattatttgggtgatggttacactaaaagcccagactttccatatatggaaaacagtatggagattccatttccaccaacagtgtattagcatgccgttttttctgcatccttgccaacctctgttttttttgtctgtttgtttgttttggttttgtttgtttgtttgtttgttttgtctttttagtaatagccattctgagtggtataagatgatatctcattgaaggttgataaataaacaggttgtctggtatatagtttttatttattcaacaaaaatatatttgagagcctagtgtgtggcagatgttgatttaaaaactgaaaatacaatagcaaacagagtttttcatgtagctgacattcctagcagagacaaacaataaacacatgtgacagtgccagggagaaagtaccattgaacagcaaagtgacaaaatacttgttgtctgtttcatgtttatgaaatagaagatatctcttattcattcaaacaagaaatctacttttttattttgactttaaaaatacaagaagtacaaagaacaatgtaacagataccaaaagtcttcctaccctaaattattaaaagcatattgctttcattctttttttatgaaaagaaaaagctaaaatccccatggaagatcatcacctcctacctttccctccctgacttcaggcaaccactgtcaataattttctatacttttacatgtatgtatttattagaaagctgtgcatttttaaaaatttgtatttatatatttattttttgagagtaggtgtcgctctgttggccaagctggagtgcagtggtacaaacatggctcactgcagccttgagctcttgggcttaagtgatgctcctccctcagtctcctgagtagaccacagacctcagtcttctggtgccacagatgtgggccaccacacttggatttctaaaaaacaatttttgtagagatagggtctcaccatgttgcccaggctagtctcaaacccctgggctcaagcgatcctcctgccttgtcctcccaaagtgctggaattatagatctgagccaccacacttagcctatgcatttttaaaatctttttttttttttttgcagatgagtaaatattgcattattttattctacttcttaaatgtatgtgtttgaagtctactcctttttatctattgtgtaatattgcatcatattatatagtatgttattaatctacatcctaaataataaagcaagtttaaacaaagtgagtatatttttaaaatatttaagatgaatatattcatttcaacagcattccacaagtgcttatgggaatatcttgtcacagccccagcccttaggtggcatgaactacagagaggagttagcctcagtaatggactttaaggagcaatatatataaacaccagctaccatgttacacagggcagaaggactgataagaggggaagaaattaactggtttagaatttgcagaacataagtgggaggatatgtaaagcctttcaaagaaaggagtataaaaaacagtgcagtaggaaattggaagagaaagccacagtatcagcaaaccaggttggaaagtgcaacgcaacttgaggaaagagaaagttcccattgactcaaggaaagagacttaggctacttacaatttgaaactgcagatgagacaagaactaggcggtcttgacacaccaggcttaggcttctacctaatccatcagtcaatggagagtttttatccctgtagtaatatgctcgttgcccaaggaagaaaagccatcaaagtaagggaggagggagctgacagcatccacactgaggcacagtggaacatgcccatgggcacttggagactaggttgctgtgtgctgagtgagaacagatttctgacctcgtcaaagatatacctctcgtctccctccaagtgcaaagaacaaaaatttcagccactccctgatccttttcttgcaagaacccagcaagagtattttatttctatggattttttttcaatacagtcattggaattccttcaataacttcaaggaatcaaacgagtcatgctctttttaagacaaggtcacagaaagttgagcatgactctaataacatgggacagtagaacaaagaggtttccgtggctctgcctggatttcacacgggcccattggaatgttcagtctcagtgtgctttggcctcctggctatggctatcttgttcctcttttatgtgctcccattagtgagcgacagggaatcagagtacattacaacaggactgcaataaagtgtgtgtgtgtgtgtgtgtgtgtgtgtgggtggaggaggagtggtttgattagaggatggagtaaatatttgtggtgggaaaatcctcatcagtttctttcttgccttcatcaggggactggttatggggacataggcagaggagctttcgtgggtctggaatacacaagtatccagagctttcccccaccaggagcttgcttaggttctgaggacacagagaataacaaaacaggaaaagaatgatgcaggggaaagggtatatcaattactgtatttccttacttctaaagcacacttttttccccatattttactgtctttgaacatggtagtcactgttgggctgacagaagttgtgacataattatcattgcctgcacaaaagcacaaaaccttgctgatggatttcagagattaggaagaaaatcccagatacaataggaagtattcttttaaaggcatattgtatcacagacatttttgatggcatgaaaggtaaaattatatgggaaaaccacagatatttgtaactctgactcaaaaagtgactaaaaggagtaagagtctgagttttaaagattagaaataattcactcatatttttgcttatattatcctttttatgtatgaccaggtgatatgtgataggagatttatgttttaaaaagtctaagaggcttctttccatagcataaactaaaaattctatgtggcaagaaataattgcaccatgtttgaattattgatcttagtaatccatcttaaatcaatgctttaaatataattacatcgatgaataattgctacacaatctgataaatgctataattgaggtatgcacaaaggactgtggaagtgttgagcttctgagagttcaaactttgccagaggagaggacataaaatctaaggagttttagcatgagtaggagttttctaggtaggaaagaacattccaaacaaaggttgaaattttgactttctgatcatttagtttttaacttctttcccctccgccagttgttccaggtccttcacctcaactcttattagacaaagggtgctgattattaatttatgcctctcagcctaacactaaagattctaagtagctttgcttcacttttgttgcccagtggaccatatgcagtagtgagttttaatcttcttgcatcttaattcatctcctttaaggtttagagctccaagcctttgtatttattctttcttggtgatcaaatctaaactgcatttttaaagagatgcatttatgttaccatttttcctagcttatttatacaggactcctcctgctagatgaattattccttcattttatcaaaagctaagggaacacccttatttggaaaccttaaaagtagtaccaggttgcaccattaaggtaccaaattcctcacatattgccaatagaaaagcacttattaattcttgctaatgaagcccttgataggtattgtggcctggagaaacatacagtttggttatggagaaaatatctaattgcaagagcagtaatgaaacactacaggtgggagggtggggggctaatacaagtgcttagcttagtgatcgctggaaccactataagaccattaccattgaacaagataattgcagcacagaaatggggaggaaagcattcccttatacctgtattcattttctagggctgctataacaataccacagattgggtggcttaaacaacagacatttattgtcttacagttctggaggctgacatccaactcaaggtatcagcaggtttagtttcttctgaggcctctctttggcttatggatggctaccttcctcacagggcctttttgtgtgttcatatctgtgtgtccaaattttctcttcttctaaagacactggaaagattggattaaggctcacccaaaaaagttaagggctttgctttaacttaatcacaactttaaagaccttatatcctaggtactgggggttaggacttcagtatatggattttggtggggggatatacaactaaagctttaacataccccctcttccctgtagggttaaatttggaaactgagttgcaggagaccccaagcttgaaatccaggcatgatagttccttcaataacttgaaaatgctccatgtttcttcaaaattaaggacctctctcttctacctgcttcactcaactgcttttattgtttatctactgttgctataagcataaaccacccagctttaaatcctctgtgcattactacaaaaataaatttgcccatgctgaattgtggaactgaagtgtttccaaaggtgaatgtaccaaagtggatggttgaaactgcacctttttacattaacccattaatcaccttcacctttaaacagtcattctgcctttatttatgtatttttttttaagagagaagaggggaacaacatagacccagcacagtaaattaaagttcattcaagcacagttgttgttgatgaacaacgcagttctgcttggttgaaacaagacacaaggggcttgttaagcctactaagtcacaggtgaacattgagggtcaggcagtcttaagagaaggtgaaacctttcttatttaatactttgacaaattaataatcgagccatagagtttcttactttcattgaaaatggcggtctctaagtgtaatctttgaaacaaaaagagattaagtctttttgtgcctggcacttgtgaccttggacaaatggacaaatagcttctgcagctaattaattcaagaatttaattcagtgtcttctctgagccatggaaggaatgatatggatattgttttactttgcctattactgaaaaccttcaagatagaaaaatgcccatttttatttaatgtggtgttgaaaatggcctataaaatccactttttatatgcagattaaataagtaatgatattttaaaggacataggcagttgtattacaaataaaagccataaaatttttctccaatagaagcataataaaattatctagattctaccttggaggaaaatttaaaaaatagttaatccattaaaaacaaacaaacaagacacaaatttcttcaagaggttaccataatgtgcttttacttggttagttagatgccaatacagttagactgtattcctgagatcccttggatagctaatgaattgccaatgctcagcagacatccccccgcctgccctctccattaaatatatatgtgtgtgtgtgtgtgtgtgtgtgtgtgtgtatatatatatgtgcgtatatatatatgtgtgtatatatatgtatatatgtgtgtatatatatgtatatatgtgtatatatatgtgtatatatatgtgtgtgtgtgtatatatatatacatatatataacatatatatgtatatatatagtgtgtattgatgctatggtctaaatgtttgtgttccaccaaaattcatatgtcgaaatcctaacccccaaagtgatggtgttaggagatgggacctttgagatatgattagttcactgtgggcacagtcttcatgaatatgattcgtgcccttatagcagagacctcagagacctccctcacttctccagccatgtgacatcacaatgaatacatgactatctatgaactggaaaatgggccctcaccagacattcaatccgccaccaccttgaacttggacttcccagcttccaaactgtaggaaataaatttttgttgtttataagccactcagtctatggtatcttgttataacccaaatggactaagacaattgataaatatatgtgaatagattgcattctacttacatgttgcccatcacatattatgtgacatgtgaagaaaaagagaagtgggaagtggtatcccatgctacgctctaacttggccaacagtgagacttgccacagtgctaggctcaagggacatgcttggtgaaatcttttgggtaagatcatagtgtagagcactccagggccttgactttaatggtctgttgttttctttttttgtttgtttgtttttaattcttgttttcaattataagcactaccattaactccatgggtttcccaggaagactgtatctgagagtggcattctaaatacaaatatatccttactgctagaaaaaaaagtcaaaacatatgtccccacccagatgggtcagaaatgtcgccttcagatctcttggacagcatgctgtcctattgtgactcttttctggggagcttcattgagaaactctttattctatgtccatcatgtttagagaaggggaaatgtgataacattagagtttattattttcccttatgtagtgatagagacactgcaatatacaagattaaagtgagtgacccagtattgtgcggcaagattgagtctgtgctgagacaaaaaccaagctgttctctaagctccgcacttgattcactgagccacactatctctgtgatgttccccatagtgtgtgtgaagcaagtgccaaatgcagtttctcagtctgcacgaatgctccaattggctgcatctcttcccctcctggctgcttttggtagaggattgctgatggaaattgtgctgctgagcttcgccacatggctgtggctacatttcgccagtgttagctggaagaatttcccgggattctaaactagaaagaatttgctgaggggccccttaggagagggtcaaggtttcctaagtgcaggtgatcactgtattatattaatagtcgagattttattttaaccagcagggctccagccattcttgtggatccctgcaatgtggttgaagtgatgttaagttttctctcactgcagtctgcctgtctgcttcaaacagatctgattcacttagggccaagtttcagggtgttaaagacagctgggttggtgtacatggcactgagaagccaagagatgcacgtcctaatcccatgttgtctggagagagactgcaccataattatatgtctatacacctatttctgcatgggactgtgaaaacctcatggatggggagagtattttctccctctttttccttagtgctagcattttactaggctcataaatattatgtttgataaattagattatattggctataatcctctacatatcacttaacctctctggatctcaactttcatggtaaaagtgatacagatgaaccgcgttaatcaccacacttccagtgttatcatctcataattctacacttttgattctctttgcctggaggagtttctggttttgttcttagctaattaagagccagacctagatattcctcccacttagttgttttataaggaggagtgcaaactcgctcaccattgacttcctatgtttatgacacgattagtttgattttggattatctatcacaaatgaagggaaagctgagtaatttttaatgtcacaaaacatatttatgggtgaggtggggagtgttaatccagttgagacaccagttatatgttcagccaactgcaagacctctctgataggtagaaaacatgacaaatttcattcctagcattttgatttgatttctgattaattctcaaaacatccaaatcataaaagtcattggtttattttttaaaataaatgatcaaatagccaaatttttatatacaggtcttttttatttttacataaaacttttaatctaaataaccctgggcacattatgggccccatttaccttctttgattcagagacagaaatgatcacacttagaggcaaaatattttcaatttgggtcagtgacccaaaacttggcaataatcttttactattcttctagttctacactattccaatatgttatttctaatgaatctgagaaatatgatgagattaaaaggtcatccctcatcactttattctatacatctccaagtaagcacccttcattccaagacaaaaaactgtagcagagattttgtgtgtgtacaaatgttacagctttttctgtatagtagttgggaatggaaaatatttaaaaaaaaatagtcacctggatcattcattctagggaagacaaataactgcatcagattatatttctgttgatatttaaattttcatgtgaagtttacagtcttggaaatgactttcctacaaaatgtttttacctttgatcccaatggaagttaaatcagaatttgtcattcaatataattcattacttgcccttcaatagtagctgagtagctgctggtaaattgaaaagttaccttgataataatttaaaaactaaaagaaagttatctataatgttgttctagcctgtggcaaccatccacttttgataaatgttccatcattttaccttttgcccagaccagatttatctacctttctctaccactagaacaagaaggtaaagcagaaacagatggaactcagtacaatgttcagacaacagtcagatactagatttatccatgatgtaattataaattaatgaattgatagtcaaggctcagaaataaacctctcatttggggagtaaatgataatccaaaataccatgacactatcctccaggatcctacacaaagcaaagaaaggggaccaagtaacctaaatatattattgcctggagggagttgctgattaccttccctaaaccaggccttccatccagggactttaagctgaatctcttaacccaacgataatgaagatcacttggattctctaatgccctgctttttatttgtgtttaggcaatgcttcactgacttaagctatttaaatgtttaatctaaaaagtcatcctgataagaactcatatagtcaggaaccaaatgaaccaggccaaaacaagagcaactgttgaacatgtgcagatgccctgagctttggaatgaattaaataatttagcttcccaattatgtttcacttatgcttttactacaactcaacaaatgctttcgaaccactgaacccaatacattttttgttgttttagagtaaatttttaaatcttaagttgtagttaaaaaattaaagtgggatgggaggtgatggcccaagccttgcaacaatgcacgttcattgcaaccaccgtgaccatggataacaggagcagacgagggaatgctgatgtgaggattataacattcatatagaaaattaattgggtattttgtggcttatttttcccatcttattgattagaccactgaaacccaatgattaagtgatttacctgaatctaaccatttcagattttatgagagcttgaaaatgatgcagaattttttgccttcgaattcctcgcccgccaattaatggtagagaaaaataagaaatcggttctctagattctcacttcaatgttctttctactacatcatgccacccctttatttggtgtgtaaacatattagcaggtttgtgattaaaaggagaggtgaaggaaagtctcaccaattattttgctccatctcttcccactgttgctaagttaataattatttgcctgacagcaaaaggacattccacaggaagactgcttttgtgtgcaaagttcctccatactccctcttttcctttttctgcaactagatgttgtgaaagggagaatccatgaagggaccaagcaatagtcaatttaaatccaaaccaccacacaagaacatcaagcagaaacaccttttaattgcctggactggtattgactatcaagtcacttgtatgactgccttgctctggttcaagtttactgtgccttgaaaagtcaatctaaaagagaagaatgaatctgagggagtagagtcccctggggtcaaggtgacaaaactgagactgcagtcacaaactaaaggagaaaaatttcattgtcgcctataagtctttcttaactttcgaattacagatttgtgtttctgtagcttgtcattcaattcatagcttgtcacttaagttgaagggtaaaagttctctccttttaccatgagacaaatacaattttacagacttgttggcatatgtaagaatcaaattgttctgggcttccctttcttatcaaaataaacgtggttccaactgaaagctgaggtccttcttccccagcctattcctatcatgccagcacttctagaatagcaattcatctcaaccgtatgttcaggatcatgcaccactgatgttccccagtatggccagggcttctggggaatgtcatgacctcaatatataagtttacttctataccctcgatgccaacaagacaggaggaaatatggataggttaacccccaaggacagcaagaaggagagtgataaggatggcaggtagcaaaaagcaaaattttggaattctgaaaggtggatggataaatagtaactgaattaataccctggtggggaacaaataactacaactcgctgctgaacaagtaagtgtgggctgtagtactccaggacaacacaagaattgaggcaatgggtcactttgatggtagcagtgcagaataagacagaaaacaggtgaaaagggcaaagggacattagacattagacctacagactctccctggtcccacagagctgagcaattggatatccttacttcagcagaagagggaatgctctttctagagagattaaatcagagaggaagatttggggagtccagaaacagttgagagtggggcgaaaaattgtactgaaaatagggactaagtgaaaggcaggcaaactggttggtgagatcccacagccgtcgctatcctctgggctcttctcatgctggaaagtagtctgtttccctgatgcctccacaggagatgggagaattcctctctggaaaactggcccaataggtgctgacctttgggaagtgcccagtaaacagctagagggaaacccagccccacttgtgcacacagactttttagtagttttatttttcttcactttcaaatagatatggatgtttaaatattgccaaatatttataagatcttctaaaatagagaaagtaaaaccagcaaataggaatccaagagaaatggagaagtctgctgaaagcagaaaacaatctcaaataaaacataactttaatattttgacagagataagaaaatattaagcaatcatatagtaagaacaggtagctataaaataagggagaaactttcaaataataagaaaaagtgttcagaaattaaaaattgggtttcctgatagaaggaataaaaaacacagtagaatgattggaagataacattgaggaaatatctcacaatagataagaagacaaatatagaatgtaggagaaaagaaaaattagaaggtcagtctaggacagtgattctctaaatttccttgcatcagaatcagctggcgggcttgttaacattcagattgcaaggccccacacctagagtttctaattcagaaggtctagaattcaacctaggaatatacatttctaacaagttaccggatagatccgatgctactggtctgtgaacaggactttgaaaactactgttctaggagattcaacatgtgcatcacagcatttcttgatagacaaaaccagaaagcagagaggaggaaatgataatagaaacaatccaataaggatatgaatttctggaatgaaaggacccaggtcatctagttcccagcacaataaatgcgaaaagattcatcctaagggacatgatgacatttcagaactttagggaaaaatacatcagggacacacatgccaaggaaggaagggaggaagggagggagggtgggagggaggaagggagaaaggaaggaaagggagggagggagggagggaaggaaggaaggaaggaaagaaagggagggaaagagagagagaaagaaagaaagagaaagaagcgaaaagaagaaaacaagggatggaaggaaggagggagggagggaagtaaggagaaagaaaagaaagaaagaaaattaacacattcacatttgctgtcttagtccattttggctgctataacaaaatagcataaactgagtggcttacaccaaaatttgtttctagaggctgggaagttcaagattaaggtgcctgctttctggttcatagacagcaccttcttgtgtcctcatgtggtggaagtgacaatgcaactcactgggtttattttataagagcactggtcccattcatgagggctccacaatgatgacccaatcgctccctaaacaccctggggactaggatttcaaaatatgaatgttaggggaaaacaaacattcagaccataccattcccatacaaaaaataaaagaatcagagtagactcacacttcttaatagcaacactgataaaacaaagacagttaaagaatgtatttcatgtcttaggagaaacaattttcaaagttagaattctgtgtgcagccaagtttcaaacaaatgtaaggtctttttcccaacattaagttttcaataattttgcatcctaagtaacgtttctcaggaagccacttaagaatgagcttctattaaaatgggaaagaaccaataaagaggaagactcagaacccaagaaaagcagatcctcttcaggaaagaggcaaagggaagttctcaggtggtgctagaagggatgcttccagatgacagctgagtggcagtttgctgagtttcgagtggactagtagtggctccaggaggagtgttgtactgctaagtggacctagatgtgttcaccttcactgggcaaaaggttgtagttctgtagggacagttggggtaataattattgataaataattaggcacataaaaatattcaccctagctaaaacaaaaatttttataagaaaggatatgtcatccttctatgctgtgactctacaatgcagaaaactcatagtaatgaatatatattatatataaatgctacatctatattgacagaaagtaaaagaagaagtatgttttgaatagagacagaaaactacattctcgctttccatagtagaaagtcatttaacaatgttaaagtggaaacatcacaaaataagaacactatttagaaataagagaagaattgatatgagttgagagtggtcactcctaaaagcaataattttatctaagtagagctgtgtcaggagatacttgctttatcattatggactggagacagaaaactacattctcactttccatagtagaaagtcatttaacaatgttaaagtggaaacatcacaaaataagaacattatttagaaataagagaagaattcatatgagttgagagtggtcacttctaaaagcaataattttatctaagtagagctgtgtcagcagatagttgctttatcattatggcctggaggtttaatttgacatttactatggacatgtaatactttgctgctaacaaaacttcttaaagaaaagaaagagaacttaatcttaggcatgaacaaatcagagaaaactgaattattttgagaggaaggaatgggtggaagataaatctggattccttccagaggtgttgtgggcctgagaagattaagtttagggagctagtccagatagctgtacctatgttccctcatctaaggaaggaaacttttgctacatttttttaaaactcaagcaaatctgggaaacggcatattttaaattatgtccagaaatgctccataaatcagttcagtggccccaaatatcttttttcttttctttttctttttcttttttttttttttttgagaccgaggctctgtcacccaggctagagtgcagtggcgcgatctcggctcactgcaaactccgcctcctgggttcacgccattctcctgcctcagcctcccgagtagctgggactacaggcgcccgccaccatgcccggctgattttttgtattttttagtagagacggggtttcaccgtgttagccaggatggtctcgatctcctgacctcgtgatccgcccgcctcggcctcccaaagtgctgggattacaggtgtgagccaccgcgcccggcccagtggccccaaaaatcttaatgcaaaaatcctactgataccatcttcctgttatatgatgcggccattaatttaattgaaccaaggtcatgaaatgagtctatgcagatgcagcccccatttgggtgctgtataaatgccctccctccaacactgaatgcaggacagcctctcagatgctgccctctgcaatctcctcaccaaatttctgattcaaacaagcaaggcaggtcaatagacagttttattggcccttttgggacatgactgcagaatattagaacttctctttataggtcccttggtaattgactgtgtttacaaaattatgagaaaagccatctagtagttagaccttcttatcccttttccaattttcagtaggctgaaggtgaagccaggacattgagtttgatgtgtggttttggcatggcaggatctcttgtttctaacacaatcaaagagctgagggctgatgggttagaatatttgggtttgctccaccattaatttactctaacagggacacttctgggtatgacttgctactataggaagagctgtgctatgctttggaaatgctatttgttgatgaaacactaattgtaaaatagttacctcggagaactcaaatgtaattacattaagtttaattacatatcattaattatataaaatatttaaattgttatgttgaattgtgctgcactagttgccttacattttgctggtgtgtggagcagatgtgcttgaagagtttggatgtcatccagaagttagtgaattgtaactgtttagataatcggagcctgatttataccatctattgaaaaacaatagctacatattttcagtgatgcgacattattgagtatagggaggaagtagcttatgcctacctgatgttttggtaattatagtttactaccgactttaagtttaatcaaccacatataaggaagtcaatgcctaatttctcatgtgcatcaatagctgtgaacagtaatttttatttatattggggagaacaatttttttctctgcctatgaaactgacaatttttttaggatgcctgaattatcaaaggaatctagagttcaatcatttgccttgtttctcagaggttcacttgctcaaattaattcaccatcaattttaaaatgtctctagacttcacttatatcaaattctctaatatgattgaaagcatggtgaagtatccatataaggaaagtaagaaattcggccgggtgccgtgactcatgcctgtactttgagagacctaggcaggcagatcaccaggtcaggagttcaagaccagcctggccaacacggtgaaaccctgtctctaataaaagaaaaaaatacaaaattagccgggtgtggtggtgtgcacctgtaatcgcagctactcggtggagctgagacaggcgagttgcttgaacccaggaggcggaggttgcggtgagccaagatgttgccactacactccagcttgggcgacagagtgagactccgttacaaaaaaagaaaaaaaagaaagtaagaaattcatacagactaacaatagatttttcttttccaatatgtgaatataaaacctactatgtacttaagggatctgacactagaaaatgtaatgattgatcttaagttttggtaaacaaatagcagtactagaatttcctctcttaaataatttgctttcatatttatatccatttggagtggagcaaagcagagaaacagtcatttaaatataaatgctacagagagaaaaatatttatgattcgtgtttctgccaatcaaataaatggtaccatttaaaattttagtttatttttgtctgtgcagatattatctactattaacagtactttggctcaattcagattattgtgactaaatttctcaaaaattggaaagcacagaatcaatttgtctaaagaaaataacttgttagtatgtcaccagccataaatcatgacatgtcacttctactacctttgaagaggatctattctacagaagttcatttttagaattacctctgcttataatttgaagaaaatacttttttccccagaaaatacttttttttcctcagaaatactcccaggtattttgatgaaaaataattaaaattatctcatataattgtatatacatctgtatatgtgtttgttggtatcagggatcatctaataagaacgaaattgaattctgtaaaagttatgttgactatgccagaaggtacaatctgtgagtcaaaatttgaggggcaaagggagggattacagttacaagggaggatatggaatagagccagtatctgttgagactgaagataggcccaaatgaggagagggactttgagcaggcttgtgtgcaggaagatttgagaaagctcagtttgtcgcttcagcctagcagccttcccagggctgaaggtaactttggtggaattaggagttggtttgccccaacccccaaatggtagtagatgatatatgccagtgacaatgtcatccaagcatcctaagcataaatactgcaggtgattcatgaaacaagtattattattgatatatgtcttatctattttgatttgaaacttgccttccaaccatgacacgagttctattttatttcctaaatcttcattttgactttggcctgttgtaagcctgttccaggctcagaccttgcaggagacattagggcttctttgtcttcaaggagcaacaggggtgtcaaagctatcttagaatcccactcctttcctatgacagtttcaggaaataagaacaatttatccatgacagctttagaaacacgatctactaatttatgcactgcttcttcttgaataattgggatccagtcacgctctgcataacagcccctggctttgggagggtccaggcttaccaactgcttcccctggagggggaagagctggagggtgagcagattgtgccttccctaagcaaagaaagaaagaaagaaagtaaaagaaattaggggtggtaaggaggttagaagacaaaggaggaagcatttgataggtcatctgtcagtaggccttgataaaggctggtaagagaacaatggaaaaccacttcaaagtgaacaatgccacactgagtatgtgccagtttaaacaaaaaagaaagaagacatgtcagctattaaacacattcattgaggggcgtctttttaaccccttacttttcccactatttttctttccttaacgagtagagaaggaaaaaaaaacaacaacaaaaaaaaacagtgagtctgtcaaagcaggagggaagcatgaggttgccagctttccggaaagtcaggcagagatatttgcattaattgaatattaatttcaggatggaggttgtgtagacaatggaaaagaggtgactttttgatggtttcaggtaatctcatgtgtttgagaatttcagagagtggggctccccgacttgttttttattttcaatatattcaaaataaagcaggattaaaaacttaatttgaagtttgggagaataagctaataagattttagattttaaagctctaattcatggacaggaggtacagaacaaaaagggcattttcacatctactcagactacatttttgtgataaccagaaaagagaaaaatcggcaaaagaaaaatttaattaagtgctgttagttcacaagatgatctctcatcttgaaagtgtctgatgtgctagtctatgctatgaatttagagatgaaagaataaatatcaaaatgtaataagaacataatactctgggaaattctatgtgggtttagaacagtgtgctacccagcccccaaagccatctttgatggaagagcagagtaatggctttttctttgtgaacttctcaaataatggaagccttggttaaaacaaatatttccaatatctgatcaatttgacagaggttcctactgaaagttgatgtttctgtaagtgaagaacagttcatctttctaccatggttggttggcttggttcaaatgaaatatagagcttcaacaaattattttggtgctcaactcttgtctcttcagttagacatgcatgccttgtggtcatggtgtaaccacccagtgggttcaccctgtccgctgcctagcagagctgatttatcaagacaggggaattgtaatagagaaagagtaattcacgcagagctggccgcactggagacctggagttttgttattactcaaatcagtctcccggagaatttggaggatcagagtttttaaggatgacttggtgggcaggggaaaaccagtgagccaggagtgttgattggttaggtaggaaatgaaatcatgagaagttgaagctgtcctcttgtgctgagtctgttcctgggtgggggccgcaagattagatgagccagtttatccatcttagtggtgccagcagatccatcaagtgcagagtctgcaaaatatctcaagcactgattttgggagcagtttagggagggtcagaatcttgtagcctccagctgcaggactcctaaaccataatttctaatcttgtggctaatttgttattcctacaaaggcagtctagtcctcaggcaagaaggagatttgttttgggaaaggactgttatcatctttgttttaaactataagttccttgcaaagttagttcagcctatgcccaagaaggaacaaggacagcttaaaggttagaaccaagatggaattggttagattagatctctttcactgtataagtcataattttgcaaaggcggtttcaatggtccatgtctcatctgtcttttgctgccctccacattggcaaatacacggtgcatatattggtttgtttattcatttattcaaagtatctagaaatagttattgagttcctactgtatcaggcatgcttcttgatgctgtacattcagcagaaaacatcataaaaccccacctccatgggggttactgttctagtccaggacaacagataagaaatagcaatgacattcagatattgtaggtaaggagaagcgtttgaaaaaacaaaacaaaacaaaacaaaacaaaaaacacaaagtgtggtagggaaagagaaagtaacaagtgtgttttttaggtctggtggtcacagactgtctctgtgaggaaataacaattagagaggcaactaaatgagatgtaggactgcctacccaaatgcctatgggaagagggtttcctcagaggaaagagccaacactaaggctctgagggaattgcacttgatgtgttcttcaaacatcaaagagtcagcattcttggacaaaatgaccaagatgacgcaacctctgttacccactgttgtcttttaaattttagaaacttgttcggggctgactttcagtaaggtgtattttcatataaaagattgcactcagcctttcattcttactttctagtatcaattttacctcttcaaagtcaaactattccagagctagagaatacaggaaggatgtggatggaagaccaggatgtgaccagtgttacccctggaaatgaagatggacttaagtgactcagtcctaaatgaaatcaggatatgtctaagtaaaatgctatcacttctattgtgttcaaattctttaactataaagtttgggtgaaatcatggttgagaaaattattaaatgtccattgttaggtctctttcctatatagattcataatatgcaaataggacaagtttatctgtacataattctgaaagctggccaggcgtggtggctcacgcctgtaatcccagcactttgggaggccaaggcaggtggatcacctgaggtcaggagttcaagaccagcctagccaacatggcgaaaccccatctctactaaaaatataaaaattagccaggcatggtgaagggtgcctgtaattccatctatttgggagactgaggcaggagaatcatttgaaccctggaagcggaggttgcagtgagccgagattgcgccactgcactccagcctgggcaaaaggagcaaaactccatctcaaaaagaaaaaaaaaaatcctaaaagctaacaggctgtagactatttttctctctgtaaacattatgctaaagggcaactattctattttgactctctatgtaaaatactgtccttatcattgagaaataattttgtgttttcttccaaagcttccccagcagggtctttgacatcggagttttttcccctcatgttgtcattggaagcagctgttacaagtcataaccgagcttatatttatcattaacttagtgacccctgctggggaggcttaacataatcatccttaaattcaaagttggggtttcaacaaaataggtgcttggacctcaaacatgagttcttcataatccaagacaatggattttgcaagttactcaaccagtcccaccactggaggcttcaaggaactcacggtcaccaattgagagagaataacccttgtcacatgactgagtgtgtgactgattctaaaagtgacacatttggcattagcacacttctcctggttgtctgcctctgctccctcaccttgctggctctttttaatgttatctgccaagtgacactttttgatctctttccaatatgcctttaaaaaaatcaaaaggctcagatgatgtagttttctatcagaatcttttcttttttccccgtcacaatagcattgctcagtatcatatgccaacctttttttttttttttttttttgagatacagtctcattctgtcacccaccccggctggagcacagtggtgtgatcttggctgactgcagcctccgcctcccaggttcaaaccattctcgtgcctcagcctcccgagtagctgggaacacaggtgtgtgtcactacgcctggctaatttttgtatttttagtagagagagggtctctgttggccaggctggtctcgaactcctgacctcaagtgatctgcctatctcagtcacccaaatttccaggattacaggcatgagtcaccacacccggcctcatatgctgaactttttcccatcacatttgcagaacgaaactcttgaaaaggaagtaaataccccataaagcagaggacttatatttttattttcatgaataattaaaaagccagatacacttctgttgaagtgtaagcttttatcgtgtcgacccttgcaaattgttagattctccctatctccatcccagaccactttggcataaccaatcagtttaggtaaaccaatattagtgtccaccgcctaatattaacctctatgtacaaaaacaaaaaacaaaaacaaaacaacaatacttcagttttgtttatgcctcagaataacaaatgttagtatacaacgtgggtattaaaaggtctgtgatttgttagaattgacctaagcatatttaacaataaaatttttaaacgaatatttgttttaaatagttctattaaaagcaatatgtgtgtatacgcttcataattagtttacaagctattcactataagatgtcaatagataaacctaaattacctaaaatccaactatctgaatctttccactagttctacagtaagagattttctaagtgtatccaatttttatggaaatgggtagagagagagagagagagattgaacaagatgatataagcacaaaacagttcattttctcccgtttctttccttacttcctcattccttctcccttcctttctttcttccttctaaccctctcttccttccaaatatccctccctccctttcttcttcctaattcgtcctcccttcctcccttccttccctccttccctctttcctctttttccccttcccccttgcccccttccccccttccctccttccttcttcccttgcaaagaaaggagcttccttctttcctttccctctttaccttttttgtccacctttgatgaagacctcacattgaatagaattctacttggctgggtaccaaggcttgtgcctataatcccaacactttgggaggcaaaggcaagaggatcactttggcaaagagtttaagaccagcctgggcaacatagcaagatcccatctctaaaaaaaattaaattagctgaatatggtgatggtcaccttagtcccagctacttgggaggttaaagtgggaagattgcttgagcccaggagtttgaggctgcagtgagccatgattgctccactgcactctagcctgggctacagagcgagaccctgtctcttaaaaaatataataataatttgacttaatttagtgtattttgtatctagagacataataaactcttgctgtttaggaaagaaattcagtgggttagaagaaggtagagacactcgttatatgataaaagtccctcccatttttaaattaaactccagactttatatttagatttcaccagtcttttcatttatgtccactttctgcttcaaattgaatctagaatgtcacatttcatttagttgtcatgtttccttagtctcatttggttagtaatactttctccctcttttcttgttttcctgaccttttgaggaatactggtcagggactttggagaatgtcccataatttaagattgtctgatgtttgtctcatgtttagactgaggttgtgttttttgagaaagaataccatagaaaagtgtctttcttgtaacctcataacaggaaatacatgatagtcgcatggtttgtcactagtttactcggataagacagtgtttgccaagtttcttcactataaattttttccctccttttttcttggaaatgagccactaggtatagctcaccctcaaagaggggagtaaataaggccttttttgaaacatggaccttgatggtgtaaagaagaaaggatagataaaagccattgccaggtttagatcacatcgctaatgttctttcactgaagactcaagtcacagaagagagaatattgtcctcttgaaagtaaatagaccatgatggggtaaactcttctaccttagggttactcatttttaatattcatagttggtagtgcctccactaggtgcttagaagtagtgggttctggactacatggctaaggactgagcttggctacaatagcaatgggtaggccagctgagcatatctcacctatggtcttttatactcaaagaggctagactgggctttttcacatggctaccccagctgtccccagtgtgcaagccttgcttgtttcacacttggtgatatattataccattgaccaaaggaagtcatgaataagtccagattcaatgcaggagacattgtgttaatcaggttctccaaggaaagagaaacttatagtgaagatatttattataaggttattggcttgcacaattggcttgagaagttccacaattttccatttgcaagctggagaccaagcttgcaaatcttggtatagctgatggtatagattgcagtccaggtctgaaggtctgagaaccaggaatactaagggcaggagaacaatgatgttccagctcaagcaggcaggcagaaagaaaattgaaccttctccttccatttgcttctgttgaagcccacaacagattggatggtgtctacccatttttgggagggccatctgatttacttagtccaccaattccaatgttaatctcttccagaaacaccttcacagacacacacagaaataatgctcaactagatatctgaaaatcccatggcccaggcaagttgacacataaaatttcccatcacaagcacaacatatggagtgaataccaaaaaatgtgattctctaagaagccttcatgtaacaatctatacattggcacagcgaataactagttaagttgggagtagaacccaaataaatcctactttagtaccatctccactgtagcatgttgaagcaaagtgtaaaccaaaaataaaattctaaggctcccccgccatctgaacggactttctcctcagccagggctgttttaaaatttaacctgaaagactggttcaggccaggaaagtggaagtcagacatgcctcattttacctctctggcattaacatcaacacagacttttaagtctgataagaaacattttacagcctattctctacgaagcctactacctggaggctgcttctgcatgataaaactttggtctccacaagctcttatcacaacccagacattcctttctgttgatcccagatctttgtttgtttgtctgtctgtttgttttgagatggagtctccctgtgtctcccaggctggagtgcagtggtgcaatctctgctcactgcaacttccacctcccaggttcaagcgattctcctgcctcagcctccctagtagctgggattacaggtgagtgccaccacacctggctaatttttgtatttttagtagagactaaaatttcaccatgttggccaggcttgaactcctgacctcaagtgatccaactgcctcggcctcccaaaatgctgggattataaatgtgagccaccatgcccggcctaatcccaggtctttggataaactcaaccaattgtcaactagaaaattttaaaatctgctctttaagctggaagccccccacaccaacttcaagttgttccaccttcctggaccaaatcaacgtatttcctaaatatatttaattgaagtctcatgcctccctaaaatgtgtataaccaagctgcaccctgaccaccttgggtacataatctcaggaccttctgaggaccgtgtcatggtccatggtccctcatatttggctcaggataaatctcttcaaatatttgacagagtttgactcttcataaacaaaagaaagattgtttttgtactgtgtttactaaagcaggagatcctacttttggattatatactcacaacttgcatattttaggaagattttcggcaacaagcgttgacatagaaaaagatttctgtttagacttttacacaattagcaaattctgtgaaccatattctttcttgagcattttactttttaacatattgaataagtaaaagaggactagaataggattcattggcctgcctcccatttccagctctttgactatgtgggtagataaccttcagcaaatgattgatcttttcttggtgttagtttaattatctgtaaaatgagaatagtcaatagttttttgtgattattcaactctagaaagtcctgtgatatattctattcttcacatcttctccttcatcaactcttgctgtttagcaaaacaagctagatgtttaagtctagctagattcaacaatggaacaggaaacaggaagactccacagaggcggaaatggattcaaatcccagttctctcagctaagaactttggagtctcaggtttaaccattctgagtatatttatttgtttgtaagtggaaatagtggtagtacctcatagggttttgagagaattaacttgaattgaatgaagtactcgggaaggcatgcatcattatagtaagttcctaataatggtgtctaccactatttttaggataagtactattgacagtaatagcaaatcagacagattaattatttatatcataatctgttaaattgtatcctcacatgtaaatgatgtaaatgacttgtacccaaaatatctgacttatatctcagaaatttttacaaacaagtcctagctcctaagatatgaggttattttacttttcaagtgattaaattgaggccacgacttgggaaacatgatatataattatttccttaacttagaaatcagtcttcctatgagaggtcatagttcccagtgggtgcacaagaaaagggtcaagttggaaccagacatcaccctgtcccaagtgcaacgtgagatcagcaggagcttgattattgatttttgtttccttcttctcttgggtttgctttcttttaggagccagtggaccttaattcacacagcttaggaggtaaagccagctctgctttacttacccaatgatcttttcctggagatcatgttccttttgtccttttgtcttgaattgaaatcacttgggggttataaattttatctttttaaccagatagcaaatgccttaaggatagagcagcatttttgatatctttgttttttttcccccaaactacttcctgtagaaacttgaacataataaatcctctaatagttttttaatgtagctcaaagagctctgagaaatagtgaaattcaacagcaaatacattcagccaacattttgtaatagatgtggcataatgcatttaaattatgaaacgggccttaattcttgtctcttaatgccaaggttttaaatttctatctttgaatgaattctttaatcataaatattgtccattctttcatccaggtggtatcatcagagctaatacagagtgaattcattaatgttaaaactaactttactccctaattatgagaaagtaagtgtgcatacattacaaaaaaagagaagtggttaaatattaaaatgcttgttcttgaggctgttgtgaggcttaaaaaacttgaaaaaattttcagggatcacacagtagtaaaaattactatagcagattctatgtttcattgttctgccatccctggttctgtgatgcttctttttttatatatattttttattattattgtttctattgttattattttggttcaacccataaatacattcatcctgctcagttttcacaaactgaactcatctcttactggtaaagaaggaagaaatgcctttctttggggaagaaactactggcaacttctcctaagacttgagggcagaatgagatatctatgacagattttcctttttttcctgtttcttgcatttgctttctgacaaaatagagaagaaaaaaaatttctttctgaagaaactgccacactctgttgtttttgattttccacatgaacgcattccatttaagcacaggagtgtctcaaaaggctggcttctcgttgagcaagtatattaatactttttcttctacaacttgtagcctgatcaacagcaattatttcagtagccataatacgccaccattctgaaaacaaataaatcaaatgctttttaaagtcaagggtaaggctaaatacagaacaaacaaaaggaagtacttattgcgtgtattaccttccagtggaagtgggtataaactacaaagatgggcataaaagggtaacaataatggagacaccatgtcaagccttgaatggactgtattcttgactatactgatcagcctttgccctttagactgacatcaaaaactctgccctccctctcagagccctcaaactgccccaggctgctggaatctgtgtgacagcctggcaaggttaacgttaagaaacacacaaaaggcagaaaacaaatagtgctgctgccgtcttattggttggcatactcctgggatgatctataatcatttcttcagcttagaaatcagcctcatggtctttggggtagtattaaagctcctgagccctgtgggttttgtcccttctattgtttatatgcgttcattcattttgccattaatcttaataaggatataagatttactttctttgttgttgcctttaaattttgaagaaaataaagcagaacaatgaaaagagaactctagctcgtaagatttatttgcaggtcagctgtgttaaaattctttccgctcgacatgtaagaagcttaaaaaagtaaattactgtcctttttaaaaaatgctctaaagcattagtgtaaaaaggacgttaggagagaatcattatcatctctgtgtgtttacaaagaacacacatgaatatatgcacacacagtcagaaaagtagttctttaagaattccatgccacgaaagatttaattaaccttttcactaggaaaccggttctgggcactgccttcattatcccctttctgtttccaccctaagaatctcacactctgttcctttcctctgtttttctcgccccatcctttttgcccattctttcatcggtgactctattgttaaatttaccagctggtgatagattcacatactcctcttcatttccgatagtaacctcctcacttccacacttcaacttttgctgttacctgcttgattgcattctctttaccttcaaaaattttaattgaaaaaagctatattgacctaggagtgtaagtaaagtcagttgaaatggttggtagtctacgagctttgaaatattatttttccacagggtataacaatttctcttatataaatgttatttatggtaatagaagcaaaggaacttcactataaataataacatttagtaagtggtgatatgaaggaatgcattattataattaccatcataattttcctgttattatttttaaaattttagatattaaaaaagacttaggaacacaggaagtatgctccccaccaagcactaggaggccattgaaatcacatacagatcagctttacattttttgatagtgtgttcattctaaagctaacttttagaaattattttgttgttgatgatgatgatttatagctgttttccccgtttcattttatcctatctattgttaacagaaaataagggtgtatattcatatagcccccatctttgtaatgcctggacatgttggttgctaggtaacaggacactatgaggtaagcaggcccatactgtttatctctgattgagcagaaatgcagaaccctccgcaggagaaaagtcctctgaatttccttgcatttttgctgaaccaaacagaattattattgcatgacaaagtaccacttagccttatgaaacttcctggcagtttcagtttaatcattgctgtaaagaatctataagtctttcttggttattaccacaaaattgtgtagcaggtttacttccctaaatcaaaactttgttgtccaggattctgttcccttttaatctttctaggttattaaaatttatcacagcagttacctaaacagaggtgttagtgtctgatgtcctgtattctaatagactttttaaaaaatcatatattttgtataaacaatgctgtaactagaataaaaggtcaaataatcagataaaattgtacggaattccaccactggaaagaaaaaaaactactcttcaaatttcttgacttttaattaaaatacatgtattatgtggaagtattaggcatcacatcaggcttagagaggcgtagattcattcataaaacattttctgggtgcccattgggttcttgggactgagcagtgatgttacagaaagcaagacagcatcctggccttacctgtgaggaaaaagctataaacagacaattacattatggcaaacttttaagcagagcatagcgagagtgtttgggagcacagaggaggaagcaaccaactagacctgggggaatcaagaggctttgagatgctatatcttgaactccccaggagttcaactttccaggagaagaaggccagtgatgtttgctggctctgccagctaaccttccttgtccatcatgcaaagcactgttctgcagggaagccctcctggatgtcttatcccaaatggaattcctttgtcgtatgttctctcggttccttgctctcttccatcagaggtcttatctcagtgtttaattatatattaaacagtgttatttaataccttaattgagattaatatcttctccaccattatacccagctccatcaaggaagagaggtagcaggtgttactcacattatccccatggaacaacacagtgaattgcacatagtgcaaacccagtaaatgttgaatgaatgagtgagtagacttgcaaatcatgtcatttaggtggctgccttccctgccttcataataggatggccaagtttatattccctgtcttagatgttgttaaaggaaaaaatctcttcttacactgcccttccccatctaaatttaccatataaattatatagctgttgccttttgcctaacatagataacatgatacagaacacttttagatgaatgattttgttggttaaaacgcagaagaaaaatactggttagtttttacatgggtccaactataatgcctgaaaactatagtgcctgaaattccttctgaaactgttagtaaattactattggtggtggggtcggcatttattaagtgcttactctatatcagactttatgttatcccttcaatttatactatcacattttaattctaccacaacatgactttgatatgctgttagtcccattttacagagaagaatgcagaagtctagacaagtcaaatggtatttcctgagttctcagttagtgggcggcagaactggatgtctattccaggtcagtctctcctccaaagccatttttttctcactgtacccactcccttatcctccgtccattgctctgaatccttaggacacatttatctacatatcaactatttttggaatccaaatttgccagttaatttccatgctatcagggagatgatgtgtcagttgcaaacacacaccaaaaatttaagaatactcattaatttgattgacaagagtgaaatttcttattctaaatagggataacattaggcaaaattgttcaaaagtagtggaaatattgtttttattgattaattggttggtttggggagaaattatcctttgtttactctgaagtagggagcatttctgattagttccttttgtcaacgtatattaaatatcaaaggagctgctgctaattctgacttggttttggaactgccacagatggacccactggtaggagaggggcttactgctagttcactagtagagaatgtagtactggattgaattagaatcaagtcttcttttcagtctgcttgttcactaacacgagcgcagacaatgtgaggagaccctctgtgccattcgtaacagaaagcagggagaagtgccacttttgtgtagcttccaacatgaagattgacttttacagtttctaaatagagttcttcccttctaaaaaaaatgctgcaattataataacttaaatattacaagcccaattttatctcacctaaatctagagggttaataaatgttttcaatgtggtttattctagaagctttgagaatctggtcacataatttgcactaaaagcatttagctttgtgaaagccacaccaaacttgccattattaactacataaatagagagggcaatttgctaatggggttccatttatggcagtttatggattgcctaactttgcccaattaactcaggcacttccaaatatgaaccggtcaatgtaaaacactgaatggttttaattcaatagaaaaacacattacctatttggatgtaaagaaacaggaaccttacatcccagtgcctttactctacagaccaggtactactgatacaaagtgggcagagcaacaacgagaaaaatatcctgctgggataaaacatgcactctagtgggagaaacaagcaatacttagagaaggatttggaggaaaatgcattccaggcttaggaacaatgggaaggaaggaaacctgtcacattccaggaacgtgaagaagaatagtgggcctggagaaccaagagccaccaaatgcttgtgagatgaggctggagaggcgggcaggaactagatcatgcagagcattacagggaagtcatacattccttatttcactaaacgccaagcatctgctatgaggtgctattctgggataaagaagtgaacaaagccagtgatgtcctaggaaggcagataattaacacgaagcagacaaatataaaatatgtcaggtagtgataaatgtagtgaagaaaacaaaacagacagagtgaggtggataatgactgggggaagggttactagtttatagagagtagttggtaggataaggtggtgtgtacatcaaaatctaagggaagtgggcctcgtttaagggttttagcctttcttcctaagagcaagtgctaagtcattgaaggattttaagtgttgaggtgacattatcagaataccatctgactggatcattcaggctataggatacaaaagagactaagaaagagtagaaacaggaaaccattgagggtattactgcagttttctagagggagatgtggtggctcagaccacataggatacgtggctcagtgtgaatggatttcatcactgaaactggttcttatttccatgtggttctaagtgccatttttgaaaaaaattctgaactaggagtaatgaggaatgattgcaagtctttgtctgtttgacctcaagccacttttctgctttatgccttctctatgaaagtaggtagtggttccaggtttttctacttcttaaggcttttgaaaaaacagatatgtaggaaagacttgaaatatgtaaaactgctacatcatataaggagtgggcagttggtattctataataggtaggatgaacactactaatcctgtttaccaggctagagaacatggagctctttattcttctaaatttctagagcaaacacagggacaatacgaaggaacccacaattcagattatttatttttcactttagatagtatgtgaatgtgatttaatattaattgacatattgattgaactcaactgacaaaaagtctatattttaacaatatctaaaccatggcctattaccaaatgctaagtttaggtacagaactaagtgtccagatccattcccaggtctcaggttctgaatctcttcataacccctccaagagctcccttttgaactctcagagaagcttcactgatggaaaggggagaaaagtgaatctccaggctccttccaatttgcaatcccagtaccttcctttgcataacccatagtttggaacatctccctatgctcagtcaagaaagaaaaaaagtcttatgtcttatgtacatgtacagtgggtaaaaaccacgtatgtactgttggtaaaagcacacagctccaggtgaagaaacaaccaatggaatcctcgtatgcaaatcatatggatgcatttgaataaaattgaaccattatcttaggaacctctagtttccaagttgatatgaaacatatataatccttgtctgtaccatattattttgcttctaacaggagttataccatccatgtgtttatttccatgacgcttaaaaacgataagccaaaacagttcatttttctttgttttgtccataggtgttcttccaattacctctgcccatttattaaaatatacattttggacatgtgggtttattcactttgtggtgaggttatattctgtggatatctgacctttgttaatcattgtgtggccaaatgaaatcaaacacatgcattgaagcagtgaataagtcgtggggttagcgagtttgatggaatcacaaccagcaatttaaaaatgtgactgaatttttcccacaattaaaatctttcattatgctacttcaaagctaatttctttcttgtttttttttttctgaatagttgcttccattaatctcactctaggtaatgatggtaatgatacaattatatgtaatcattgcctgaattcaatatgcaacacatcagtccctttgtgtggtgatcgtacactctctgcagtcctgggatttggaaagtttccatcatgttatgccaagatcagattcaaaagtctctgacattttgcataacatcagtcagtcgtgtgttccaactgtcccttttagtgattgggcaaactcatccatctgactgctgctggtggaagctagggatgaaggcatgaagcaagataagctggactggccttttacatagtttccaaaacacttaaaatattcagaaaaaaaaattaggagcaagaatttgtaaaggatcttcaagtgtacaggtggctaatccgcttaaactactaatgacacaaatcatagtctaagtgaacttatgtttttatgcaaagttaatatttattttaaaagtttaaatctgtttttctaatatttatagctaatcttaccagtggttatcattcaggatgaatctgtttctcaaaatcctgataggtagatgtgtgcttccaattcctattttttttaccactatgcagatgccattttgattcttatgttccaaagacagattttgttccacacacttacttattcaaattagttcaattaaggaataatattgtctgtatgttccaacacaatagaattgaacatgttcatgtcttctaagaattaaataataaactatgcaggtagcattaagatagtagcttatcttatgcttaaatttttttctttgcctttcccattttgtttccttcttagaatacattggagggctttcttggtctctggtaaatatttacaattcataattttactctggcctgttaatttgatttattgatcatttctctttaaaggacaatgtcaacacaagagtgaggcatgggttgcagtgggtggaatgacagtcatattgagccctgctatgttttggatatggtttgtccccatcaaaactcatgttgaaattttgattcccagttatgacaatgttggaaggtggggcctagtgggaggtgtttgggggtggtacctcatggaatgagtaatgccctctctcaggagtgagtaacttctcgttgtggcaggaatggatgaggtcctgagacagcaggttgttaaaaagagtctgactttgtcagtttctctctcttgcttcctctctggccatgggaaatagcataatagtgtttgttttctccactctcccatctccctctcttcctttctctgttgtccacttcttaaatatatactgttcaagtactattatattttcaaatcacgatctgataaggtggaagggattcaaggtaaattagaaaagctccctgtattcacattcacagagccccttctactcctgggaagagataagatatgcacttggtcactactaaaaagtaggaagcactgtattatattagaaagattcttatatgggagtaaacaaaatccaagccttctcctcaagggctaactggatgttcctgtatcaacatcaatattgaagacaattctgcttcaatgtaaaggggtacaggacagtctactgtgacctacactcagagggtctttgatgtccacactgtcaatgttatacaaccgagctattcctcaaatcttaggaattctacttctgaggcttcctctggcactctctttcacttccttcagaatatgatggcagtgcatgctgatctcctcatttccatccttcttgatggtcagggcacacttaacacttactcctgttaggttattcagccaactggccacatatcattgtggctacacgtaatagggcattttcacatagctcaccagaatcccttttaggccagcctacctctgttccaacagaactctacatgactggctaagcccttatagcatatcaagtctgagcttcgaaaggattttcctagtttgggggcactgctcaatttccctttgtttaccaaagaaacacaacagtatctggcagtatttgattagtccacctgtggtttttggaattgaggtaatgttacccctactttgtcagcccacacttcccaaaacagtgtccaaaacccagaaacaccaaattaagatcccatcaccatccataagattcagaaccccattagatccacaaattattatggacaatttctatttcttgtgaactgtgcaaaagtttcttgaggagcacaaatcaattgagcatgatccatgagctcctttgcatatcaccctaagaatgccatgagcttacatggggtggatttaagagggttggagataaatcaactagtatccagggctgaggtcttaacaggaatcctcctcactgagagcttgccttgatcatatttctgccaatccctcagtccttctctacaatttccccttgacagcatgaaaacatgggctgatctgtgtattctgacttgatgtcattcttgtcacacccagaacacagatcatcttttcccactcccatattcttccaggatccttttccatggtagttctactccttaggttgatcatcatcttctttcactcttcccaactacagagtgtaattaatctagccacttactgggacccacatctcctgaccctcccccataacctttactctttaaatgaatatactgctcaaacctattccaaaaattgagtgtagcaaagacttcaatttagtctgatttgcccaaacaatatggatacatcttgaatcactcttttggaacattagctaaatattttttaaaggctaggctagtcgttagctaactttttctttttccttttttttttttttttttgagagtaagtcttgctcttgtcccccaggctggagtgtgatggtgtggtctcagctcactgcaacctccacttcccaggttcaagcaattctcctgcctcagcctcctgagtagctggtattacaggcacctgccaccatgcccagctaatttttgtatttttagtaaagacaaggtttcaccatgttggccaggccggtctcaatctcctgacctcaggtgatccgcccaccttggcctcccaaagtgctcccaaagtgtagctaactatttttaaagtgtgtagatacttttgcaaataaatgtagttaacgtatatacatacaatttaaaaatgtatactcagactatttctcaatattgtgggctgttagcaagcagaattattttaaaaagcaagttttaaaactcaaagccaaatattgttactaaaatgtttcatgggaattggcagtggtacctagagttttaatgcctttacaaaccaagagtgtataggtattgtggatggaacatgtgactgttcaagggaaacctgacaaaccatactaacaatggattattgcactcaaagaaagatgggaaacaaaagaatccagagaacagtgcttttgttttcacgacccttcagttgtctttgactgttctttcttttggcttttctgctttgtaagagtctttgattcaaggctgtttcatgatccactgaactataaggaaaccatgggtctaaattgcccactatttcctttagtgcactgttagatgtagtcagtcctgggaacttgtttaataaaggagttttgaaaatgttcagggatcttcttttttttttttttggtatattgtataattaacaatgacttttgccttgaggtcaacatacttccaatttttcctaaataaatatttactgaaaagtgtagatgtgctgtaggcacagctagtgtgaactaagctctgagctaaatgacttaggcacatcattgtaattttcccagtaactctgaaaagccaatagcaatattttaattttatagacaagaatatggaagcttggagtgattgcagtttgtcatatgtttatgttagaatttgacttacccaggtatgtgtgactctaaatccaaattatttttaagaccttaggctctttcaggtcttttatctaaaaatgctacaaaaagaaggaaatggggagatgtagataaagatttaaagtagcagatatgtaggataagcaagtctaggcatctgatgcacaacatgaggactataggtaataacagtgccctatatatgagattaatgctaaatgagtaggttttagctgcccttgtcactaaaataaacaaaaaaagggtaactgtatgaaatgatggagatcttcatttgcttcactatagtaatatttttactatttttatgtattttataccatcacatgttataccttaagtatatacaattaaaagttatttaaaatataaaaataaaacataaagaatgctgcaaataacagtagctcttttttgtagttataaaaagatatggatatttaacattcccattgctaagcttccacactaagcaacagtaacttattaatattacccagtaaatcctaagtacagaaaagattaaggcattgtgcatttatttttattaaaataatttatgtaagttttaattcaaattaggctcagctttaggcacctagaatattaattcagaaagtagccttattagattagcttcaaatgcacagaattttggtcaaggacattgaagtaaacattttatctttattagccatcaattggcaagcatttattgagtaccttctaagcactggggaggagcttggacctgaaagaaatttccatctgttggagccatatgactaaatcacacgaaacaacttgagaaagaagcaagaaagttcataattaagtgctaatttgctgtagaaattcagggaagcagtaggttattgaaagcatcaggattcaagaaaaatgtcatggaagacatttcattttaggtagccttcaaaagatatggggcagctttgggtaattggagaagcatgaaaaattcataagaaataatgagtagaaagacttgtgttgggaagtaatgaatgaggttggataaattgacgcatcaggttccagagaatacttataataagttgtctgttttcctgcatagactgtcagctgagtaaggctagggaccctatgcttcttcctcatctgtgtcttcaagcgcagtgcctagcatggtataggagcttaataaatacagggtagctcctcagtatataaaggcagatgaatctggatttgatgtagtaggaaatagaaaatgcaaattagaaaatatagaaataaatagctatctgatttcagtgagcatagttgttaatattactggtctcatgttgctgaaaagactcttaatttggggtaaaatttccttcaatcacttatgtatgcataataatggaggtgaggagataatgggccatgattggatagtagaaaagttactttctcttagctgcagactcacataaatgctagtgatttgtttgcatttgcactcctgagcacacttcaacagaagtgaagtcgaatctattttgactagaagaagaacaaaagccctgagtggaaagtgtattaaagataaatgtgacatattcattcagtcagtcagctgaagttgagaagaagatccacaagctcagtcaagccttcaaatgactgtagcccagactgacagcttgacagcagcctcaggagagaccatgagggagaagtactgggctaagctgtatttagatccctggccttcatagactgtgagctaacacacgtttgccgctttaagtcagtcaacacatctgactggaaggcactgagtgctcaacactgtggggatatagagaaaagccttggcttctgcccttaaggaactcagctgggtgcagaaaaagacacatatgtacaaacacatactgtaagaggcaaccggaagaggattgagggcagtagaggcttcacagcagaggtgacatttgagttaggttttgaaagatgagcatgctttgcacaggtaaagaggtttgggtatcctgcattaactgttctactttgttgaggatattgacaaaattacagaaatgaaatagttgaaaaataaggctaatagtaattacaacaacaataataaaatacatttacttcatggttttaacagtatttccatatacattaattcatttgatccacacaagaaccaaaggagattggctgagcagttattgttgtacccattttgtcagtagggaatctaaggttcagagagaccaagtggcgtgtccaaaataatgattctgctttatggaaacaaatacaaagtataaatcaatgtataaaatgaaatgaccttaataaaaaccatgctagaagaggtcagaaggaagtgaaatcaattctgtagaaattttgaataaaaactgcatatggtgtgagtgatgcatttgtcacaaaggctgggtgttttgtctcaaggggcttctcgggtaggtgaatttactggtgtcagaagtcaggtgctcagctttgtaagctctcaaacctgacttagtcagcatatacgaaggtctgcctctccagggaatagtcatattattaatagcaaagtgcatagacggatttattaatttgcaatgagaaatgtcactgccatgtaccccagaatattctgttggcacagctagtacactcattccctgtaggcagatatttgagggaagctctattgtagtgaaagagaaagctgttgttgcccatagactcatacctgagagttggctagatacatttaagaggtgtttcttggcttagaggtgggatggggagattcaagcactttttcctgtgtttagagatcaccctgcaggaacatcagtgccctggccaaggctcacttgtcccccaacataagtttgcttctatgaccctctgtattagtttcctagggtagcaaaataccaaaaactaggtgacttgaaacagcaggaatttattctctcacagttctggaaggtagaaatttgagatcaaggtgtcagtagggccacactccttctggaggctttagagaagaatcctgttttgtctcctccagattctggtgattttggcagtctttgtcattccttggcttgtagctacatcactccaatctctggcttaatctcaggggggcttcttccctctgtgtgtgtcctctcttctttcaaggacaccagtcattgggttcagtgcccactgtaatccaggatgacctagttttaacttaattacatttgcaaagactctgtctccaaataagtttatattcacaggtactgaagattagaatgtagaaacaccattgtacggggcacagtttaactcaccacatgctttcttcccatgcttccattattgatcaacctcactcccaccctatcctgggtagacccattctgcactcaaatgttaatttgacctgaaaacctctttgcttataactgacctggctttttatatcaatgacttcagggaaaaagagagtaacagaagttagaacagtattcccctaaataacttggtttttatttatttttgtttccaaatgccaaatctttcctctatttctaaacctacagatggaaaatctctgcaatcactactctattaagaatccactgttagtgatgtgagcttgtggggattgataatagtttgagaagcaacctcagggttgggaggagggaaacttaggaggtgggctttggccctccctcaacccacccaaactaaaaacagtaatgatattctttgacagggtaatgctgttttatttttcaatcttctgtcaaatggaaacaaaaggatctttgccaagtattttactttttatgtacaatacaaattgctacaaatcaaactttaagggaagcttcccagcactcccttctcaccagattagtacctcctaaacctctgccctatagacattctgccaccttctgttgtttaatcactgcattctgaactgatttgtagtctctctctgtattttattttattttattttgatacagtctcactctgttgctcaggttggagtgcagtgatgcagtctctgctcactgcaatctctgtctcctgggttcaagtgattcttagcttcccaagtagctgggattacaggtgtgcaccaccatgcccagttaattttttgtattttagtagagagagggtttcactatattgaccacgctggtcttgaactcctggcctcaagtgatcctcctgccttggtctcccaaagaattgggattagcagcgtgagccaccacacctggccagcttctcttttagaggctgtttttatttacaacatttctaaattcatggtgggagggtacctatagttataccatttattaaagtgagaaaatattcatgtgaggaaatcagatattaccaagtataaaacaatacaattataaaaaatgagaggcaagacataataagcatggctgaagaaaaagtacagtcattagaaagaaatgtaccctttaagaacagtcctctgatatagaagccaggagagtttgccactcctataggctgtgaccttgttcacgtgactttccctctctcctcaacctgcttttctctaaaaggaggtattgataagttaatggctggtgtgtggggagtcagatttcttaacgttagggaagttacagataactacaaggcaaatcaaaagaaccctggggtattggatttgagtcagagacattagtgtgagcttttatcagtttaatatatattcagaaataattgtgcatgtgtgtacacatgggcagttatacatatatagatttgtatgtgtatatatatttaatacatacacattatatattaagtgtatatattacaatatctaaatattatatgctataaaaatataaaaatataggtagaatatataactatatattgtatataaatatatatcatatataatatatattttatataatatttacatataaaatatatgggatatatatctttatatctatgtgtctgtatatataatataatataatataacataatacaatacaatataacatatatcccagcttttccattgagagagactagaagcagtgatgttccagtagcaacaagtatatccaatgcctcaattttggtttttaaataccattctctagtaaaagggatattggctccttggagaaataactgactctaaaactgggttagagaaagtatgagatgagccaagagcatcctgtagtcccagagagccagggactgctcaaaacaaaaaaatgccaaaggtaccctggagacaatatgaaagagctcccaattgtcagagctgaaacaaatctgagcaacaaaataggatgggattggattacaattcacaatataaaataaatatacatgagtacgtgctgatataaacaattgaataaatgaacaaatggggaagaagtcataaatctttcttatagatatattccaaataatataagtgtgggcaggacttagtgactcatatgcaaacaatagagcatggaaaggggataaaacagtaacagaacaccccagaagccactggcttgatcagtgatcaaggttaacatcactagtaacaagtcatgttaatagcatgtcccccagtatgatatgatgaggagaacacttcacttctatggagttcttcccaaaaacctgtatctcctgcctgatatgagaaaaaggtgaacaaatccacactaagggacattttgcaaaacgcctggccagtactccccaaactgtcaaggtggtgaaaaagcaagactgagaaaccatcacagtccagtggagactaaaaagatatgatgatgggatgcaatgtgtgattcctgattagatcctgaggaaacaataggacattagtgtaaaaaactggtgtaaaaaaatgttgaaatccaataaaaatctgaatttcagttagtagtaaaaaaataataataaaggaaggtgttggtccaaatggctcagtcccttccggtataggattccacactgttctataacccagcagggtctcaaaggaagtgttgtacgcaaggacccagtgttattctttctaatttattttatatttttaaaatgcttctttttacatatacttctttttacattcttaaaaatatagggagttgcagcaggctttgctgcagataaagggaccatggacaccctgccaccagttacagcaagaagaagagagggtagagctgagtaagagatgggactggactgtggctctcaggagaatcacattctagtcctgcctgcctaatggcatatgaccttgggcaagtcacatttctatgcccaaatttatctgtaaagtaaagaattaggttagtaattatctaagtttctaattgtaacactgtataattctactggttctctgtatgtacaagtggtagaagtcttaagaatagaagatacaatttctagagcagataaaggatgctcttttgtacaccacagtgacaccttctgggggaatcaagggttgcctccctgggttgggtagcctggaaaatcagattttatgtgggaggaaaccatttagactcaattttgacatcagctgtaaagttgggtaaagcaggttgaaaggaatgaatttcgtaggtctcttttcttgcctctcattctctcctgcattatctagcatcattctgacactgacaaaaattaactgtggcatcctaagcaacttacttaacctccatgggcctcaatttcttcagttataaaatggagattaaaaataattactttgtattactttatgagaataattgaacacatacaattccaagactgcaatctgttatgtaatcctttatttgagtgttaggacttttccagcctcctgaaactcttcaattattaatgacagtagtcccttcatgttggatgatagagagggttgaagagcagaatcttggctgctcatgtctttgaaaaaccctgaattgtgtcaacaggatagatttactttttcctaatatgagaacttaaaggaattttggacatagttatagttgtttgctgaacatgatttatgtttatgttcataaatcagcaacattcaagtcactgggagtttttttccagctgccactgggggtaccaaagtgggagcaggaaaacacagttgtggctatggctggcattcaatggtagccctagtggaagatggataactggggagtattttgaacgtgggtagatttgtgttaaatggattttcaagaaaggttcttctccagccagggcttctaccttagcacatggtcttagtttattgtaaactatattttcaattataaactgcccagcctttccctctgtacatctgccctcctttttgtggccatgagaaaggaggaatctgttgcaaggcaccactgggacccaggtgtctggcagaacaactggtcccaggaaggctgtggctcctttacacatttaaaatctataaggtacttttaaaccccatactcaaagtttttattctgagcattgaatgaatgtattgttagcagcttaaagttaattttggaagaaaacttcaaacaaacaagaaatgaaaaaagctatttcataagtgcatacactaaagcatattgacacatataacttaaaacaattttcagaatttaatgaatatggtctttaagatgtgaaacatccttaaagttatatacatatgtctaataaaggaccagaaagtggaatcatatgtgaccttgaagcctttctgttccctgttatctgaacaaagcaagtgcctggagagttccttaataaatatgaactttccctcttccttcatttctccatttcaaccaaaaactgtgctatcagagctcaagctcaacaggacatctggagaagagtgatagagccaaatggagtctatgatcaccccaaattcttagagaaaggagaaacagaaagaccgatcagtcttgtgccatcttcataaaaaacaactgcagtttttgtgttctgaagttgttcacatgattagattcagccttctacaaacacttactgagcaccaggtgcctggtatgccattaggaaatgagtctatatctctcttgagaggagatgcagataagcaactagggctaaactggagctcacaaatgttctaagagggtgaagtaggaagaattaattgcagtggaaataattagcccaaaattcatgaatgacgggatatttgacctggatcttgaaacaaaagtagtattttgggagataagatcaggtacaatgacaacatcaagttatgagagcctggaatcgaaggctacaatatagtcaggtgaatgtcttgggactggatggatccacagttgtcaacacatgggctccttgcatcagaaataaaagttaataaaagttagattccataatttttaattctgtaaatgtgggatgggaccaagtatctgctgcacagtcagatttgggaggtaccccacagggataggagatatttaccgaaagtaacattaaaaaggcactttgtacttttacaagctgagggatcttggtagtccaaggagtatggattgtatcctgtagataaaacagagatttttctttacttgattgcatagtattttttggtaaagttggaatatttccacttagaaatatttaaagtattcttttaagatcctcctcatcaagaacatttaaaaatgccagtttgtgaacttaaggatgaaaacttctgactaaaaggcaacaaatacaaagacacacacacatacacacacatgcaatgtggaagtttactgttatccacaatagttataagactcttccagtactaatggatttccatctgacgatgatgtgttcatggcagcgatatgggatgggttatctaccttaggattgaaggaccctagaggtctcttatctctgtcactgatatggagatcaattcttcctgtgcctcagttttctcctatgtgagaacatcataataatgcctagtgagtatcaaatgacccagaaaatagtcattaaaaagtataaaaagaacttaaaaatctaaaaatggaatatgtaaaacccaatagtacatacagaggcatatccagacaagtgtttcagggaatgctttctgactttatagttttaggaaaataatcacatttttaattcgtttgcaaatatgtatagacatagatataagtgcattgttaagtagagaaattgtaaatgccatacttctaaacataaaagtgaatatgtaatgtaatcattgatccaagagattccattgtagaacagctgtttaagccttctggaagacgtttttggaaatatgattgagaatctattttggatttaacagacatcttcttatatttttctatatttttcttcattatcattaaagggtatcatctgctcttggttttgtgttttaatttgaattcacactcttacaataaggtcacctatcttactcagctctgtgaaactgaatctaattttagaataaatgaagaaatcaaggtgtaggtaacactcataaagtttaagaaggcctgtgttgaattgggtatcttcttgggctacttggataaatgattccttttatttaatgaaatcttttaagaagtaataaaaaattcaaaattaatggctaggatcagctgagaggtaggaagtattcctccacaacatcaagccatggatgacttttgaataatctgaaatactctcagtgtttgaaaagacctgccatttttacttgaacttcttgaaaatgttgagcttcttagaaattgtttggtatgattctctttgcttctttaactttggaaagaatattaatttatttctgccttgttgaagaatgtatctgcttcagagctgacctgattacccagttgctttcagggaaggagaagagaggagatttctctctcttctattttccttttctcatttattgagatgattgtctacagagttggtcctttttctaccccactggcaattcttgctccccattgttctaccatgttccccactgttcctgaaaatacagaatatcaactctgttaaagatgagagtcttttttttttgagatggagtctcactctgtcactcaggctggagtgcaatggcacaatcacaacctctgctcactgcaacctccacctcccgggttcaagcaattctcctgcctcagcctcccgagtagctgggattacaggctcccgccaccacgcctggctattttttttttttttttttgtagttttagttgagatgcggtttcactatgttggccaggctagtctcaaactcctgacctcgtgatccacccaccttggcctcccaaagtgctgggattacaggtgtgggccaccatgcctggccaagatgagagtcttaaaaaggaaccttttcatggcataggaaaggtagtggcctaactatctatagcatgggaccaagtcatgtggtgtttgttatatgtgcttagataagtgaataaacaaatgtgcttgggtaaataagtgaataactgaatgaacatgtgtgctctttcccaaggtttggctttaaagggaaaataaattcacagaattacaacaaggtatgagcaaaatcttccacaaatatataggatcagaaagtaacagttccaaagcttggaagggatgacagggtgcaagatttacaggctaactttatgaccgggagcctcagagctgttagagcacaggtgggctgggaccatccccctgagaccctgctcctcaaccaacttgtgtggccctctggctaggggtggtctcatgctaggagctcatgtgggtttgtcctgtaattttctctgaaacagcagaggaatactatatctgaattatcccctatcccccccaaggtttgactgtgatggcagcaataaaagtcagatggtgtcatcataattacataaatgacattagcaggaagaatgttaaaatcattactcatcttcaagtatttttgaccattcatgaatatgttaatcagaatatgaccagttcaagggaaatgacaaatcaaagccttcttgttgataaattccccaaaccctttgatcagacccaatgtccatggcatggataattgcatttggtggtaagaaaggtaggctttctgaggtttaaggcagcagaaaagttcatacctttttaacttttgttactttgtatcatagttctattaaggcagttaggatattactttttttttctctgaattggatgtcagcagacatgaactctagtcccatatccccaattcttttgttttccttggcaacaattttattaaaatataattcacttactgtagaattcacccatttaacatgtacaatggtctttagtatattcacagagttgtgttcattctgaccattaaagtgtaggtatcgctgcagataaatctgtgaatgagtttcctcatgtgtaaattaagagtagagcaatgtattcttcactcttcctttcagtgatctgtttatgcaaaaaaaaaaaaacactcattaaatacagtgaatgtttataagttaccattttggaaaatctctgctctctcgtttgcgctctctcgctctcttgccccacacacacacacatgcacacgcacacacacatgcacacgcacacacacgcacatacacacatgcacatgtgcacacacatgcacactcacatgcacactcacacacgcacatccacactcttgtgcacacatgcacacacatgcacatccacacacacatgcacacatgcacactcacggaatgcacacccatgcacactcactcacatgcacacacacacatgcacacacatgcacactcatgcacatgcacacacacacgcacatgcacacacacacagaatattcttccctccatgatgtccaacttaatttttccctgtcatgctacatccaggtagtctcaccttcactttctacctaaaattgccccccacaggctccttttcatgaatgcctgctatattctttctatcatgaacaaagattatcttatgaatatgggctaatatagttttatagacatattttgtccctgagcaagaatataagcttgcttctttcaattgccacttgtactcaataggtatttgttgaatctcttacatgagattactgagaaatatatttgctgtcttaaaatgaagacaagttcttactttgccaactgacagagtcggcttataaatgatcaatattttcacaatgaaagcactttaggaatcaccaggacagagagtaattgttaagatagtagctgtgtaccttaaagtaaaggtattattgcccagtagcacgtgatattggttgactagcattgcaagtacaaaatttcctattgctctccaatgggagttaataattaaacctgtacaaagctctttataacaaacatattgtcatggtaaattccattggccatggtggattatatctgtgatagcctccgatcagtgactaacattgtttgggaaattttctggttaagcaacatatggtgacttctgataaggacttatctaatatcatagatggcagaaatccatttttcaatacaatcaggtacatgtatattgtattaaaaaatctttccaagtgtttttaccttgactttgctaatatagttagaaatttcttttttcttttttattgaacaaggaatagtgcttcttattgatatcctagctacagtagcctaacctgaacgatagcaataacttcttggaacatgtttgtgttatcattaactgatctaaaaggccatagcttggggcttcttttcctgtaagctcaatgggacaactatcagtacacagaaatacagacaagctgtgggagtttccttccttcctacccatagacagtataataaaaatgtaaatactgtagtaaactatgataagacgaaatgcaataacaaacatatttttcctcttcacaccaggtttcatgttttctctaagaaaggatgagatgaggctgatcctcataaatatttctgaggcttatgtctttttagacctatcgatttgtatacgtgaaacagtgcccatatgaatggttgctgttcatgcttctattccttatctaccatgaggcacagaattcttgtttaatctttattatgttggactttgtcacctcttcctatcctctaccttctcagcccaatgcatcgttcttctttgatgttctcactgtgctattgtacaccctctccaagactaaagcaattccatcttgaatgttaatccaccatgttggcttctgataaaccccagttacaggaaggcctctaagatttctagttattattgctccttgtgtaacagcacacacttagcataaatcctgtccttaggtaaaaaacaaccttgatgttaccatactttaattgtcctatgcatctcttgtgaatcacatacacccattctgtatggtatataagccctggggggtaatggcacagggatccaccatcttgtcttgctgcctttcaagacacagacatggcttgttttcatgatatacaactatgaaatgtttcatacaaatatgaaatgtttctttctgcgaaactggattcttcagcctcttttctttggcctccctgcttcctcagactttgaaggtaggtttgcataaacctatccacagcataacaccctccaaccctacttgttatagttgtccaccaacctccttgtccctctctcaaatccactgagcatttataatacagcccatgctcatcatatcactttgcctcttacctcctttgaaagccaccccaaaactagaatcatgaccaggttccttgaagtttacaagtccaataacatctttaatacacccctgagtatggttcttatacaacccagttttctcttggtcagtcctatttatgcctttttcttgacatgatcagtaacagcacgctttttcatttgcaaatgtgtaatgttatcatatttctgcttgttgaccttatcgctccaagaaagtactggactcccttcattatttcaaaacttaagtataattttctttccatctagtacagaactgttaggacccccttaggtctccgtcttactcccatcttaaaaattctagctcccttggccttgtggggaattcacattgcaaattgtcatccttcattcaaaccaattacctactttctaaggtctatatctggccttccagagatattcaaatgtttatctggatttttgctactgtaaatttattctcttcatcttccctgggcctccatattagaatatgcatttacaagaccttggtcattttcggctcctatttcccataacaactcttataagatttcgtttcaacttaactttctgcctattttgtagtgaaaatcaaggttctgagtgtaaatactttacctacctaactccaaacatagacacttctctacatcatcacctatctttacttcctttgcttcaggatcatagagtttttctttctctgattcaaggctaaccactcttactataatcttttctgaaatgttccatcaattattctaatttttaaaatcttctgaattttgaatatctctttccttcccagtggattttacatatgacactcccacttaaaaacaaaatgaaaacctctcttggacccaacttctattttgtctactgtatcctcttcaatctttcttctttccttcttggacggaaaaggctccttcttcatcccctatatttggatgccttcattgtccttctgagtctattctagcaaatatcattaatgaccttccagttgtcaaatctgatgttctcttctcagacctcatcttatgggctacctttacgacatttgacaccattgtttactaatatttatttccagtataaaaatggccctattatttttttagcctcttaattcttcttgagactctatacaaatcaaggcaaggccagatttgaacagcgaggaaaagtaaatgatacaggctggagggtggttgacggaaatgggtctgtaagcatgggttggatttcatgggtttgagcaccttaatttcacactgcttcctctattatctttttatattgtcaggtcaatatgttaccttaaaataattgcaaagaatttttttttttgaaaatgtgctcaggtaacatgactgttgacttaaaactaaaggaaacaaagttaaatggaaaaaaaaaaacctaacagataaaagaatgagcagagatatcactcactatttcctatgcttagattgtggatagagatggaacaacatagggtccagggatctgtgactgaatccaggggatctgattttgtctccatttcccacttcctaatgcaaacttgaaattgagacactgtatgggaaatagatttatattcttatgctgggtctcaggttaagtagttgtatatcattagctaactttcttattatttaagggccctgttatgctaactttctatgattctataaaagtagatctaaagtagtttgtaggtatgaaagagctttataaatgtaatatattattaatctctgtcaacatacacataaaacttccaacctttgtatgtgatgaaattcaaatgtaataattatttgtcatctaacactgaaggaaaatattttacttttacacggaacagcttattatctgctctgtgcccttacaacatggatagtccatttgttttttaaaaaaagagagagagatggtgacagctggtaattcatttatttacaaattggggtcctgacttaacaaataaatatttgaggctttcaaaagcaatcactgtaatttttgcacacatggtaattttttaaagaaaattatatacagactgttttcaattatattcaaaatttatgaaagatgtcctcctcctatcctgaaagtttatattttattaaagatggtgattgaaggcttccactgaagagcattagctttgtttgaagcactgtatttctgaagcccaaattgcaaatgaaataaatgatgtgccctcttgttatacaaacaaccaccagctatcagccatcaagtcaggattgcagttgtgttaaacaggctggcctctgtctctcctttgtcacgcacttaaggttccctcttattctctggattcagatggctccagtgggcgtgccttcttggtttaactgatgccttttcaacttttgtatctttgtatgggtggaggagacttttgaggatttgctttcaatccttttcatttagcctcccttatgtcatttctttgagctggaggctatgttgcagcctggccatttacgttctggccctaaggtatggctaatcatgcctctggtacccttcatgcatcttaatatgaagctttggggcacttggttcccagttggtgagatcatcctgggattgtgtctacagctgcgtctctggcattatctcttaggattcccttaaggaagtatgttatgcaaagcatgactataaagtaacaaatttggttttcatacaccatacataaatgcttgtctcgctgttttctaagcacattttatatatgcctttctattagggatagtggcgaacaattgttgtcgattgctcagatgaagatgagtctcctaatatgattcctaaaaattcctggttttcagatgggttaattaaaggtggcagcaaccccaaaatagatttatgggaaaatggagaaaggaggctggatggctacaggagtcttagaaatgtgggcactttcagaatatggtgttcggaagtctatgtttgaaaggaagccaacatgcgtaaaaggaaatgttgctgcttgtgcaaaacctctggctattagatttctctgtcagcagacacagcggaccatttgatacacatgctggtagtcttcacccagaaagagtggggtttctgtcaaatgtttgcaagtaagtaattggtctgaaaaagaaaaatggggcctggaggaagcacaggggttctttggactgtgtccagtagaaaaaacagtagactagagatctaaaaacacagatcttgatctagcttttatcattctgtgctgtgtgtttttaaccacatcattgagctgagtggtctgcataagccacggcctggcacaaatataggtaaagcgtcaaaaataggtacagtagctcatagaagatactttaaaagcgtttgttgaatgataagtgaatttataattcattcattgaatttataattcattcattatagatctgtcatacgatttgatgcctagattttgaagtttaatgttcatctccataccagacattttatgtctgtatgttcaaattcattatgttaacaaagaatgtaggtcacctgggcaatctgtggatagagaggatgccccattagctgactgctaaattttaggatgctgacagcattgtagaaacatgttgattaggccacaatggaaatcacgtctgatcccagcagcagatgagactctgtgttattcagaaatgtatagaggtcataaagtgaggttgatttctaaacaatgataataagaatacaaagtggataattctattaaaaaaaagaactcattgaacctttgaactctagaaacaaagattaggctcaagtagttaagcacagccagatatttctgggtcagtccctatagcacttagataacagctgtgggttgacaattgtcctctagcttttctcaaaagaggaatctcacagaccaaggcttgaaaatggtatttattatgaaaacctagggcatgatggaaatattttggaattttgtacctattttgcaagtgtaactaggtttctcttattgctttgtagctatttgtgaacattgtttcctttgacattttaagtttctgggaggctatttctgaatcctgttcatttatcttctcccatttccaagttccattctaatcttcacctcaaagcagagcatttgttaccaagaacaattcaggaggctaccagctcagttcaagcattgcccgaaaatgctttttacttttgtacacggattcgtttgtttactcatctattctgcacccaccacgaccaagcatggtaccaggtgctatgctatgtactggaaagggagagatgaaacatgataggcactgcctcgaaggtgctcacactctactacttcacccactgtaaacaaactctaaaacatggtgagagttgtgctatgataagagcaaggtgtcctgagcccaaggtgtctcctttctgagtatagggcaagggagatgatcagagagggtcccagggagaggcaatatctaagctgaaatataaaagagagggagagttaaccaggagagaaatgatgcagagggatggaggtagaagctggggttggagggattagggtcccatgaaccacatgtgcaaaggcacaaaacagagaaagtaatacccttcagtaaactggatatgggagaagtgggcatttattttactgtgattcaggaaaggaatgacaaaaataaggtgagaaatacagtaattactaacttcacccatttctactcctttgaatgttaaacttgtatgatttattattattattgcttatttgcttgactagggagacaagagccctgtattttggtgctagatttgaccatttcaaggtgagttatactaaataaatttgtaatatctgggcttctttttcattatacctttctaagttattttagaattggcaaaacatatgtcattttgtgtggaaagtttttgtagcttcaggatatttggaaaactatatacagccattatagaaaacatagggagattcccccagaattaaaaacagaactatcatatgatccaacaatctcactactgtgtatgtatcttatatatctaaaagaaatgaagtcaatatgttgaagaggtatctgcagttccatgttcattcaagggctattcacaatagtcaagatatggcatcaacctaagtgtccatcaaaggatgaatgtgataaaaaatgtatctatacacaatggaaaatgattcaacctttaaaaataaaaagaaatcttgaaattcgtgacatggatgaacctgaaggacattatactaagggagataagccagggacaacaagacaagtactacatgatctatcttttatgtggaatcaaaaaagacaaactcatagaaccagagaataaaatagtggctaccagaccctgggataggtgggtggatttgggagacattggttaaagtatacaaaatttcagttagataggagaagtaagttcaagacatttattgtacatatggtgtctatagttaaagtgtattatatagttgaaaatagctaagagggtagattttaagtgttttcaccacaaaaaatcagtatgtgaagtagtgcatatattagtttgatgtagccattccattatgtatacatatgtccaaaacatcatgttgtatgccataaacatatacaacttttatttgtcaatttaaaaagtaggaaaaaaaattttggctgggcacagtggctcacgcctgtaatcccagcactttgggaggccgagatggatggatcacgaggtcaggagattgagaccatcctggctaacacagtgaaaccccgtctctactaacaatacaaaaaagttagctgggcgtggtggcgggcgcctgtagtcccagctacttgggaggctgaggcaggagaatggcgtgaacccaggaggcagagcttgcagtgagcccagattgcaccactgcactccagcctgggcaatagagcgagactctgtctcaaaaaaaaaaaaaaaaaattataatgataattggaaaaccctaacccagaaccagaactctagtagataggaccacatccaataacagaggccaaaggcaaaagatggtgaagttcatttgcagtgaagtcctgcagggcaactggggaatctatcaacaaagagatgctgtagcagtggtgcacctgtccctgcgaaaggctctgagtctcagccatgaatagtctctcaccacaaggccatgctcaccaaatctgaggctttgtgtagctcagtccttagatgagctacctaaaaactaacaggaaagaaaaatacaagagaaaaaacaaatttggtaaaatgctatgttgcaacaaaattataccaaacctacaacatagttaagttcttgtttaagctaaagaaaaaggatcctgggttaagtaggccaagaaccctggcctgggagctctttctggtagaataaaaatctgcatagcttagtaccaaagatgatccccttgtccactggtatttatactgttaggaagtcaagtacagaacaataattaatatgcatttagggttcagtttatttctggcaatcttttctcttctttttcgctacctccatccctatctttcacaacaacccctgcaaggtactttgctgttgtgaaacacggaggggcacctggattgcaagatacctgtaattatctccattttattggagagaaaactcatcctcagagagtataaataatgagttcaaggtgatatatgctgggactattaaaatgtaggtagattgtataatccgtatttgatatctgttcaattccaagctcatgttctaacacatcatgctacttatagtctagaaagactgactgtctaattccaaaataaccatttggctttaaacattttgaaaacgttatattaaaaattagaacacattaggataatagagtagtatcaagaagaggtcaatggtagaaaacaagggcctatcacaggggcatggctctaaatctatagggtacagaagggccaagaggctcatgtcagtcagcagtgacatctcccagtgaccgctggaaggaacttgacctgtgtgtgctggcctgtgtgctcttcttcgatttaattccagtggtggggatctttcaatctcccaacaccagatgctttcacagaatgtatgctattttattttgaaatctcctatcagttctagtcaaatatatgttaaagattaatacaactactaagttactggaggaatcattatgcagcaaaattactataaaatgaatttaaaaatggacttcgaaaccattagaaaaatggggaaattatatgaatttgactattcacaggaaagaaactgtataaatggataatgtatagtaagaaatattttcaatgcagtgaataagcaaattaataagatttttaatagcagtgagatagatttttttaaactgttgggattacagaattaaaaagaaacaatgcatttgttgtcctgagaatgtggaggaataggcattctcagaccctggtggtgggattgcccatcagccagatttttggaaatcaatttggcaattttttaaaggtcttaaaagtgtttgctatcctccaccttgatccagtgtttctctaaggacatcattagagatatgtgtaaggatatatttacaaagatgcttattgcagctgcatttttaactgaaaaaatgggaaatatcctatattgccatccatatggaaatggctgattaaagtgcagtataatcgtaagacagaatatcatgcagctattaaattatcaccaaataattttattgtacatgaaaatatactcatgatgagctgcagtgagctatgctcatgtcactgctctccagcttgggtgacagagtgagatcttgtctctaaaaacaaattaaaataagataaaaatatatgaatgatgtaatgtgatagaaaatttaggataaaaaaacagaatgtgcagtgtgaacttgtatgtgtgcttgcaagcgtgtgcacacttgcatgtgcctgttgatgtgtgtgtgtatatatgtgcacatgtgcatgtgacatccaccaaaacatgaggggaagacaccaaaatgttcattatagtccttctggttgatgggattgtgattttaatttttaaacatttcttcatattttactgtatttttcaaactttctgtaataagcaagtatttatctcagcaaacaaaaaaagtggttaaaaggtatttaataacataaatcccaaagggaatttttgtaagagatttaaaattaggatggctcaggttaatagagtagtataaagaaccggccaaaagtagaaaactagggcccatcacaggggctgctttaagtgatcttagaaataactttattgtatttccagaagcactttccctattttgcctctgacatacacatcaatggtggaaggagaggagacaggatgctgactgggaattaaggcttacagaggagagagttggtctctaggagattttatgtgataggtttggagataatctttggtttccaaaacaataactttatccggctgatgagcacatgaaagccaaagagttgattgtatgactatctatatgccagtcattttacactgcgactttatattccttttccatgatggttactattatcctacagacctatttatttatttatttgtttattctgtctccttattggacgataaagatataaggatgagaccttgtttatttatttgtttttttattttgagatggaatttcactcttgttgcccaggctggagtgcaatggcgcaatcttggctcaccgcaacctctgcctcccgggttcaagtgattctcctgcctcagcctcccatgtagctggtattacaggcatccaccaccaaccccggctaatgaggccttgtctatttcactgctatatgctcaatgctgagcacatggcttgacacacagaaggacctcaataaactgtttttgcatgataaatgaattaataatgaattcattacaaatctatcatagagtctgacctctagtttttgaagtttgttcttgacttgccaaggctgttggtgtgctctcagactttaagttgccaacagacttagatgttggggaaggaaatgaacagctcttaaaaccatagcccctttgattttgctgccattatttaggagaggatggaagtgccactaccccactacattctcactttgttcttctgacccagtaaaaataggcatggggaaagatgtcatctttgtgttcccttgtggtaatagcatggcatgtgtcccacctgctgacttttttttgatacctgctttgctaacaatgcctgacttttctgtataatccctgacttttctgtatctccaactagaacaaaccactttctatgtgtacatttgactgctctgctcagtggactataaaagcatcaaggtaaaatagtttcccacttaatttttttttttttgagacggagtctcactctgtcaccaggctggagtgcagtggtgtgaccttggctcgctgcaacctctgcctcctggttcaagcaattttcctgcctcagcctcctgagtagctgggactacaggcacacaccaccacacccagctaattattgtatttttagtagagacggggtttcaccatgttggccaggatggccttgatctcttgaccttgtgatccacctgcctaggcctcccaaagttctaggattacaggtgtgaggcattgcgcccagcctccacttacttaatttttaaaatgagcctgttaggtaacaatattaagcacaccactatatgtgtgtaatataatatttttatattgtaatatattatttgacttttacttgtaatcgttagcaaccatttgtaaaatacctaatttgatgctagcactatagtaagcaatttacatgcattagctactcaatctttaccataaccctatgagatatatgttataccattttacagatgagaaaagtgagtctattgcaacccaggtgtgactgatctcaaagcaggtagaattctctccatattccatgcaagaatcttgaaatactaagtatcctgagtatttcacagtatttagagctgggactagcatcaacagtacatagcaaatagtcaagtcacattgagaagcttgattttctgaaacactcatgttggcattcttaattttcattatccaacattacatagttaccagtgttgcctttcattcatacaccaatcgatatcctaattggtctgcctcaaacctggaagcaaattgcctggcaaaggcagagggagagctgcagatggatatgtttaaaagggctgagtgtgtagagttgctgagcaaaggagagctctgcccctgtgtcccctccttgtgtctcacctgaagcttcatatttctgttgctgttcttcattcagcctctcattatttacagttgtcctctaagggaatcagagctcactctattccatcttttttacttttgaattaattttcctaattggtagagagaggccatttgggatacaaaaccactttagtgcctagccgggaaatttctgaaagctctgtcagtggaaggagtgtcgagggacttgtccaagttgatgttcaattctttcagcttctctaggtcagttcttttctctcgcatagcatgtctttcatttattatattctgatgccattataaactagccaagggaaaaaggacaatgtttaacctctgcttacatggactcacaatgcagactgtgcaaaacaagactgcagggctaatatcacagtcagagagttcaagaagctctgaaaaccatgggaaccagtgacctgttcaaaactgaactttaattctacaaggaagagagagcagaggagagagaacaagaaaacagaaagcagaaaaggacaaagcttcaagagaccaccctggccacctggtgccacttggggtctggggtgcttgatggcctcttaatgttttgaagcacagccggcagcatgaggaaggcgtgagatacagggcagcccccatgcacttggatcctttagtttcagcttccagcagggaagtgcttaattgcatccgtgattgagatgatcatttttattgtgttcagcccagagttaaggagagggggcccctccttaggcaagttttgaatttcaggttatttgtcatctcttagccattatcaatggtgctgttactgtcatcatcattatcatcagaagggaagtgttaagcctataattacatgtggcactgtgctaagtgtgatacagggaagcacttggttcttgccggccaggtgtgcataatcaaaacacactctgtgtcagggcagaccaaaagtacaagttttgcacagaaaggaagatgaaaacactgagtaaataagcaggtcttatgaagatataattgcctgggttctgttttaggactacaaactatcatctggggacttatagtctatttaaatactacctctaaactactgctatgctcctggcacagccctaagtactttatatgaatcttatttaatccttgcaacagccctatatgacaaatgctatgactatcgctaacctacttaccaggtggcaatgttaaggacacactactagtaagaagcagaacaaagatgctgagccagtctatctgaccacagggtccatggcaatgataattgcattaaaagcctctcagagccactgcaaactttcatagcaaatacattttcatagcaaatacactttggggccagactttgagtgcatttcattatttgaaaatttcgatgaacattgtgttaatgatcatataaaactcagccaaacagacaaagcaacaagagagcaagaaagaatgaagcaatttatttagggtagtagaacttttgaagttagctctgtaatactttttaaatgctgtaatgttataaaaagaaagaaacacagaacataggtagaagggcatactgaactgggaaggaactgctatattgggaaaaagaacaacattatctgaaggatgagtgagtgagttgagaggctgaaataatttggataagcatctcatccatttgaattctgattatttataggcacactcatccctaatcctaatgttggattactgactattaggttctgattattccattaaaaggattcaatgattgcatgttaattaaggattcttccaagttgatactaatataccgataattctatcctctctctctctctgacaatttactttgagattccatttatttaaaagagaaatgttacggatataaaagatgttgtctttgatagtcaaaatgaacttactaatttgtttgtttagttttctgttggtttgctgtagaagttggacagttccagcttctctccaaggagtatgtatcttatccacattgaattccttattccatctaagatatgatcgctacataggaggaaatgctggataatggaaggattattggactagcagttaggagtactggattctagcctctctttgctacatctacaaaagcaattacagaaagtccctcaatctccttaggtttattttgttatttctaaagaatctagttgggttataccaatgattctcaaaactcactgtggattagaattactcagaaaacgtttttatcatgtatatataaaatatatatatatatctgctatcagcaaacaatcctgcataaaaaataaaaaaaaacactacattttttcttttcttttttttttattgttgtttttgagaccaagtgtcactttattgcccaggctggagtgccgtggcatgatatcagctcactgcaacctccacctcctggggtcaagtgattcttgtgcctcagcctcttgagtagctgaaattacaggcacctgccaccacacccagctaattttttaaatatatttttagtagagacagggttttaccatgttggccaggctggtctcaagctccttacctcaagtcatctgcctgcctcagcctcccaatatgctgggattacaggaatgtgccaccacgcccggccagcactacattttttctgaggctgacttccgagggctgctgggaatccctgcagtcctttagccccaactaaaacggcactcctaaaagtgaattgggttaggccagtatgttggctgtgcttagggttcttggccattcatacagagccttaatgtgtcatcaatctaccatcctcttcccacccctgtcacccactgacattccatactgattccttcttgaaggagctgtcttttctggattagttcatacatgcaggagaaggagttctggcttagaattcaggctatctgagttctccttctatctgagttctgtgaactcaggttaggcctgagttcacaggccctaaccaggtctgtgatctcagcatacaacttacccttcagtgcctctgtttcctcatctgtaaaaagaaggaatcctttcttgctcttcaactctatgatccctgctcagaccttgggagccactgcagtgttcagctgctctcagtttactgttttctgactcattcctctgcaggggcccttgcaaggccctggcctgcctgccccatacccgcaggctatgtctgactgctgcagagcagcgagatcccagggggctcctcttttctttccttctttgcgtgtggaacaagtaatctggcacgttggcggttttctgggcaacagaaaatcgcaggattgttccctgatagcagggcttttctgggcaacacaattctgaaactgtcctcttgctcacttgtcaacccatgacggacagtaaagggaagaggagggcctttgacttcactggtgggcaggggaggaagctcttgaagacataaagggatgtgactgtggcagctgctctgcttgttgaaaccttggtattcttacatgtggcttgtgattgaggttctgactcttgtacttggcatggtcttttgtgtgatagatggtgaatataagtaagtctgatgcctaattaagaacaccatacaattacccatgtccatacagatgatgtggctgtcaagaaaaggcttcacctggaagagggatgaagataggattttatactggactgtcgtggaaaaatatcagcatcttccgtttaactccatgagcctcataaagactatgtcctagctccctgtagtcctccttatttatgcatatgatttgactttccttcagtttctctgagcattctactatttcagtgataggtaaccattttttcatcttgaaactgttctaaaatttgcactttttgattgttctttaaagatggccctgaggcattaaaaacagggaagaggatgggctcacagatgggaggctaaatggaattacaagtgaccaagatccaaaatattatactactcccctcgcccctcctgcctgccaagtatgttctgcctattcatctgtgtccagtaaagtgtagcaagtatcagaccacatgaatgaatcctctccctgctgagaactgaccgcaagagggctcctgggaacagaagtccactgagcttctgcagattgaccgagagttgtctagatttgtaaacaggatgaggaagagactattccacaacctttggtgcagaggggaatgtgatatttagtagaacaaggcccataaagctaaataaaagtgttttattttaggtcattaaactgtatgtcatataacctttaaaacagcatgcattataaatcagcagctcaggtttatagggtagcttatcattcatttaacaggcatagtgatagtacttgaggctcgggccactccttacctctttctaaattaagagaatttctaaatttcttttttttttttttttttccaaaaaaaggaagctcattctttatgggcttctgctacccccagcccagtgttcagccacaatgcttctcactgtggcagcagatactaacattcagatgctcagaaaacacaagcagtgaacagtcatccagagagtacaggtggtctctaagggagaactttgagagcctcaaaactacctttatatgtaatggacaaacatattacatgtctccagcggacttttaacccagaataccacccatcttagggtttcgctggtgctgttcttccacagataaaatacttaaaagacatatttatttaactgtctttgcagaaacatgagatgatgtaaatggttgccaaatcaaagaagcagtacccaaaagtacattctgcatgagtccacatacataaaattcaaaaacaggcagaacttttagtgccactgaaagatacatttaaaaatggttaaaattgtaaattttatagtatgtctattttacctcacacacaaaagaacaaaaaaccaaacgcctgaaaccaaaacctcagcacagttaatctaatgagtgacagctcaggagattagctgccattgggattatcaatgactgcaaggaggcatgagtgggacttctggatacacagaagtttctgtttgtcatctgaatgttggccgtacagctggctcactttggtaagatttattgagctgtatgctatggcaagcttacttttctaggtaagtgttttgcttcaggaagacatttatcagaaagtaagaaggtgctaaaaaaattagttgatttgatttaatttgactggggtattggtcacaagtatgaaaattcattctattcttcaggtgccacaggtatttgggcagagataattgaataaaattatgtcagtgaatagtatttctatttttttccttgcaaaaatcaaatttggtttaaggatgacagggcaaggttttgtctgcatttagaccacagcattgccaccctttgaagttgccttatttctttgaagctgccttatttctttgaagctctgaaagcacgtggtatctgcaacaatatagagagggctagtctaatggtctgctcttagttacatggcacgtaggttgttttccttaaaagccctgcctccgtgtggctctgtgggatagtgagcttcctgtcatctactggaggccagagaataatctagaagggatgctctgcagaggctgcttatatcgcagagacgttgaacaaaattatctacaatgtcccatgtaattccaagattctgtttctaccattctctaggcgtttatagacaatgtttattaaatatgggccctcatctctgtgtcagtttcttcttcggtaactttgtgaaggcaagtcctaaaggttaaagaaaaatagcaatccttttaggacacttgtattggtcttttaaggcatttcacaaattggatggcttaaaacaagagaaatgtattctctcacagctgtggagacctcaagtgtgaaatcaagatgtcagcaggtccattttccctctgaaaactcagggaagaatccctccttgtctcttacagctcctgatggccccagccacccttaggactccttggcttgtagctgcatcactccaacctctgcctctgtggccttcttccctgcatgtctgtgtgtctctgtgtcctttcttcctcctacaggtacactagtcattggatttagggcctaccctaaacacaggatgatttcatcctgagatccttaattatgtttgtgaagaccttatctctaaataacatcacagtctgaggttccaggaggatataatttgggggatgacagtgtattcaaactattgccaacaccttcttggaaagaaaaagaaaaaaaatcaacattaaaaacctgtaggatatccaataaatgcaaagtgagtgttgagagaataaagcgttgagtccactctcaggaagggtgagggctccgacggggaggttatccacacgtccattcgttcagtgaattattactgggccctgagctataccaggcactctgttaggtactgagtgtagagcagcaaaataaagaaacagagaccatcctcatggcacttatggtccagcgggggagatcaatattaatctaaggaacaaaaaaaaaaaagatcactgcaaattattgaaaaatacagtgcggcatatcattagagagaattatattgagaagaggcccagcttttgatgtggggtctgtcagaaaagttttctcagaggaaatcatatttaagctgaaaccagaggatgagtaggagttagccaggtaccgactggagaataacactccaggtaggcagagtggtgagttcaaggggcgggatggaggtcgctgtggctaggatacagtgagcaaggcccggcagggcatgggataaggagtgggtgcctggagcctcatgaacccctggcagttcacagtcaggatttgggggtcccttcaacaagaagacccagaaagttagaagaagaggaatggcaagctctgaattctattttaagatgactctcctgcttgatgtggagaaaggagggaccaaaaagtgaccccagcaggctaggtatgatacggtggcgcaggcagctggagcagagaccctggtgccaggaaccattagaaacatattcctgctactgcagccagtcagctgaccagtgtatttcctaggctgagaggcaagcatggctcaatagagatctgtagagctccatcatccatatggaattgactttcaaaatgatgaaatagaactaattttcaagtagctcttatctaaaactaacaaagggggttttacttgagttctatgagcgctctatgctcatttgttgttaaatttttgaaattattttctggtttggaatgtagatccagaatttgatatatgcagatgagcatgtgctaacatggccgtggtgttagctagttaagatccggaagtgctatcacacaggatgggaagggcctcctagagaagtgagagtctctcagacctagaaatactggcacatgatacctctgaacccacggagtacccagtatacaccaccaggaagctgtgtggcacactgtttttaaatctcaattgaagcagtcttggacaacaacctttgttttctatctagggaggatctagactttaggtgaatgaaggggagatgaaaggtgagaaatttaaggaaaggtgtgttctaattatgaaaataatttgtatgaccatttaacttgtgacacagagctcttcctgtgtggttaccaattctgtacttgcaggtacaagtctgtttgatgtactaggtgcacatgggaccccttcctcgggatttcttaacatgctgctgtttcctactccttgtgtcattggctgggagaatgttcacaacagactctggcaaatgagttcatcctccttgcagataatcaccttatagaagaatcacattgtcttcccagccgaagccctcttgtctgaaggatacctagtgttacgtgcgtgtgtaccattccaacctcagttcctccccatccccttaaaaagatgtgcagtgtatgatccctacagataatgtaggaaaaatctgggtttgagaggtgggctggggcagagaaggccttagcagagggcctcagtgcccatctgcttagtattatccacatgagtaagttgtttccattgaaatcaacaggaccgtatggcaatgttcgaatctgaaattatttccaatggattcctgtgtagttacaactctatacttgcaatctttgtgatttcaatttggaaagtcattcaagtgagtaatttaatgttgggctgttccttctgttttcccttcaagctcaaaaaattctcaaaataatgatattataaacaaactttgactgtgcctaacaggacagtgaggggttacagttctgtttgttccaaatataaactatcaggtcagatttgactttatcaactaggcactgggttttatgaagacaaatccgacttgtgtgaagccaacttttaactcctagataatatcttacctagaaagagataatctgatttatcttccaatgtacaatgggcctttttcctaaggcacagtgaggaggacttcactaaggcacatatcacaacatttctcctctttcatgccccttaagccccctaatttttctctaaagatgatggtctcttggttacagaggtaccccaaatcacttttttaaagtaagtaaatggccaggcacagtggctcatgcctgtaatctgaacactttgggatgccgaggcaggtggatcaccagaggttgggagttccagaccagcctggccaacatggtgaaaacctatctctatgaaaaatacaaagattagccgggcatggtggcaggcacctgaatcccagctacttgggaggctgaggcaggagcatcacttgaacctgggaggtggaggttgcagtgagccgagattgcatcactgcattccaggctgggccacagagtaagactctgcctcaaaaaaatttataaaataaataaataagtaaataaaataaagtaggtaaaatgcacattgcattcatgtctatgacaattgtgggtgcacatggattaaagagctctagaattctaaaaggcttgctacaaaacatcattcccttgctgttccacttccagtctactccccctcccaaaaggaaccactttgaatttcaatacaagtttattagggaattgtgctctatatctctaaggaacatgcttatattgttcctttttaaacttttttccagcttaggctttatctgctaacttccatctgtggcagagatagagatggcttcctttcctacctttcaccattcacctccaccctcaatattccttctcatcctcagactcccagtaaagttatatcttaatttgtttagatcaatattcagtgttctcactactgagttagaacatactatggttattatttatgtagtataatttccactctcccaacccccactccagaattcataattatcttgtgctttgttttcatagctttaacatacttaagtcttcatcatctgcctattcgactggtgcaaaagtaatggcggtttttgcaataataaatgtcctcccaattgttcagacgcatctgtccatttcttctttttgaggaactctcagagactcctgacctgccctcacctggatgggttggctgctacacactgagcagtgcagtcactaagggtctcctttcaccaccattttgaggatttcctgtacttccctttcttactgctttaccaacttcctgactctcctgtctgctgtattccctccttttggtgggttatatttttcagtagcttcttgagaaaggattcatgggagctaaaattaaaattttatgtgttagaaaatgttttggttccattttctcacctaatttgtagtttggttaggtatgcaactctaggtaaggaaatgttttcttccagaatttgagagcatagctctattgtcctctagcttccaaggctgcttttgacaaagtctgatgaattctggtagctaatcctattagattagctatcgctacccctccctccctttctctcactctccggaaattcataggatgttctcttttgtctgcagtgatctgaactctccttatattgtttgtttgtctttttgctctaattcttaggctgtgtctttatattcaagtgaaatatttctattggcagtaaataataataaaaatattccaaaatgcagccgtaataaattagacacagaattcaacacaaaaaccattcagacgctttactggtgatcctgccattaaggatgacacaaaccctgtctgttgttgcctactaggataattattgcagatcagtgaggagccagaacaccaaggcattgtagaacgccaacagtaggctagaatgtaaaggaggaaaacctagaaaagagcaggtttggcttcagccgtccctcagacctaattaccattcccaaagggacacgaacaccatatttaaagcattcatctaacttacagagggtgaggcttggctgtgggagggccctgcagccagcatacctgaggtcagatgaatcacttagcatggctttggaatgttctgtctgaggctggagtcaggctcataagggcttctttgcattttaggggcccagccaagtagactaatgcaaggaagtctttatatcccagagtaaggaattgtggcataaatcaagaaggcaatgctgaaaacccaaattacacagatgaaatgaaccagagaggtaagggcaaaggcgagcctaagctgaccctcaggcatcctaagtgcttgatcggagacgacatgattcatacctaaccccaccagctgtgagccactcataaacaaccagtctgtcaacactgtctcagaagtgggaagagttgattctgcaagctgaaactcttcaaaggtacagatgagtatcctgagaagaggcagaaaggggcaatagtgagtatttcagacctctagagaccatccatcactttcaccaccagatatcaactttattttacctttcatggatcctgttctcttgttttcatagatcttcctctcataccttttttaaaaaatacagtctcactctgttgcccaggctggagtgcagtggtgcaatcaggactcactgcaattttggcctcctgggcctaaacaatcctcctgcctcagcctccttagtagctgagactacagttatgtgccaccacatcctgttattttattattttttttaatagagataaggtcttactatgttgcccgggctggtctcaaattcctgggctcaagtgatcctcccaactcagattcccaaagtgctgagattacaggtgtgagtcattgtgcccagcctcataccttatttttaatcctttctcaatagccagttttatcttacctgtacctatatttccaaaaatttgcctaaatttcctgtggttgctcagaactctacagctctcctcaatttcaaattgtaacttgaaattgaacctgaaatcttcctaagatttaccaacagaccagcatgatcagtacatcctggttattttttgtcctttggcaaccatttgtatgcttattaaaacttgtctccctctttcatagcagcctaaaatttcttgaagcaaaggctgtctttcattcatcatgtcactcaaacaccctatacacacagcttcagcacaggtaaaccagcacagtgagtaaacctggctccatctgacccattctacacaattccttcccctagacggagtcttggtcttcactactaaggaagcctaaccttggaaatggacctgtgggcaaataaaactgttttctcttccagggatgtttccatttgaaacttcagcttgatggccacatgaaatgtctttctcaccaaataaagaaatagctaactatgagggttattttcttcaccagggaacctacccgatctctttcaaggcattccctgtaggcagcttcccactaggccacaaaaatcagagtctgtcatgattgattgatcaagaaatacctgcccacagagggccacacttcctctgaggctcaggcacctttttcaggagggaaggaatgctagactcagggaaagggctcctgaccatgaaatgctcagaaagttggtgtgtgccagggtcagagcactgctgagagcgccagtgatcagtacacattccatttccctctgtgcccagcactgccccttgaagtcactgttctgtcttttcagaatggaaaaaattagagaataacaagttgctcaaaagcttcaagttcttgcaagaatgtcaattaggttagacggtgacataatagaataatgttcatatggcaattccttacagcacaatgatcccaaataatatcacctattgctacagcctgtgccatgcgggctgccacacataaagaagctggcagtgtgtgataggcagtgggagaagctgaagttgttactacgtaatgagaaagatggtgtaaataccatgtcttggtttgtgggggaggtgttgcctgtggaggaggtatgcgactcatgggagagggtggttttatcttactaggagtaaagactcttaatgtgttcaacaaggtcgatgattttgactaagatggcatagccaatacatattacagaggaaaaaaagactggataaggcaattgagataggaaacataaactggaaatgaaatacatatcagtatagatcagttcacacttgagtcacgcatcaaatgttcatggtttagcctggcactagtgggtcttgatctaccaccacatctctatatgctcttatgaacactcttacacttttcaaaatcttcttacatacattatcttatttattaggggaaacagaatgaactgctaatatcattcccactttaaagataaataaatggaaggacagagagattaaactaactgctcaaggtcacactgatagcaagtgatcacattttgaccaatattgaccatgatgaatgaccaagtgttgaacactaactacaggtaatatgttaattcccaacagccctagcagatgactagtgacattgtttctgttttgtagaaaagaagtatacgtggcttgctaatgtcacacacagctggcaatggcagagatcaggttcaaatctagatatgcttgcctccggagtctgcaatcttaaccactatcctttctctctgtaatccagcaatttgcctcctcctggaagaatctagtgattcttgcgtagtaattgtgatttttctattaaacctcatctctttccaccatggtaccttcattttaattgatttcactatttgtagcatcatctcacactttttctgttagtcacttttaaaaagtattattccatacaccccacctgcctggtctcacaatgcacctgattctccagcattatttatatacttctcccttccttctctagttatttggaaatatttttaaggcagaaacaatgttttaattttatattacattttattgtttttgcattgaaacccaggtctcccaactccaaatgtaatactttgatcaaaagcacaggctctgaagtcaggaagactcaaccaagttcatgttctgactctgcctctgactggatgaatgactatggccaagctatgtggtctctctgacccaaaaattactcatctgtaaaatggagctagccaaatcatagatcagatgtgaggaatattctaggtcatgtataagctattctacatagtgagtagcagatttagaaatgactcaatagaaactgctattggtgttatcatcagtattaattatagttatgaaaagaaagctgccagctttggaaaactcctaatgcttaaaatttctctggcttaggaaatctctggatgttttctaagagtctaataagtagggatgtctcacatataactcagatggtttgataaaagccagttcttgaatatgatgctggagtcagtagatagattgtcacagcaataatagatatatcacagtcaatagaaagctataagaaatggaaatccaaagtgattggttatggaaatgaaaaattacttttccctaccttgaaaacaggtgatgtctttcagccatttactgtcatttgaaaatgaaaatagtactatttttgttaaaataactgtgactgaccaattcttttttgtaatatgttcaatgggaaatttcttagttttctgagaccattctgggctaataaattagaaagtttccaagagttaggataaggactttgaaatgtgatgacctgtttcaacatgaagctgacagtgtaatgaataacagagtttcaggatcctgaaactttgattgcttttccttttcttatttgctttgttcatctcagagaagaaaatgatccacatttgtaatatcaccttatcctgcagttggacattaaacatttattttaaacattaaaactgctgagcttgtgagtttataacccatagatacttctatttatttatttttaaattttaatttctttatgttgaaattgcaaaatccagtgaatcaaaggaaaatgatacctggaaattgtgacttttcatgaagtgtaaccaaatacagctggtcaggagagcatgaagcagggattttgttggtggtgccggctggaatggcagggctgaaatgtacacatttgttattggatgctttatggtttggttatgtttggattatggtttttaaaatatctttgggttttgaaaacccagaacaatgtattcataatccatggtccatcagctttattgtggctttcatttcatagagaaagagtggttttgcatttgcaatgaattagctgtttattttcccaactctcccatttcattatagtgatacaatttattcacctaacgataaacaaatttttttccaattcttggtcagtgattggattacactaaaggaattttgttttcagggtgttggtgtgtatccataaaacaatataaattttgtattgatgagggaattgcctttcctatttaattatgattgtgggccccgtctctctctctctctctctctcaatctctctcaatgaatgaaatacagaactattgtgaagagataataagctactaaaaagcattcagtagttgttactgttataaattattcattccctgtggctttagaaataaagttctttatcttttcagaggcagctcaagggtagaggcatttaggagatctctcaccgagtaggcagactgaagatttctccctgtactgttattgcttatgtgctccatctcttagggcaaagtagtttgcctttcttctcccaagattgttatacatgaaaatataaagatcattgtattttgatgcatcttccaggaatgctgagaggtaatgaaaagagacaagtacaacccatatgagagatcatttcctcaactctttgttaagatagatgcattgtaaatgggaacatactgtggtgtattggcaggcaggtcatctgagtctctggatgtagagaattacaatgtgcctctgttatgtcattttattttgtactcacatgagcaattgcaggaatgcacaagctaacatatcagttatgaaagagcccaaatgagggcctacggatgaatgagtctccatagccaatagttgacagtgcttagagtcctgaaggatgatttcattgacttgttgcatccttcatgcaaacaaggattcgacagctgtcaaaagggcagattggtctctacactctccagggatctatgtgaatagtgtctgtttggagaagtgattagaaatattaatgggctctgaaaacaaatcaaaaagcatgtacctctaagaccgggctccctacagggtcaaattcaggaaaatcggattttaacaattgaatttgttttggttcttttttaaaaatttaagcataatctctattttgaatgaaactgttataagagagaaaagtaagctttactgaaataggcagtaggtagggctgaatttagtattctgttttattgttgttgtttgttattcgcttgctttgtgattatgcctaaatctagaaagcccaaatgaagcatcattcccttaacatttgtcttctctttccttttatttttatttatttgagacagagagtcttgctctgtcacccaggctggagtgcagtggtgcaatctcggctcattgcaacctctgcctcctgggttcaagtgattctcctgcctcagcctcctgagtagctgggattacaggtgcccaccactgcacctgcctaatatttgtatttttggtagagatggggtttcaccatgttggccaggctggtctcgaactcctgacctcaaatgatctacctgccttggcctcccaaagtgctgggattacaggcctgagccaccatgcccagccatttgtcttctctttcaatgcacaaaaacaggaactatctctttgctgggttatatattcaaattttaacacaccaaattatttcttcttgtgggattaaagttttagataatgctaaagtcagtgaaagaaatatttactgttttcagagcaagagggattgaatggagagctgtggcccacagtagaatggatatttaagaagcatgtggatgttcctggttagaatgttaatccataagaggcaaatctaagggtagaaccacagaacactagacctggaaggatcttagaaatcaccttatccaagttatttactttcagaggaagacagagacatgaaaaagagagaattgcccaaggccacacaatcaggatgaaatcatcaggagtagaattcaggtttcctggctttcattgttttataaatgtcttgaagcactgacttaaaaactgagtaaaatccacttatttcaaagaatacttaatagcaaaacttctaaataacctggtaattacttgcagtttgtttcaatgatttttttaaaaaaatgaatattacctatgattatgtaagagtagagggcagtggttctcaactggggatgattttgcccctcccacaccagagaacactggcaatgtccagagacatttttggttgtcacaactggagagggagaagggaaaggtactgggatctagtgagtaaagaccagactgtgttagacatcctataatgcacaggtcagctccccacaacaaagaattatccagcccataatgtcaacagtgccaccattgagaaaccatggcctaggtgcatgaactttgaggaatgcaacagcttactttgttcttcccttttctttttttcttattgatctaccatggttctaagaagaaatacctatatatcaccatggttgatatttgcaaaaaactctttcaaagtatgtgaactattgcagatgtttgtaaatcctggattccaaacatggaacccttgtgtacttgttttctatagttaacgactggcactgttcagtgacactcaatcagagctgatgctggctatgagtacagcatgaccatgcaagctgacactggctgaattcaaaccttcttaagcagatgaacatttatatgtggggagagacctggaagacaaactggaatctggaagggttaggatatttggcctagtcctcacagaggggctatgtatgaggccttcgaagttcactggttctgataaacactacagtttcttgagggaaatcagataacgcaataatgcactgcaccccaagaattaggcattttcagacttcattggttttctagagaagtctgcttaatcattatatcctgttgcaaacaaaccgctagactgacaataccacccaataaaagaataaaatttgtccatctatcattaagataattgttattgattagtctccttataattttctgccttttgttttcagatattggctataaatcacagccacaacaggcactgagcctgtgtttgtgtctattatgtggtcctgataaggccaggcagcgtttttcaccttcctgatgcgagttattgagattgattgaagcgctttgcttgtcctatcctagacactgtgtaattaatgtttcattatgttaatacatgcaaatgtgagagtatgtgtttgattgggaggtgagagaacaaaaaggattaaagagttcactccaaagtacaaattaatttattgcattgctaactgtcctctgaggaatgagggagtaggcttcaaaatgaaaggaaaaaaatgcacaaagagaaaatgctgttgcaaggctgtctttcagaggtggtgtagttaatggttacaaaacagatattcagtcacatgacagagaccttgcctatgaagtggtttcagcatgtctccctctatagtgaaagggtttaggacagggaagccaaagagtattttctctttacatatacaagcatttctgcatagacatagtatattagaaccatactatattaatacagtagagtgatctttcatatgtaaacagcgattgacttcatgacattatttgaggtgcagcaggaaggaaattttaacccccaaaaaacccacccacagatctaccacaattatatgcatattactgcattttcttccttgtcttcacagtgataattttgattatttcctaatatattaatatataatgctctgtgatttacttatttccttaatgtcagacaatcaatatgtttctatttgtctggatttgctatgatagcaaatattttaatgagcactgtttttgtatatacagtaatttttgttctattgaattattttgctgagatagcttcttaggagtggaattactagagcctaaatctttttacggctttctatatgcattgctgttttagaaaaattcccactcccaatatctagcatagaaactcaataaatgggtgctgaatttaaggaagcctagacttctactagactatcctaactcttgaggttgccatattaagttgttttagctaatcattccttaatgtgggtaaaagctactgactcctcccatacatacccacgaagtgatggtattttgaatgggttttaaaaataagaagcagaagaaaaaggtggttagaatttaagactcagccaggaagggcaggcttggattggagagagagtactaatagcactctaaagtcactggataaccagggagaagggctttgaaaaagtaaagaattctaaaataatcatggattgtgtcttatccacgatttattcactggaggtattgtagagcaatcattataagatattcacaactattattacgttatgtgacttcatttattgtttatttactttcatttctgatgattaccttagagcagggggcagggtgggaatatgtggtcatgcctgtttcttttcccactgtctatggctgcttttctgctgcaataacgaagtggagtagttggtccataaagctaaaaatagttaaatggccctttgcagaagaaagtttgcagacctctgatatagagaaataaatctgtcagaaatggagattgaagtccaatacatttcaaattcatacttattctttgggcaaattataatttgtcacatcctcaggctcagttttctcctctctaaaaatcaacataacaataatcaggtagttggaaattaaatcatgtaataggttaaagtattggttcatttgttcttccctcttctgaaagaaaaagttcaaaaatgtaatcagtgtttatctagtagttacgttcatgctgtcctgatgtgttcatttgaagattcattagatgtaaatttttgagagtattttgtatgagttaataattaatgtaaccaaaaatgctaagtcaatcttctgtaaatgtcccctgtttgtagctacagccatgcttaactgtaggttgctgatgtcagcattggctgggaaggttgtctgaacacatttatccatgtcaaagcatcaaactcaccactattaagcaaaatggcatagagttgtgagttagttactgaatgtgatggagaagggttctctcctgtgatcctaactcccatgcctcattctgccattattcttcatggtcaagaccagtggagttagcagtgtctaagtgtctgcagtcctttctaacatgattcacgtatcatttttcatagtcacgttgcaaattgacaaggaagtcaatactttggtgatatttcttggttcacagtttccttcagttagacccatcacatttttgatcatttggtctcagttcgttttcagctgcatgttagtgtaactagtctgcagccatccctttcaagttagtgtcaggaggtacaccaataaacaccgcctttttttgttttttgtttgagacagggtctcactctgttgcccgagctggagtgcagtggcatgatcataacacattgcagcctcagactcctggaatccagtgatcctctcacctcagcctcccaagtagttaggactagagctgtgtaccaccacaactggctattttttaaatgtttttgtaaagacatgttctcgctatgttacctagggtggtctcaaactcctagcctcaagcagtcctcctgcctcagcctcccaaagtgctgggattacaggtaagagccactgaatctggcagacattggcattttatccacaccgaaagaagtttccattaatgggtaaacaacattaagatgagaatgaggcatgattctctgtaattcaaatttaactgaaaatccagaagcataagagtatattatacatttcagaaatagaaatgtatattctatatttcaatataattaattctgtttctagtgcttgacaatatttatcactaccagataaaaataaatatatttcaaactaaagtgtaattatgaacatctgtatcatctttaaaagagtaataagtaggtgaccatatatcttaggttgcctagaacaattccagtttatacactttaaaaatatatattatttttattttttaaacttccatgggtacatagtaggtgtatatatgtatggggtacatgagatgttttgcagtttatacctgttgtcctggcttaattataaatcaagtctcctttcagtatcagaagtgtctgaaatatatagtaaattatatgatgatcctagcgatcactctagtgattagcttgaaattagtcaaaagcaaaatgcacaatgtcataattagcctgtccccgtatcatacacgtttttttgttaaattatactttatttgacattgttggcaaaaaatgattggcatgctgatgttcaacagcaatctcatctaaaagctacttttaaaaccttggctgactatgttactgactctatatataggagatgttatcttgtatccaggtgggtatccatgaatgcctttaatctgcagagtctgagtttctctggccctgcatccccataagtaaggtttgaggcctgcagctagcaatccaagctttagacccagtggaaagtaattactcaaggaagtaaaaaatgttcactccttttcctttatcctctttagttcattaagtatgttaaagatggaaagatattctccttctctgagactaacaatgttcaatacttaaaaaaagttaccattatctattatgtattcagcactgctaaacccaaacaggcaaagggatttaagcagaattgtaggcatagttcttaactttgagagtagtaaataagatataaatatatgtggtagatcaataaatattttctgggtgacataaatgtttgaaagccctgatacttgtaaattcttataagaaaatgccttgtttcttcatagattccattatatgtaataaatccaggcttttgataattcagatatagccctgaggagaaaataaaggttttctaattttgtattactcttttaaagatgatacagatgttctaattttgtatccttctccaccatcagctccctccatgtcagacactcagggtcttctgatttgttgctggaagaacagagaaactgtcttcatggagaccttccccaggaattcccttgaccaccctgccaacactctgtgttaaccctaggctcatccctccagggctcactggttgccaacatcagtagtatgataagccattttacaccaagttatttgggatatcatagaatcacttactttgtccctcttcccagattatatatttacatgatgtattagggttctctaaagagacagaactaacgggatagatgaatatatgaaggggaatttacaaggagaattgactcacatgaccacgaggtgaagtcgcacaataggccatctgcagtctgagaagccaggaagccagtctgagtcccaaaacctccaaaagtagggaagctgagagtgcagccttcagtctatggctgaaggttcaagaggctgtggcaaatcactggtataagtccaaaagtccaaaagctgatgaacttggggtctgatgttcaggggcaggaagcatccagcatgggagaaggatggaggctggaagactccatctttttatgctggcagctgattagatggtgcccagccagattgagggtgggtctgcctctctcagtctactgactcaaatgttaatctccttgggcaacaaccttacagatgaaccaggaacaatactttgcatacttcaattcaatcaagttgacactcagtattaacaatcacacatgacaaagaggtttcaataccaaacactccatgaggattttccagaatcacagtagctaagaggcagtctatatcaaatatttcaattaatattgtgtgattctgtttattccatctctgagctggtttggccctacttctttgcttaaacagtgtgagaaaaagaaataacatatataagcagaaaggtgatctagaattaatcctacacaggaattcagacattgacattttgttactaggtcctcttctgagctgtgtcaccttggtcaggacagttaacctctctgggtctttgtccctacctgcaaaataaagttaacaacctttccctgaccaataggatcaaaagaggctgttatcaatcactcttaatttactgtaaacataaaaaaaaaaaaaaacagaaaaatcacccagtgtttgtaagctacaacacaaaccctcagcaaatctttgggtaaccctggcccatgatttaagatggtcagtaattcctatccctaccactagaccatctttgtgcaagagaatggatcttgctgtatataagtgactttgataattatcaggtttttttatgtctacattattcattcctctggctgtgcaagagcgagggcacatttttcatactgttttttgaactgcagagaaaaaaagttgaaagggaaaggaagaacatttcacttacttgattacattaaaagacagtaatagggttggctaatattatttaaaatgtacagtaattatagtttttaaaattacaatcctagtacatattatacaaataaaaatgttatatagcaaacagtgactttttttatgttctcatgataactaattagtccccagctcctatgacattgacgtaatatgaggttaaaagagctacaggtattaggagagaacccacaagtggggcagaacaagagtggaagcaggtggatatctggggtcacatgttgatgaaaagtctccagctgatgaattatgggggaacccacatttgagatagagactggtatattatactcaataaactcagcacactttctgaccttactttggctttctgtctcaaaattgtatataaatttagttctgagtatttcatgacaacacttgaacccctcaatggatttatagtctctatcattcaaggggacttgctgtttattatttagataaattttaggcttttactattcctaaatggtgctcaggagaccatgtctttgctttgagtcttactgattttttttatattagagacgacgtgaaaggaatttgttaaagatcaaataagataaattaatgaaaaacagctggatagaagcacaaccaggaatggtaaatagtggttaaacaactccaagaccccacaagacaccactggtgatactttgacagttccctagctctgcaggacttccagttacccagacatctttttaaagccaatgaaaaaaactctactgtgcaacagcagagtgggctagactgcactgcctttatttcaagaagaaaaccaaagaaatcttcatcttaaatatgtttttcatggaagattaaaacacacttagtaagaccattttctcatcctgtgggagctttttaggacaggatgatatgaaaatggcatgtgttttatgtttcataggtaattggaatacatttggtgaagcccctggaataggtacagcggggagtagtagccttggacacagtgggcatatccagaggtggtgaagacagggacaaggagggaggaatgaaataaaggatctgtggctctggactagaggactgttggagagaatgaggaagccagagagctaatagacatttagtaggtgtttgataataagtgtgaatgaatgaatacgatgaagaacttcacctggatgtacagccaacagaccaatcttttaaagcttataaatgctaaatctattaccaaaagaatggagtgttgaggagagcttaacataagatggcagctcggagctttgatgcccctcgctgtcaatcagcagtatcacctcagaacagggtcatcagactacagcccaaaggagggccaactttggccctctgcctgtttttgtaataacggtttatcatttttacattgttatcttttacatggcaacataagtatcgatataccatcctcggttttgcctcttggtccacagagcgcaaaaaaatttattatctggcccttgatggaaagtttgccttaccactgtctcagaatatgacagaaaatgttatcagtatagatactgataagcatggtttttattgacagtaacacaggcacatcttgcttaatgatgggaatcgttctgagaaatgtatagttaggtgattttgtcattgtgcaaacatcatagagtgtcctcacacaaactttacatggtagagctgactacacacctaagctgcatggtgtagcctattgctcataaactacaaacctgtacagcatgttattgtactaaatactataggcagttactgtaggtaacatgatggtatttgtgtatcaaaacatagaaaagccacgtaaatattttgtacaagagattaaaaatgatggacttatataaggcacttaccatgaatggagcttgcaggatgagaagtgagtcaatgagtgagtggtaatcgaatacaaagacttaggaagttaccgtacttactatagacttcataaacactgtacgcctaggctacaccaaatttattttaaaaattattttcttccataacaaattcaccttagcttactgtaacttttttttactttataaacctttaattttctttctttctttctttgttttttttttttgagactaagtctcaccctgtcacccaggctggagtgcagtggcacaaacatggctcaatgcagcctcaacctcctgggctcaagcagtcttcctgtcttaacctgctaggactacaggtgcacactaccacatctggctatttaaaaaaaaaaaaaaaaaagaatgtttttgtagagatggagtcttgccatgttgctcaggcttgtcttaaactcctgatctcaaatgatcctctcacctcggcctccctaattgtatgtgctagacttttatactactggcagcacagtagatttgtttatagtagcatcaccacagacacgtgagtaatatgttgcgctactacattacaatggctgtgatgtcactaggcaataggaatttttcagctccactacaagcttataagaccactgtcatacatgcagtccgtcattaaccaaaacattattatgcagctcatgactgtactgagtagtctcagtcattcaccaccaacctagcagaattaggtccattttttttaaacatatgttatgatttttctttcactgattgaagaaatttttccaaattattcgtttttgtctatctatgtttggttattcaacaggtatttgttaaatacctctgaaataggcaagggttcccaggggttgtatgaaataaacaatatgattcatgtttgctcccttggagtttgcaacataataaggtagaaattctcaaaaatatgatctgcaacaggaagatcagagccacaagagaggtacaataaagggctatcacttctgagagctgagtctgtcactgctattcagtgaagactttctgtctctgcacaggcctgtgtctaccgtttacattttgtaaaagaggaacctgatgagaatttatgtttactctttggcttaaaatgtatcactagctctaaggtactaccggaaatcacaccatgtcagaggccatgtgaatgccgtcggcactggcccctgcctgctagtatggtgggtccaaggtactaaccaagagctttcttttgcaattgagaataccttcttttttcatatacattataaaaactgctctattaatctacttggaatcatctggggctctttcttttttgaacaacccacatagagtccctcaaaaaccctattgatgctatctttaaaatgggtcctgaatatggattctaggaaaggctctaattagaatatttttagaatttggaacaaccaacgcctgcatgcagtaagcccttttaagtagaggcatgcatatttcttcatctttcagtttccttcaggtgaagacacatgaataggtccttcatccttgaggttcacattagaccatgaataagttgcacatatagacgccagaaattcccttacagttctgaccttctagagaggcttcattcttgctccccaagtcttcccccatggaacttaagtcaccatctataaaacaagttatttgagaagtcctttaataaatgctgacctcgtgagcagtttaaaactcattggtgcttagttccaaagctgatgtttctgttatcactgtgggttttccttcttgataccattcatggactaagcagaaaaatatcacctttctattgagacaagacacagtaaatatcatgacaaaatgaatgacagcattttaatgaaaatcgctatttggcctctatctttagaaaattggacttgttataatacaaatgttttatcactgatgagtccccacatcagacgttatgccacaatgtcaaccatgaggtttgctgaatttttaaggttttccctggacctgtcagacctttgtggaattaatccttcgtatttgtaataggagtttccacaagatgaatacttcatttctcatgaatcataataaagcagcccacgctttgtcagcaaagtgacctctgcagtcttttatcttcaagagaaaagattagactctctattttatggataatgaggtaggttcttggtctcttggcaccttcagtaactgtactctttgtggtcttgtttcagtctgtgataaactgatcagagggtgattatagcaaatctcttagtatgacaaatttcctcctaaatttgagggtaatttttttctgtaagtagcaaagttaataggtgtgaactcatagacttttataatattagagctgaagatgcctccttgttttattaatgagtgaattgattcccagtggtgtagcccacacttagaaggctaacgaggggcagatcagacaaagaactcaggtctcctgacccttgtgctgggagctttcttttgcaattgaaagtgccttcttttttcatataaactacataaattgctctgttaatctccttggagtcttctggggctcttttcttttttgagctacgctcatctcatccctcaaaaccctattgactctatctttaaaaatgggtcctgaatatgatcatttctcatgacctctactgcaataccttaggccaaatctcatcatttctcacctgaacaatggaaatagcctccaatctagtttctctgcttcttccaatgacctctgttctcaagacagcaaccagagtgatcctttaaaacaggggttctcatcctcatcactactgatgttttgggatgggtaattttttcttgtgagggtctgacctgtgcattgtaggatgtgctacgtccctctacatggtggatgccagtagcacccctctcagttgtgacaaccagaaatgcctccagacatcgccagaaatttcctaggggatgaaattgttcctccattgacaactactactttaaaacataaattggacctttttgctctccttattgaaactcttctgtaaatttgacagagttaaagcaaaattctttcacttgcctatgaggtcccattgaatctcactgtgagccctcagaccttgcttgctggaactctctcattcactccaacccagctattcctggggtgggctcgtcacacctgcctgggtgccttagcatcctctgcctgcggtgttcttcccctatatatctgctccacgtctgtgatgaactgagggtttgcatcccccagaattcatgtatcaaaatcctaacctccaatgttatagtattaagaggtgggactttggggagataattagggttagacaagatcataaaggtaagtcccccatgataggattacctttcctataagaagaagaagagacatctgagctctctgtctccccatgaacaaagaagaggtcatgtgagcacacagtgagatagtgggcacttactggccaagaaaagaggcctgagaatgggacctgccttgctaacaccttgatcctggacttcccagcttctaagtctgtgggaaacaaatctttttaagccacccaatctatggtattttgttatggcagctgaagcagactatgacaatatccttcttcacaatattcaggtctttgctcaagtcttgccctcctcaatgaaaccttctccaaatcccacaactccttcctttccctcttgattttcttctatagcacttagtctcttctgacattgtacatattttctcagttagttctttattgtctgttccttcctactagaatataaaacctagaaggatagggattattaggctgtttattattggattcttcaaggctgtttgttcccagccttgaataatgcctgatgcagtaggtgctcaataaatattaggtggatgaaggaatggcatgaagatgtttaaatatcttttacaccactgctaagcattacagtaaaaacaaaataatattacaaagtttatggtttcaattgcattttgtcaatgcaatatttttcctttggcctttaaagcaaaatttcaaacttactaggcttactgacaaagtgctaccataaatgtgccactaaaaagcaagcaattttccaagtagaagtgagaactatgacatgtagtatgaatgagttcccctttgagaaaacctaaccgaaaacaatccaattaagaatgggcgtagaaggatcctgaaaataacaagtatcaaatttgaatataaaatatgatcacaaccatgtggataataaagcaaatcattataaatgaagaaataattaatttcctggaaggaaatgcacagaaactttaacagtttctgttaaaatgatcattattggataagcaaggttatggacaattattatgatatatgattttatgtccatatttttgtattgtgtacactaaatatgggtaacttgataagagatttctaaaagttgattggtcacttcacaataaatggcatctccaaagcttgtctacttggctgccatcaaaatggagaaaatctcatgcactgggtactccttaaatcacactttttctaaatactcacaagagcacttcttagtgttttagttgacagttctgcatttataaaatgccatccctctctctacttagagaaagactgatgaaaaacacggaagctaaagctagcttatatttcatcaaactgagagggaagaaggctcaaacccagggcagattaagcaacacatcaaagtttctctttttagtgttaattttgtatgagacctggggcatgataacctacatgtccggaaatgttacttgttgggctggaaaaaaaatttcattacaattttcctggtatcacacagcaaaatcaaactgcagcttagagagttagctcttggggcaacaaaggaatgaggaagttactctcccgctccaacttagcccttattattgttctttaccattggatttagccagaggacactcaggcagttgcctggggcacacacttcttgccctttaaaaacctcagatctctgcaaagcttcttcagctttgtggaagatgccatgtgctcggaatgtcggatgtggagcctctgtgtgggctcactaagagatttcagctgggacagttgctttgtgaactccacatcttacctttatatttccaaatttagttccctgtaaagggaagagaaaaagaagaatcagggtatcaagagcaaatcggttcagcacccttttgctgagaatatttggtggtgttgcacttggtcagcaaatgtcctgacactaaaatcacttcctgattcagtcatgctagctttccaagaatttactcttctctagatatgtgacaactgaggagcacagtaggaatttatttgctagttgcttactttagctatggtcttaagaaggaatttcatggaggataggtttctcagataaaatacaggatgctctgttatatttgattttgagtaaataacaaataatattttagtataagtaggtcttatgcaatatttatttagtataagtatttaggacatgtttatactaaaatttatactaaatttgtttttcatatgaaattctaatataacttgtgtccttaatttttgttcactaaatctggcaactctaatgagggagaaactttgactgttccttttaaattttcacttaaattttcatccatagcttccctatattttaatgatccttaataaattcccatagtaaaatgtatatgttttctttcctgatcagcctttttttacattatttaagttcaggaattaattccacataacttaattcatttctgatttgcattttttagtaataaaaatttgtcttaaatggctttaaagtgttagtctctggcaactgtggaatgaatgtactcttttaaaaatatgaccatgtattctgacaatattttttaatgtcttatcaaagtgaataaaatggcaccagtgcttcacagaaaccccaatagtcataggtgctggtcctttggtgagtgcacactttctctctctggtctagcggaaattaaagtcttccattaatgggaaatacacaaagcacaccctcaggctacagcacagttaaatggctattgtggttttcccatctagagactaaactagactaaggggcagatcagcctggtaagtgtctacaattatattgtggaactaaaatggaataaaagaaaggcaatgtgataaagaatactggatgaacccaaacttcttttggaagaggcttgtagttattgtcactgtttagaagaaatcctctcatagccccttatgtgaagaatcaagaatattccaaggaatattctaaatgtccaaatgaccatggaagtttaattttgcttaatggggtaaggccatttggggcccaaacagtgtgctggttgtaacagaggaaagattaggtattgtaaacaatagtcctctttcttgatcctttctccacttcagcctttcaaagagaaatatataataaatattaataaaacgtgttgaaataagtgttcaattatttgcctttctagattatccttctaagttcacctacttacttagaaaaataatcaacccaaattacacaaattcctcaaatatgaaaagtcatggcaagatagtagaagggacacaagaacccccttgctccaatccaggccaccagatgttttggagcaaagttctagagttttagttaacgtgagaattacctggaagacttcttaaagtacagattgctgggctctactgccacagtttctgattgggtaggtatggggcagggcctagaattgtgcattttaatatgtatttttatttttaattggcacacaatagttgtacacatttataggatacaggctgatattttgttacatgtatacaatgtttggtgatcaaatcagactagttagcacatctatcacctcaaagagttatcatttgtttgggttgggaacattcaaaatcatttcttccagctatttgaaaatattcaccaaattattgttaactttagtcacagtacagtgctatagagcattagaacttactcctcctgtctaaggggtgtaattttgtattccttaagcaacctctgtctatcccctccctacccttcccagcctcttgtaaccattgttctacttaacattgtgcgttttcagcaggttcccaggaggtgttgctgttgctagtctagggactgtactttgagaaccactgtttcagaatttgtattctgatatactaaaccaagtgaagttaacatatgcttagggattctgttaattcatgtttgtttgtttttgttttttaaattcctgctccattgcatggcctcataagtattataatttttttccagggctaaagaccagagttaaagttgtacatgtaattgatatttgataaattgaaagtagattatattgcatcatccatagaattatttttatttccttcaatggaggtctctttatttgtcttaagccaaaagaagcaaatgtggtagcatctatttctaagaaaagatgatagtggcatggttttctgggttgatatgaagattcacggatcatcagaaactctaagcaccccaaaatgaaagtttgtgtaattttaagtgatacaattatgcatagcaagttctatggggatttgtatgacattttctaatctcaaaatcttgtaggagcttttttccccacttccaagctacttcttataaatttcattttgagcttctattgccttaaccagaagcttttacattttggacctggaaagagatttctgactccacagagaattattttttacacttaacaatgtttgatattgtagataaaatgtcataccttaaaaacctcattttaagttagtttgcctctgcgactgaatggtctttggaactgagaagaatatgataaagagagcaagcacaaagggaccaagcttagagaaatatttgtactatttgatcattttggtgagtttctaaaatatattaagaatattctctatgtatagataattaatataaacttgaaatgtctttggcaatattatttctgatgcttatttatgtctgagaaaactaaaacatagataataaaagttctcccttaggtcattcctcaagggtaggccttcttttatatcctcatcaggaagcatggaaggttttgctatcttggtatctgcttacaaactatcattttacagaaaaaaaaaaaaaggaggagaagaaagaggaggtggagaaggaggaagtgtaaggggaggaggaggaggaggaggagaaggcccaatgatgatctgacacctcattacttttcttcagacaattatagataagaaacgctagccaatagttaaatacatatatggctttatgcctatatttcaaccaaaatttagaaatcttcccaaaccaacatttggagggagagagagatggaaacactcatttttatggtgaactctgatgtcagactccgttgtgtaagtttcttaatggatgagatttgggaactttccagtctatttctccacaatatattatagttgtcttaagtaattttatggcagagttcaaaggatttctttctttatgaagcaaggcttggaaatgtaactatttgagggttcaaggggatggccattggacatcttaaaaataaaaccaaacaaaataaacttctccattaggttttcacctggatgaaatcctcaccattgtaattctaatatgaaattctctgcagcattgtaaaatcggaagtttagttttgattctcaaaatgagttcttctgttgccttcccatgacctccttccatgcattttccaggaggtctacactttgaatgaactctgagtacctaattccagactacaactttttgagccacaggctccgaagttatttctacttcttgtcttcttcagttttatcatctctgtcttcctctcttcatacattaaatcagcgtagttgatttaagattaatccttggatgaagtcattttataaaattattttatattaagaaattatatactggtgggcaaaatctctccaaatggaaccagtacactaagagaaagggttgagggggtttatctaaattgatgtcaatgtaatgtattcgtgggacatttcttagtcctgtgtgcaatacaaggaagttaaaggtagccttgcctaatgacacggtatttttcagtgccgcttcgccagccggaaatcttccacaacacgcagcgctcctgcctgggcctcactgggttccgagctggccgctgagctggttctgcccactcagtctgacaggctgcggtcggctcgtgctacgacccctgatcccacgcccaccataggcgtgccaggcatggagcggtgaggggtgtgtgagtgagtgagtgcggaatccagccaccaccgcacagagccaggtgcgccagctgctgcagtgcggcaggcagctttaggtgccggcacaggcgctggttccctgtgaggcggcagctggaccaggcatactgcaagcaaattctgccttcgatgctggtgtctggactgggggaacacggtgacacccaaaaaacttagagacgccaacaaccacagagccccaaaagggtgttacagcatgtcaccgtttgtttgttcccgtagcccagcaaacaagggtgtgtcagagctctggctccgggagtcccaaggtctgcacctccagaagggttgcagctcttctctccttcctgccatatgcagcacagtgaacggggcaaggggtgggcaggagtgtgtttcggctcctttgtgttacagctcattcagtcctgctgcactactctggcccacagctcttgggctggcccggccccactgcagcttcttgtcgtcttgggtggccactcgggcagcagtggagggctggagggctacagtgttacagctccttttgcacctgatgttcaatgggtcccaggttcttgtcctgcatccaagaagaatgaggttgcttggataactggagagtgagcaaggtggagaaaagttttactgagtgacagaacatctctgggcggagaggcgatctgcagtgggtagtccccaggtgtggctgagtctggagtttttataggctcagaatgtgggaggtgcagcctgtaggtagccatggaaaaggcaatatttgattggttaaaaagcattattcaggctggacccattggctcatgcctgtaatctcagcacttcgggaggctgaggcaggtggaacaactgaggtcaggagtttgagaccagcctggccaaatatggccaacatggccatctctactaaaaatacaaaaattagccaggtgtggtggcgcatgcctgtaatcccagttactggggaagctgaggcaggagagtcacctgaggcggaggttgcagtgagccaagatcgcatcactgcactccagcctgggagacagagccagactccatcgcccaaaaaaaagaaaaaaaaaagaattattcagaaagaaccaatcaggaaagaacaggcaaacaggaacagaagttctcactctggtcacagactccattcagaaccagcagcccagttttcaggctttaggcttttttcggcttgaaggttgggtttcactggggacccacccctgtctgcctgggaatttgtctgcctcctgccactgtcactaacatgagctgaaacttagaaaaggagaccaatagaatcatatctactatttctcaattaacttgattcaccaggatccatcttttctataaaactaatcactaatgcaagttacttaaagcagtgaggtgcctatatcccaaagccatatattcaaaatataattgttataaagagtacaaaaagctcaaattgccattgaactgcaagggtaattgtgttaaagttgatctatgtactcacagcactgaaaactgtcataatctccttgtttcagactaagtggattatttatgtgtgataatgggcacatatgctcattaacatgctgtcataaacagctgtgttaaatgtattatgtgttctgtgacataaataaggtgcttaacatgaggttgtgtttaaaatataggccccaggaagaacaaaaaagcaatacatgctttctaatatagttgcctgctcttgaatttcaaatttatttcttctttattaatgctacttgtatggaaattgtgggtattactctagcgaaatatcttggcattcaaggacattagaacttctttctgctgtctcatccttagtgtttctcaagccaggtttgctagcttgtgtttcttttctggtagaggaagagatcacgtagacatgggaaaggtattttcagcaaaatcagccttaagtgattcagcaagcttagagcagggttcatttgacagatgctctcaattcaatcttgttctaaaagcctccaaactagatgttgaacttagagatcatctagttcaacttcttaatttttgcagatgaaggaactgagtttctgagggcttaaaagacctttctgagtcatgaattttgaagtgataaaaccaagacctaaggctagatatccagacagccaattcaatgtacttcccactagaagaacaggatgtactataattgggttgactacaccaaaaggatctgtggggagaaggagcttatttgaaaataaagacaccaggctgctgtcatctgggatctttatcaatatccatctataatagagttatgtgctcaccattattttacaatttatattaattcaagcaaagttccagatgctttctgagtgagtggccaaggtgaaaggaatgaatatatgacagtgagcgacacaagacatcattgggcagaataacagacttcaaacgtaagttttagaaaaattgagtatgcaggaacgaagcaaataaaaccagggagaaaccgtaagaagctgttctgctttctcttcactgtaaaatggggtgtacaaagatagaaatagttctgtccatcaggaccagtatgagttaaccccttatgagaatatggattacctgcaatttagatgcctgccttttaaatgacagaagattggaatgattttacaaagtacaacgaaaagtgttcccattacagaaaaatgaaggaagctaatgaagtcaaggttgctatcgtggaaaaaaaaaatgaagactaaaacataatttaggtggtattttttaagaaatgaaatgccatttcaaacaaataaagggctcttaaagaaaatgtccatctcttctgcattttcacacaaggtgtttcaggagaaaatgggattaaacatcagcaagaaaattcagttagactcttaaaatgattaaatattgaaaacaagataccgagggacattgtagaatctctagccccaaagattgttcaaaatgaaattgaaagtaatttgacttgaatgatttaagtatacacctgtctgagcaaatggtggagccaatgacctcctgaaaccttgtcaaggtctttgactcaacatgtgagtattctgtcaaatgctatactgccagcttcaaaaacaatatactttaactgattatacttgcttcctcccctcaagattcttaaatgaatttctattacccttggttgattctttatgttcatttacgtttatgaaacaaattcaactgtaatatttatttagatttccaagcccatgagaaacatttggatgaaaattaagacccttcagggatttgtgattttaggtagtagctttattgacttgcttctgccagtgggatttacctattttaaaacccacctgagctttgtcctaaataactttgcccatgctgttcagagttgacttttattcttatagaaccctgtatcagattggattttttaaaaatttcaatggatgccataatcagaatgaagagatagaaatagtctccccaaaagtcttagctaccacactaataactattgctactttaaaatatctaattttatttggaaaatattagttttttctgtctaaattttcatgtactgactgatatgtggtaataagcatgccaggatttatatgaatttgtaatttctcataatattaacttttggagccaattgttttcttaattatgattacctcgactgggtacttttttgcttatttaacataatatccttgattttagtttttatttattcttggacattgttcaaagccctcagcttttgtgaaaagctttgtaaagaaaagacagggaatctaagcctgagatttatttgaatacatgaacatatttccctgtgctctcttgttccaggttttcaaattaaagctttcacagcactgcgcttcctctcagaaccttctgatgccgtcacaatgcggggaggaaatgtcctcctcgactgctccgcggagtccgaccgaggagttccagtgatcaagtggaagaaagatggcattcatctggccttgggaatggatgaaaggaagcagcaactttcaaatgggtctctgctgatacaaaacatacttcattccagacaccacaagccagatgagggactttaccaatgtgaggcatctttaggagattctggctcaattattagtcggacagcaaaagttgcagtagcaggtaggtggattcttccttctcttcctcctcctccttcctctcttcttcttattcatttttggggatgagaaaataatttttgtagaaataatgtacattttaaaaatcttttaaattttaagttgacaagtaattatatatttttatgaagtacaatgtcatgttttgatgtatgtatacatcgtggagtgattatatcaagctaattaacatatctgtcaccacatacttctctcttttctgtggtgagaacatttaaaatctactcttttagcaattttgatatatacgttgctgtgcaatagatattaaaagcttatttcttctctctcactgaaaccttgtgccctttgacaaacatctttccattccttaccacgccccatcttcccaagcctctggtaaccattctgctctctagttctatgagtctgacttttttataatagattctacctgtaagtgagatcatgcagtatttttctttcagtgcctggcatgtttcccttagcataatatcctgtaggttcatctatgttatcacaaataacaggatttactctttttaaaggctgaatagtattccattgtgtgtgtgtatgtatatcatatatacacacacacacatatatatatatatctcatattttctttacccattcgtgattgattccacatcttggctgttgtgaataatgctgcaattaacatggagtatagatatctcttatataccctcatttcaattcctttggatatatacccataagtaggattgttgtatcatatggtaattctaattttagttttttgagaaagctacataaccatttttcataatggctatctaatttacattttcaccaacaacgcacatttttaagaaaaaggaaagatgtaaaaagattcatgtttattctgtcatggatttgactgacctttctccttaaattatcttagaaaacagtcataggacctcaactggctgcgtaaagttatgagattatttttttaaacaaaactgtttcaagttgacttactacttatatctaagggaggacttctcattaacagaaaaatattagaaaatataatttgctaattttactttacagcttcattaaatgctaaacttttgcagagtccatttttttgttgtggggccttaagaagagtaaattttattttaattatagtggcatggcctacaacatatacatgtcaagtaagaaataaaaattccttctagtgcttccaaatttcttaacgcttggtaacatgttggctcaacagctgagtaataagatgaacagtttttgttttcacctggatacactgaagtcatgtagactctgaaaaaatggtactgaccattctggaacccatgatattgctatttctgccccactcttctggttagaaggcagctcataattatttctgttggcccctgaaatgttagacctgcaaagtgaagaatcagtttttttacttgtttctataaagatttgaccaaaacctgtctttttttttaacttttatattgaccataaagcaaggcaagcagattgaacttgaaataaatttaagttatgaatgggtaagcagatttgaagggctgctttcaacgtaatctttagttctcaataaaaacaatattgaatcataggctgtttagtcatttgttatgggttttctttcccaggtcctacttagtctagtctcatcttggaagactgatcagaataactcattttcatcaataacaggacaattgggcagaatcaccactccttcatgcactctcctagtgagggtctgagaaagttgaaatctgaaagatgtgattttgtcaggtggtgctataaagaattacatctcatagatatgtggttaattcccatatgtagcttcaaaccactcttctgtagcttttctccactaagaactctgtagactgaatgttttttctccctaaaatgtgtatattgaaattctaacccccaatgtgatagcactgggaggtggagcctttgagagataattagatcatggggtggagccctcatgaatgtgattagtgccgttataaaagtaaccacagaacacccctgctcctttcaccatgtgaggatacaatgagacgtctgtaatctgcaacccagaagaggaccctcatcagaaaccaatcatgctggcaccctgatctcagatttccagcctccagaactttgagaaatcaatgtctgttgtttacagcctacccagtccagatactttgtgatagccacccaaactgatgaaggcagagttttccatagtcagttaagccagattttacctagaggtagactggctagccattctgcttttctttggactgacttggcttttgcacttgaaagtcccatatcctgggaagccacctcagtgccaggtaaaaccaggacagtgggtcactctacctcaaagtgtccctggtctgctttagcaatgacagactgaggtgcagatgcagaaaaccccctctactcaggagacaggccaggtgacatcctgatggtgaaaatcaaggctataaagtaactggaaccttggagtgatgagtgtctgaaatttgattgatgagtataaagtgtagagagaactgaatgttaatgttaattatgattgattaggagaaacaagtggaataaatccttcagatttggtaaaagcagctttctcagaatgctccaaatgaagtggaaaggggacaatttgactttcagtcactagagaatttctggcctcatagatcccacccatcagttgtccacaaggccagaggaggtctgctgatttgaatgaagcaggctgatattttgatgccttattatgaaaggcagctgcctatgcactgttaatgaaaatggcctgttacattgcagtttcagtcttcatgcaatctacattcacatttacatgtgctgtctttcagtagtgaaatgaagaagagttccttcgctgtgagatattaaaatacagtggcttggactttagtattctgtacaaggataggcacacggattcagtcactgagttaaaatctcatattagattgtatcatttcaaggcaataaggctgttcacagcattttaaacacttaccatgctgtttggcaacacagaatacatcaatgttatgtctgctgaggttaagattgccaaaccactagaattcacaaggggcatatatcttcccagtaataaagaccatggacctgatttaatctcagttttaaagcattagcactcaataaaccagtcaccactaaatggtaacagtaggctttgcttgggtaaaacaacaacaacaaaaaaatgttttgtactctcaggtgctgtatagagcccatattaaataatgtccctcttccatttttgctttctcaaagtgtcttttgataaaaagaagtgtagcaaatgaaatctgtctttaatcagtcagcacattttacacaatgatcttgccatgcaccattcatcctattttctaggagcttctcaagtgctcttaaaggcttgagtgcacacttggctggagagggaaggaaagtaggaaagataaacgaagaactatcattccatccaacattttcttaaaagttgcaaagtaacaggctactgactctcagtatttctagtcattttgagttctatcagtaaagaatacctgggctattaagcctccatttgaaagcaacttcatcatactggctgaaatttgggaattttatttttatccaattagctctaatctaaaatgctgcagtgtttctgtgccatgtatacttctatttagtcctctagattgagaacagctgaagaagggaagcagcgctgaacttatctatgaagctttcctaccatcccctctactgtgtatctagcaaagtatgtcatgttaatagtagacatttgccttaccaatgaagacctggggctttatgccatataaagagagctttccgctgttgccatcctcctctctacctctccttctttgtctcccttctactcctcctccttcttcactggatttcagcagatcaaactcacccatatatgtgcatacataaacatactcttaacaaactgagttggaataatttgctttatatctcaatagcctacaaattaattaactattgaaaactttgtgattagaaaattgactgtttgggaatattcaagtgccacttaaaaaggaaaaagcatgagcatttcttcattccttccctaacccttaccgtgaaaatgaacttgcatctggccaagcacatcttccctactctaaacgttgccagctatctgagcctctggagtattttctgttcagcagacataataataacctacctcccaaggctgtggtaattttcaaacaacatctaggatgtaaagctctagtgcagagtagattcttattcaatgacagccatagtataaatagaactaacaattattattattgtgttattttaataattattaggaatgaacaactttcaatattcccatgtgatgatgcaaaatattttttttcagggcaatgaaaaataggcaacaaatcctgagacatacatattgtaatcttggatcagatatctgcctttgcaatctgtgaacacaaactggcaagcctgaattaagttttcaaaaagttaaatctatgggagattttttggcaagcagtgcccaaatcccttggaataaaagattcatttttgaccactggatctactattatgttaatgcaatcaatacagtttgtactgaccagagcaggcgtttgagattgagtgaccttgcaatcatttccaaaacatgtacagggcactcctctcagccttcttaatggcttttcaactgaaaaagattcactgaagctggttcatgggagttcacttggtctcgacttggagtttaacacaactggtaccctcctggggatgaggaattaattctaatatgtaagaagactagataacaatagatttcctatgaataaacataaaaatcccattttattttgcttttttatacaaccatgaccccctgtccacccttccccacacctacccacccacacagctccttgtccactgacttgccctgcacactctaaggagcacggttggagcctaagtggtacttctgcttgcatttatacttctggggatggcgtgggacaggctcctccaagggtaaagcaatgttgactgctggatacattatattgtatttgtgtccaggtagatttgtctttgttaatttttcagcatttacattttaacattaaaaccactgacttgctttttatagcagtttctgcttcagaaagtgaatctctatacattaccttgtaatgctcagaaactgtgatttaagtacccaaattgacaggttaagaacttactggaaaaagctaagagctctatggccagagattgggacttagatagtctaaatccagatgcacacttattcccttatcactttgcttctcaatctaaggactagatttcagaacgctgtaaacaatttcttatgtaatcagtcatttatttttaatcaatgaaactctccacaatacaaattaaggaaaataacaataatggtaataatgataataataatgaaaatcgatttatccacttagtcccttgaaaatgtcaactccttgtgggaaacactatgatttagatgttttcttctaagatgagaagattttgctatcatagctatacattcaatagtgacacatgacaaatctgtgtcagaaaaacagacagcatataatttttaaaataagctcataaataatgatctttctaggaacacaatttggtaatcttttatctttctaagtggttttacaattcaggcgaagtttgcatattttttttctgcttcttaaaaatcaagaaaataaaaggccaactaaattgcatttcttgacttgttatttcattcagggacatatttttttcttccctattacaatagatgttcaagatgcaaattgtcacactctgcttttaaataacacctgcattataattaaaattcccctgtgtttttaaaaaataattaattacttgaggagttgtttcagtgaattctcttctagaatgcctcccatttaaatgagttatgaaataattagtgaaagcatattatggtgagagaagctagaatgaagcattttgtgaaatgataacctgacctttatgttcttacttaaaagaacctgaaaaaaaaaaaccttaactgaagagaaggaagaataaaccacattgcctcaggtcactcaaatgttatataaaggaaacaccaagaaaaatgtttatattccttctctctacaggagcaaatataagaattttgcctagaaggtcaacttcatcctgtgcagcagtctggaaaatgtatcccagggcccttgaatacgctcagaattctatttgggaaggtttggttacagtgcagagctttccattttacatttatagagatattgtttattttcaaatgataagcagaaaattaaattgctctgactctgtaattcttaatgacttaatgatcttcatttagctaaatgttcccattgttttgtagttaaagcatgagagaaagaaaaaataagaaataaatgtggtcttataagtaactgttatatgtttactagtcttatcatttttctttaattttattgctaaatcaaattgagatacagccatcaccaatatttccccaacgcctattccatcacacagcccccacaccctcaacttaaataattgcattttaaagagtagggttttagttgcctccttcctaagtcaattaactctgcaataaaattaaaatacaaatatattcctgaaaaatatgcagagtgaaaagacatcttctacattataaaatttacaatagagaacttgacaaggctttttatagtagaaacatcaacaaaataacctaaaaaaaattttcaacctttcatttccttttctttgttatgaattctaattcatgtgacaatggaaatagctaattattcattctaaatttaatcagtatcttaagagctctgttcttttattcaactcttaagctgtctacagttcgattttgctggtactgtaatgaaaatgcaagagaaacatctaacacaactcagtaatagtaaccaaaaactcttttgaattttagaaaacctttttggaatacaaaaatttaagtttcttgaaaaacgtcaagataaaaaagattcaaatcatagtaatgtgagagaaaataatgtaatatctgttcctttacatcacaaggaaaatatattacactgttaatcttgttaatctttaacaaaacacagattaacaagaaaaaagcataacaaatttatttaaacaaagttatacacaagtaactttcagaaatgaagacccaaacccctagggaaagctttatatttttatgctaagtcttatcagagaagtggagaattgtggaaaaacatgattggacagagagcatagacaaatggaaataaactgggggaacttgagtaaggtctgattgttcaaataattgtctgcacctctgtatgatattccttcctgtattagtctgttctcacactgctataaagaactgcccaagactgggtagtttataaaggaaagaggtttaattgactcacagttctgcagggctggggaagcctcaggagacttgtaatcatggtggaaagggaagcaaacatatccttcttcacatggcagcaggaaggagaagaatgagagaagtgcagagtgaagtgggggaaagccactcatgaaaccatcagatctcatgagaactcactatcatgagaacagcattggggaacaacccccatggctcaatcacctcccacgaggtccctcccacaacacgtggggattacaatttgggttacaattcaagatgagatttgggtggggacacagaagcagaccatatcacttccccggctatggggcaggactcctgtcacatgagggtttcttttatggacagctctcacatagaaaggtgggagatagtcagagcgtgacctccaaaccaccacattttggtgtagcatgtcctgcaccccatcattaagtagaataattgtagcattacattagatagcacagttatacaattctgatgaaataatgatggataataactttatgaacctatttctggtactgatttttgtcctatttttatgtgtatggtaaaatatattatttggactcaataactgtatacaaacacatttgaattaagatattaatattagatacaaagcttttctacaaagtaaagagacatcaaaacctagagtgtgtcctggaagccaagtaaattaattagaggaaatcatggaaaatctcagtgtatggtacttcaaccatcttaaacgtctactgtcataagcagtatatatagatgaaagtaatgaatacagttagtgaacacaattacttatctccctgtaaaaagttattgttaacagtctttatatttataatctatatctgcatactctataataagcagtctaatacattggtcattgtattagtccattttcacactgctgataaagacataccagagactgggaagaaaaagaggtttattacagtctacatggctggggaggcctcacaatcatggcggaaggcaaggaggagcaagtcacatcttacatggatggtggcaggcaaagagagagcttgtgcaaggtaactcccctttttaaaaccatcacatcttgtgagagttattcactaccatgagaacagtatgggaaagacctgcctccatgattcaattacctcccacagggtccctcccacaacatatggtaattcaagattagattttggttgggacacagtcaaatcatatcagtcattatgcctatcattgctaaatttgcctattatttggtagaggtaagagaataaatcagaaaaagccatttggattcatgaaagagcgagataattttgacctagcaaatcagttgttttggaccttgaatcatgaagttaacataaaacaataacaataaaacaacaatgataaatatttctgatagaaattcaataatcagagtaggtcccaaatttccaaatttatcttttcattctatgttatactgggaatgaacaaacacaaacccatgcacacacacacacctgtgactcttagtgctctagcccagagttctttggaagtttcctgttaaaagacagagccttagcctcaaaggtcaaagcgcttccactgaaaaaccttgtttgaaaaattccctctgtagtctcagctactcgagaggctgaggtaggagaatgtcgtgcacccaggaggcagagcttgcagtgagccgagatagcgccactgcagtctggcctgggtgaaagagtgagactctgtctcaaaaaaaaaaaaaaaaagaaaaaaaaaaagaagaaggaaaaaaaagaatttccacagcatctgaggagcagcttttaggtccacagaatttatcacaggttcttaaccagcgcttattgtgaaatgtaactcaggtatctctaattgggccagatggagctatggagttctaatttctggagggcagttaagcctcaaagtttggtttctcagagtagcatgtctaccttcagaatcccaatgagcatgtgtcagagaaaagtcacatttaaatagtttgataggctgggcatggtggctcatgcctgtaatcccaacatttgggaggctgagatggcaggattgcttgagcccaggaattcaagatcagcatgggcaacatagtgagaccactgtctctacaaaaaaataaaaaattacctggctatggtggtgcatgcctgtagtcccagctacttgggaggctgaggcagaaggatcacttgagccaggagatcaaggctgctgtaagctgtgagtgtgccactgcactgcagtctgagtgacagagtgagaccttatctcaaaaaaaaaaaaacaaacattttttaaacaaaaatttaaaaaatatttgataggtctcagtatatctggggctgggagtggtggctcatgcctgtaatcccaacactttgggaggctgaagcaggaggatcacttaaagacaggagtttgagaccagtctgagcaacatagcaaagtcccatctctacataagatttaaaaattagccaggtatggtagtacatgcctgcagtcctagctacttaggaggctgaagtgggaggttgcttgagcccaggagtttgaggctgcaatgatctatgattgcaccactgcactccagcctgggcaacagagtgagatcacaacttaaaaaaaagatggtcatatatgtgggatatagtttgtgtgacaggatctgtattctatcacatctgcatatttcccgtgatgatctgtaaaggaatgagtttacactatttacatcctaacttaggttacccagagatatttagatataaacacagtacacagacacattcacacacctttccatttagatggctcttcctagataagcttctgtatcttcaatctactgatgaacaccatggtcataaaatctgcttgttgatttataactcctgttcttttcatacacattttaaaaatctgctttaaaaaatcagtttcattgtaaccctgaggctttatcacccttgaaacaggctgctcatcaggttcatttactaagattttacctgaaacacttcaccaactagaaacctatttaagaaagtatgttaaagattaataaagcctatatagcttcaacattaaatttcagtgctggttggttttattggattggatttttgtggtcccttttgcaaaggaattcatctccaaaggctgaaacatgacataaaaaataattagtatttctttgatgcagaaggcacaggttccaggagcatcctttgaatcccacagtgcattgggcactccatgagccaaccttgtggctatttttctaaagttgtttccagttatgtcccagcccaggagtggccaggtttggaatatgtaattgcagataaaataaatgttctcttccacctcagtatacacattgtgaatatctgggatttgtttatttgtttttattgggaaatagtttatataccataacatttaccctttaaaagtatataatccagtcactattagaatattcataaaatcgtgcaaccaccaccactatctaattccataacattttcatcactcctatctccccttctgctcctgctctggaaaacacttatctacttcctgtctttgctatttaacataaatgagattatctgattatcctgtggcttgttttttcacttaatgatatatcttgggcatcttcctatatttgttcttacagatcagtttcatggtttttaattcctgcataatatttcatggtttatgattcacatattgaaagctattctatttgtttctgaatttttgcttttgctaataattcattaatgaatgttcttgtatttagtaaatgctcttctgtacatacctttgacaagtcttcttcttacctagtggtgtaatgacttaatcaaacggtatgaacattttgatagaaactggtatattcaagagcattttattagcctggacctaaacattgtaagccaggatttgttttactgctattgactgagcatatagagctgggttcttcttaacttgtaaatatcattgaagcctactgcctactctgataagaatagtgacgagttgacactgttaatgaatagccataggcatttgtcagagagaatcttatacatggaaacctagaggaatgcatctcatccatgtcctgggtttctgactatggtttggatattcatcccctccaaacctcgtgttgaaatttgatccacaaggtggggcctaatgggaggtgtttgtgttatgacagtggatttctcagaatggctcagtgccatcctcacagtgataaatgagctcttgctttattagttcccaggagagctggttgttaaaaagagcctggtgtctcctccctctccctcttgtttcctctcttatcatgtgatgtctgtacatgctggcttcccttcaccttctgccacaaatggaagcagcttgaggcccttatcagaagtagatgttggcaccatgtttcttgcacagctttcaaaaccgaaagccaaatgaacgttttttctttataagttatccaacctcagacattcctttatagtaatacacatagtctaagacaattttccatgtactgatttgtgtctcttctgctgtctgtaaaaagaagtttctagtagatatcactccatgaactatcttgggattcctcttaggtccaaaataacaatttttcaggctctgtatataatgtcagaccccatagagtcacatcagcataccatagaagaatgagaactctttctggtggcctaaatgtcttttagcatctgagtcctgcctatacctctagcctcattttcttttcttttttttctttttttttttttgagacagatcattgctcatgttgcccaggccggagtgcagtgatgtgatctcagctcactgcaacctccgcctcccaggttcaagccaagtaattctcctgcctcagccacctgagtatctgggattacaggcatgtgctagcactcctggctaattttttttttttttttttgtatttttagtagagatggggtcaccatgttggccaggctggttttgaactcctgacctcaagtgatcctcctgccttggcctcccaaagtgctaggattacaggcataagccactgcacccagactctagcctcatttgtaaccaaatccatactcatctcttcatgttttacagcaatttgataaatgtgcattctggtgccacggctttgcaccctttattctatatgccttattctctcatacatcatgctagctcttgccttttcttcctcagactcagttcttgcaacccaccttcaggaacctttaactggccccctagactaggagaggctccatcttctttgtgctcaccgtaatctatccttccctctgtcattgcatggagcatattacactgtatctttacaaggctcctagacaaacacgcctccttccctggccaaagatctcataaagacacagaccatgttacatttgtcttagcttccctaggcagtgagactccacagaaccttgctagttgtgtggggtaacacggtggttagggacacaggcttcagagctagtcagcctcagaatctatctcttggccattcactagttctgcaaacttgggacaaccatggaaacgttctgggcctagttttttcatgtattaatggctatgagatagtgtctatcttctatgcttattgtgaagattaccaaataatgctgaacagaggacctaaaacatagtgaagcaggacgtttccctgaccccttcactggactcgcaacaggggttcttcctttactcagcccactgctctcaactccttgtggagggagcgtacaagtgaacaagtcagcaactggagtacacaagtgctagaaccagtcggccattttggtgccggtaggatcaaactctaatcactagacctgctgcacacccttcacaggagggagcgcacaagcgagcaggtacaggagccagagcaagcacttttgggcgccagcaggagcaaactctatgcaggccccatggcagcatccaggtggggtgcctgcaattccggaaggcccagagggtgtgttacagtgctttcagctctgccatctgcagacagcttaagtgttagcagctcagtgggcccatagctaccctctgccaactaaggcaaagagccagtgtgacagcctcctgtatctgcactcatggctcccaagctcttgtccagcatccaggaaatataaggttgcatgaataaattgaaggatggtaaatgtgggggattttattgccgatgaaagtggctctcggtgggaagagaagctgaaaagagtacagtgtgggggaagggtaggtaatcttcccttgaagtctggccatctctggctgaattcttttttgaagttatgccatcaagctgttcctctgaagtcaagccacttctctccaatcatccggctgcttctcccctctgctggctgagtatggggtctttacaggcacatgatgagatgcggtggggccatgggtggtttaggaaaaggcaacatttgagcaggaaaacagggatataagttctccttttaggtggtgatttcaggctttttagcttgagggtgagattttgtcagggaccgacccttttctgcctagaatttctctgttccctgtccccatcaatggtaaaagctcaataagtgaggctttatgaaaaacagaaaatcagggtagtattaaagattccccaggtaccttgcagcaaataggaagagagaatccccatgaagaaggctttttctatgtggggacacatatcctgtgtctttgctgctctatgagtattggcctgtttcccatgcaaagtttgttcttccccatctaggtgggccctctgcaaacatacgagattatatttatctttttaaagttcttagcaccaatattgtaggatcaatacttctgcctgaagtaaataggatcaatcaaataatgactgtgctagaaagtagttggataatactcagggttcatgatttttttatttgatgatattgaaacacatctctttaacctcacttagcaaaagtcagaagtaaagtttgtcatggctttgaagaactttctatgggtcagcaaaccttgggacaatttcactacattctaggaaggcatgtaaactacctattggccagctactccaggcagcctttaacatatcacaaaagtaaatggtcattacagacataaaaataatggggtcaagagactcatgcttattatgacttgaattaacaactatgttttcacacaaatcttcattatttataactggcttagacaattatccctccttttacgcttgttggtttcttgtgttcaaaaactgcaagcagttactttattttgcccgaaggtctaaatttgtttcttccaacactaagccatttttcccaagtcttatttttcccttgaatttgtgtaaatacctgtagtacaaacgtttcactttaaaaaagggctttttaaaagccgtttttctaggaaatattttaataatcagcattatttatgttgcctgtgtagttatgtaaataatttcagcctttcctcacaaacaactcttataacttaacatgccttcagaaaatgtgaataagattaccagataatgcctccccagtaagcatgttagcacttcaggaagaaaatgtgagtgctgagttgagaatgtgtgttaggcacaatgacaataacaaggaggattacaaatgaaatagcgctacaaatagcaccacagtttggaggaggaaagcaatttggtgaagtgaaagatgttaaatgttttaattttcttctatgccagtaaaatcttgtaaaacaaggtgacatattaaattttctatactacagtctctccaagagcctgtcaacattttcattgtaaactctattttcagagctttataactcagcattaagaattcactctggcttgacatttagagtgtaaggtcttacctggggaacatgtgtttcatatgttttaaaaattacgagtttatccatttctcagtttataatgagtaaccttttcacactttttcccttgtctgctgtgcctcagaaattgcagggagaaggcttacctatggtaaatcgccaatgggggaagaatctacagatgtggtcaacacaggtcagggctgctgattttcattactgaaactcacaaagagcttctgtagaaagcaaagagctctgctatgctgccctcaacatttcagactagactttgtgctatccaaggggtatattttaccacgacaaaaacctgactgattgcagaattcttagtcccctgtctgtttatttcaacatttgtattatgttgtgtctggcataagacctttttctaaagctttacaacatacaccctaatcttgcttctttgtttttaagtcttctttgcatgtgtttgtgtgcatgtgtgtgtgtgcatgtggtttattttccacctttctgtcattatttagcatagggaggttttcagtcaatattattcagtaatacggctaccctctttataccttgaaatacctacagtttaatctctggaagaattagtttttagaaagttagaattagaaaagggtgagggagaaataaacaaggaagcaacagaagagaaaaatatctgtggccatttgatatcagaccttaaaatgtcttgaggactgagtaactaccatggcttcccaaaaggatcatatgtgggttgtctaggaaaaaaatggaattccttcaataaaatacatggtagcaagtcttcagttctaggttatttcaggagaatcctagaaaatcatcacttcctgatatgtattgagaattatttcactcccacctaattgcattgtattttacatggctgacaaattatcttccaaagtggatataccattttgcatttccactagcaattaatgacagtttgttgctccacataaccttcatcatttgatgtcagtgttctgacttttgggcattctaattagacgcatagtggtatttcactgttattttaatttatcacttcctaatgacatatgatatagaatatcttttcatatgcttatttgccaccagtgtgtcttctttggtcagatatatgtgcaggtcttttacctgttttaaaattgaattattcatttttttctgagtgttaacaatttttgtatatttggtttgagagtcctttatcagatacgtcttctgtaaatattttctcctgttctggagcttgtgtcttcattctcttgatggcatccttcatggagcagaagtttttaattttaatgcaattcagtctatcaattatttctttcaaggatcatgcctttacatattgttgtatctcaaaagttgtctaaaagccatctctatacccaagatcatttagactttcttctatgttttcttctagttttatagtttcatattttacatttacatctgtgattcattttgagttaagtttgtgaagtatgtaaggtctgtgtctagattatttttcttttgcatgatgatgtccagttgtttcagcatcaattgttgaataaaactgtctttcaccataatactgtctttgttcctttatcaaaaaccagttggctatattttcaaaacatttttagtgtgtttatttctttccatgtctattaacaccatccaaacagaaactgccatcatctcttgcctgcttctcctaaaacagtctattaattagttgacaatatatttcatacacagaggagagttgtcttttaaagcatttgaagttggtggatgattttccactgcttttaggatcaaatataaacctttagtgaaatataaagccctgtggaatctggcttcctcctgccatcccttctctctcttttcctctccttcctccccagccaacttcatttctgccaatttcttcataatgctccagccatatttttttttcacttccttgagcatgtctcacttcctcccacatcaagtcttggactatggagtaatttcgtggaaatcctaaacgcagctgcctttggtttagctcattgctctgttcattctttaaagctgttttgctgtttctttctctgagctatctgttgagtgtttaggtatcactgctaactactatcgcataccatgccctcaatgtccttcataacaattgccaattataatttcattattatttgtttagcacatgccttcctcactagagtgaaggcttcctgagagcagtcagaatcatatctgtcatctttgctgttgtattcacagtgggcacagtattatagtgtctgaatgtcctaccagagtcatgggcagtgactgaactggaatcatcagaactgcagagccaaggagctgagggttaagctcaagattactggagcccaggacttctctattcatctaggagtgaagtaatccaatgaaaagtcaaaagactttagttatcagtgtacagggaaaacctagagaacaaggacttggtgagtcatggaatcttggacttagaaaagataaaagtctgcatgtagaagtcagtagttttaatagtgatctcacattcagagcattacatgattcagggttcatcttccttcgccatccttcaaagcacatagtccagagatcatttcgttttctatacatggttcctcacatgctgaggaagacgggacaatgttcttggcctctccttcccactgggcctccacaggggaaaattagcagcattcattttttccattttaaagaaataatccgcttttcttttcagaaagcagttttccaatgctctgaggtttacgttcatgcctcactgggcctgatttactcagtgtcatctgagcaaagaggcgccctgggatggcccagcattagagctggtgcttgagcccagatgcacgcacagaatggtacatgaagcaggcagaaggtggagaccatatatttcttttaatgcagtaaagaaaaagtattcacatagaatgaatatttaaataaatgagtaatgtaattatttttcagttccattcaattaaaaaatatttattcaaattaaaagggaatatgcctgagccccttactagctgacattggtgatttctctagcgctttctcccttagagagccactagccttcttctccttccagaggctggggatgctctcacttttctttcctatactctatggagggacagataagcaggaaacttcctctacatagaaacactagtgagtcaatttccaaacccagagacattttggtgcattacactcactaatataacatggagacattgttatcagagaggtctctaacaaagttttctctgtgctattttatctatgtgagggaggtgggaatttcttcaatatcaaaaacctcctttaatattgagcagttttttgcacttgatcttagccaaaaggccaagtagcactgaaatgttttttgtttgtttgccccctccacacaccttctctctctagtcacctctctcatattttaattaactcgtaagttcagtgcttctcaaatttggtgtgtaacagaatcttctgtagaaacttgtgaaaaaaaaaaaaaaagaaaaagaaagaacaaggcccaggtgttctatctcagtgaggctgttgtctttattagctccccaggtgattctaatatataccaaagttttaatatgtctatggtttcatgtttacacgagataacactatgctttgttactccataatatcctctttttttcctaatgtggttgtttactcaatgatacattctttttacttactagagttgaatcatttttgattcttggaagctattaactatcagattctctttattagaagttattgtcatgacaaacacttaggtaaatggcgattttgtcaatttatgctgaatatctcttggtttaggaactttatgttaactgttattcttttaagactagaccattgtaccatgactaaaaacagacagtaaaccatggatatcaagagaataatagcgagaggtttgtaagtgtgtattgtggggcaccagcaatttatttttcagaaagccttattaaatgcatctctacggattgccatggtttatggcagaagtgatgtgatgatttgtattagagttttaataagtttagagttgaaaaatttattctgctttcagttccttccctctggctgacagttaatgtccaaggtacttaatcagagaaactaccatgggaggtctaataatactgtgcaacaaagggaaaagcacatctctaggatcaatttcagagccagctgtattttctccttaaagaaataataactcaaatgagataaggtcctgccttcaaggagatttcagtccagaaaaagatctgatccatcacagtgcttttgttttttattatattgggtggtgttttgtctttctttatttctttctttcatggtaaggactcaatggaagctgaaattccccgaggagtgttttagcatcttatctctagtttcttgcctctaaaagttgaagttacagtagcacagtatacatgtttctccttcttgcttatcctggagacttcctgcttaaatatatattgaaatggttgcaaatattttcattgccaagaaaataaactgcaaattgtttggttgtttggcattcagagtgctatgggcatagatccttgatggcagattgactgtatggctatagctatcatatgatgactcttcaatccctttatgacttttatgagagaaccccaccacatcctccagaggctgctgtaacgattaacagcaactgcaaataactttgcaaaaggaaattatactttgagtggaagagcctagatttaaggtaatgaaatccctgaaaactatagcctatgtgttaagatttattctttaagttggttagatatcaaactatgattctggcctttgaactcttaatggtgaagatttttatcttacatgatgaacacattacaacaattttgttatctgaacattgagtaagttagtagccacaacgaagaggtcagccttatattttatatccttaactatgagttctatttcaagatgatgtattcaccaaatctttattagtttccccaacaatactgtgggcattgatataaaaagtttataggaattgaaaaattaacccccccaaatatatatctctatatatctatatctatctatttatctatctatctatatattttgagacagagtctcgctgtgtctcccaggctggagtacagtggtgcgatctcggctcactgcaacctctccctcctgggttcaagcaattctcctgcgtcagcctcctgagtagctaggattacaggcatgtgccaccacacctggctaatttgtttgtatttttagtagagacggggtttcgccatgatggccaggctggtctcaaacccctgacctcaggtgatctgcctgcctcagcctcctaaagtgctgggattacaggggtgagccactgtgcccagcccatatatatatatattttttaaaggtgggagtatatatacaaaagacaacaacaatttgtaggaaagataaatcagatacagggggaagacagatgaatcaaggctgttgaagctgcagccaaccaaatttccccaataataatttccacaggtggttgttaaatttaccagtttgtaattaccaaattgttgtggggcctggcaaaccactctgtaacaggggccccagatgcttgtgatattcagaatgattaggtaaactgtggcgtggagccatggctgtcagaaagtgtggtccctgatcagctgcatcagcatcatctgggaacttgttaaaaatgaaaattgtttagctttattccagatctgttgaatcaaagatgatggtggtggagcccaaacaatccatgttttaacaagcccttcaggtgattctggtgcacactcaagtataaaaactactggtttagaccaggcccagtttgattgcagttgatgtggccggctgaatgttgaagacgcttcagtaccaagaaaaaaccccaaggtaggagtgagggagaaagggcagaatgaggaagtggggatattaatgagatatctaattctatcgctgtagctacatcttcttccctgtttactttgtgcagaatactcaacaagtagccattactcccaaggtaaaagaagcagcatcttcttaaaaactgagtagactggagaggtcagagcagcaaagaactctgcattctgttgaaatggcaaaggttcccttgttcccctcgcagagtgtgtgatgggggtatggcttgcttcttcagtgccccgctgctcacccctctaggggagcatacagtcgggtcctggttactgcctgttttctccagccccactcatggctgctggactagcctttgcctgctgggaaaggttaaggagaggtgcccctgaaccatgagtgtctgcggctgtcgaggtgaaggcatatatgacacctctaggaatagttagtgtgatttacaccttcggcagctgagccaaatcctcactttacttagtaacattgctgtagcctgtaccaaaactctttacattgtaaagaaagtgataagagccatttcaaaccatgtgagagaaaagagagaaagtctggggcttttgaccagcccagttagagtggagttttttaaagcccggtgaagggaaacagagcctcttaccagcaggaaaaggtggcagggttttggaggaaaggcagacctgacagtttcccttcgtccacgctcaccttccaggatcctgggtgaggccccagttgaaacgggaaaggttcgcctgtccccctcgcagggtgtgtgacatggggagtggctcgtttcttcactgcctcactgctcatgcttctaggggagcatacagatgggcaggctatggggttccaaccccatggcagtgtctaggggtgaatgtttacagctcctgaagccccagtgggcgtgtgtgatacagggtgctctcttagtttgctgtctaccggaggcttgtgttaagcagctcaagtagactctctaccttgtcgcaaggacagatctttctgtatcccgggttcttgccttggtgtactggaataatcagatcacacgtgagcttggagaatgagtgcaaagttttactgaatggaagtagctctcagccaatgggggagccagaagggagatggttttcccccagagttgggctgctgggtggccccagctttcctccaactgccgggtcaaactctgcctcgtcccgccggtagatggcctgcaggcctgccactattagttggtgtgctcttctgccagagtgctccctcatgccctcttgccatccagccacttgtgtcttcttccgccgatgtgctcctcttgacgtctggccgcctgtgtgtctgcccactagggtctcaggcttttacaggcccaggatgggaatgtggtcttggaaaatgcaacatttgggtgtgaaagtaggagtgctcatgctcacctaggtccgtgagggtggagccccagccagggacctgcctttctctacccggcacttccctgcccccttcatttaaagggtcttcccttcccagcactcctgtatcactgtcatcaagatgttcccagcacaatagggaacttctttctcactcacactacagcagagttggatactgactttctccccaatcaacagacacaagcaaatatttcaactggctcacacttaatataaatttacaacagtatcaccagacatttacaaaatttttgcaacacaacagagaaaggcaaaagtgaacagtagaaaaataaaataatcccaagataattgaaggaaacaattttataataaatactagtactcttagaggaaattgatgaaacattgtacatatttataaaccaataaaagaaactccaaaagaagaacaaaaatgagctcttaaacatttaatttattatatttataacttatagttttaaaatgtattaggtttgttaagaacttagatattttagtagaaattttaaaagaaaaagaagggttcaaggaatacaggaagtctataagatctgttctatttttaaaaaagctggaagaaaaagtaggattaggtcaagagttctagagtatccgggtagcaagaaaaccagaaaagattaaatggaggggaaggacgtttacaaatatataaaataacatccctgagagatcttctgattgaaagggtctaccaagtgctgagccaggttgcaggaggtggggatgggcggggaaagcttatagtggatctactatacgatttaagaaaatgaaggataaataaaagtttcagagaaaaacgcacatacataccaaaacatactcagtctccctgtgactcctcaacaaactaagtgtaaaatcataaaacaatgttccttattactttgagaaaagttttctgcaaactagttatttaaacattcaaactattaatcatgtgagtataaaatacattgtcagatgcacaagggctcagaaagtgtctcaaatctttgctagaaagttaatttttgtaaccacgtatccaagaggagaaggtccttgactagcaataggtttgggactagcatgaggccaaaggtgcaagttcagagcctttttgtgtgtgttttgattttgtttttccattatgggattttttgcatttatttttactttttaaaaaattaccttataaaatgttatttatcttaaaattgagtgttttggtgccccgttaacttttatgtccacacatctgcctcgctagtctcatctcagtcctgtccttaactagtgtatgagtttcctatggctgccataacaaactggatggctgaaaaacagaagtttattctgatagttgtggaggccagaagtctcaaatcaaagtgtcaggagggaccacagtggccctgaaggccatgagaactcaggccttgccttctcaggcttctgttggccccataagttatttggcttgtggctgcttcactccaatctcagtctccataatcacactaccttctcctcctctgggtgtcttcccctctgtatgtccatctcaaaattcccatctgtgtgtctcactggatttagagcccaccatgatagcccagaatgatcatctcatctcaagatccttaattacaaaaatcctttaaaagaaataaggtaacatttacaggttctggggagtaggatgtaaatgtatttttttggtggtggggacaatattcagcccatcagaagcagcaagcagtggatgcaaaatcaggaaataataaaggaacattccagaaagatacctgtgcagctgacctaaagagtatctagtccagactaaagcagaagagaatctaggaggcagatctccagggaaaaaaaaagatttggtagaatcagtgggatgtttgagggagcaaatgaggcgattataaaggcaaatttttttaagtaagaaatgccaagtgtatctatggcagaaggtagatggaaaaatggaaaggagagctaaaagcagtggacaaggacagcagtctcttcttgctgtgtataaaatgaaagattatctaatcttgatagaaggaaaaacaaagagctgcaacaattgtattacttacaagggtttttaatggtcaccaatatagataatccaaatagcaatatactaagcgaagcaaatcgtggcaaaagtgaaccaaatcctcagctatcatactaagaagtcagtaaataatgtctaaagttgaaaaacttaaggaagaaatacactatgtagagacgtgaaagaagctgcaagtaaagttttaaaagttttcgatagagagtgaaactattgtatgcaagtttatttcctttggtgttttaaatgtgcactaatacataaaaataaaagaacttgtaacactttcttcagttgcatgccttgggaatgtcttttaatgaatcttggggtgtctttaataaatagaattttttaattttttgcattgtcttataatgcctatttcactattaaactctgtgaaccgttaacatttttttccaggcattggctgatacattattaaaatgcagtgaaatgaaataacataaaaataaagacattctaaatccaaacaattttaaaatcatactcaatagaccctttccccatcaaattgttgttaaagtttctaaaagcttcctttagatacatatttcccatatctcatactggtaacacaaagctcgcagattttgataattttgagaggcataatttgagtaattgcctagttttttctttttcttttctcgtcattaaagtctttagtagttttgtttttactgtcttgcctgagaaaacctttcctaaaccaaggttgtcaagatattctgttttattatcctctaaaagttttgtcactttattttccacacttaggcatcaaatacacatgggcattgtatatgataggagatagggttgtaattttattttaccttatcaatatccaattgtgccctgctcatcaactgataggatcatacttttcccactgctttccagtgacttaaaaacatatatgacatatcaagagtccattaatgtatgatgtgtttcaggactcagcattctgcatcagtgttctatatgcctagcataaatcaaatgtcaatttaattgttgtgctgagataagttgatgttcttggaaaattatctttcaccttgttcttttcaagtgtatgttggcttctgatggccctttgcatatccataaatctttttttttatactttaagttctgggatacatgtgcagaacatgcaggtttgttacataggtacacacgtgccatggtggcttgctgcacccatcatcctgtcatctacgttaggtatttctcctaatcctatccctccccaagtggcgcataccccaacaggccccagtgtttgacgttcccctccctgtgtccatgtgtactaattgttcaactcccatttaggagtgagaacatgcagtgtttgatttcctgttcctgtgttagtttgctgagaatgatagtttccaacttcatccacgtccctgcaaggacatgaactcatccttttttatggctatatagtattccatggtatatatgtgttgcattttctttatccagcttatcattgattaacatttgggttagttccaagtctttgctattgtgaatggtgccataataaacatacatgcacatgtgtctttatagtagaatgatttataatcctttgggtatatatccagtaatgggattgctgggccaaatggtatttctagttctagatccttgaggaatcaccacactgtcttccacaatggttgaactaatttacactcccaccaacagtgtaaaagcattcctatttcttcatatcctctccagcatctgttgcttcctggcttcttaataattgccattctaactggcatgagatggtatctatttgtggttttgatttgcatttctctaatggcatgtccataaatctttagttgactttgatgctttctccattaaacatgttaagattttgattgaaatgcattcaattataaatttggaaagagaaattgacatctttacagttttgggatttccaatctatggatataatttactacttcatcgtggccttttatacctttattttaagtgttattaattaaccatcaaggtttttcatagctttctgcaggttcatttctagtacatcatatttatttttgcctgactctttacatagtatttttagttgaatttcatctgtttttcctttatatgagattcaatagatatgtagttatacaaattgacacaacccaggaatctagctcaattctgtgcaattctaataccttagcttgacattcttttgaactttacagttttgagattaataaaatttatgattgtcttgtaaaaaattattaattccagtttttagatatctttcaaaatatatagtctctagaggtatagggaagaaaaagtaatattttcctcatcatagcaagggtcatggctgtgacttctattaataaaagataataagagaaaggcattcacatttacttaatctaagttttatatgacacaggaacctttagaactgaagaccccccaaagcagggaaaactgtgtatatttatgcttacgtttgatgaaaattggataattatacagaagaattacaactggaagaaaaaggagtataagctaatggtaagaaatgggagaacttagcaagtcctgtttattcaggttctttctggtgtccttgtgtgatattacttccctccaagtgtgaggcagaccacctgtcacgtgaaggtcttcaggggagaagggaggaggaaggtcagagacctttctgcttttgctgttttctcaatttccaagctgccatactttggagtagcatttcttgtaccccatgagagggaaatataaggagagaagtcttaggtggtgaaaagattgggattgtaagagtggaaagatatgatttctttcttccctcatcattagagttatgtatgacatttctacacaaaagacagattaacaagaaaaaaagcagaacaaatttatttcatcaaagtttttattaaataaagacttaaagacccagggaaagtgtctatttttatgttcaggttggatgaataatgctcagccatgtagaaatacaactggacaaaaggatctgatctaatgataataggttgagaaaggaaacctagcagagcctggctgtttgaattcttcttggtttcattgtgttgcattccttccccgcaacccctgcaacttccttgcaggcaaaggaagtcatagaattattttatggccagttatcacacagaatagtgcgggaagatcagagtgactttcttccttctgagcctctcccaatctatttcagttcaaggtactttgggatagcattctccgagctccaacaggatccaccaaactgctatctgagcttgattacaagtcatcatagacagttgaattttatagtcaacgtgtgttgaatacttctatgcaagtgtcattgtgaccgctgaaagggagtttctcacttagaggagctaacatagtatcaagatgagtaaaaagagtgcctctaacattgtattaatatatatagtattaatatttcatagtctgccatccacttcatcctccagtctgatcagtaacagaagttattgatcatttttcaaaacagcatgggaaattcattttatttatctcttataaagcttaataaacagctatagagatctttatgaagaggactttgtctcttgaaggacaatattctattttagtcttaaaagcattaaatttttcaatttttaaacaaaattctcatcaattggatgttatacccatctatttatatgtgagaagaacaaagcttatattactttgttttttttatactaccagggcatattttaaagtttgaatgtttaaacatacttggtcagttgaagagaatgactttcttcattactgattgaatatacagggagaaattttagcaagaagaatgtatgacttttttaaagaaaataatttctgaatgataaaaaggaccattttcccataaagacagtcaaggtaaaatacaattgagtagaactaagaaaggaaacaacctcttcagttaatgcattttcagagctaagcacaaaggtgcttcctaaacaaaaggatctttacaaatgagggtgctctttagagagaatattttcaaaggacccctatatagttcaacaggctccttcaaatgcagtgcattttaaaagcttagaaagtaatgatatgccctctagactgccaggcaggagttttattgtgaaggttttggcaacacagttcggtttgtagcatccgctttgaactagcctttcatgattctgagacacgtgcttataataataagtatttacaagtcaggagatgaaattcaagtttctatttttatttcccccatcctctcatctcctacattttatatattggacctaccctaagattgcttctgactctgcacactctagtgtcccaaatttattcctaaactctgcctctatcctaacttcttgcatacatactcaccctttctagccaaggacttgcattcaatcccaaatacgctgacctctggaatctcagcctttctccatgtgcatctttcttcctccatgtgtattcacttgaggacctttcatgcttgtgactggctgaacctggatcaattgctctgctcctgcttggctttattccaacctctcttgttcctctctaggttagtgtacaagaaaaatcagcatatccccaataatctgttaagtgagttgtgaatttgagaagttaaggggaatgtattccccattatactcttcgtataaacattttaattttaaaatctgacactctacctagaagaaatgggtggcagatttgcccagcaaggtaaatcatcactatttgttatatcatgtatactgttgaaaggcctaaatgtctttggacagatggtgccctgttagagtaaaggaagctaaaaacaagagatcatactgattcccagtgtgttagatgtttctaaaagtatgtgtatgtcataatgaaaaacagacctaaactaccaatactttcagaggaagcatagtcttagactctatttatcatttaagtgaataataattatacaagaaattcaatttatataagctgtcaattagaatgagttggacattcctacttgttctttttacagcaactgctcttaaaagtggtttaacaccgatttaaactccttgaatacagtaagcatatgtttatccagaactaaaaataatttatactactactcttttttttttttttttttttttttttttttttttttttacaacacaaaggttgaagtacataaaaatgctattgctttacacaaggcagcaaagttttaatcttggcatccacaggtgtgtaatgtgacttgagacctaacaacaccctctaattctttctgaatccttataaaaagtaagttatgtccatgatgttgatagtattattttttctgtaaaagacattgtagtgtttaaaacagatttctggtacagtccttgttctcaagcatttggtaaatagtctgacttaacaagagtcctcatgtctaatccctctaaatacaggcttatacttcactgtatatacaagtgtatatgtgtatgtattatatatagtgtgtatatatagtatatatgtgtgtgtatgtacacacacacttgtaaatacaagtaggtacaagtttatacttcactgtgccttacagggcaatacatacttcataaattgatgcataatgattgtgcatatttatggggtacatatcatattttgatatatttatacaatgtggaggaatgatcaaattggggtatttaggatatccatcacctcaaatgtttaccatttctttgtgttgggggcattttgactcttctaactttaatgtagtctcatgcattttgaaatatacaataaattacatgtttactaccacacactagaatttattccaactgcatatttgtacctattgactaacctctcttcatcctcctcctccacccttcctagactctcgtaactgtcattctagtgtataagtccatgagatcaactttttttgctcccacatgtaattgagatcatgcaatatctgtttctgtgcctgccttatttgacttaacatagcgacctccatttctgtgttgctgcaaataacagaatttcttttttatagtgaatgatattctattttgtatttttataccacattttctttatccatttactcgatgggtacttagattcctatcttggctattgtgaatagttctgcaataaacatagggggtgaaggtatctctttgatgtaccgattccctctccattggataaatacctagtggtgggattgctggattgtatgatatttctacttttagtcttttgagaaacttctgtactgttttccataatgtctgtactgatttgcattcccatgaacagtatatacgggttcaatttttctctacatgtttgccagcagttgttattttttgtctttttgttaatagccattctgactgaggtgagaagatcttctcattgtggttctcattgtgatgactgatgatgttgatattgaaaattttttaaatatgttttggccatttgtatgtcttcttttgagaaatgtctattcagatcgtttacccactttttaatagtgatatggctatgttgcttgggatatgtaccctggggttcatcgtctcatgctgagaaagaactcaggacccagacacatgtgagtgggttaagaagtagaaaatttaatagaataaaggagagaggagagcaggtcctagggaggtggagggggagagagagagagaagagaaggggggagagagagagagagacagagagagagagacatgtccaaaaaagtggggaggtggttgactgcagcagattttataggaaggctggagaaggtggtgtctgatttacatagggctcacagattggttgatcaggcacgaggtttacatagtgcacagggaagactggtcaccccaacctagaatgtaaatggactttccagttaatcgacaccatcttgattcctgttgattgacaccagtaagattggcaccatttgctctttactgtgcacatggctgacaaagagaagggaagatggagctgctatctttaacatgtgtagtccctagttactgctggcattcacctgtgcaagctcccagtttgcttgtctgtctgcagctctactttataggctgctctttgttagaaaatgatttggggctgcttttcattaaagagaaaagcattaccaaagactcccatgcccttactctctgcttaagtaatttcttaagtcctatatcattccaccctctgcagtggtaaccctaactgctgttagagaatgttggatgacaactttttctggctacttcctgctgaaaggggtatcatgtggggaaaagcagctagggctcctcctggggtcaatctaagggtcctcagaagaaaggtgtgtccatgtttgtttggtctgcagcaccatttgcagtttgattgctctcaatcattctaatgggttgtgatactggtttgcctccaccagatgctgctaaatattaatataaaagtaacattcttttttgaataagtggcattggatttgggtggctagagtaactttagtattgaccttggctaaatctttcctgcaattattaatcccctcatgacttctgcagaccatctaaggcatgtttaaactttctaacttctcctaagcatccttctttttaaacaaccaactattatttttaggacaagtatttaccatctttataatcctttcatacttcctttttggtgaaactattatccctgctataaggataataattaagcaaaatactacagcaatggaaactctgtgtccactattccagttagaaggtgctactgtttatagccctactgcaaatagcagagtgagtatagcaaatcttgcaagtgtggtgtagtaggtactttccacataaaatcttacttgtcaagatacagaatttatctttgggggtctatgaagttccttggttttattttcctaaacaaaactccaggttatgggcatcctatttactttcactgcttggcaggatttgcaggataattgctcagaactagcatattaatccagatttttgtgttacccatccctttttgtttcttccaagctgcaggaaatcaccatttgattacaggaataagcaggattagtctaaaatgtaggcaaaaaaacttaaaaacaattagtgagacaaggatttaatgacatgtatgatatgctttggagcataacttttatctctccagtcctcatttttggtaaaaaaacaaattatgataggaccatgttgtttgtagaaaaaactttaaccttatacttggcctgattatttggaataaagttcagcaagaatggttatttctacatagctcttttggattggcttagatggaactcagttccacaaggaatcttagataggaccttttaaagctgagcccggccataggtttatattctctaatacctgtgagttgggtgatccttttctcttaatgttccaagataaacttggagttcgtggacctgttagaaagtgacattctttactgaccacaggttaggaaccctgtgtggggactgtgtagacaaggtatgaggccagtcttccccaaggggcttttatcagctctgcaagtcgagattgactccttaaagggaagcatatacttccagtcaaagccttgataaaataaccagttttccaattgtgtcccattgcaaaagaaaaatggattattattgcgatgatgcaaacaactatattgccataagttaagagtactcacagatagtttccaatttctagaggaactaggcagagagaaacatgctccaaattttgttcacagaagtataccttactcaattattaaaagctttaaaaagttaaaagtatgtttccttgagtctaaaaaacaaaacaaggatcagaaatacttcaagcaaaatattccaaaaaggttgctttaactttctgagtacagtccattagttaactcttgttttgtttgacacataaacatttcagttcttcataagtcccatacattctttctctattccaatgttacaatcttcaaaactattgaaaacctgcatttgcaatcacctgttaaggtccttaatatggcttgatgataaaccacattttgagaaggaacaaagcaaggtgacaattgtctgcaaatggtgacaaagtttccagggtagttagttaaaaacatgactaagaagtttagttatctccatggtttacaataattttacccttaattatgattgatagcatatactcagacattagaattttagaaatcccatgcactgttggaacatatcttagtattattcactaaaatataacttaaattgtacatcattttggcaatcccatgcaactaaacatgtcaaataatcctgtttacctcttttctgaaagtttcaggggccttctgagccatccagaaatcccagctcagggaagataatttggatactagaagtttgatttttgggatgcctgttaaatgttagagatttaaaacacttgatgttatgaaatagaatcccagattaccataaattatttattttgccaaaatgatgactcaaaaagcaaaaatcttttattagcctttactattgcatgaaaatcctgttaaaagccaaatttttacccttgcattagtttattaatgttaaccccaatgtttaatgaaacctcagacaatttcatataatcttaaccaagttgaacatgaggtgaaatctgtacaagccttttataactgcttttgctaaagaggaggttagtgtcttaagacagtcttgctgtgcttttatttcaatgctcaatttataaaaagaccatataataccctttgaatttagttaatgtttacacatttttgcaagattaatttttacaatcttttcacaacttaaatgtgtttagctttattatatcaaatttaagataatccctcatccctgggcaaaatttacatttccatgctttcttataatcttttactaaaagacaccttgcaaataaaactgtttagtgatttcaaacacatgttgcactgttaactctttgcaacttttaatgaaaaacctggttagtaagcaactttatgtatcaggtgtggagcctaggaaccagacagaattgcagagtaggtctgactccacatgtcccaggccttacctatctgtaaagcatgcagtatacaaccttggaacatttagcaagcctagtatctaagtggtatgattaagaccacctttttgcattttgacgacacttgcattttgccaataatccttaaggctatttttatttcttaaagattatagtcatgtgagctaaaaaatattttaagtgcttatttttctttaatcaattagagctctttttgtagacattacgcataacacatatatagcaacacagaattcagaactagtatgatttttcatttgccagtttcttattgggattattggcttcagggcggagcccttggaggaacagggccaggaaggcatgcatttctagggcataaaaaacaggcacagctgaaggcaaagacagaccccccaaaaatattggtgccgttttataatggattttggatccccaaaaggagggagagcctatgggagaagagagtatggtaattttaccatgcatttcattgcaaggcaacccaaatccattcagcttattttgtaatcagcccaacccccacatgattcttatctcttgggggagtggggaagtttgtatgtttcaggtgaccaagagtatgcttctctgattcaaaagtgcaaagagttaactatccttccgtaactacgattagacatcccttaaagtatgttttctctctagttattccccacactaaagctctatcatgatgcgaggtaatttggtacctctaaaactcaaaactgtcagataacacaatgaaaaacagcaaagcctttggttttgagagggaattatctgcttttaattcctggggttttgtgagaaaaacaggttttttctcaaaagagagtttgtggtgtcacctctgtttttttcccaaggagttccaggctaccagaagttgtcttagggcctctcatgtgtacattaagagtggcaagacaaaaaatggagaaaaatgattcagttgactgagaagaaaaggctttttctaggaaagcaagattcaagaagagacaaacataaaggccttttaaaaaaaatctagaacttggatatctgctttgaattaagctgagcactctttaagaaaattattttaaatctcttgttactcaactttagccacgctaagcagttaagattttcagcttttgaactttataaaaagtaacctcacaggtgaaaccaacaagcctgagttagtttgtgacttaaccatgagtgtacaaggtattttcaaagtggtggtaagcagcttttgaaactgtcattgcaaaattgtgactgagacagtaaaggagatctgacccaaacaactccattttgtttccagcccctaagctatccttgcccatccctgagtgtaggctgaaccaactttgggaggagcctggtttacagtttatagtccaaaacaaagataatagccccttctgaagatatacttccctcttgtctggggaccagaccaagaaactagccacaagatcaggaaccatggctcaggagtcacgcagctgaaggctacaaaattttgaccctcccttaactgctctcaagatcagagcttaaggtattttgtaaacactgtcattgatagatcagctggtaccacctagatcaacaaactaacttatctgattttctggccctcacccaggaactgacttagcacaggaagatacccaccactgtaaaatggtggagactaaaagtattgccacgtggttacaggtattgctcccaaagacatgaaacaatatggaagcctgtagccaagtttgttatagactgttttgttgggctggcatgaacaggaggcttatgggatcctgggtctgcatcctagcctaacatatgttttcttttgacagaaagacacacaaagcacaccagatttgctacagcttaagactaacctcacaaatcccttttcattaatttaaactttacagataatataaacaatgatccttgttacctcttttaccagtttgcatgggaagagagaggccaaaagcctgaatggtaagaaatttctacccttttgctggcatgtcaggcttctgggttcccttccccctagctcaactagagaagcattttaaggtttggaaaattaacatttcccaggttggaagaacattataaaaaaagatagccattttataccgtaaaagaaggaaccacaccatacaaaagtctgggatatcagagttgtcaaagaggtactgcttcctttcctatcaacagtggtgtttcccctatttcttcaccttcccgattttctcttttccctttttgcctgttataggagacatattgctcatctccaaaattctctgctgcctgcagaattgcctgtttttcacctacagttggggttaagctttggagcagcataacatccctccatgagaagtcaaatatctgagttaaattttagaaagcttctatatacctatcagggtcattagaaaattggcctaagtctccctttacttgcctaaggtcctgcaatgagaatggaagttgaaccctcgtggcatcacctccattggacattttctgcagggttaagagctaaggtggcggaatgggaaattttggagatggtggagatggaggagctggtggtgtggttggagctggccccagataatggggaatgaaagggccaggatgctcaatggctgcctcaaatggttcccccaggagttgcttttctaattttggggaattctctctgtgcctgtctgatatgattgctaaaagagccgggctgattttgcaatgcttgcaaaggtctagcaaaaaggcaatgcccttatgtagaagaaaacaagccactttttctttaaaatctcagggtgaaaggagttccagtgcttcagaatgcaccccaggggagtgcatgctgaagatgatacccatctagaaagagaagtgagaaaaaggcatctgtttagtctccttccttttggtgtgacccagagtggaaaggaagacagtggaggcgttccccctgctgttttttgtgttttgttttttttttgtttttttcctaaatggttcctgggtcctggcatcaccaaccgtggctgcaggcatgaccctcagccatagaaccagaggaactaagccattggggttagtaatgctcacccaagtggctctagtcctctgcttgtgattttgctttgacttcctggacttgtgtaacctgcctgactcctcaaaaaatgtatctcaggagagattatgtgacagttgcatttaagcatctgttgcactttcctccttgatggaggaagtgtgctgatttgagctctatatcctgctagtatggttcgtgttaaagcatctacccttagagaatggttccagttaacttccaaacttaaaatacccttactaattaagtactattctaaatggaagcagaatacgtgccttaaaagaaagtaggtatcaaatggccattttcctgctgatgggatagtattgacactaaaatctggctttggaggatattttgctcttaattgttgaaggtagagttttcccatttgcagaagcaacataaagcctggtctctagaagaggggtgcaataagggcaaagaattgggaagccagggtgttttgataaaggactgacaatgtgcctcatggagagagtacctattccactagttggtgctgttgaccttgaaatgccatgaactctccagaccaagggcagagagtgatgctcactgtggggggtgcgagggtgggggcctctgttcctagaaaatcccaaagatgcctacctttgagctatatccacagttactacaacattcccagatctttccaaacaagattatttccctgaattgtaaaacttcctacacattgcatacatagagagattaagagatgtgatggtcatggacgagaaaggaggaaattatgataggaaagttggagatcctgttgccaacaccccaccagggtggtcagaggccgaggtcagtccataagcctttgggtaacactcaggggtagccccagccagaagttctcagttgccccaggacttcttccagccccatacaatggctacgtcttccatgaaaggaggctggttcaaacatggcccatatgccatatgcccagaaacccataggtattgggggattctccatgttctctccagtaggtgtgacatccgagtctttaagaatggcaggcatgctaatggtatttttaaatggctggcagatgcctgttattgatttaatttgattttaaaatggaggctgaggcaaccattccagttgattctattccattctattccattccattccattccattccattccattccagttgattcaattccattctattccattctattccattccattccattccattcgggttgattcaattccaattaaaggacagattttgaggtttttctccatatttaccactcacatgattctaccttctgatccctttcttttagaaagaagtcaggacacagacacatgtgggtgggttagggagtggaaagtttaatagaagaaaggagagaggagctcttgtgtgtgagagacctctgataaagaggtgtggtggcagactgcagcagattttataggcaggttggagaaggtggtgtctgatttatgtaggacccacagattggtttgatcacatatgatgtttacatagcccatggggaaggattgtcaccccaccctaatcttatgcaaatggactttccggttgattggcaccatcttgtctgttctttattgtacaagtggctgacaaagagaagggaagatggagccaccaccttgaacatgtctagtcctagttcctgctggcattcacttctgcaagctcccagcttgcttgtctttgaggctcaactttacaggctatttattagaaaatgatttgaagctgctttttattaaagagaaaagccttactgaagactcccatacccttaccatctgcttaagttatttcttaactcctttatcagtagtatttgttttttggctgttgagttgtttcagttctttgtatattctagatatgaatccctagtcagatgaatattttacaaatattttctctcattctgcatgttgtgtcttcactctgttgattgcttcctttggtgtgcagaagctttttagcttaatgtagtctcatgtatctattttggttttgttgcctgtattataaagtcttggccataaaatctttgcctagaccaatttcctgaagcatttctcatattttcttccagtagttctatgtttttgagtcttatgtttaactctttaaccattttgagttgatttttgtatgtggcaagagatacgggtgtagtttcattcttctgcctgtgagcacttagttttccctgcatcattattgaagagggtattctttctccaaggtattctctttgtgccttttttaaaaaatcagttggctgtaaataggaggattaatttctcggttttctattaatctatatttctgggttttatattgtgccattggtctatgtgttttattctaataccatactgttttggttattatagctttgtagtatatgttaggtagtatgatgcttctagctttttccattttgctcagtattgctttggctattcagaatcttttgtgtttccacataaattttagtttttttttatatttctcttgagaacgtcgttggtattttgatggggattgcattatgtctcttgaatctgtagtactatggtggcattgggaaggatggctattttaaaatattgattccttcaatctttgagcatgtgatgtgtttacgtttgcttgtgtcttcaatttctttcatcattttttttgtagttgtagaagtcttttgcatccttggttaaatttattactaggtggtgttttggtagctattataaatgagatcacgtccttcatttttaaaatctagtttgttattggtatataggagtgctgctttttgtatgttgtttttgtatattacaagtttactgaatttatcagttctgagttttttggtggagtctttaggtttttctatacataagataatgttgtctgcaaagagggatgattgttctttctttttccaatttggatgccttttatttctttcttgcttgattgctgtgctagcacttccagtactatgctgaataaatgtggtgaaagtgggcatccttgtcttttagttgttaaaggaaaggctttcaactttttttccattaagtacgatgttagctgtgttgtgggtttgtcatatatatggtctttctttattattttgaaataccttctttttattgttgagagtttttgtcatgaagaggtattgaattttatctttttgatgcctgttgagaagatcatatgatttttgtccctcttctattgatgtggtgtatctcatgtattgatttatgtacatggaaccatccttgcatccctgagacaaatcccccttaatcatgatgtattatcttttcaatgtgttgttggattaagtttgctaatattttgttaaggttttttgcatctgtattgatcagaaaaaatggcctgtaggtttttgtgtttttttaaaatctttgtctggtgttggtatcagggtaattctggccttgtagaatgagttaggaataactgtctcctctttaatctttgtaatagtttgagaataatctgtgttagttcttcatacatttgataaaatgcagaattaaagccattcagtcctgaacttttctttattgggacgcacctgatttctgattcaattttattattcattattaatttgttaggttttctatttctgtctagatcagtcttagtaggttgtatgcgtttaggaatgtttcctctagattttctaatttgtttgcatagagttattaatagtctctaatgatcctttctatttctgttgtatcagttgtaattccttctttttcatttctaacttatgtgggtcttctctttttcttggttaatctagctagcagtttaaaaattttaccttctcagaaaaacaagtttttgttttattggttcttggcaatgtttttcatttagtctgtttttagttctctaatttttgttatttcatttcttctgctaattttgttctgttttcttattttttctagttccttaaggtgcattgataggttgtgtatttgaaatctgtccacttttatgatgtcatttattgctataaacttccttctagcactgcttttgctacattccattggttttggcatactgtttttcgttcttattttttccaagacattttatttccttaatttcttcattgatgcaatagttgctcaggaccatgttatttaatttccatgtagttgtacagttttcaatattctttctattaaatattgttcaataatgttattgaatcaatatagaataaaacttgtcttattctattgctatatcctcctgctaatatgatttatttttcaatatatgaccttgtctcttcagtttttcatttaaattgttttctataggtacagttacttttttttttctgcttttggtttccatttacatggaatatctttttttatcccttcactttaaatctatatcggtctttataggtggagttagtttcttatcggtggcatatagctgagtcattgttttaaatgcattcatctagtctacatctcttaattggggaattctgcttacattcaagcttattaataagtgaggacttactcttgtcattttgttagttttctgggtgttttatataccatttgttattttcttatggtttatcatcatggtttggtgattttcagaatggtaacacttgattcctttctctttctcatttgtgtatctagtctaccagtgagttttatactttcatgtatttccatgatggtagatattatcctttcacttctggatgtaggactattttaaacattttttgtaggaaccagtctattggtgacaaattgcttcagcttttgcttgtctgggaaagactttatttttccttcatttttgaaagatacctttgctgggtctagtatttttggctaaaaggtacttgttttataaagcattttgaatatgtcattccattttctcctgacctgcatgatttctgctgagaagtccactgttagtctgatggaggttcccttttatgtgacttgatgctttttctcttgctgtttttagaattctgtcattgtctctgacagtttgacaataatgtggcttggagaagacatttttgaattgaacctatttggggatctttgagcttcatctatctagatgtctatatgtttttcaagacttgggaagtttttagctatttttattaaataggttttctatgcctttgcccatctcttctcctttgggaaattccagaattcatttaaaattttggtcattttatggcatcctactggtcacataggctttcttcattcattccttttttttttcttctgcctgcattattagaaaaattattttgcttagcctattgacacttgtatttttttatttctttgatttcttcagttctaggacttttggtgctcttaacatatctgtttcttttttgaatttctcatctagagcataaattgtttctctgatttatttgtattgttggtgttttcttatatttcactgaatttctcatcataaaatttctaataaggaattcaagataaagttcctgttttggggatctgttattgaagaattattttgttcttttggaggcatcatgtttcctttttttgtttcttgtgtccttatgttaatatctgcacatctggtgtaatagctgcttcttccaattttatggataggcctttgtaaggaaagatattttcctacagatgtattatagtattggttaagtaagttgctttggctttgattttggatgggtatagcagtgtagtctttgtatgacttcagttatattcagtgtcagcgatatctggaagtacctaagtggcttagactgcaattgttaatggaggttgtggtaagactttgatgggggtgggaacatcagctgggttagttcttgtgcaccagtttggcagcagtacaaatgttgggtctgacctcaggcctctggatggtgtgtgcaggcaccagcagtggtaggtaggttgaacttatactctgccctgtacaatttgtatgggtgctggcagcagtggtgatgggtgggatggaacccccagtggtatatgtagctgctggctgtgatggatggggccaggtccccggacagtacattcacatgcaggtggcagtggcaatgggaaaggctggctggttctcaagccgcataaaacacatgtgggcaatagcagttgcagtggtgtgtgaggcaggcctgttctcaggcaccactggtggtggtgggtgcactggacctgttagacctccatatggtgcctttggagggcagggaagattaatccccagatgccaggttgcttgcacgaaggttgcttgcacgaaggttgcttgcacaaaggctacacatagcagcttcttcctctggtacctaatgagatgttgcatagggcaaccatcagtatcagatagggtctgtcaatacccaggcctcgaacaatgtgtatggcaaggcaagctttgcaatacataatttttaagtgacttaatatcaggctatatcttaagatttatatgtctttaatagagtagagaaaacaaaaatttggaaaacatttccttactgagtggtagaagtagcagactagtctttggctgatccagagagactgcagaggaagtttcttttctttttaaaaatgttttaaagacagagtctcactttgttgctcaggctgccctctgactcctgacttcaggtgatcctcttgcttcagcctcccaaaatgctgggattacaggcatgagccactgcacctggccccctgcagaggaactttctaatacaattagaggtgtttttctttgttaaaaaataaaaatccaaatactttctgagttgaaaggaagctactctaattggccaaagattatttataactgtgtctgtgaggctagttaggctaggaaaaaaacctgaaaagggtgagtaggaaaaacaataaggcaaaggagaatgcagtgaggtggaaaagctgtatttagagccccaaaccattcgtatgaagttttgtatcttttttttttttaaggtggagttttactcttgttgcccaggctggagttcaatggtgggatcttgtctccctgcaacctccccctcccaggttccagtaattctcctgcctcagcctcccgagtagttgggaggtgcctgccaccacgcccagctaattctttatatttttagtagagatgaggtttcactatgttggccaggctggtctcgaactcctgaccttaggcaatctacccacctcagcctcccaaaatgctgggattacaggcgtgagccaccgtggccagccttatgtgtgttttattaatgtttgaaataaaacaggaactattacaaactcacatgaaatgttcttgtgatgcttaatacatatagacatatttctaaagattttcttctgaaattagaagccatctaatccgtggctacttgagacttccattaatttatacacattcagcggagctaacattcttatgatccatgaagttgtttatgttgtcctgcattgaactgcttcagattgctatagtttgaagtttgggaatttggggagtaatatactcctcattttataaaaaggaaataaacttcatcaaaggtaagagaatttttgttttgtggcatgatatattattgctcatgggtatacatgtaacaaggaagcatgaaaatgagaaggtgaaaaaaagggaagatctgtgacttgcttaatattgcacacctacaattgggcaaaatcaaaattgaaaaccaggtcagtctcatatcaagtcacatgttcataatcatgataggctctatccagtaatttcagcaattgtacccaaatacctaaagttaattccactttccaaatacttgtatggagcccatctggcacccatgaatcagtattttagaagttctctcaaatggctcggtgtccaagtgctaggttggttactacaaaaagcccagcataattgatttctgaacaattgccaggaaataaacaccaatctattaatgcagcttgatttctgatactttgttttatctgttaataactagcaatataataataatgcctattataattgaatcacttacaggattaatgtcaagtttggctagtttgttgttgggtgtggatattttaagctctaattgttcttcagttacatcattttttccacttgacggggaactctgtaagggcagagatggtagttcttcactttgaatcactaatggctatcaaaattttaagacgtagtagttgtcaacaaacatttgctgaactagtttaaataatttttctaaattatacttttattatgataaatagtgatagtattcactttcttgtggtgttcagtgaattaatgaaattagttactgcagagttcctagtgagaaaaggcatccatgggtcctactcaataagtaccttcagcaaaatctgttctgaaagtcaaagtgttccccagctaatactgtgatgaaaatgcctgcagaatcaaatgcaatatgacattcaatgttttaaatgagtcattaaacaaagaatattccaatattgtgaatcttctgtgaagtttttacagactgatggaatagaaaagatagtattctatttttacaacaagaaatactgggagatgcactacaaaatgacatttccagtgagatttgagcagcatcttatctttcaatgtgttctttattcattgattcagggtatcattcctggggtatataggtgaatatgacgatgataatatgtctggcagtacatagattgctatccttctcagttgaaaatggtgttgacggtgaggttagatgcagataaaaaataatctttgtgtgatagcattttcaacaccaaacagatgttgcatacttatgaatcagtgacttctcataagtagcaaaatgtacattgtgttaacgtatcaccttgttttcataagtacaattggttcctgagaggctgcagagtatagtagagtaaaagcaagagaagttttcttttttctccctgatgtatcagttattgttgcacagcaaactaccttagacgctgtggcttaaaacatctatttattttattcataattcactgggtaattctactggtctgggccagctggactggtataattatgcacctactataagctggcgtattggcagggtgcatcattgacaatagccttgttagagagataggagcctttcttcaggtagtctcatcctctggcaggctagcttggaattgtttgcattgaaatcccatggagattgcagggttccaagagtgagagtctcagtgtgcaaggtctgtctcttgagtcctgggctggaactttcaatgtggcttctgctacattctactggtcaaaacccatctcaaattcagctgaggcttaagaattatagaagtacactcttccctatgatgagagtggaagaggttactaccatttttagaatttgccacagcttctattgtaattctcaaaccaccctcttcaagaagtcatgtcttttagtgataaccataaccacaactacaacagtaacaacagctcacacgtatggaggacttaattgtaacaaagcctattctaatgttttatatggattaactcaattttcacaataacaatgaaggatgagtattagtttttctttatgggtgaaaaaaaaattgcctcacaaaggggttaatcattttacaaaacattaaaaatttccaaaagaagattgccttagtcaaataaatgcagaaaatgcaagacaaaataataattaaaagtctatctatgtttctatccatacaaccatttatcctcttggacttctcaaagttttgaatgcagtaaagtatattttgaatcttacagaagggaaagaaggttataagccacgttcaaatttggaatctaggaaccccttcattttgcagagtatctgttaacatcttacatgacagtggtattctatggaactgtttgtaaaatgctgtaattaggctttaaactagattccaaattgccctgatttgtagcacatgtatctctgtcactgagactataaagaatataaaacatgcaatatgcctgctttttttctctatgtgcttgtctgttcaaaaaatcagtgaccctttagacatgcagaagttaagccagatgtgtctatgaatcacctcaagggttttaagccaagttattttgcattgcattattctattctttttttttttttaaccattcccttcttttttttatcaacatccctctgagcagtaacacagtattactgctctaagggatgacagttggcaaatagtactatagcatggcaataagatacagaatgaaaattatacctgtgtcaaattgcttctgaatcatttacttcaagatagtcaaattaggaagaccacccctgagccatacagatgaggcagtaggttggagaaagttatctctagctctttaggttttagtatctaccgtttaatattgctattgccagagtagcaatctggaggagagttttggaatcaagattaggctacagaaggaatttaaggtgtgtgtttttgtatatatacatatacatgtatatatataactgtacgtaattgacccttgaacaaaacagggttagccatgccaacccccacacaatcaaaaacccatatataactttttactcccagcaattttttttttttgagacaaggtctcactctcttgtccaggctgcagggcagtggcatgaacagggccgactgactgcagcctcagtctcctgagctcaagtggtcctcctgtttcagctttctgagtaatcggaaccacaggtacacatcaccacgccaagccttttttttttttttttttttttttttttttttttttttttaatggagacacagggtctcactgtgttgtctggactggtcttgaactcctgggctgaagtcatcctctagcctcagcctcccaaagtgtaaggattacagacaggcgctactgtagcccagccctgaaaatcttaactactgatagcctattgttgaccagaaaccttgctaataactagcataaacagttgattaacacatactttgcatatttgttatatattgcattcttgcaacagtgtaagccagagtaaagaaaatgttataaagaaaaccataaggaagagaaaatatatttattaaagtactgattaatactgtaggtttatatcatgtgttgacaagatgaataatctgtctgaagtggtgggcaatgcagctgcagaggtcaatctacagtacatatcaaacaattcggccttttcttgtaatgtcatgacttgtctctgcctcttgggaacactttgaacatcactagtggcacttcgtatgggtcccatggtgttattcaaggtttacaatattgcactaaacactatgaaaaatatacaagaactgcaagagatcactttttccatgataaacaatttattgaagagatgaactgctctgtggagatgatgagcatcacacggcattttaagtggatactcacaacacttgaactcactgcagtaacaatgggaggtggctatgaaattatcacagtagtacaatgtgtactacagttaattttatgcatttattagttaatgctgcattctgtttacatttctctctactgtgaacggtgccatgtactgtctgtgcacattttaactgttttatactagatttgtgtatattgtagtaaatgataaaatagactagtacctatatattatatacatttagagtataacttagttttactttatatttaggctacacggtttgtctgcaaggttttcaaattattgcaaatctccaaaaaaagtttccaaaatgtctattgaaaaaaatctctacatataagtggagcctcacaattcacacctaggttgctcaagagtcagttctttatataatttgccttagagaaacaacacattcattcaatccacacactcatggacctctccaggagtttgtaaaagaataggtaatgacctaatattaactaagtaaatgccagcattttatttaatcatcaaaacaacacgatgaaatagatatttttaatcctcatttttacatatgtgatgacgttttgctggggatgcagcaccagatgggccagtccttgggcaccagcatggtggtggtggtgcgaaggctgcacctggactcgggcgtctgggtgatgtgtgtgggtgccagtggtggcatgtagggtagattgataacctggcccctgtacaatgtgtgtgggccaccttgaagaggaagaatcacaatttttacctccaatattttttaaatggcaccactaaaaccaaaacaaatcattaaatgtatttatatcttaccatgtgtcacattctgttaaacactttacattcttcatcttatttagtgtatacaactttagttctcatgatttctttttaacgaaggaagaaactggggcttagagagtacataaattggtcaatatcataccatttgtaaataacagaaaaggtccatgatttaaagccaggccactcatgaccaaaatctgttgttcttcattaaataaaacttcaacttatgaaatagtttcatctacattgtatcgttgaatccttaaaacagctcagctgggtcagaagtatcatcggtttatagacaaaaaaagataagaatcaaaaaagtttggtaatttcccccaaggtcataaagctacaggttttttgttgttgttagtttgttttgtttttgagacggagtcttgctctgtcaccaggctgaagtgcagtggtgcgatctccgcttactgcaacctccaactccctggttcaagcgattctcctgcttgaacaggagaattctctcagcctcctgagttgctgggattacaggcatgtgccaccaagcccagctaatttttgtatttttagtagagacggggtttcaccatgttggccaggatgatgtcgatctcctgacctcatgatccacccaccttggcctcccaaagtgctgggattacggacatgacctactgcgcctggccctaaaatttcgttttaaaaaaatatgcctggtgtttcttctagttgtccatatttctttcttatgacaacagataaaatacacaaactttatattttcatcaggatagatttttttcaagtctagcctctgccactaaatgtgtaattttaaacaaatttcttaatctctgtgagcctttgcttcttcatctctcaattaagggtagcaattctagctgcctcacagagctattgcaaagtttacatgaaaatgcatacaaatatgtctagacaagtgcccagtgtgcaggagagactcaatgtataatctctggctttccttctctctgtgcctttcaacgcaaatggaatagtttcaggataaagaatggtcagcttacataaccaagtgaggtgtatattaacagctggcaccaaaagtcatcttaggaactttgtcagaatatcttcataagcctttgtggaagatgtgactctgacagcagagatgtcaacaggagaccaagctataaaaggagaaggttagatggtctagataaaaaaaattatatgaatttttgttttgctcacaaaaaggaaggaaataagagacgaatggagaaggtagggaggagagagaagagccagagaggtaggatgaggtgaggatatatgtgctggacagccaggtaaaattcttccacaggttatagaaagatattttaaaaatgggacatacattgttaatttaaaattgtttacattaccttgatttaaagtctaccaaagaaactactttcagtaaagtctaccacaaatgaatactagaaatgaatgtttcatattctatatggattaccatgacttaaaccagaaatacataactggaagtagaagggaattcaagaatgtaagccaccctcgcattctcagaaatctgggcaacttgaggatctaagacaattttcaagggatctcaagagataggcagtaccagctgacatgtggattttgtgtttagttgaaatatcctctttttatttgaaagtccacttaaattcactgtaccaagaaatcattttaatttcagcatgatttagatacatttgaaggagacaaactgaagatattaccatgcttgaggtttaaggtgatgaaggacttttaggcatatttgaaatataccccttaactgttaacattgacaccagtggtaagaaatttcctccattagataataccggcttgaataaatcagaagcttgctgtgatggatcatttctgtatcttatttgcagttaatagatattatttcttagagcagtttttggttcactataaaaccaggcagaaagtaagagacttcccatacaccccagtccccatacgtgtaaacctcgctcccgtcaacatcccatgctctagtagtgatatttttgttaaaatagatgaacttacattgatacatcattatcacccacattccatagtttacattagtgttcactgttggtgagtctttgtttttacctacaaacttattacattggtagtgttaccatcaagccagtgctcaccaaaatagggtctttacctttttagtgccctgaagctaatatgcaaaattgaaagtgaatgcataggctttatttgatggccatgaaattgagaagcagaagctgggatcacaaacttctcagtctgtaagagccagaacttcacagataaagggcatctttaatgaagtggttgggcattaaaagaaaggagaggaatatttgtcttttctgggaatgggtagagaacttcttgtaaccaattgccacctttctttctgtcactttatggcttcttccggttgtcatgattgtaaactatcatggcagtggtgggagtgtcatttagtatgaatattagattataatatgaagttagaggttcttcagaagtcaagtgagccaccatcttggatcctaccagtcttagccagtttggtcatgagggggaacttttgacctcaggcatcctgtttcctaaagatatgcagagttggttaggtgcagtggctcacgcctgtaatcccagcacttggggaggctgagacaggtggatcatgaggtcaagaaatcaagaccaccctggccaatatggtgaaaccgtatctctactaaacacaaaaattagttagctgggcttggtggcgcgtgcctgtagtcccagctactcgggaggctgaggcaggagaatcgcttgagcgcgggaggtggaggttgcagtgagccgaggtcgcgccactgcactccagcctggtgacagagcgagactgtctcaaaaaaattcagagttaaggtggagtggtactttacctaggtcacataggcattatactgggtaatactagacgcactgcgcctcctgcctctctagcacggtgagatgccccatctgagcatacatctgtagctagattgctgatgactaagtataaaatacaaccatttcccagacatgtgaactgtatggttcactgcaaaactgatatgctccctgtgatattaatacactcactcatatttcacactttgtcaaagagaaagctgcgtatatataaattcaaacatacatacttgattgttttaaaataatgacagcaatattgaaagcacagctattagtttagtaatgaatagcaaaaagaggatgctggaggctttaatggaagaagaaacattattacaactttgtcctcaggatctcgcttttcattacatatcagtctgaaataaatatcagtctaaaataaatcaattccaccatattcttctctttttgcctctggacaggtttttaccagatccgtatataatacttcatatttttaccaactctactgcaaacaggtgtttatcctctttgcgaaatgctgctttaacataggtgcagatttaaagagtttaatgtgattttacgttttcttattatgagggagggatcatccaatcatacacctcatctctcaatctctcctggatacatatgggaaatatttcattcactggtcgtttggtccagggaactgaaactcatcccctttcatgtgttaattcggactgataccacattaaatggctcaggggccttggctctggggttgctgtgaccgctaatgctttgtgttgctaaaacccacacatcaaatgtgatgccttcattttgcagttattccctagcaagtttccctttatgtatgagatttcacaagcttaggtgcctaataagaactagtagaatcacgtgcacacatatacaagttaggaggaagtgtttaggcactatctacctgaatctattgctatgtctaaaaggtcttgttctggatttttgaatcagaattattagtttgatgttgagccttgttccttcatggtagacttttgccaaatgatgtgatttgacatctaaaccactaggaagcatttcataggtgacataccagtagacagcctgtaattctgactaagtgactcaatcaagatttggctttttttttttttcctacaacctcccacccacaaaagtctcaatatcatagattgaactataaatcttgtcatgaaaaacaaaagacaaaatagaaaacaattttataaatgtaaaatggatcactgttagaaaagaaaaaataaaaattggcatggtcaggaaaatacataaatggaaactccctattttggaagggataatgatggagaacactgttccaaaatacaatacataaatccaagggagtgtctcctgccacctgccagtggcaggcagaagtttccctgttgtacggactccttgctttaatcatattatggaaattcttatgattgattctgctgggtaaataagggtgtccttaagtttaaccccattgtctgtactcacttcttcttttgattgtcagttttctatattcttactttcctctcatgttctaagcattggatggtctggacctatgagattttagagcttctcaacggacttaatgaccaattaaagctctttcttaaactgtaaatttttggcatggggatcttgactaaaatgtttccacttactttaaccctaggtttatgtctacaaaagcgtatgcctgggtaatcctggtttcttgaggatgccatatgccaaacagtcagtaattgcatttctgttggtattgttgaccaattccctcatatcttacaggtttgggtgcagcagggatccagaaggaactgccaaaaatgacagctaggaatttgagggcatctttagaacatttgaagtttggcattttagtacaaatattgttattgttgctagttttaaattttgccaaggacataccctaaagtacaattaaacaaggaaaactagagataccatgtattttgttactgacaggtctttgttcttagagctcccaagatggcggcaggccactcccaagatggcagcaagccttttattctctgacctggggttcttggcctcatggattccaaggaatggaaacttgggccatgtggtgagtgttacagctctattagaagccatgggtcacagaagagaaccgtggaatccagtgactagtgttcagcttgattaggatgaacccgggcacttagctgctcaggaacaatggcgagcctttagccatatcgggagtggcaatgggcgacttgctggatcaggagtgcagcgaacacactgctggatctggaggggtggaaatcagcagtgggtctgtgatggcggcaaacagcagtgggggacggtgagtagaagctcaacttgtgccctaacaaacacagaccagaagagcgtgcagttgcaagatttcatagagtgaaaacacagctcccatacaatgagaggggacccaaagggggttgccactcccaactcgaatgcctggggtttatatctcaatcattgtccctccccctgtgctctcagatgataactgatttgactatttctttacctcctgcttttagcctaatttgtattttagtgagccctctacctgattggttgggtgtgagctgagttttacaagtcccgtgtttaaaggtgggtgtggtcaccttccccagctaggcttgggaattcttagttggcctaggaaatccagctagtcctgtctctcaatttcataagagaaaaatccttctaacaaccaaaaaaaaaaatatattctcaaaaagtttattgaaaggaaacaaattggatatagtttacaaaaagtcaccaaattttaattttcttaagacaacaggagctaatgaaagcatcaccaatgacccacttctaaagacaggaggaagagatgtatgggatgcagatagagacatctaaggcagggaggggatccaaaccagcacagagataggaaattctgctcataaatgggtggggagtgagaacgatgcaagccagggacccctggctggtgatgccctacctgggccttgctcagccatgctattatgccccagctcacctatgttatagcttataccaatctggcagttcctgagctattgtaccatgcccaagaacaataaggatgtgctgtatattgaacggtgaggagggcaaagaagaattttagtgcatgatgagacagctttcagtggagagggggacatagggatgttccccctacccaaaggtgggaaagtcccccatgtggctgggtctgaggtcttttatggactcaatggggagtgcgcactgattggttggtgagtatgcaaaaatggtcaaagcaaagataccactcaaaggtgggcatgacagtgtagaaaaccaattaggaaagggtaggtatttttgaaacaggtgaagggtagggatcaatcagaggaaagcacaccaaatggaagacaagttctcaatctagtctgaggatttaacttgtaacttggctttcaggcttcaaactgtcttcagctcggaggtagggtttcactgggggcccaccccagtctgcctaggtatttggctgactcctgtactcttgagagggatggcagatggcacgttgtttcagcatctgaaatataatgtggatgggcaactggaaagacaaaacagcagcagtggcatgaacagagcttagcacagaggggacaacacacaaatcgttgatgaatttttaaaatgtgggaaattgaacaattcaagctatagtctgcatttcaaaaaagatatgtttgcttaaaaaaacaaaaaacaacaaaatgaccccttcaccacaaaggatcagcctatatcacacacaggtacatgcaaactggcaaattgtcattatcgtctttcacaggttttatgaataaaaatgacctatgaatatttatatgataccctttttcttatcacttttggtggtattatgtaatgaaaataccagctcaggtgttgttatgggcgacattcattagtttgttgggttaactatgaggatgagctaattacttttaaaatgtgctttcatccagtgattcaacagaaaatacccatgctcaatagcattcgcttggttaagaaatgaaattgggcaaataacttatataaattaatgttggaaaattatattgaagagggactcataacttactaaaaatcactaaagaaaactaatttggattgagtaaaattttcatacattaaattgagtaactggtgaaagttttatttttttacattacaaaagaagtaaacaattttagtactacaaacacagtcataatcttattaaacataaaaagaattgatattataaattataagaagagatcatgctttgtagcttttcattatttttatcgaagatctgaatagacggattttctttttaaaaaatgttttttgcttcaaacttagctctaattctcttatataattgacatcaatcacacttttaattatctttatcgtatcaaataaagacatttggtaaatctgaggaaagaatgaaatccagcccaaacaaaatttcggtttattctgttattttttgaaatctcaactatgttttgtattttgaaaaataagcaaagccaaatttctttcaaaaggcaacttttaagaatttgctgtttttaatttggattaggattgagagccagcatggtccatgaaagtggtttgagaagaaaaataatctggttttcataagtagaaaccttgttgagttaggagaaaatcactcagtattttagaaattgattgaaaatgattgaatttagtttggagcactttttcttttcaatatgtaggcttacaaaatatagcatttataattcacctcagctaccctttctgatattatttttgttttatattttatgtgtgtttcaattaaattttgtaagatctttcttagaatgttattttccctttccaatgatcaatgtctatgccttgcttctaaaaatatatacttatttctctaaattgaggttgacaagttaattgtgatttcaggtaggagggaagacaagtatcttcagtacaaccaacaattcactttattaatgtttgtcttcaaggagagcacaaaggatgcatcagaaaggcagaaacacacatattgtgctcatcaaaggtcttaaaggccagagaagagaacttggcaggaaagttatcatccaagttcaattatttaatcttaaaaaacatatgatttagttagatagccaaaacctgggtagaactcagaatagatactatttattttcaaagcctaagggcatgcattttcagaaaactcagtggcttaaatagtgcttaagaatttacatttaattaaactggatgcaggtaatgggggtctgggtttcggctgtctcacattatgtacttgctgctcattgtgcccaaaggcaaagctccatttaaattcaacagatcttagcaactactgaacactgttgggctgagaatttgatagtgtatcaggctgggaacttacgcctctgggtaaagataggccagaattctgtgagtgttagcaatgatcaccagcaatcaggcagaaaccctagtctcccaaaattgtagagtggggagggtattcagtgagctgatccacttagtatttacagaaaaagaaacacatggcttctgaaactccaatgaagagaacacatgggcttaagatagctatgttttaaagaaaataaaatgatgtgaactttccttggttctgaaataaagttgaacttaatgatccctaatgatctttctctataaaatatcacaattccaggaaaaatcttcttaaattttctgatacaattagacactgatctctaatctttgtggtggttgtagttcactaaatgccacatgaatatgaatccacatttttgtaaagaatttgctagaatttgcagatgttataggtgaaaacatcaattggagtacaaatgtattagggtaaataaagggcaaaaagatggtagtttttagggagggggaacagtacagaatggcacatgagatgactcttgacattctgtatgcaaagtgggtctcatctggattatcaactgtcacaaaccagggatcatggtggattccacagtatcacatggtatggattaaggatatacttcacaggggacagtggaaacttaaaagttatatgtcgggaagaaaagacaatgtgtgatggttaattgtgtgtgtcagtttgactggtacacagtgtgcccagatatttggccagacatcattcttggtatatctgtgaggttgtttttggttgagattaacagttgagtcagtcaactgagtaaagcagattgccatccctagtgtgggtgggcttcatgtaatcaattgaaagcctgaatagaacaaaaaggctgagtcaatgaaaactctgcctgcctaactgcttcagctggatattggtcttttctggccttcagaccagactgcaatgatgctgcaacaatgactcatcttctgtcttgaggctgctagctttcaaattggaacttttactatcatctctcctgatattcaggccttcagacttggactgaaactacacataggctctcctgggtctccagcttgcccactgcagatcttggtacttcataaccattacaatagcatgaatgaattcctcataagaataaatcctattggatctgtttctctggagaaccctgactaatacacataggtgtaccctgttctttcattctcctagaggtgagccacagctaagatatcgtgggtttgtgttgcagtgcagggatcctgcctgccatacctctcctagccctgtgagtcaagcacaaggtcaacctcatcagtgaaggaacaaacaaaatattgggagccagccagtctggagtgggatagggcctatacatagaattttctgagataccagtagcctgactcctggagaccttgtgacccatgacaagtttccatcttgactgctgtgaggaggaagacacaagcagctgagcttaggtgcagtctctcctctgggagaaagagaactctgacacctcctctttcaggcaacgcaaagagagcaccagggtctcttccatacaatcttgatccttgtatcacaaactgatgatctatgaatagcaccatgaaaaatgtagtcttgcatacaagaaaaggttaagatagaaaataaagattgctaaataataggcaaaaaacatttagtatttactcaaatgtaatacgcttcctcccaaaattatagttcataaatttgtattgaaaagtaattggaaatataaactatttaattagaattcataggctatagaatatcaaaaagcctttcttaaactcagttatgatgggaaatgcatagatttttcagcaagtaataaaatgaagataggattacattggaaagagcaaattgtgcatgattctctgaatggaggaaaacagaagcaagattagttaagacgttggtacagtgagtgattaggaccctggaatgaggtggtgatggctaaaaaaaatgaggctatatttctgagttgcttgaaagacaatgggtcattcaaatgtggtgactcattataaatggatggagagaaatcaaatataacttcaacattgcaaaagtgggcaacaagaaaaaatagggacatcaaacggggtgggctgggggtatctattgtaggccaaatatagtaaaagactttatgatgagagataccatccaaataaaatgaaatacaggcttaataattttggtgaaatatggactgattagcatctgtttaatgagtagaaagttaggtaattgacatgaattgtgtcccctcaaaatacatgtgttgaagccctatccctcaatgtggctgtatttggaaatagggcctataaggagttgataaatgttacatgaggtcataagagtgggtccctaatccgataggtccagggcccttattaaaagaggaagagatagtagagcgctcacttgcgcttgccttctcacacgtacacacacacacacacacacacacacgttctctctccacgtcccaccacccccctgcccccctgtccccaccaatgtgaggacactgtgagaaggcagccacttgcaaagagaatagagcccttaccaggaaccaagtttgctgacaccttcaacttggacttccagagctgtgagaaattaatttctgctgttgaagccactcagttgctagtgttttgttatggcagccagagctgattaacacagtaactttcatgtttacaaaacaaaataattatgttttaccctaattattgtatttgaggcataaaagctaaaacatcaataaatcataagtaataatgatttattagataactatgatatatctccaatgatataggacatgttatataaatatcttgcaaaagacatcgacaactccagctggatttgctttagaaatgtttagctttggaattacatggaatgacagaatgtgtccaaaggccaccagtttgcacatttacaacagagaacaactttattaggctacagatagtgacctaacgtaacaaaaaagagataaaccaaccaattagtgaataataagtaatagcaactgataattattgtgcccttgcattgtgtcagatattttctaagcacctcacatgtatctgtttcggaaacttctgtgctagggagatactattattaatcccatttttaagatgaaaaactaaggcacagtgaatcagtaacttggtcacactcacacagctgtgaaggaaatgagtagtagtgaatgacaaaaatgctggcaattcataggtccagccattgtcatgcaggaaaaaggggaaatttttataaacattggttgaaaagttatactgaactgaaggaacttataaggcacaacacggtctaactctccagtcaacgaaaacattcctctctcagctgctctggtgggtcatccaggctcacagtgaatgttcccggcaagaaagtgccttcctgctttccaaagaagtccttttcaaggtggcggagcactgaatagtacagaattcatcagtatattgagttcagatcctatctataacttaggtacttttgttttcctgttttaaagataacattaagaacctgctgttttttcctctatagaatctggcatttacagcactttctcatcgatcacaccactgagtgttaccattcctattttacagagggaaatgtgaggctgagaaagtttggacaacatagccatggcagtttataactcaaagtatatggatggatgacactcgctagagagttgcaacagccgatgcagctgtccccaggccccaaactcacttatatttcctgaaacaccaggaaaagcatcttttatttttatatgagagccctaagagattattttcatcttattcaaaaatgaaaagattttatttaattaaaaaatctatttctattatcttagaacttttgcttctcagtgtcaaatatttttggttacctcagttactttttgcaaggtacagttttcaaatcccatttcatcctgattgtccttccctgaattatttaagtgtagtttagctacacttaaagcacagtattcgctaaaattggaaataatgttccagacgttatattacattgaccattatatcccttgatccaaattatttattgttgacaattattacttaagataataaagaataaacttctaccagaaataccagaaaatcaatatatacatatgtaagaatggaaaaatgaataatataaattatttactattccattgatcaggccaatcactttttgtgtaatatttcttgatttgttttctatgaatatttttataatatctgcctttatattacattgattattttgagttctgcttttcttcctttgcctcaatagcatcgaaattttatagatactcacaaactctgagaatatgattttaatgccagtccttcagtagtcatctttatagaaaatgctaagttaattataaaattataaatgatttggtgattagtatctttgtaaatattttgctaccttctcatattttaaattattaggtacatattttcataattgagatttctggcttgaaaagtatttgagaattatagaatcttttaagtcagtctctcttcctctttctaatatatattttcatcttaatgagtgatgacaatgatttttttcaaaaagaaaaaatgaaaacgtatttgcctaatgtgtatgtacacgcatgcatacatagacacccacatatttcttaacactgcatttttagaaaattcaaacttggatattttctttaggaaaactcccaatctgaaatataaaatgtttatatatatatatgtgtgtgtgtgtgtataatttatgtgaatacatataaatatacacatataatgaaatacagtactcaaggagaccaaaaagagaatgagggtaaagccagcttgtggaatgctttgcatactatgctaagtggattgttacgccattgataaattttaagcgtcatggataaatatgaaatgctacatgtcattgttttgaagaggtagtgatgatagtttcctaagtctaattttatgctgctggagaaaacagaatgattagaattcttatttatgcctacagaaaagaagctgggcacaggggctcatgcctgtaatcccagcactttgggaagccaaggcaggaggattacttgaacccaggagttggagactcacctgggcaacatatagtaagaccctgtctctacaaaaaatttaaaaattagctgagtatggtgacaaaaaatttaaaaattagctgagtgtagtggtgcatgcctgtgatcccagctactcgggaggctgagagaggaggattgcttgagcccaggaggtcaaggctgcagcgagctatgtctgtgccactgtactccagcctcggcaacagaatgagaccctgtctcaaaaagtaaaaaaaaaaaaaaaaaaaaatttaaaaagaagatgaaaagcatatatatcaaataggcagcattttggcaattagagccatttgtaaaatgggtgaatcatgaatcctattcatagttttatgcttactgagcttattgatgcaaatggcctgctctgggatactaaaagatataaaattgaatgaaataaggaacccaaaacaggtgaaggagaaagatcattagatcaatggtcaccaaacgttttatttaggtagcatctgagattctattggactatctgtacattccactcttcatgtgctaaacacatacttggtcatcaaaacattcagggaataacatgctaggaaatgcataacacagataaattgaaagagtaatgggcatcaaagccatttggtgcaataaagaatcattacctccatgacagtggctagttagagaacagatacaaaaagttagagacttgaatcattctatcaattacatctaagacttgcattcttaattttttgtatttttctaaggtgattcatggagagaattagcttgtgacttaacactacggagttaggcaaataagcatttaagtgaacatcataaaactggaggggttacaaaagagataggagatataatctctaaacttagagaagtttacagtcgttttacagaaatattttgcatgtaggtaacccctgattaacaatacaatcaagtgctgtgttgtgtgggtcaatatgagctatagtatcaaaataaaagtgaagaaaccaacaagacaaagagctaatcaccctcctcttcccaaattaatcttcctcattggttctaaaatatgctttcactggtaaaatccagcaatgtcattttccgagcttgcagggaaaaaaataaattaataattttctcaattataaagattgtgcctaaaagtttttcttaaagttttgttgtctacaacttcctgactagattagaatgaaatggaagatattacataaattagctgaaaattatatatctggttattttaagtttattatatttttatttcatgatgtctgcaaagaacataatgattcatgtggtcttacacttaaagcttaaatgggaccactttgtatggtgcagtttaagagaccatgtgtttttgtgtttgaaaaaagataaaagacctgtttattaatctcttataatccagacgtcagttgttagtgaggtgtgttgtcttatttagtatgtttttgagtaaacctaaacctaattctccttttatatagcatgattaacttgtgaacttttttttttttgagactgagtcttgctctgtcgcccaggctggagtgcaatggcgcgatctctgctcactgcaagctccgcctcctgggttcatgccattctcctgcctcagcctcctgagtagctgggactacaggtgcccaccaccatgcccagctaattttttttttatttttagtagagatggggtttcaccgtattagccaggatggtatcaatctcctgacctcgtgatccacctgcctcggcctcccaaagtgctgggattacaggcgtgagccaccacgcccagccaacttgtgaactttcatattattttttcaacgtgggagtgagcatgattgttgggtaaataatttcctgtggacacatttggtttcattcaccccacttgacattccattgctaaagtagacttagatacagcagtcctcccatgaatttaatatatgggaaggttaacaagcagagtaaatgaccaagtatttgtggtgattgaagttgccaagttccaggaatacataagccagaagcaccttaatgagtgatgaaactgatgatgattttcctcaaaaagaaaaaacgatgaaaatgtctttgcctaatgtgtatgtacatgcatgcatttataaaagcacccccaaacacgttcctaacaatacatttttagaaaatttacacatggatttttttatttaaaaaagaagactccaaatgtgaaatataaaatgtttttaatgtttttgtaacctagccatacattcatgttttttttctcaatttctagagctcgtgggtccatccaaaattatactgaattatactgtttaatttagcccattcagataggctacagaattgaacaggatgaaaagggcagcagtatgatgcatccaacaaggggccgaccagaaattctgacctccagatgcagcattaagttcaaataggatcagtaaccacattaggagggtcaccagatagagaagagaggtgatacatcccagagttgattgtgaacatcttagctcaggcacacagaaatcaacttactatcattgttcaagtctaacctcagagacactagcaattagaagttaggaattcagggtagaacactggaaaacgaagagcctggaacctcccttccaaaatctttttgttagtgaacagcctattctccaccttccctgaactctgaacagctgaactcacctggagaaaaaaaattgcaacatctgggacccttatctcaaggcaaccctaagaagtgggtttactctgttttcgtgctgaatttgttctctcattttatgacgttatttcatagtttctcttctcttctctaaactctaatactctttcttctttcctcttccttatctactacattcattttctagttaccaaagaaagtgaagaaatcagaaaaaagaatgctgtcattctttcaacatcaaacctactatcctatctgcatctatgccaatggctccacttcccccttgttacctgagtggcaccacgttacttctatctaaacaacctctcaacatacattccacatgccctcccctctttccaaccgaggtgtattcctctcttcccctccttcatcatttgcttcactatatattagattgttctcaacagcctaaaaacattgtaatagtttccattaaaaatatatgctggcagtatattcctttcagatatcatctcatacctgtatttatctttgtagaaaacttttttgaaagagtgttttattgtgttgacttcattccattcttgtctcccttcatcattcattccggctttagcccccttcaatgaggcttttctctaatccctccattaagaccaatctcatgaaagtcatcagtgacctgcatcttgggaaatccaatggtctgcctcagttcttaattaaacttctcaaacttttaacctagctgagtacttctttattggaatgctgtaaatatttatttctgtatgtatctgtttgcttgtgtgttgcccttctccatcactaaaacgtaagagcaagttctgttttgtatactccttggtcttgtatcttgttttgtattcccaatgtctaaaacagtacttggcattgactaggtgctcaaaaatcacttacagaatcatttaaacagtcatgtatttgagtaacaggcacatgaagttataaacacaaacataatttatcaataagacaaatattttgggagtcagatgtttcttacctttagtctgtccagagccagtacagcctaaaattaatttggtaattgggctttagaatctcttcatttgcatttgaaatgaacccatccaatatgtccactgaactacacagcttagagtgaactctctccagttgacttaggataagtaagcatattcacagaagccattaatctggatccgtatcccatgaaaatataagactaaatcttaactggttttgtgaaactatgagcaaaaaagtgtaagccctatattgtcaggctattccaacaggcaataccactgaaatgcagtagctcctccctaagctaagtgccaacaaggagtgaaatgtgctaggtgcccaattagtatctctacctactgctcattccaaaggtctccaaccagctattgacctaaataatccacctagtttcaggccacagccaagaagtctatttatagctcagagtaaactaatagctgagctgagaggcctttttcttatttgtaattctcccttctaaaatgtaaggaaactaacataccagaaacacatgaaaattataagcccctgcaacagccaaattccaattctgcgttttccccctaaacaaaaaggaaacaaaatgttgagagaatgtcaagctgctaccagccacattcagcatacttgggatccacagttttaatgaaatcatttagcctttcaaccacatggcacttctttatctgcagatgaaaatcctggtttttagtattaaggttgtgaaattaaggttgtctttaggattaaggttgtggtggagatacaattttttccttaagttgttttcttcaaggaatttatccacaagaaggttaattatgacatatttttatagatgcctaagtgtaggatttgttttagcattaatggaccatctaggccattacagaaagatgttgggatatttaagaagtggtattttttaagaaagtaagtcaaaacatgagaaaatgaacttaaatagctagaatttataatcttttaatctgggtctgtgtcccatgaaaacataagactaaatcttaactggttttgtgaaactatgagcgaaaacgtgtaaaccctgtattctcaggctattccaacaggcaatacctctgagatgcagtgtcccctccctaaacttttgtttataattacagtcaacatttattgaaaatttttggactcaggccaggctttgtggctcacacctataaacccagtactttgggaggctgagatgggaagattacttgaggccaggagtttgagaccagcctggtcaacatagacactgtctctcaaaagaaaacatccgtactctactgaattctgggtggatcgacaagtgaatgcaatggtcctcactcctgagggtgttttacttcatatgatgaaaagatatattagaaatacatttttaagaaatgtattaatagtgtgatctatgataaatatttggcctaatttcttctactttctgagcagttgtcttggcacggtgaagattttcttgagttggggaatacttggaatgtcaaagaatctgtcttgaggctacctgctattttacttactaaggtgggagatgtaggggactcactcatttcaccaggatttattttttggacaaggacaaaataaaaatgagcttttataaattgtgttataagaaaattcatagatcagaatcatagctctgattatacttcatgactataatattttcatacttggtgtctgtgtttaataagaatgagcccaacaactaggaaagcatcctgttagtatcttcagggggtgtcctgtacgggatacataatggggtgcctgagtgagataaagcaacataaaacttttatgtccagggaacaacacgtatgtgacaaagcaaagggaatctaggactagagaaggtgtaatgcctgcaggttgtttatacagcttgtactatctgggcagtgagtggaaaacttgatgcaaaacagaataaggaaacatgctcgctaaaactgagcatggaggtgagaaaaaatagattattttctcagaaagggtgaattgcaactccatggccagttggtatctttccatttaaaaagacctccctggttgacttgatttattctcaagatggcttcgacacacggaaaagtgggtcacttgatgagaaatacgctggttttcaataaaggggaaagtgatgtttttttcttcaacttagttccagtagaagttccaaaataactggaaagttattctgtttcttttactctccttgtgtcttgtgaatgatggcaggtttatttcaaaattgtgagaaaagaaaaacagtggttggaaaacatgaagtggtctgtttattttggccattggtgagaaatgttctggaaaagctatctaaactgaattccagctgtatgtcactggatgctggcaggatttattggtgggaagttatggcaaacatcttgatggctttaaatctgtattcatagctagtatcttttgtgtaattatacttaaaaatcattaatttcaaaaaaaaattagagaatttctctaatgcttgtacattgagaggggaaggaagaaaaactagaaggttagtcttttgaactgctatagttttaaagatgacagaacccttcatctcagcaagagcagtggaagattaaaaatattagacatggccaggcattgtggttcactcctgtaatcccagcactttgggaggctgaagcaggcagatcacctgaggtcaggagtccaagaccaacctggccaacatagcgaaaccccgtctctactaaaatacaaaaattagccaggcatggtgacaggtgcctgtaatcccagctacttgggaggctgaggcaggataatcacttgaacccaggacacagaggttgcagtgagccaagatagcaccactgcaccctagcctgggcaacagagcgagactccctcatatatatatatatatgtcttgactaagaccagggatatctcccttctgttattctgaaggtctgcctattgaatagtcaatcctgaagataagcaagataaagaattaagaacaggaaaccacaccaagctctctgtctccatttaccccttagacagatgtttctttaagttttttgaatgagcaattcattattgtaatgatatgacaaagagaatggatgctaaccatcctatgatccaagtttatcagctacatgatattggtcagcttacattcctttatctcttggcttcctcactgttaaaatgcacatgattctgcctaactaataaggtacttataaagattacattagaatatgcatatcataccttggtgtctgaaaaaagctgctgtattactcttattaaaaataaaattaagcaactcctattcctcttaaatttctattttatataaacctgcacctaacatgtggaaattgagagaaatagcttcagttttgtttgccttttttgttatggtattgatttctattatagttatataattatagtatataatggaaattacctattttttgtctaaatcagtgacaatggatgcaaaaagtacaacactccaaggaagtatctctgcccttgaaatttctgagaaagtttcaacaactacacttcagactaatggaaaatatgatcataattgttttggtttgttttaaaaaaatcaccttatgtttaaagaacattatgaacaagcctcaaactgttctgctgctctacacacctacaagtgaaaatcaatatttctttcaaaaatttccatatatgtctcagataaaagttgcgctgtgctcacatttttctaatgtgacatatggttggtttcaaatgcatgcccaggaggcaaaatactgaataaactgtgatgacttatagtttagaaggttttctcctgagggggggaaaaacagcagataatattgttacaggaaatccataagccaaaaagaagtttcaaataactctttctcccaagtcttccacaagctgtccttaaatttttaaagagcacttgaataataaaatgtgttggttatagccccatttttcttcatgactaccctcaaaacatttactgaagatgctattttaagctgccatttcaaaatttttaccaccagtttgtagatgatttctactcagttgtacaacacaatagcatacaatattccctccattcattctgacatggatcatctatttttctgcccaaaggattgaagtgagaatggcatttggaagacatttcaggaacagttagggcaagagataggattaggtgtccctgtgcctacacggaggaaaataagtcccactcctctaccaaaaagaaaatttagctttactctgatgctagatgacttagtgattagccggccatagcttgaaacattttggagtcttgtttttggtagagaagagggaacattctaaatttcttccattctctttttttttaatgggaatgagtctttcccctttgaaggaaggggctggagtgcagtagtgggatctcagctcactgcaacttcggtctcccagcctcaagcaactctccggcctcagcttcctgcgtagctgggactgtgcgtgagccaccacactcagctaatttttgtatttttagtagagatggggtttcaccatgttgcccaggctactctcgaactcctgacctcaaattatctgcccgcctaagcctcccaaagtgctgggattacaggtgtgagccaccacacccagccaaaaatatgtttatcattttacagtcagccctctgtatccgtggagtttccatatccatggattcaatcaacccagataaaaatattcagaaatatattgtatctgtactgaacatgtaaatacttttttcttgccaagattacctaaacattacagtatagtaactatttacatagcatttacattatattaggtattacaagcaatttagggatggtttagggtatatgggtggatgcacataggttatatacaaatactgcaccattttatagcccggacttgagcatccccagattttgggtaactgagggagagatgactttatacgtgaatgatcagtctagcaaacccagccagggcctggagggggccctactcagtctcaggctgagaacacctattgaggttaggtaggtcatttaagttcattgaactcaaatagtcttttagtatttaaattccttctagatcagaggttcctaaccccaattgataagcagagtttcctagttagagagcctttaatagctacatcctgagcttcacctttgaggggagggaccgaaaacagcattttaaaatggctgaggtgattttgatatagcatagctagcattaatttgtgaatttgcatttgggaagtatatccctagagaattcttaagcaacttctctagagtcttgtcaaccttgataaccacacgtatgtttgaatatctcatactgcaaaactattatttgcctaggcagcacatgctcttttcagtagacttgactgcatcaaagaaaacaatattaaatgaaaatgcacctgcataaattctctatcaattggtattctgttacttgggggccatagaaaatctaattcctaatccacacaatagctcttctactactatttgcagacaatggcaggcacttgcatttcagtcatttcttctctagaaaaatatttctagttcatttagtctttatgtgacttgattttaaaatgtatgtattccccttgcttttctttgaatttacccctgaggtttctcaagtgagggcttcaactgaacacaagtcccagtggggctgggttcgtaggtgtgtgagctgcattatctcaaaggaccctccaactcaggtctgtgcttggttttgtgttgttcattgagttgaaatttatagtagtagtttttttttttcttttttaagcaagggcctccacatttccactttacacagaggtcacacaaattaggtagcctgtcctgtgtcccagctctagtatgatcttgtataaacggttcaattcccacatgccccatgctaatggaacatggtatacattatctgttttagtagccatgttactcctcagttcatactctacatactacgggatgcaactccaagattgttttctactacacagccatgtctccttcatgatggatttttgagattgttgtgggaaacaaatacaagatgttatattgattccagttaagcataatctttaaagatttggcttatggttccagacctattgagacctgattaggttctgattgtatcatccatcatgtttgttgtccctcttaactgcatgccaccaaaagacacttacaaccccgtcttataaagtgatgaaaaatatcatagtaggaagcatttaaagaaatatgaggaataatggttttgatcatgtgatctagttgctattgtcttaaagataccgaaagtctccaatttcagtagccagtgtgtaatctttattcttcttgcctaaaaatagtttgatagtctttgttgtcattgtgaataagaatgtgaaaatacttcagttgtaatgggggcttcggccaacagaagactcatttctgaaactatatggtatgaaaaactcacctcagaggagttataattatttaatgcaaatgtagaaaatctagtgtttctgtctaccttggcaatgacatcttttggtttggatgcttcagggagccagttactttagtaagtgctttggtgctgtatgagagaagacatcctcaagtgagaaaggtacaagagatgtgtaaatgttttcccacttacaataggtgatttctgaattatttgcttttattccaatttaatcatggaaagttttaagaaaagtaaaattgtttaagatgatgacagttttgatttcagctatgtatatggtcaggtaatgaaatatgattttgtttgcttatataattaaaatacaattaggtcaaattaaatactagcctggctagctgttatgctgttaattagaattttaaacagtatttggatactttaatcatttccctattttatctgagtaatcattccctcagaaatacagaaatgaaaacctcagaagcccagaaacataacattacatttgagctaacttttcttttcctacataaagctgcatgcattagtgaaggctgatgctcagtttcttgtctgagatttctcattgtactaaaacagattcaagggtgaacttacagtaggatccgtatgctggtaggaacaccttagtcctagttgcagtgctggaagaacttgttaatttgctttagatctattatttacccatcatctctaaagtgaaggagatatcatggcacatcactgaagtctctttaatctccaagattgtacacatctgtaaatttgtgaaatgcctccagagagatagggcagtataaatgattcatactattgattcacttggcaagtggaagggctgagctcagaaataaaaaggcaattctattacagttcaagagtctgacaggaccccactactcagacctcaagaagtgctttgtagcagttgaaaatgatactttaaaaagcatgtgtgagatctgtgttcacatgcatatatatttatgtattactcaccaaaaattactgagtgtatactttttgccaggaactgttctagatgctggggatatagtagagaacacaacagacaaagactctacctttatgggcttttattatgtggcaaaatataccaggtgttaaataagataagcaattctattacattaaaactagactgaaagtttaggcagcaaatgagtgggagggatctgcaaaagaaaatttcactttaaatattgtggtcagggaagcacccactgagaagatgacatttgagtgaagatctgcaggaagtaaaggtgcaagccttaaagatttctggagggatgatgcccagaaagagccagcaggtacaaagttctagaggtgggagcctgccagctgtgtctgagaaataacaaatagaccagcatgaagggaagtaagcaagccaggaagagaggaagatgcagtggagatacaataggaagccaaatagtataaagcaagcttgtccaactcgcggccccatgggccacatgcagcccatgaccggtttgaatgtggtccaacacaaactcacaaactttcttaaaacattttagatgctttttgcaatttagtttttttagctcatcagctatcgttagtgtattttatgtgtggcccaagacaattcttcttctagtgtgttccaatgaagccaaaagattggatatccctggaaagtcttgtcaactattttaaggtccttttcactcagagtgaggaaatggatgtcttactatttaataggatccctctggctgctgagttgagaatagtctatgtgcaagggcagaagcagcaggcatgttaagaggctattggatgaaattgcacagtcacacattatctttttctaatagactaatacctattactagactatctgtagcctgatcttctactcttgaattagtcactcatttatagatataattgttgactggtacaaaatgctgtcattgttctagactgaagttatttaattgtaactgttaatgtgaatgcccccgttgggacccaagaaacctcttttatctaccttcatagacctagggtaatccatttccattaaatgtaggtttatcaaacccctactttatatcaggcactattccaattacttggaataaatcagtgagcaaaggagactaatagccttgtcctcatggagttgaattttaaagggagaagacaaaaataatggctgcaataaacaattgatagagtttattagatggttatgagtgtaatgaagaaactacaatatagatctcagggcatagggcaagtctcggtattagtaggacattctgatcaggctttattaggaaaatgagatttaaataagaccttaaggaggtcagaaagttatccacggagatttcttggagaagaatatttcaggcagaggaaacaagcagtggcaagcaaccaacagtgcaaaacctccaaggcataaacatgacggtcattttcaaagcatagcaagatgatcagtatgtctagagtgaagtgagcaatggagaattagtaggacatgagctatgattagaagtgagagccagaccatgtagttgcttggaggctagtgtaaggactttggattttgctttgtatgaaatgaaaagccaaagaaggagaaatatgatctgatcaagcacatcgttctggctgctgtgttgcgctggaatatgggagggcaggcgtgaatgcagggaagccagttaagctgttgcaacaatccagtttagagaggatgaaggctcagagaagggtgatggcagccgaagtgttgagacgtggtaacagttacattctggttatattctgagctgaatcaaacagaatttgatgacagattagatgtggggtctgagacaaagagaactattatgacaagattttggggcctgagaaactagaggggtggaattgctatcacccaagatgaggaagagtatagcaaaagaggatttattgatctatccatagttttgccttggacaagacaagtttcaacatttaagtgaagatgttgccttggcagataatatacaaatgtggatttaggatggaaaatttgggttgaatatataaaccaggtagtcatcctaatgtgttaggattatggtttacagtggggtttaaagccatgggcagcatgaggtctataaaggagtatctgaagatagaacaaaggaggccagtgcccgagccctgcatactcccaaatgaaatgatttaaaaagaatttttaaaaatcccttaaacacctcagaattcagcttcgtaccttcttctacatcagtaaagatctgcaatggaaatagtttaaacttttttcagactggtgggttatttagccatgcttgcagcatgatcatttcgggaggtactcaaagcatagtgtatcccaaacaaaaaagggaataggttttcctttacatgatggcaccagccacttggtagtgactgattggtatgctatgctgcagcagatgtggaggttggatgtgggtttcataggggaaagagcctcacaatggcttagtgaggccttccaagggagcaaaatgggcgaagcctggtgccatgggtttgcttatattttgcaaatctcataaatgagaactctattgtggggggctctgacttttggggatcaaactccttttaaagaattaggattataaataatacctatcaaaactctgcatgtacctgtgcaccctcaaaaaccctgtgcaccccaaaatttatgcatataattttagtaagacttctgggcgtcttccgtggactcgtttaagaatccctgctgtactaactcaaaaacagtcttaatagcttaacacaatttctttccaaatgtagtcagtttcaatattaagtttggtagactctactatttagcataagtagcaaacagacatgagatagttattccactattattgttctaatcacttcatggagaaacttgccaagaataattaaaagtaatttgcaacttcattgcccttttattggccattgactttgcaaacagaatgtagctatggaccaagtggcacatgttcatatggtttgccagtttggggtacacttataaaatcttttcattactaatgtagtaagcaaggctaactgaattggtcccctcaaagacagatggcaattccagacattactaaatttttttttccaaaatttaaaatgtacatattaatgatgtggaactactcttagattagccatatgcatagccctctgccatagccaaatgagaatatataacctcttgtttaataacaatagggttttgccatcaaagaggattgaatagatagagcattctggcatttaactattgccagaaattgtacctcagctttaattacactgaaacaaaactcactggcacatatcttccacatgcacctagtccacgttaattacctccacttagcaagtccacctgtctgagtgttagggccacattttcaatacaagttcttctagctgttacactgctaacccatggttctcaaacccaaagatccttgggaaggctaatgcatctcttttagagccctggagtttgatttgtagccagctgttttgaaaattccaacccataaacatttctgccacactttatagagggattctaaacacaaatgaccactgggatgaggcaattacaagacctgtgataaatagcaagcacatcccctgcccaatgacattgagtattttttttcttttgagacagtctcatcctgtcacctaggctagagtgtaggctgaatcccatcccagagtctcagatttagtaaaatctaaagtagaaactgctagcaagttcccaaacaatgctaaggtttctggtctggagccaccacattttgagaaccaccactacaatccttattaaatgttatatgtttctgttgggatatgaggtgaaatggacttcaaactgtttaaaaactttacttcctgacaagagctcactgcagccttaaattcccaggcttgagcagtcctcctgcctcagcctcccaagtaactgggactacaggcgcgtggcaccatgcctagctaattaaaaaaaatttttttgtagagatagtggctcgctacatagcccaggctagtcttgaactcctgggctcaagcaattctccggcttcggcctcccaaagtactgagattacactgaagatggttttacctcctagtagaaataagcaggtcagtctgccaagctccagcacagaactcccggggcctatgtgcttgggtacatacacagcagcttctgcagaaaacaggtctctcatctgtggcttagcactgtgtggaggagggcagagcttccacacaggtgggaacacatccggcttggcaattgttgtaactgaatattagcctcatgccttcttctctttatagcagttggatccatcttcaatcagcatcacagaacacaaactctccagctctttttaggaagtaaagtttttaaacagtttgaagtccaattcatctcatatcttaacggaaacatacaacatttaataaggattgtagtggtgattctcaaaatgtggtggctccagaccagaaaccttagcattgtttgggaacttgctagaagtttctactttaaatttactaaatcagggactctgggatgggactcagcaatctgctgtcacaagtcctctgggtgagtctgatattcactgaaacttgagaaccactaatcccaggcaacgtttccgaactttttgtgtgcctaaggattgcatggtgagctcgtctggggtgttactgaacatcttaatttctaacacttataaaagcacacaagctaatgtgtgccttctacaccaaaatatttgtaaaaaaatttgaaaaatatatgaccttattttacagaaccatttactgcttagaatcaaagcttatcaaaattatttgaaaaattagaaaagaaatatgttttcttagtgacaccatttttttaattctctgtggtcttccttgtgattagatgagtaatttataattatccaatgcatttaatatacttcagaaaggcaaaaaaggtaagttttcttgttggaaaaaaatgactggtacaattaactactatatgtgtttatgtgtgtgcatacactatatatgtatatgtatattggacatatatgtatatatttgatcttttcatgttactgctcgatattaaactatttcttcttttgtaggaattctatgaagttgaacaatttgcattttcttaaatgtcttattttacatgttttcataggcaaacagctttttaaatgcactttagtaattcactgatatacacgattgaatttaggttatttaacattccatgggtgttttgtaattcataaagtgagagtagtgtgttatttaacacaatgccacgtatggccatggataaactggttgttgccataaatcctgaaagaaatttctgggagaaaaacaatttatattacaatcctctttgttttccaaacacaagaataattcaattttaaaacaccactcaagatgcccaaccatttcaaagtaatttactttctatttttttcccttgactttcaaactcattttttatacaaattgtaaagcatggattttaaatagggaaaatattgctgatagacatttgttttgctcaggagttaaactactgctgatttcactgcattgaaaatgttgaaggaaatatgactgaatattttcaggagacagattttgttttgatttttgttatatcatacgatcctatttcaggtctataattttgaccacgcaactaaaatttacagcttcaaagaatcttcactttagcaaattgaaatggcttcagagtaaattcacttaaaataactctcagtttgtatagagatatctatatatccatatataatgtgtattttaaggtatatttccattcctttaaatgaattcaaaactgatttttaatgaaaatgattcaaaagtaacatttattgacaaaaacttctttgatacgcattttatttttaaaaaatcttttcacctaggcataacatttaaaaatatttcaaaaagattcagatggcaccatgagaaaaaataaaatttgttatccttttgtttactccattcttatgctgctatggaaaaatatccgagactgagtaatttataaaggaaaaaggtttaattgactcacaagggaggcctcaggaaacttacaattatggcagaatgggaagcaaacatgtccttcttcacatggcagcaggaaggaggctaatgagtgcccagtgaagggggaagcctgttataaagccatcagatctcatgagaacttgtgcactatcatgagaacaggatgggggaaaatgctcccatgattcagttatctccacctggtccctttcatgacatgggattatgggaactacaagatgagatttgcatagggacatagccaaaccatataattcttcccctggttcctctcaaatttcatgtcctcacaattcaaaacacaatcatgcccttccaacagtctcccaaagtcttaactcattttaacattaactcaaaagttcaagtccaaagtctcatctgaggtaaggcaagtcccttccacctctgagcttgcaaaatcaaaagcaagttggttacttcctagatacaatgtgggtacaggcattgggtaaatacacctgttccaaatgggagaaagtggccaaaacaaaggagctacagtctccatgcaagtctgaaatccaacagggcagtcattaaaccttaaggttccagaatgatctcctttgactccatgtctcacgtgcaggtcttgctgatgcaagaggtgggcttccatggccttgggcagctctactgctgtggctttgcagggcacagccccctcctggctgctttcatgggctggcattgagtgccagtggctcttccaggtgcacagtgcatgctgtcatggggtctggaggatggtggccctcttctcatggttccactaggcagtgccccactggagactctgtttgcagggttccaactccacatttcccttctatactgccctagcagaagttctccatagggctctgcctttgcaggaaacttctacctgaacatccaggtgtctccatatatcttctgaaatacaggcagagctttccaaacctcaattcttgacttctatgcacccactggctcaacaacacatggaagctgccaaggcttggggcttgcatattctgatgccatggcccaagctgtaccgtagccccttttgaccatggctggagtgtctgggaaacagggcaccaagtccctaggctgcacacagcaggaggggctctgggttgggcccttgaaaccatattttcctcctaggcctccaagcctgtgatggtaggatctgctgtgaagtctctgacatgctctggagacacttttcccattgtgttgatgattaacattcagctccttgttacttaggcaaatttccatggctggcttgaatttctccccagaaaatgggttgttaatttctgttgcattggcaggctgcaacttttccaaacttttatgctctgctgttcttgaatgctttgcagcttagaaatttcttctgccagataccctaaaatcatctctctcaagttcaaaactccacagatctctagggcagggacaaaatgccaccagtctctttgcataacgagagtgacctttactccagttcccaataagttctccatctccatctgagatcacctcagcttggacttcattggtccctatcactgtcagcattttggtcaaagccattcaacaagtctctaggaagttccaaactttcccatattttcctgtcttccgagccctccaaactgttccaatctctgcctcttacccagttctaacgttacttccacattttcagtatcattataatagctgcaccttatttatgataccaatttactgtattagtccattctcatgcttctataaagatctgcccgggactgggtaatttacaaaggaaagagatttaattgactcacagttctgcaggactggggaggctttgggaaacttacaatcatggcagaaggggaagcaaatacatccttcttcacatggtggcaggaaggaaaaaaatgaatgcccagtgaagggggaagccctttataaaaccatcagatctcatgagagctaactcactatcacgagaacagggtggggaaaccacccccatgattcaattatctccacctggctcctcacatgacacatggggattcaaactaagatttgggtgaggacgcagccaaacgatatcactctgtttattaaattgttcatctacaattttgaaggagcactctctatttgtccttatttttaaactttataaaatttttatttgaggctttagagggggtattatacttttatattatgaattttttgttctaccaagaatattttatgttgacatttttaattgaaatatatggctctattttcttgtcttagaaagtaagatatactgaacatatttgaatcacattctggtgactaacagatttttacaattgttcaggataatacttgcatgtattagtatgaaaaaattctacagttgtacacaatgtcagtgattgtactggctgtgtctttcccctagaagatgccggggtgtggtgggggaggggaagaagaaaaagaaaacttaatttttatggtaagaaatcgattattattctatcctcattttaaatcatcaagtaataataagtattaaacaataataagtatttactcaattcttactatgaaccagatatttggaacatgggaatgaagcataaatcatgttctttaaactaaaagaacttggagaaatggttgcaacagcatgtgataatgcaaattatttttggcttttatattattttataaatggccaatgagccaggacaacagtgaatttcataggagttcataaaatggaaacacgaactaaaatagtttaccaacactttgggagaaaatggaaattgagttagaatttgaagaggatcttagaagataggtgatttgggaggaagtgaaaagaagggatttaagctggttctgggaaaagaaaacagcttgagtaaagatggaaatcaatgttatttttatttagtagaagataacaaatttaccttgactgaagcagaggacatgtggagcaatcacaggaaaaaaaataactttagagtttaggccacattgtagagctgaaaggcaaaagaacttggacatttacttaaccatattacaagtcctataaaaacgttttacttagtaggagaaattatacaaatgaatcaacctattcaataatacatgaaaatgaaatgactttgtttttaattgacacagaagttttctattaaggtgatgaagtgtttgcacgtgtatgtgtgcatgttcaagtatgtttgtgtgcatgtgcgtgctggagtcatcatttatcacaataaaaggttgcagctacccacctaattaggcatgaagcaagcaaagactggataaggtgatctttgtctcactttgctcctgagacatctttgtctccagtactaatcagcagtgacgcgtcaagtcatcgtgagtgacaattacagtcctctcattacaggaaatgattgcacgactaggcagattgatgagtgtattggtgttccctaagaaactgagctcctccccaccagccctcttcttgacaacattgctgaatattattaaatacatatttaaggcaattcaggtaaagcttcttcacttggcaaaacaggttatgattgcttagaaatttattctaagagcaaaatttaacacatctccctgaattgtatcttcattctgagagtctgtgcttttctgcagtgccttttcaccttcagtttgtgcaacagtacctgtgatggtgtggattaggtgttacattttgtttagacatggaaaataaaataggtagacaaagtattttgttgaagactggttagttggaagctgagtgtcagactcatttcatttcataccttgcacttccagttgcagatacctttaaataaaacatagttcacttcttcccactacaggccaatggattggctctagcccagtggtcctcaaacttgagtgagcataggaatcacctgccctatacgcaaggtttctcgttcattagttctccagtgggccccagttacttaacatttctagaaggctcccagggggtgcagatgttgatgctgaagctgggggtctggagaccaagaaccactgaagcctgtctaaaggggtaacttcttattggtcacatttcattgcccaactgttcaattccttgatgttccccagaagctttcttgcattccaatcctatatgattttgagttctttctggacacagtctgctctgttatctgaacaaacattttatctgatgctttcctttgatttttccaatcatagtctcatggtctatcaccatgagacagggattgctttaactagagaaatgataccaatactgtttgcttagattgattttctgatttactagtattcaggcattaatatgatctggtgcctgcattctcagtaacaccaatatttgtagaaccattctaagtgtaactttgatcaaactaatcagcttggtatttttttcatggatggtccagctgtcaaaatacagatgtgttcattaacctaacgaaactgtcccagtatgaactatgctgattactttgactaaagtcatcatcagattggttcttgggatccttctagtccaaactgctcacgcagggcctaaaataaaatgactaaaaatctggctatctggctatcgcaagtagaacaattggaggctaaaaagtaaaatattattcttatttaaaccatgaacatcattaacatatttattcaaaagttcttgtccaacatctgcaatgtgccaaacacattcttccaggtgcaggaaacacagcagtgaactacaaaatgaagtctgaatttgtagaactcatattctcaggaaggagaaatgataaacagggaaacataaataaacctgctaccttctgaaaggttagatgctatgatgaaaaaaaaaagcaggaaaatatgatacaatgactgggtgtggaagctgatttaggtagaatgatctctgcaggtctccgtgaaaaaggcattcaggttgagacttgaatgaggagaagtagtcattcatctgtatctcagagtaggaaaggtaatggtaagacttggagtgatggtggaggaaaagcttttaagaagaagaaatagaaagttgcaaatgccttcagccagaaaaatctgggaccttgttggctgtggaatcatggtttgattttcttctaagtacatggagaatcagaggtgacataacttgttttctgcttaaaaaaaaaacaacactctgactaatgcatgtagagtgcattgtaggagagtaagactagaccagttacaaggctattttatcaggtctgttttagacattgaccttgaacttgcagctgaaactttttaaactaaaatgtctctaagtatttccactagcagatcctaaattgaataccaggaatttggctcctgcttttagataaaacactgtaaaaggcattctgtccgagaaaggaattgccatctgctgagaagtgacaatgaactgggatggtaccagtacatgtagtgagaagtagtgagattcaggacctattctggaattgtatttgaaaaggctgtctgaaaaaaaataggttcactgggtatagtgggtgctattggtgacctgtccagacccactttgctggctggagagtcatcctgtagttgttgggagtgctggctggcaaaagcttacagctgcctctgtcaatcactcgtttccatctgaacaacatttttgccattcccccctcctcccatccatcttctttcatcccctttctccataaggcaatgtttctggaagtgtggtcctggaaagagtatcatcaatatcacttagtaacatgttaatactataactgacaaccggaacaaatatgagatatatcaaacagaaaaatacaaagattaaagtttgaggatattccagaaatgacaatttttgcgcatatatatatatatatacatatatatcaatgaaactattttaatgaccataaaaagtattgcattgtaaagaaaatttagttttatacaatcaaattatcaaaacttatcattgaatgtgtacagtaactgttaatgccttaaataccattgcttcctttcaaacataatttcttgtttttcctttagtcatgagtttagtaagggaaagtaaatctcacatgattatttttagaaacatatatacatagtaggagagcagagacagagctttactataaggtattgttcacttgattatggaggctgagaagtcccatgacacactgtcttcaagttggagacctggaaagctattcatttagtctgaaggcctgagaatcaggaacattgaggtaggagattgatgtaccaacttgtcagtcaggtagaaagaatcttcaaccttcttacttctttttgttctattaaggcccttaatggattagatgatgctagcccaattggggagggtcatctgctcactctctccaattcaaatgctaagctcttctggaaacaccctcatagacaccctgaaataatgtttaaccaagtttgtgtgcatcacatggcctagttgagctgacacataaaattaaccatcactcttacttaatcagaaattctggagatgatggggtccaggactttgtgttctaacaagccctccaggtgattttgatgcatgctcaagttgagaaccattgaaatagagtggtccctaataagttatttgaacaaaaatctcctttcatgctttcctaacagggacctgcaacctaggatccaggaatgaaggaaaaaaataattgagggtaattcctaggtttttgtctttagcatctggcttagtttcactagctgagatgagaaaaacttgaagagaagcaagttcggagaaatcgatcattctattttgaacttggttactaatttaggtgctttttagatttcccagtgggaatgtcaagtagctaatcagatgaagtctggtattcatgtgtaaggtcaggatttgagttataaatgttacagcctttactgtatggatagtaagatttaggaagaggtcctagagaaagaaaagtgtatagcaagaacttgtatctttttttgcatatatttgaaacaaattattagttaaatgtattaaaaatacaactagactgtgtttatgcaaaggattaacaagattttgctaattactaaagaattcaaggatgatttagctttaagggtatatgaataatttttttacctttgttacctgctaagtagagaagccttcttccagaagatgacatctatacctacctatatttggatgctagagaagcagaacctggtgaaagctcaaggcaggtctgatccttgcatcaagcagagaaatacaaagattgaagtttaaagataccctagaaatgaccatttttgcacaaaattattttaatataaaaagtactgcattgtaaagaaaaacataattttacacaaattattaaaactcataattaaatgtgtgcaataactcttaatgccttaaaccccgttgtttcctttcaaacataattttgtatttttcctttacaagtgaaagtaaatctcacatcattatttttaaaaacatatattgtattcagcatcttttcatcactcactgcctattaaaaccccactaacaattaaacacatgctggtcataattgtgtcaactgcttatgatgccaaatttaacccagttgtcaggagcagattgctagaacacatattaaatattttcctattatttgaggactagcaccagaaaagaacaggaaatatgtagggaagaggggacccactgtgggctgactcatttttcagggggtgagtttttatatacaactttaatcctccttagaaaattattagcatgatatagtatgatgctgataaacatcgcttttttgaagtcagacgtaatgacttaggtctactatctaccaattttatgaccctaggcaagagaattgatctctctttgcccaattttcttgtcaataatgtgaacaccccatagggtcattgtgagaattaatccacataacagagacaaaatacatagaatattgcttggaatataggactggtcagataacatcctcacctccatatctactgtgcccaatctcctctgggcttcaggaatgcctagttaggcaaatgcatcattagatgaaccagtgtctgttaagaaggatgattgattgatagataggtagatacatagataggcagacagacagacagacagatagatagatatagatgtgagctgggccctgggtaagcactctttaagagggttaacctccatttaggaaaatcatctttaccttggtctcattaatacatgatcctcttgtatgttttccacacacatagtaattggccttgtaactccagtattaccatgtgttaaattccaaaggagtttgcaaccatttcctcagtgactcatcatggtatacattattttattcatttatctaatatatgttgaggtcataccatatgctggaaatcatgctggattatgtagatcagtattatctgtgagttacaaaaaaagaagtgacacaaatacatatgaactagtacaaagataaagagatctatgtagagttaaaactaaaagtcattctctaaagactgactatattgcttcttttattcatgaccagtcttgtgaacttagagaaaggtagggcttcctctttgatgtttgtcacccagtgatgtcaatgagtgaagatctgattttgaccatcaaaagtctctggacaagaagttctgaatgaatggctctggatttgtgctttatagtcagtatagtccatgaaacaactatgggaaatattctttggtaaaggaaggagaagaatttgccattaaagataggcagttttctgcctaacacaatgcaaagacctgtccaagaggtattcatctgtgctaacatctgacctccgtcttgacaagatgtcagtgaaaaatgaactcactgagatgcatttcagatcccttgggaaaagacagacagagagaggacaaaacataaggtttaaaagcagcccttaggagagatctgagaacaatttccaagaatattttcccatgtgttaccaggaaaaggcaatacatcttaaagaagactgagctgcccaatcagcttacttcacttcagtgaactcctccctgagacccctgtagctactctcaaagctttatattgacacaatttaaaatgtgaaagatagtaaaagttaatgtaattatcccactggatgatctcagcaattctcgatcaaagagaaaaagccatcataatgcaatgcctagcaatggctcaaaagcacagccatggcccccctgagaggataataatgatcccaatagcaatacaaccagatctcttaggaaaaagaccatgaaaacctctaaacaattagaggctgcaaacctggcaccagcatcaggtaaggcacagcctcctgaaaacagtgggaggcctcagggatcatgcccaagttcaaggtaccatgtaaaagattgctcctccatcatagggcatagaatagagccatgaacattaactctttaatagaagttttagaagaaaaacttcaggcaaattaaatttaacagcatttatttgagtaaagatcaagtcatggatcagggcacactcagaaactgaacaaggtttagaaagctctgcttcagcagcctgagaagtcaagtacagacattacttgattggctactgctaggtatttaccttatttgtgtgtgatctgggggaaagtccctccttagaggttagtttgttgtttctgattgattatacttaagtttccttttactgtgtacatggagcttcagtgtgcttatgtaaggatccaaggcactggggttgcctcagtctaatgttcttccagttttttgtttaatagaagcaatggtaaatggcatagttaacatctatttcagttttcctttacaaggatttcattgatttccagcagttaatacattcctctacactatgaactcctctcacaggaagcatggaccaaagaaaagtaccgttaaatttctccttatgggctacagtactatgaaagggaaagagtttaatgaagaagttctgagcctcaaggaattcagcttcagccaggcatggtggcacatgcctgtaatccctgcactttgggaagctgacgcaggcagatttcatgagctcaggagttccagacgagcccgggcaacatggcgaatgctttctccacaaaaatacagaaattagccaggcacggtggtgccaaaatgtattgtcagctactggggagtctgaggtaggaggattgcttgagccagaaggctgaggctgcagtgagctgaaattgagtcactacactacagcctgggcaaaagattgagaccctgtctcaaagagaaaaaaaaaattcagatttaactgcttcctcctcctcttctatctcccccttctgccactccaaacacacacacacacacacacacacacacacacacacacacacacttggggatacttgtcttggtgtctctcgcagagattgggagctttcagaaatggtgtgtcaggtctgaccctattctttttaaactaagaaaaaggagaatgttgatgactgagcttcaactggaaaaagtagtggtggagaaagacttccaacaggagttcaataaccatggagattatgtgatggatattcaccagaaatctgtgcaagaagtggatggttcaggcagggggcgagcacatggagctggggctgtcagtgcaaatatagggaatatttcatggattcagactcactgtgcagtaagaagtcagcctgcctgacttcaatatgtaagtgttatgttgtggagtcctgaccttacaggtagaatgaatccatttttaaatggaacgctttctactgagatgggctttcaatttggagcccgttgttattctcttttcgtctattccttatgtaaaatcccttcctgtaacatacacctagaaacatgttttatattctcaatttagacttggtttgaaagttttgctacttagccattttcttcttgtattaatctctgtgtttcacacttatatttgaatttacatacccagaagttaaggtcaaaatgttggacaatctgtaaagcataagcactgacccattagaatcagcatcagccattgtgttggagtagaatctggaaaccaccttgacccattggttgctggattttcaggtggctcatggagggatgagtgtgcttgaacatcacaacactcaagggctcagaacggtagctatctgatcatcagaacaaatatatttcattattttagcaaacagcataataatgatgcattaagttactcagttggaaatcataaagccatcaaactttgcatctgctagccaaacgacggttctatgagtatataaagatcgtaccatcacttcgtctctgtaaccacgttccctccctccaagacacatactcccaattgggtcaattcttcaattgagactaaaaatacaaaaagaaaaagcttgatacatcctctgactattagtttcctggttagaccattggatcaaggtttattactccaactacaaaacagttccttccactggctagtgtgaagcaatctgaaagagacgtaccctagttgaatggtataacttaaggatttattagccttgtaactttgagtaggtcacttaccatttctctcatctgtaaaatatgagtaggatatagtaatctctggtttctccagttttggtattttgaatctagttgtatgaattgacatcagtttgtgcctattgattatttaagtctgataaattacctggacatagtaaaaccaggaaggtagcttttattctgtacttcagaggaaaaacaggaaaaggttcattgatttgacttttctaatttttttttttttttttttttgagaaagattctcactctgttgcccaggctggagtgcagtggtgcaatctcagctcactgcaacctccgcctcccaggttcgatagattctcctgccccagcctccggagtgctgagataacaggcatctgccaccatgcccagctattttatatatatatttggtaaagatggggttttgccatgttggccaggctagtctcaaacttctgaccccaggtgatttgcccacctcggcctcccaaagtgttgggattacaggcgtgtgctaccatgcccggccgacttttctaatgtttttgatttttacttctcatcaccaaattaatttatgtcagtaagtagttacttttgggacaaaggacacacattttggtggtttaaaataatgcattttggaatcatatcaaactttcgtatttttttcccatagaattatttggatttttatttacttatatttacttaatgtaagtaattggagtaatggctttggagtttcgcatgtttatttacagttgtcttcatatattttatccattaaaatttatcctgtcttattgattgtagtcaggctctgactttactaatattttttcacataactatccagttgacccaacaacatttatggaattatccatctttctctaatggtttaagataagacatatttttccatttatgttaagtgatttttagacttttaattcagttccatttatccatgtattcgtgttcaaataccttgtttggcaacttagtgtaatctcagcacattcagcaacttctttatgattcagttttcttatttttaaaaaggcagcattgacagtgtgtacctcagatgttgcaaacatgaaataaaataatgcccatctaaactctcagaaaatcttagatattactgagcctgaaacactattattgtattttcttcttcctgctgctgaattccttttatattttgcaatcagtttcaacctactctgtgtgtgtgtgtgtgtgttcgttctaggaggtatgtaaacagattcactaagttgaaaatcatatagttgggaaaaggctttctcaggtttttctaattcccagaattagtactgtccagcaggaacctttattctacatagtatcctttctactggactgctgtttccatctgccctaggtcatgcctacctcagttaattatgtgttgtttccccttgaaaatcagcaggaatgcctttcctgcttaaaacaaagactgattccctgccagtctctttcacaaaccttgccaacagtggatggaattgatcagttttgtttctccttctctaactctacagggaaaactttactcataatcatggatgggaatagtgcccctagctgagcagctgagattaaatccagcaactgttaacctggtatagggcaagaagagagtattggaaacaacaaaacacaaaaattcacaggcaatatagcatcttttgtacctatttccaaaacagaatctcagctttgttttaataaagcatcattggcaacagaatatgccccgagcaccaaagttcataaaaagtagcctttataacatgattatttattagaatgcttcttcattttttagcacagaaaatctagcatacaatttcataacagacaaaggagccaaagggacatagatttcttatgtactagctagtgaaatgaacttttgatttcagtgttcacatttaggaggcttagcagagagagtacatgggcttttccactttactggattttggaggtaaaaaagaaaaacatccaagcccagaaataatgtcttataagccacgacaaaaatgccccaggtcatgagagaaaactattgcttctgggtaaaataaaattggaagcaaagagaactagaggttacagcaccttgatagttggtggggttcgtatgattttgagtcttcaaatcagttttggatggtcaagaagtatttttttaccatcccgaggctgttaagctacagatttatttctgcatttctacttataccctatgaaagtagctctaacatcatgtgcccaagggcagagcttaaaggaatattttctgtggaagtggaataatcagtcaaaatttggaatcactcccagttcttcggaagtaaagttaattaatctggaagcacatcgtttgtgtataagaaattcaagagcagcataatgagttcagcaattagctttaacttttcggaaacatttctcagaaatatatgcattgaagtctctcccccaactgtatttttaactggtgtattacagctgatttttaaacatgccatcccattggttgatcttgtcatagagggaaaaatccattattagctctgcttgtacagtaaagttctgctttattatgtaatctcatttctgatttactatttgctctaagtgaacgtatgactacaatgtgtaatgaacattgtgtagcatcttgaaaagacaaagattaatgcctccttgacagtttttttccccacttattccttggggaacacctattctacttgtcctgtaactggaattacacattcaccccccagtaatttttataatgatttcaccaaagaacttgaataaaagtagttcaataaatgacactgtaatacatatactttggagtcctattgtgtttttctaagaaaatgtaaaatcatatttagggtcagattttattttatgtgttattgaatgcattgtaaatctagagggctgtttaaccaggttccgtcaggtaaattaattaccaccacaactgggtttaatttgtctttttatcttttctgtattaataaagtcagtgttttacagcttcgatattacctttttgaaagttcttatgtttctattaatgaacaattaaacggtatttgtattcttcaaaattgctaaaaagtcagtaagtagataattataattaataacacattcatagtctaccagtatcttacgatgtatacttgtctttttcttcaaagtgaggtgacctcaccaaaatattcttcacagtaggttgagaatagaatttgaaacttacaatatttttagctcttttaagattatgttgctctattttatcctatttttgtatctcattcatggatcattcttggtgtttattcaattttagtcaaatttattaaatatgatacacattttcttaaaagtgtttaagacttactccagaaaatagtttgtcataaagcgaaagagtttttcagacaatagaattcccaaacagcctacttaattctgtttgtgaatgacttgaggcatcacatgaaaactgcaataaaccacagtctccatcactcccttttctttcatactgagtttgtaatctctggcctccagaaaaatatttggttaaaaatctagtcaaaaagtttgtatgttgtttccctttgggttattccatttatcatttcctgaaaaccaaaattcccttagccctcctagtctgctcttcttttccaaacaaatagcaaattgagtttaagaaggagcctgaaatgaacaatgtcaagtctaattctgaagctcagctaaagctaaatagacatgctagaagagtagcatccatctgaaatataattattgagcaccttttccatgctagaccttattctagctgctggatattgaaagaaatgtaaatttcaaaattatggacaaggatatgggaattgctgtttaaacaacctttactgcaattatgatcttaccagtgggttttgaccagacaccagataatcatcttataagttgagacaggtgatacttcactaacttactgtggatagaacattgaatatagctttatatacatgaaacatacatataacacaagcacacatccttcagctattcaaaatagattttatttttccaaatttcaatagcaattctagtacaagtataatacaagtttaacttaaaattggcatcctatctaaaaggctgaattataaaaataaattttggtaacatcttcagtttatcttactaggcttaaaggcatatcaagagaagaaataaaaatcaatgtattttatttctaggattggtactattattgacacaaggatattgcatcaatatactctctagctatcatttttattttttgcatattactttttaagggtggcctgtgaaagcaacacgagattcccaaattatagacttaaaggtttactttaaaaagatgagatgattgttatttaactttcatccatctgtttctctttaaaaaactgcatttgcagcaaatcaagagtaacacgattttgaaaactgaaaaacaaaaaacaaaatatctgagcagccaatatactttaggataattttctaatgttctatgaaaataggtaaatcaatacaaggtgaaaatgttttgtttatttctagagatgttgattatgtatcaaacccagtttgtccatgaatgttaaatagacacttaccaagtgtctatttggttaaaatttggttaaaatttattttaaccgaagaattcaggagacatcaggttattatttttatgtagttacagtgcttagatgggcatttgttgaacactggaaacttcttattctccaagccacataaataacaggcatatgaacattcagataatatggatgatagttgccattgttgaaaaatcagcatttattaaattcttactatggaaattacatatttagtatctcatttggtctacccagctgcagtatgaagcaggtactgttagtggttccagctaataagtaagtgattatagaaatgagtagaggttattttggcgatttttctatagttaaaatttctacctcttgacataatccattcattttcccccaaagtttctgccttgctttcctcattttataatataatttagcttgatttttatattaattgttcaattccactcctaagatcaaatgttagggtgggacaacgagacacagtgacagggagtttgaatagagacaaaagcccttggaggggagagtatttaatttgcgaatctcatgttgctttcacaggccacaaagcagatggtcaggttcagaagtttagtgcctggcacagagctgggcacaggataaatcttctgtaagccatttcaaatgaagaagtgaataaccaaatagaagaagtcgtaagaccatcctgtctcaaaatagttggaaagcaggctgaaggaggcaacattagtttctgttcattacatgtttgttacaatacagcgtattgaccaacttttcatactacattaaatttcacaaccattttatgaaacggtacacttttcaggtgtgaaactagcagaaaaaccagatgttctgatttcatcaggaaaaccaaatagatggatttaatccatggtagaggtgaggttgggaggtctccaatgatgctgtcacgatttctctgttctctgtttacctccaggaatctggatgattgacacaggaaacaagtaatttgcacacaatagtaagtggcaggactctgaggtcctggaaacagagtgtctgtctaatgtttcactacttcaggctctcactgttcctaggtcagggaccaagaccacaggtcttgtgagcagatagggtagagataacccaacatgcaaaaatgatgatttttacaactgatgagcaagatgtcgcagacagatgaagcctgcctgcctaacttcggggtaggagtcccagccttcagggttttgtgtaaatgaggagaggcaggagtcatagttgatattcaaagcactaccagcaaagaattttggtctcaattcccactctacagatcattagccactcagtttttggcaaatagcttttcttgacttcagtttactggtttcttcaactgtaaagtaggaatgttgaacattaggctatatggcagaatgaattttaatagatgtcataagtatagatgaggctattttatctgcttgatgtctgtaatgccacatcccagaccactggaaagcacagttaacactgcaaatatacaagcagttttgacttcttttgattctattttgcatcatgaaggcaaagtataacctctcatttattcaaggcccatttatttttttttattcagtgattgggtaaatgcagatagtttctaaaatgcctttctaattattggaggaattatttgaaggtttggctgggtatttctgtgagacgagatggggaagatggagatagaggaattaatatttctcaggtttatgaaaaattctaaatgaagagtaaacctaccttaaagtaaacctaccaggagtaaacctaccatgaagattgtgtggacttccctctctccatgttttcctcttagataaaaaaatattttgaaagtaagtatcaaatcatttaataattaaccaggcatccttcatctaaaatagttgatttacttgctagactcacatgcaccctagacatgccacaggtaactattcttttctgtttttaactgactgtgagcttgagaaaatagaatcgccttgtaagcacttgcttgtacagaagttgtttattagttatccatcacagaaagcccgccagcagggtttggggctatatgtaattccagaaaagaaatctttggtgtcttcatatccaaaggtgtttccactgacccattaacattgggcatgccttcagagaggcctcccaaggactgactgtgtctgtgtttgtcagagaagagataattggcccccacaggaatgagagccatgacctgagcttcctaagtgaaactgtcagaaaagcttccagggtcagacctgcagtctaagcagcctctacactctgttgctgacagtggaatcaagagttatgttgcataaagtccttgaaaccaggtgaaccacaagttctgggtgtcttcggcttcttgtaacactatagggagctcttgtgtgaatagcctaaccatcctcatctgttctcagttctcctgtctcccaggttctagtgctttccagcctcccgatcagtccccactatttccagtttctatttactttttctccttatcccaagttttcatttctacttagagcatcttcaacaaagtatggcacttccaataatttgatctgaatgcggagtaagacttagggtaaaagagtagattgttttgacattacttattttctccctgtattttctatattcacagatgtaatagtaaacaaaacgtcttaggtttccgtatagctttataaggttttaaaatgctgttttaattaataacataatgccgtattttgtcgataaggacatgaccgtgatgtggtacaaagactacacacatactttggaaacaatagttgcaagttcacttctagctttaccaagtatttgataccagagagaaaggcaaaatgctcatgatccactctagcttcagttttcttatttgtaaaatagaaataatcacttgtaccttgcacagttaaagttaataagcctgagcaatgtgatattgttagaggggcatctacataatctgcccaaatggtcataaggatggtgacaggtgacttaaaacattagcgtataaattctttttttttttttttttttgagatggagttttgctcttgttgcccagactggagtacaatggtgcgatttcggctcactgcaacctctgcttcctgggttcatgcagttctcctgcctcagcttcctaagtagctgggattacaggcacgtgccaccatgctcggctgattttttatttttagtagagacggggttttgccatgttggccaggttggttttgaaaccctgacctcaggtgatccacctgcctcggcctcccaaagtgctgggattacaggcgtgagccaccgcgccccgccattagagtctaaattcttatggtggcttgtttaataatgaataaaggtgattatgattcaattcaaataacacaactccttgtttaaataatttaagtcaatgtctgttagaaatacagttgcatgccttgaataagtaagttaatttaaatacgtgtgtgtatgtatatgtgaatatagatagataatttcattattctatttatgaagatgtctttttaagatgtttatggaacttaagatgatagaattactcttcatagctaattaagagagcaaggccgggcgcggtggctcacgcctgtaatctcagcactttgggaggccgaggcgggcgtttcacgaggtcaggagatcaagaccatcctggctaacacggtgaaacaccgtctctactaaaaaatacaaaaaaatagccgggcgtggtggcgggcacctgtagttccagctactccggaagctgaggctggaggatggcgtgaacccgggaggcggagcttgcagtgagccgggattgcgccactgcactccagcctgggcgacagagcaagactccatctcaaaaaaaaaaaaaaaaaagaaaacaaaatggcaatatatattatgaattcactacaacttttaattagaattttgttagtcataatggaatctttatattcttgaaaaatgatctgaaacgtctgttttttgaaaagcatgttaatagctttgttacaatagtcagcatgcatattgatttaacgactcctttgcatgactctaaaacatgctccatgtacgcaccagagttccctccttggcccacaaattagaagtaactgttatacaacaaattaggtatgaattttcaatatgaaattccagtgctccttgacaattctttttctctaggctatgagtgtgggtctcagctttaagctgatgggttaaattctatatgtataagcagatccacattctcttcttttagcttttctgcttcataagtattttgctgtttaactgatccatcaccattacatgtggtttacttttccattttggaaaaaaaatggtaaaaaaataatatcatgtatattccttcttaaatagattcaatactctggtaaaaacaaacactaagtaaatgcctaatggcgtgaatctgagaggagagtgcttttagtaaattcaggctgcagacatgtttgggtaacattttgctatccttgctctaaagatacatgctaatggatgggcaagagtagcattaatgagctcactccattaaattagttctttttttcttgttaaatatccaaaagagaaagatggtccacttaactagggaaaaaaagtttcattttagtgcagtagaaaatatgatgcatattttctttctaatttaatttctaaccattaagattcaattgtacaaatgacccactgaagcacttggagagattagaaaactataaactgaatgtcatttgaatttggctgtctagacaccatgatgttatatagggtaattcgaatttaacatcatatttttatgaggccaccaagataagcccagtgacttctgtgaataatcactaatgaggccctcaaatggaatgtgagaattgatctcttctctggtggttgtttttattaaacaccatattggccaacccttccaatcactgtgatttgaacttttgtttgaatagtcaagttttctcttggaattgtagaaaaaggtcgctgtcagtctgtgggctgaggaaaaaggattacagctctaatgagccaaatctgtgcaaatgagaaaataataatctcctcataattagaactccctttttaaactaactgttggtcgtgagtttttcaaaagaagaaaaatcatttcattatttggttaaaagaatatttggaaattaatgccactggaaagggggaattaaaatgacttcagctcgtttacccaaatatgttcattgctggaacctcatcctgattttctagtcaaaacaattattgttgttttccatgaagtttagatagcgagaatcatgcattgtctgttcatgcagtagttgacatttactgcatacagcaatcactttcagtctttctgaagactgcgctgtaggaaggaaggctagcacgcccattttacagatggagaaatggagtattgctttctcaagcctcaaagaaattcttgaaatggtattagaaatcaggactgtcagctcccatgctcaatttgtagatcattgtaagcagcagcagcagcagtaacagcagtactggtagagtaaatcgagaggagaaagcatttcaacaattccagcagtactcagttaggaggagattttatttggaactcacaacacacagaagcatgtgtctacttggttgtgggtgggtgctcaggactgccctaggatattaagacatattactttagtagaggcatacaattctcccaggctttcctagctccttttttgagcttctcctggcattgaagggtcttctgggtcccccgtgtatctgcaacctgacctttctgaggcttgaaaccaagagagtttagaagccaacctgtaattaaatagccatgtggaaaaccatgctggaaaaggcaaccccatgggggagttcaaactgaaaggaaaaacagtgaaggtataagatgtgagccttcttgtatcccttctgtggaatgtcacatcacagtagaggaggattccagctgaagagtgggtcatttgtgtgcaggcccctggaatggggcagcaatgtttgcttgcttttctggagtttcagggaagccaaagttcaaaagccaaggactttccatgattaaagttccattctcaagaaagcaccactatgcattaatgtcaataagtcaccatgacaaaccagtaaaatagggcaaatataatcttacttttcatatattagtgatgttaaaaaaatggcccattggctcatgcctgccatcccagcactttgggaggccaagatgacaattacttgaacccaggagtttgagaacagcctgggcaacatagaccctgtctctgcaaaaaaaaaattaaaattataatttaaaataatggcccatagtggtaatgtggctgtccctaagatcacaaaactagttgttatgagagcttgacttgctaatcctgttatctgatgctttgttgaggactaatggtggattgatcctgtagaggccaggggaagactttctcttcaccttctgaagtttcactgagaaatcaactgacaaaaagaagattcattgaaaaaaaggcatacatatttatgaacatacacatgcggaggaccacagagggattgcttctattccccagtaggattcagaagctcgtatacaatcttgaggttacagcaagaatgggtgcttggatcatggcaaaataggctatagtggtaaaacacatgaggggaccagggaagaggaggcctggatagcaaaaggtcttgttttgcagatgagatcaaatagatggtgaatgtttctttaagacctttaaaggtatcagatattcagttaatcttttctaaatctggactagagaaagcctggctccatcaatgcaggttttctctacatatgctcttctgccccatgaagacaattttcaaggctacttctgtttgcaggccctctgaacagccatctcaaaacaggccaaagtatattttggggtaaattattttggtttatttcagttcctactttgaaacttcaaaaaattacatacataaaaaggcaaattggtagctttggagaaatttgggttagaggttcttagattagataggcaaaggaaggggaagacaaactaggataagcaaaaagataaataaataaataaataaatacattattccatatcatcttgaatcagttttgtagtccagagagtagatcagctacagctgttttccattctagcaggtgcattgccaatgggctagacgtctatataggatgcagcaaatccatctctaataagaggcatttctatggaaactaagaaaaacaaaggttaatatctggagtggtctgtagatttgtttttctagagtgtctaatgcatcttcagatggcagtggcaatgtttctggattgtagtttaaatcaggtgttcaagtgaactttataagtagttcatacatcagctggcacaaaagctgcttatatataagttgctccggtgatttctcccaacatttatatcaagttgtgtagcttcagtgtgcagagcttcaagaaaagcacagtttttggttttaagtgattctaaggcagaaaaatgggagaaaaatttgaaaacattagtttggacacttgtagccaggaagtaattcaggattcagttcaaattatagacaaataaaaaaacctccaaaacaatgggcagggctagaatctaaaaacatatgtactacagttttcttttgaaacataatttctcctccggttccccttttctaccaaagacaaatcatgtgtagtaagaccatttgtttgcaaaataaattttagtcttagaatactcagccttattatttgcatagagtatagcaagaatagtgattggccatataggttctttaaaagttggctttgctagccgggcgctgtgcttcatgcctgtaatcccagcactctgggaggctgaggcaggcagatcacgaggtcaggagaccgagaccatcctggctaacacggtggaaccccatctctactaaaaatacagaaagtgagccaggtgccaggtgtggtgacatgtgcctgtagtcccagctgctcaggaggccgaggcaggagatatacctagaacctgcgggcggaggttgcagtgagctgggatctcaccactgcactccagcctggatgacaaagcgagaatctgaatccatttcaaaaaaaaaaaaaaaaaaaattttggcttcactgtgactttttcataacaaatctcaggttagacttttaaaagcctctaaagtctataaagccaagctaagtatttggcatcagactgtgcccgtaacacttacatgaattgagtgaatttctgttttctagaggtttcaaaatatcttgaggttcctgggcctgtcagaaagtgacattcttacttgcaaggtcaggaaccttgtacggaaacaatgtagacaaggtaccaggccagcctttccaaggagctttttattggctctataaagtcaacttcaattcctcaaagcagtctggtcgtatctgaaaataagccattacagtcaaagccattaccagtcaaagccttggtaaaataactagtacccacaagtgtgtcctcttacagaagaaactgattcttgtggaacctatgtaaacaacgatattaccataaaataggaatgttcatgaatagtttccaaattttggagaaatcatgtagatagaagggtaaatatttcagttttgcccacaagagtatagagcacccaattgttgtaagctataaagaaataattcttgactctggaaaacaaaatataaaaaagaatcattaatattccaaacaaaaatcatttaaaaaaagcgtttaagtcctatgtcagttcaggaccacgtaattaacttattctgcttgctgttgggttagcaatatttatgattacgtcagcttttaaaatagagccctggaaggttttacatgggtctaatgacaagatctccaaagttatcagaagcctgtattcaagagtatttcagggtacattctgtaaaatttattgaagaagcaaattttggactgtagctgattgtaaatggaattttgagaaaaattaaagcaataattttctgtgaatgataaaagacttagaatagccacgggtaaagatacaactgacaaggaaactttgttgtatcatggcatacgacaatttaacataatcataattgtgactgataacatatcagaattttaggaatctcatacagtattagaacacattaataacatgtttatagaaatataacttgaataaagttaactccatattttgacaatgctttccatatgatttttacataccagataaacctcgtatgttcctcttgggcttccaggagttctttttggaatttccaaaagttaattcaaggtcaaaaagacaattttagattcgaaattaaatatggaagttcgtcaaatatcaaaggtttaaaacacttcatatcaaaataaggaaagttaaaaatacttgatgaaaataggatcaccggtcactgtaaaataatagttaatcatttagctaaagtgataattaaaaaaaaatattccggccgggtgttatggctcacacctgtaatcccaacactttgggaggctgaggcaggtggatcacctgagatcaagagttggagaccagcctgtatgctgaaaccccatctctactaaaaatacaaaaattagccgggcatggtggcacgtgcctgtagttccagctacttgggaggttgaggcaggagaatcacttaaacccaggagagggaggttgcagtgagttgagattgcgccactgcacttcagcctgggcaacagagcaagactgttgtctccaaaaaaatatataactaaaaaaattaaaaaaaattcaaaaatcaaaaacacttactcttttacagagaggagaatcaggtttccaaataatcaaaagatggaataaagaaaatatgagatcaacggaatctttcccttgagttcttccctctcttttatttctttagtttacttaaaagatagatagaaatattttactatgtcttgttaatgctacacaaatatcttgttccaaggagaaacctaaattctacctttccatcagtatattattaatgctaaggctaattttaataaaatttatttcaattagctttgaccagagaagatattcataaacattttataacctcttacaatttttcctattttctttctttccctttttatattcatccagtttcatctattctttatttcttaaatacaatttacaacaacttttaaaaacctttagccagaattactattcccttaatgaaaaccacattctcatgctttcttataacatttcttaccgaaaatacatctcacttttcttatacactttgcatacagaattgtttctcttgtatctagtagttttaatcatacatattaatcagtgttgactcccataaccctaattttcagtgaaaacctaggaaataagtaattttaactgtcagtcatgtactaacaatttataaatacatatcgtataagttttaaaagcataagctttctatagaacaatttttctatatggaacaggacatatttactagcagacctacataacttttgtttttaagaaaaaagccaaaagcatatgagcttaaactcatatttagtaattaatgtcttagcattatatcttatttggaaatgatctagatattcaatgattattcatcatttaatttagcttaaactctaagtgcatagttaccaaaaaattttgagaaacctttttaagtaaatatattataaaacataacttttattaaaagtgtatttatgaatgtttatctcatttacagctatttaatctatttttaacaactatgtttggtaaatttcataagacaaatctagccatcatctcaaattaaattttctattaatcatttttgtattactgtctgttaggcaagtatcataaaagcaaggaccttaaaggaccttaaagttagaaacatacatatttcattgataactcagcagacttactttattaagctaacaatattaaactagtattatttaccagaagactgctaaagtaatgcaaacttaaaaagcatttaggtttatttacttaaattatgagtggtcatttataagtcaatttgctaccaggtagacaatatacaaatagacatgtatatacaaaaatacagacataaagatcttatagctttaatttttaaatttttagccatgagtcaggtaaaactcactagtttaaaagggcagttggattaaaactgtatctctgtaagtggaacaacttaaaatttatttcttccacatgttcaaagcctttactaaatttcagagaaaacagggtagcaaatttacatttgaaagcatagagagattttaagctttttcaagaagtctgggtgtgttagaggaagattaaaaatggatgctaaggtaacataaaatcataagaatttatcacagtattttacaaggaaacacacagatgaacctagagaaagttcagaaaccttcacaaaataatgagctaaatgcaagaaagtcatattttggagaccaatctagtttgataggtggctttttaacatagtttccattttctttttttaatttaattttgtattatactttgagttctgggatatatgtgcaggtttgttacatgggtatacacacgttacataggtatacataggtgccatggtggtttgctgaacccatcaacctatcaacaacaactacattaggtatttctcctaatgctatccttccccagcccccaatccccccaacaggccccagtgtgtgttgttcccctccgtgtgtccatgtgttttcattgttcaacttatgagtgagaacatgtggtgtttggttttctcttcttgtgttagtttgctgagaatgatggtttccagcttcatccatgtccctgcaaaggatatgaactcatcctttttttattttatttttattgagacggagtctcactctgtggcccagcctggagtgcagtggcatgatcttggctcactgccagctctgcctcccaggttcacgccattctcctgcctcagcctcctgagtagctaggactacaggtgcctgccaccacgcctggctaattttttgtatttttagtatagatggggtttcattgtgtttgccaggatggtcttgatctcctgacctcgtgatcctcccgccttggcctcccaaagtgctgggattacaggtgtgagccaccacacccgcctgaactcaccctttcttatggctgtatagtattccatggtatatatgtgccacgttttctttatccagtctatcattgatgggcatttgggttggttccaagtctttgctattgtgaatagtgccacaataaacatacctgtgcatgtgtctttatagtagaatgatttataatcctttgggtatatacccagtaataggattgctggatcagatggtatttctggttctagatccttgaggaatcgccacactgtcttccacaatggttgaactaatttacactcccaccaatagtgtaaaagtgttcctacttttccacatcctctccagcatcagttgtttcctgactttttaatgatcgccattctaactggcatgagatggtatctcattgtggttttgattagtatttattagtatttctctaatgaccagtgatgatgagcttttttttttttatgtttgatagccgcctaaatgttttcttttgagaagggtctgttcatacccttcacccactttatgatggggttgtttttttcttgtaaatttgtttaagttccttgtagattctggatattagccctttgtcagacagatagattgcaaaatttttctcccattctgtaggttcagcatgcaaacagagacaacttggcttcctttcttcctattcgaataccctgttcactctgatgagagtttcttttgctgcgcagaaactatttagtttaattagagggaatttgtcaattttggcctttgttgccattgcttttggtggttatgaagtctttgcccattcctatgtcctgaatggtattgcctgggttttcttctagggtttttatggttttaggtcttacatttaaatatttaatccatctttgagttaatttttgtataaggtgtaaggaaggggtccagtttcagttttctgcatatggctagctgattttcccaatgctatttattaaataaggaatcctttccgcactgcttgttttcgttaggtttcttaaagatcagaaggttgtagatgtgtggtgttatttctgaggccagtgttctgttccattgatctatatatctgtttggtatcagtaccatgctgttttggttactgtagccttacaggataatttcaagtcaggtagcatgatgtctccagctttgttccttttgcttaggattgtcttggctaaaggggttcttttttggttccatatgaaatataaagtttttttctaactctttgaagaaagtcaatggttgcttgatggggacagcattgaatctataaattactttgggcagtatggccattttcacaatattgattcttcctatccatgagcatggaatgtttttccgtttgtgtcctctcttatttccttgagcagtggtttgtagtcctccttgaagaggtccttcacatcccttgtaagttgtattactaggtattttactctctttgtagcaattttgaatgagagttcactcatgatttggctctttgtctattatttgtgtataggaatgcttatgattttcgcacattgattttgtatccggagactttgctgaagttgcttatcagcttaaggagattttgggctgagactatggggttttctaaatacacaatcatgtcatctgcaaacagacaatttgcttcctttcttcctatttgaataccctttatttttttctcttgcctgattgccctggccagcacttccaatactatgttgaataagagtcgtgagagaaggcatccttgtcttgtgccagttttcaaagggaatgcttccagcttttgcccattcagtatgatattggctgtgagtctgtcataaatagctcttattattttgagatacattccatcaatacctagtttattgagagtttttagcatgaagggtgtggaattttatcaaaggccttttcagcatctattgagataatcatgtggtttttgtcattggttctgtttatgtgatgaattatttttattgatttgcatatgttgaaccagccttgcatcccagggatgaagctgacttgatcctggtggataagctttttgatgtgctgctggatttggtttgccagtattttattgaggattttcataccgatgttcatcagggatattggcttgaaattttccttttttgttgtgtctctgtcaggttttggtatcaggatgatgctggcctcataaaatgagttagggaagattccctctttttcaattgtttggaatagtttcagaagaaatggtaccagctcctctttttacctctggtagaatttggctgtgaatcctcctggtcttgggtttttttttttgggtggtaggctattaattactgcctcaatttcagaacttgttatttgtttattcagtgatttgactttttcctggtttagtcttgggagggcgtatatgtccaggaatttatccatttcttctagattttctagtttatttgcgtagaggtgtttataatattctctgatggtattttgtatttctgtgggatcagtggtgatatcttgactatcagcttttaattaagctgacttatgaccctatagcgttctaaaagaaattctttcaaatctactgcaatgtggagtagacttcactgtgaatcctgcaggagattctaagtaggctgtctgaatatacaaaggattttaactttgttttaggtcagatttttgctctttaacttggtcaagatagtttctaaggctaaccattacattattatgtgtctttcttttaatttgatcttcccataaatacaaataaggcaattgttttgaatgagattgctaatatgtgtatgtgtgtatatatatatatatatatatgtgtgtgtgtgtgtgtgtgtgtgtatatatgtgtgtatatatatatgtgtatatttgtatatatatgtgtgtgtgtattatatatagttttaatttaggcttctttttaatttaacagattcaccttttggtcactgatgattaggatttttactggtgtacttgttctaatagcagcctaatagccttttcatggaaagcccatgatgtaattttccaggtataaaataagttaaaacgggtttaatggagagggcatagagggaatcctaatgatttttcccccaaaaaattactcccagaagtaggctaagattgccaaagtcttctgttgccacagacagttaagtatggcatttgtatgcgtgtagcatctctgataacctacaaatttgtggagtgctgccactaatgaaaccgctgttgcaaaagtatgacagtaagagaaatttgacatggctgactccatcttgcttctagcacagggtggctgtctttgctcattcctaggcatggaccaagctaatttgggaagaaatttagtttatagttaaataatagtgttatgggatctttggggtgtcattttcatgactgtgaagctctgtggccggtggcacttttgcccaagttttgcttaggcctgctgggctcattctgcccattcagcctggcagacactgctcagctcacactactggcctgaaccccctgcctccaagggagactgtgagtcaggtagggagcaccaaggggtgtgggagtgagcatggggtccagccactgcacacagtcagacacaccagctgctgccatggggcaggaagctccaggtgccagcatgggcaccggtactctgcaaggctgcagctggaccaggtgcaccacaggcagtttccccagctggcactggggaatgtggtgtcacctggaatactggagatggcaggaactgcagtgccccaaagagggagatacagccctggctcttgaagctcccaggtctgggatccccaaagggtcacagctcttctctacttccctttgcctgcaatgtggcaaatgggtcatatttcaactgttagtgttatagctcttttagcctcgccatttgttggttcccaagttctcgtcccgcaaccaggaagaataagttgcgcagacaagtggagggtgagcaagatgaaaaggagttttattgacaatagaaaagctcagaggagacccacagtaggcagctcctctttgtagccagggtgtcctgataactctcagcagagagggtagctcctgtctatagctggtcgtcctgttgtctgctctgctctggttgagcccagggcttttatgatcctcagagtggaggaagtgtgcctgcattggtccatgggtggccataggtgggcctggaaaaggcaccacaagtttccactctggtcacaggactggcagcctggcctccagccttcaggcccttcctggcttgaaggtggggcctcaccgtggacccacccccttctgcccaggagcctgtctgcctcctgccactgtccatggcacccagactgctcatgccgaggggcaccagcaggccagcaccgagctgccctcagccctcccttggcttcctcccatgctcgtcagcacccaaagtctagagggggccaaagtctgctggcgtgtcagcactgccctgagtgtatgtactcctggctgggctgtgacagcccgggcttggccccaaccctgttccaatattgcagtgggtgccaggagctaggagaggccagacggagagaacagacagccccaagcctggggggtaaaggcggccttctcaggcccccaagggtgcagagtgcagagacacctgggtcctgcgacagggagggcagggctacagccccagccatgactcctctcagcctggggtgggggctccaggtcctcactgggcccctttctgtccgctcctccaagcccgaccacactgttcccctgccagtgggcgacttggcctagccccatcacagtagctctcagggcagcaggctctcgggggtggggctcccactggctccggggagtgctgcacgagctgcggcccagatctgcctcctccttgcacactccctgcaggtggtgggcaagagtggtgacgcaggaacagagtccggagtggtggaggctccaggcctggtagcaggtcccgtgggggtgggggctgtgcagtcagctgccttggggacatggggcacaggggacccatcagtgccatttctgctcctgcagctgctcctgccaccaccactcgcaccttcccacagcagctggagcgatggcagccgctgctctggattgcccaccactgccatctacagcccttcccaaaaactaaactgttgctgtgaaacgaatgaaaggccactaagttagaagggtgagaacggctttaattctaaataataccagccattattccggaggccgtaggattcacaacttccccaattactcttgcagataagatcactgttgtagaatctaagattggccttttgagatatcttttcacatttctgcagttttgacaaccagacggtcccaccttgacctgccaatcagtcccgtgccccaccccccacccagcaactgactcagcaaaataggacagcttaggttcactatgatttcatctctgacccaatcatcacgctccctaccctagacccctacccaccaaactatcttggaaaaaatcttaacctctgagccttcagggagattgatttgagtaaaaactttgtctcccatgttgcatagccagcttcatatcacttaggctcgctctttactgcaatgccacggtctcagtgagttgactttgtgcagcaggcaggaagaaacttttgggcagttacagtcacagatctgttaatctatgacataggataggcctcccgggattggacttttccagcactaaccagacaacaaaggttgacatgacaaaagccccatagggatgagacttcttcagatgaacacctgcaagaggtttacacattcaggacaaaaagtgtgctgcttaaaatcttatatatcttgggttctcaaccattttcagactggccagctgacacgacctcaaaatcatgcttcaggcccaatcccaacccctccacggtggaaaccaagagagtgtgctcccacttggtcaccagtcaacctctcagtgacataaaataagatgagaaagaacagtgtcttttttttttttggctgcccacagcaaagtttatagatgctggtatgatcagaactgcaaaactgaacagtctgtaggactggtttgaataacagacttatgggggttttaggctcacattctaccctaggctacccctctttttttcctttagagatggaatctcacttttgttttgcttcccaggctggagcacagtgacatgatcatagttcactgccaccttgaattcctaggctcaagccatcctcctaccttcatagctgggactacaggtgcacaccagtgtgcccagctaatttttaaattttttgtagaaacagggtcttgtcatcttgcccaggctggttttaaactcctgggctcaagcagtcatcctaccttgacctcccaaagtggtgaccctctttgtgacaaaacaacacagaaagacaaagacaagactatttctaggaggaaagggaccaaaaatttatgaatattcatagcagaaggtacacgagttgctacatggaagataatcactcaaattcttttctctcattaatcaagattttgcagagcaaaaagggacaattatttttttccctctgcttgactgaatctctgtctactggtatgtcaagtcctgggttaccttaactgtggctttcagaaaagcacagctttggtatcatgctcatagtgccaaaactgtagggccaagggaaaaacttttcctttgccctctgaagtttcactgaaaaatcaactcatataaggcagattaataaaaggcatacatattcatttacaggaacatgggagaggaccaaagagggattatccccgctccccaattgggttcaggagcttatatgcaatcttgaggttacagaaagaatgggggcttggaatggcaaaacaggttatgggaggggaagaaaaggacacttggctagcaaaggtgggtggtcttattatttagatgaaatctcacaggtagcagccctcagagagaatcgacaatggtgaatgttcctttcagacttttaaaggtgtcagaagctcagttaatcttttctaagtctggacaagggaaagcctcagcgaaagcccagctccatcagtgcaaatcttctctacgaatgccgatctaccccagagacagttttcagggctacttctgtttgctagccctctgaacagccgtctcaaaatatgccaaagtatattttggggtgaaatatttttgtttccttcaatctgatgccaaatcactttataaaaagaacaggagactcatctctgcctttgttattttgcatggtctgtgatagacattactgataaagttgaacgtgtccaggaaatgtgataaagtaagaaccctcaatgcaaagactttggtcatgctggcagctgttcctggggctaagaaaacaatattcatgcactgatctgctggttatatttcattataaataggggttagtggccctaaagagagggctttgatcacttgtaagagctcagtgatgatataacacttgaaaaaatcttcaccacattttattatttctttgccctcctctggtcacttcaagttagaaatacaaattataaaaaataagctattacattttcacagacgaactaatgaaaaaaggcttttagaaaatatttaaattatcccagataaactgtgttaatcctactgacagtctatttgtaatataagaataatgctgtcaatctcacaatttgaaatcggtcacaggctgattttttaaaaataccttacaaaatatcctacaaaatatctttaccttcccacaagtctcatccagagtcactccccgataaactgtaagacaagtctctcagtgtttatggatcaaatttccctccaagtctttcttcaacatttgctagatttgtcctgctttctacctcccagtaaacagtgtacagaggtcgggacagaagcatctctttcatccggcaaagagcttatggaacctcagccataggctcaggcattatcccagccttggaaatagagccaatatgtaggaaatacagacatatcagtcagtagatatatacacgagcttgcctatgacatgaaaatggactgttattggctattccatccctcttccattcaacttggattatagctttagcatataaaaccttttggtccttccaaaccatacggacttgagtgggtagataaaccacaagaggtttgatcatttgtcaatagttttatcaaaattaatatatatagtatttatagaacgctgtgattcaccaagggggtaaatagatcagtcaacagtgaatacagctgatttggcttggcttgttcttcctaaactacgttgctgtcttgtgggtatatgacaatcgaagtaacacagaaggtggcataagtagattagtacttgccagatggatgatattgatatgaatgatatgagtatagatgagggaaggaaaggaaagttttccatgagtagaatgtgaatatcggctaatgagtgattgtccctcagttcaaaatcctatgaaagcaagttgtgaagatgaagatttttctatccagagtgttttagaaaggaaggtgtaaggatttgatctaaaattactttccttttgttctcaactctcttacccaggcttcattctactttttctttgtcttcacgatcaaaaatcagtgagtacagaacttgtattttcatcctttgttagataaaaatccacattttgtttgagagatgaagttaaattccttatggctacccctgggattaaaacacttaccctaaacttaaactggctaaaatgttttcaatagatcaaggaggtaaatacactcctgtaaagcagtagtgtatgttaataatatttttaaaaattaaccaaatcttataagccaattacttttaatgacagacaaagaagaactgtctttatggcttaaaaacattataaagaccaatttaacttatttaaaatgattttcgaaatggccatattttctgcaaaataattaagctgtcatacggacttctttataatcaaaattgaccattgccaatgttagttaccataaaggtatttaaatacaaaaataaaattgttttgagttataatcaatttttagtttattattctttattctcaggctttatacttaggaaatgttgaatatcctttgaccaaaagttttcaggtttaatttttcatctagttctccatcttgtctacatcatatctcttttatgggtctctattgctatcacacatgttctttaatttttatcaacaatggtgtgtttttgttttggattttgaaaatatttggtattttgtttaatgaaatggccattgagatacagccacaagaggagacagaggaaaggctcaggaataaaacaaagtttattatatttagaggtcatagagacagaaggcagggcacactacacagggccacaggggaaagaaactagattggttaggaaagagaagacaggagtgaaggggagggttagtctagagcctttactggtgtttctttgggaaaggcaaggcagggaagggtgaacagtgtagaattggctaggtataattttggtggactttgggctgtggggcggttcctgattttttggcatctgactttgggatgactaaggcagaggaatattgccttctggggtgtttgggccagacagaggaagtatggctttagattggttgatttgtacatcaacgcaatgttccaggcgaggtcctttgctctctctggagttgactagctcaaggaacagtaatttctcaccacccagaaaggcttttcaggatgtcaaaacaatataataaacaaagttaaaacacacaacagcgaaacttttttttttttctgaaaaaaggctactggctgttatttcttgccagaatcaataaaaattcctcctaaaagataattaaaaattatcttctctaatgtattgctgcaacctggccatcaaacagcactaaatgtaacttgtcttaatttttaccaaagaaaagttggtagcattacaatctgtctgtcttccttcgagagatagagatgtgaaatgcaaacactgaacataatgttctgtgtgagctctaaaaacaccaagaaatagatgtaggaagttacgtagaatggtggtctcaagtatcatccccaactgttgatacaaactaaacttgcagtcagggatgctatagcataaaatattcatgctgttattggtgctgaaggcgactgctgatttatttgcaattagtagtaaagaattcataacaatgctatgatgctcagccctcataaaccctgggaggcttctgtattttgcaggcttgcagttctgttgtcactgctatacttttttaaaaaagaaatgagctaaaccttgtcagagctgacggcactatcttttggagcttttcttctcccaattgaagataaaggcaaggaagctggcctgccacacagaggctggttcctggaccttctgggatctctcattccggtcagtttgctttatcgggcacctgcccaaggatgaagaaatcataactcataatgacttgtttgaaatattttagaccacgtgggtgagaagaacacactttaaaataaaaggaatgtgtagtcatccttccttacgtttgccttccacatatgtcctgctgatctagtattttgatgttctttagtgaaacaacatttatccagggaaattctaaggatataggaatccatcaacactagatttgtaagccaacaaggaaacaatagagggcaactaaatcaatcatttgtcataaatacaaatgtcactaatccaaagttggtggccacttttctgtttttacatcagagcctagagaatctattgtttactgatctgacactcttggtagctttttccagattccactttggtgctgatctacattccttttctcagtgataaatgccatttagagttgtattattaataggatttaattttgacagccagttttaccaaatttggcctataaaggcatacattcttcatatgcataggcatacattctttacttgatggctacatcattcaactattgtattattaagaaagccttgtatttacattggatgtcacagtttataaagaaaacatagatgtattttctcaagccatagaactgtgctttatagtgacaatttccatattatgggcccataatgtttagggttaattctgcattgtaatggctaacagaaggaatggtctggatcagtgcttctcaaattgaaatgtacttatgaagcccataaatatctttgtaaatgcagattctgactgagtagtctaggatgaggtctgagagtcaaaaacatgaatgtggggagcctacatgcattgtgctcaggagctgccttagagatttttgccttccatatctcccctttaaaattgcctctgacgtttgcttttgggctgctccctaaaataaccacctgccagtttatcatctcttgtcgcagaccctccatttccctagaatagtgttgctagatttaccaaataaaaatagatgacaccagttaaatttgaatttcagataaacaatgaatatgtttttaatataattgtgtctaaaatattgcatggtacacatttatactaaaaatgtattcattgtttacctgaaattcaaatttaactggatgacctgtattttatactgtaatcgtaccctggaaacaaatgccttggtgtgtattggtctaggtcaatctcaacactgttgacttggggtccagatacttgtatgttgtggtagaccatcttgtgcattataggaagtctagcagcatctatggcttccacttaccaaacacctattacaagcccgtcccttgttgtcacaactgaaagtgtctccagacattggcagtgtccctggagaaaaaagaaagcagccccagtttcgaactattggtctagagggaggagggtgtgtgtgtgtgtttctaaatatgtaggttgagaaaacaaaatattagtaaagttttcggcaaggtgcagtgcctcacacttgtaatcctagcactttgggaggctgaggtgggtagatcacttcagcccaggagttcgggaccatcctgggcaacatggtaagactgtctctataaaaaatacaaaaattagccaggcatggtggtgtgcacctttaatcccaggtactttggaggttgaggtgggaggatcacctgagccaggggaggttgaggcttcagtgagccaagatagcaccactgtactatagcctgggtgacagagtgagacaatataaaaaaaaaaattagtaaagttttggtaacgtgtctttctttgtcaaatatgataggagagatgtaatgggagtttctaagttaggttctgtggaagtcatgagattaaaaaaaattacaagcaaatattttgtcatattttatctacgtatgaatctgcttccctgtcccgtattctcctaaaacatgcaccaagtagcacttaaagctatattaatgataatgtaaagagtatactgtttcctgagtattttgttccatttctatacccatgaaataaacatatttcctgtgtgtctctggggctaaatataaactctcttccccagcattcatgatctttcactggcttcctcctccctccccaaaactcccctccccactttggggtttcctccatatttcctaacgttcctctctcatctgcttcatcaggccatgtaaaccaaactgacacagttcacacttaactgtgaattccaagcaatttctgatcatgtgctttgctagtattgccctccattcacactgcctcatagccatcctcaaatacattctataaaacctaactttcaagaaaccctactttatttccccaacccataagaatcactctcttttctggcactgtccataacacaactcactttctcccttggataagaaacagttactaacaagttatctcccatactaaccttgaaagactttagagtaggttttgggactgcattagtgttacattgtccaaatcaccacctacatgcagtccccaaggtatcctcatatttagcttatgcacatgcgtttaattctgcttagaatgttttaaccccgtagccttttctgacctccccatttaaaattattatgactctgagacaacacacactaaaccacctttcctaatttatttttccccatgaagtcattattttctctcacatgttatttttacttatttgtttattatctgattctccctgagagtatataatttttactaggacgggtcacttgtgtctctttccctagtgactggagtagtttctggcacagagtaggtgttcaataaacaattgttgaaaaagtaattaatgtgctgggatatctgaaggtatttcaaaaggtgttggtctcaaatatatttgatacttgagaatatcagtagaataattttgaagggacaaaacttccatgggtgtagaacttctaaaacacacccgggcacaaagttatcactttataatcctatcttgaggttatttcacacagaaggcttagagagaaaaagctgaaaagttgtattgattgcaattttgggggaagtgtactaaaaagactcccatgcttaaactgctctaataccaggtgcaggaaataccacaattgctgatagaacaaatactatattacttgttactggctgagtagatttagaaatcaaattggacctaaaggaaagtgaaagaaagctctttcataaacctttgcttctttttcctttcctcttttttattgtcttcataaaagtttcatttgagggaataaagtgccccctggggctgtgtctacatgaaaccttaaggtattaagcattcatttttgtgcagttgatcacacaagtcaatcatgccaaattgggaagttattctcccaatatgttaaccaactatacatgaaatttctagcccatatgttgtttggctttttttttttttttttttttttttttttgagatggagtttcactctgccgcccaggctggagtgcagtggcacgatctcggctcactgcaacctccacctcctgggttcaagcgattcttctgcctcagcctcctcagagctggtagagctggtattacaagcatgtgccattatgcccaggtaattgttttacttttagtagagacgggatttcaccatattggccaggatggtctccaactcctgacctcatggtctgctcacctcagcctctcaaagtgctgggactacaggcttgagccaccatgcccagccatgttgtttggtctttgtcaggactactgtcgcagctcaagagcagccatagacaataggtaaacaaatgggcataactgtgtcccaattactctttgttttatgatattgaaattaaatttcatatatgcttcacatgtcaggaaatatttttcattttaaatttttgtgggtacatagtaggtgtatatatttatggggtgcatgaggtgttttgatacaggcatgtggtatgtaataattatgtcatggaaaatgggatattcatcccatcaaagatttttcctttgtgttacaaacaatccagttacatatttttagttatttttaaatgtactatcagattattattgattatagtcactccgttgtgctatcaaatactaggtcttattcattcttttttttttctttctttttgagacagggtttcactctgtcacccaggctggagtgcagtggtgcatttcagcttcagctcactgcaacttctgcctcctgtgttcaagcaattcttgtgtctcagcctctggagtaactggaattatagccattcactaccacacccagctatttgtgtgtgtatgtgtgtatttttagtagagatgtggtttcaccatgttggccaggttggtctggaactcctggcctcaaatgagtttgcctgcctcagcctcccaaagtgttaggattacaggcgttagccaccttgcccggccttattcattctttctaattatgttttgtatcccgtaaccatccccacttccccctgaaacccctactacctttcccagcctctggtaaccatccttctaatctatttcctgaggtcaattgttttgatattttagctcctacaaataatttagaatatgtgaagtttgtatttctgtgtctgagttatttcacttaacataatgacctccacctccatcagtgttgttgaaaatgattaactctcattcttttttatggctgaatagtactccattatgcatatgtaccacattctctttattcattcatctgttcttggacactcaagttgcttccaaatcttggctgttgtgaacagtgctacaacaaacatgagagtgcagacatctctttgttatattgatttcctttttttaggtatatatgcagtagtgggattactggattatatgatagttctatttttagttttttgaggaacccacaaactgttctccataggggttgtctaatttactttcccaccaacactgtagaagggctcccttttctccacatcctctccagcatttttattacctgtctttgggataaaagccattttaactgaggagagatgatatctcattgtagctttgatttgcatttttctgatgatcgatgatgttgagcactttttcatatgcctctttgccattttattatcttctgagaaatgtttattcaaatcttttgaccatttaaaaacattggattagactttttcctataagatgtttaagctccttatatattctggttactagtcccttgtcagatgggtagtttgcaaatattttcttccaatctgtgggtttccttttcatgttgactgttctttgccaagcagaagctgtataacttgatgtgacccagtttatctaattttgctttggttgcctatgcttatgggatgttactcaagaaatttttgcacagaccaaggttctagagagttccccaaaagttttactgtagtagtttcatagattgaagtcttacatttaagtctttaatccattttgatttttgtatatggcaagagataagtgtcacatttcattcttctgcctatgaatatccagtttcccaccaccgttcattgttgaaaatgatttactgtaagtatatggatttattgctgggttctgtattctgttccattggtctatgtgtctggatttatgccagtaccatgctgtgttggttactatagctctgtagtataatttgaagtcaggtaatgtgattattttagtttttttctttttgctcaggacagatttggctatttggggtcttctgtggttccatataaattttaggaatttttaatatttctgtgaagaatgccatttgtgctttgatagggattacattgaatctttagattgctttgagtagtgtggaaattttaaaaatactgattcttccaatccatgaacatgaaatatctttctatttttgtatgtcttctttaatttctttcattagtttttaatagttttcattttgagatctttcacttctttggttaacttcaaagtatttaatattatgtgtggctatggtaaatgggattactttttatttctttttcagattgttcagtgtaggtatatagaaatgttaatgatttgtatgttgattttatatcctgcaactttactgaatgtgtttatcagttctaatagttgttttagggatcctttaggtttttacaaatataagattatttcatctagaaacaattttgggttcgacttgccctttcttttttagttctttatagggatcctttaggtttttacaaatataagatcatttcatctggaaacaattttggtttggacttgccttttcttttttagttctttaagatgcattattaggttatttgaagtttttgtttctttttgatgtagacacttataactatgaatttccctcttggtggtgcttttactgtatctcacacgttttggaatgttgtgtttccattactgtttgtttcaacaaatttttcaattttcttcttgattcaggagcatactgtttaatttccatgtgtttgtatagtttccaaaatgcctctggttattgatttctagtttgattacactggggtcagaaaagatgcatgatattagtttcattttttgaaatgttttaaaacttgtgacctaacctatggtctatccttgagaatggttcatgtcctgaggagaagaatttgtattctgcaatcattggatgaaatgtactgtaaatagctattaggcttacttggtctctaacacagactaaatctgatgtttctttgttgattttctgtgtggaggatccgtccaatgctgaaagtggggtgttgtccagctgttatcatattggtgtctatctcttcctttagcgctaacagtatttgctttatatgtctgggtgctcccacattagatgtgtgtatattttcagttgatgtatcctctgctgaattgactccttatcattatataatagacttgtttctctcctgttacagttttggtctttaagtgtattttgtctaatacaagtatagctacttctgctctttttttgtcttcattggcatggggtatttttttctatctttttgttttcagtccatgtgcatctttacaggtgagatgtggttcttgtgggcaacagatcattgggtctcatgttttaatctattaagacattctatggctttggattggagattttagaccacttacattcaatgttatgattgataagtaaggacttattcctgtcactttgttatttgttttctgttttatttttattttattttttatttatttatttatttatttatgtgtgtgtgtgtgtgtgtgtgtgtgtgtgtgtgtgtgtgtgagatctctttctgtcttccttttagtgaaggtgattttctctagtgatatattttctttctttttattttttgtgtttccactgtatatttttcaatttgaggttaccatgaggcttgcaaagactatcttataactcactcttttaaattgatggcaacctaatactgattgcataaacaaacaagcaaaatgctaataaaactctacactttgtctccttgctttttaattttttgttgtttctctgtgacttattgtacttattgtactcttgaaaagttgtggtagttactgcttttgagttgttcattgttaagtctttctacttaagagtagtagtttatagattacaattacagcgttataatatcctgtgtttttctgtgtgctattatcagtgagatttgtaccttcagatcatttcatattgcttattaacatctttttctttcaagttgaagaaattcctttagcatttcttgtaggacatatctggtgttgatgaaatcccctaagttttgtgtatctaggatgggctttatttctccttcttgcttgaaatatattttcactggatatatcattctagggtaaaagttattttccttcagcactttaagtatatcatgccactctctcctggcctgtaaggttcccaccgaaaactctgctgccagacatattggagcttcattgtatgttatttgtttcttttctcttactgcttttatgatcctttctttatccttgatctttgggagtttgcttccttgaggtagtcttcttcaggttaaatctccttggtgctcaataaaccttcttgtgcttgaatattgatatatttatctaggttttggaacttctctgatagtatccctttaaataaactttctgttcctatctttttctctacttcctcttgaagaccattgaaatatttgccttttaagtctattttctagatcttgtaagtgtgcttcattgttttttattccttttttttttatttcctccatgtattttcaaatagcctgccttcaagttcactaattctttcttctgctcaatcagttttgctattaagggactctgatgcattcttcaatatatcaattgcatttttcatttccagaatttctgcttgattctgtcttgttattttaatctctttgtgaaatttctgatagaattctgaatttctttgcggtgttatctttaattttgttgagtttcttcaaaacaactattttgaattctctgtctgaaaggtcacatatctctgtttctgcagaattgatccctggtgccttatttagttcatttggtaaagtcatgttttcctcgatggtcctgatgattacagatgttcatcaatatctgggcattgaagagttaggcatttattttagtcttcacagtctgggcttgtttgtgcctgttctccttgggaaggctttccaggtatttgaaggaacttgggtacaaagcctaataatgcagtggttcttgcagactcatagaggtaccactatggtggccttagatttaatctgaaaaacttctctgggttaccatgcagaaactctcattcattttccttactttgtctcaaacgaaatttctctttctgtgcagagtcacctggaactggggttgggggcacacaagcactcctgtggctaccaccactaggaatgtgctggttcagatctgaagcaaacacaacactgggtcttgtctatggcctgctgtaaccactacctggctaccacctatgttcactcaaggatgtaggattctatgatcagcaagtgggcaagccagtcatgtttgttctcctcccttcagagtggcaacttccctcaggccctgggtaggtccagggatgctgtctaggaaccaggggttgaagtcaaaaaccttagaaatttacttgatgttctcttctactatggttaagctggcactcaaaccacaaaagagtcattcccactcttccctcccctgtccatagacagaggagcctctccctgtggccaccactaccaccagcccacacgggattcttccaggccaccactgatattcacttaaagcccaaaggctcttctgtcagcttttggtaaatgctgtcaggcctgagacccacacttcagggcagtgggttcccgtctggacaatggcaggtccagacatgctatccaagattatatgcctggactcagtgactccaagtgtccacttggtgctttaccccactgtggccaaagctggtacctaaagtgcaagacaaagtcccctttacttttccctctgctttcctcaaacagaaggagtctttcatcatagccaccacagctgggaatgtgctggatcacatctgaagccacaacatctcagggctctaggtccttggcatactaacttgacatcactgttggttattaagggcttaagggctctttagtcagcaggtgatgagccctgctatgactggattcttcctgtctaggcagcagttccctcttggaccatggtgtgtctaaaatgtcatttttgagataggccccagaatgtggccttacaactctgcccagtgcccttttctactgtggttgagctgatatccaagatgcaagacaaagtcctctttcctcttctctctcctcacctcaagcagaaggaaggagtcatttttgttgctgcaagctgcactgcctggggttgggagaagagggccgcaagcactcctttagcctccccatctggtatctccctaggtcacatgccatccgaatctactggctctaagcccagcccaggactaggaattgcctaggaattgaagtctttgtgtcctacagtgccttttgagtttacttagaaccccagagcgctttggaccatggtggcaaggcctgccaagaaacttgagctctgactgctagaataggtgattcccctctggctaggctcgtccaaattctctgtccatgaatgggcaccagctgagtccagcagggcttagctgtgcactgtgacagggcagcactgagttcaatgtaaagtcccccagtcgctgtgctgtctgtcccacaattgcacagactctctctgtgtgcatcttgcattacctggcaggctaagagctccccttctaatgtcacttgcctaagacaaggtcccatagctgtagcgtattcgttgtcttttttcctgtctattggaggaggggggtcagacaaaacctctgtttcctctgctgggaaaagggggagggatggtgttgatgattcaagactatctcctaccctcttcagagtctctttagcgatatgaagttaaaaccatgcactgtgagtgcccacctgatttttggttcttctgatggtgctttttggtgcatagttggttgttaaaatttggtgtgtgtcagcggggatggcaaatgtagccttctattcagccatcttactctgctctcctcttcctttaaaaattattttgcttagctgtttttgcttgtaggtcccacaaaaacaggcattggactagattttgccctttagctatagtttgctgccttctgccactgactgcttcaagatgatagcagtgccctcctaggctcttctagggtaatctgagcaggagcagactggagtggagtagccatggtaaatgcatatgagaacacgggcatgttgaatgaaaggcaagatttcaagtcagacagaagcttgaaacagtattgcaaactcagtgctgaatttgatcactaattaagaccttgtagattctttgtgcttttatctaaatcctgttatcactctgcaacttttaggactaattaatgcaggctcatctatccttgtactacctcttctagcatttagaaacaatcatcaatggttttttttttttaaactatcatcaacatgtatttgcagaaatggagagccaaacatattattttctatcctttgtgctgcctaatgctttatattaggtttattccatctgtgtcatcttagctgcaaaaggtagttccagcaaaaggtgaaggtgttcagagattgatactatgcaattaagacttaaggatactaatcttaaacttttatttttagatcttgtccacgatgatagaatcgagggtcacttcccctcttattcattaacgaatgttttaaaaagttgcttacaaattatataatctttaatgcttttataatacaatccctgtggataccagagaatatcatttccaagtcacaattttaggcaattgtttatctcaacttctagatattttttccctcaaaatgtcaaaatttggaatatccagtttcatagtatagcttatccaacttttaatagtaattattaatgtcatgattttttaaatccaatttttctcagaattagtttgcagcctctgtatcagcccaaaccatctgctcttagatctgttggtttttccaagtaggagacctttcttatggttttcactgaagtaatacagcactttcattttggcagggggaaactgggtttagcctttgaaagaaagtctcttaagacactgaaaatgcactttcaattagtaaaattagcctttatcacttaataaatgaagtgagtctctttatccattttatatcacaaagaattaaaatctcctgtcctttgttttaattggtgattgaaaatactttttcatctaaatgtattagcactgagcatgccctcccctgttgtgcttcctgtttgaaaagctaattaaatggtctcattgctgattggctggaagcctatacaacttcctggctgcaggccattaacaccctggccagaagtgctgacaaaaagatgaagagatttacaccctctgatttctgtattaacaacaaggacaaaacagtatgtggtcttctcagtggataatacaatttaaagataggatttctttttccacaggtgcatttgtctctgaaaattagcagttcagcttggtgtgaataataaggcatcttctctgatgagtttgaatcatattaaaaaatctgttatggacaagttcaaggtttataagactattaccatttctctaaatgaaagaacccaagtcagcttatttctagatctatgttctgattacttaaaaaaagtactggaaataacaagtatgaaaagtgttctattctataaaggcaaaatacatacatatatataaatattgcaaaaaacatttttcttaattatgtcagttatttaacataaaattactttttaacaacaaaaaacaatgccctgtgataagattgcttttcccaatgaattcaccactggttttaatagtttaccatatattttagcaagaaaacatgtgaagcaaatgtgtatgtgtatatacagaagcccacataaaaatagagggatatatgtatatatttgactagacttttgcatatataagtatacatatacacacacccctctttacacagatatctatatatacacacacatatatatacatacaagcacatgtatgaatattaatcatgcacataaatacacatataaacatgtcacaatataatacataatataaccaatttaattggcttttcaaacaggaagctcaacaggggagggaatgctcagcactaatgcatttagatggaaatgtgttttcaatcatcaattaaagattagatgtggagaacctctaatatataagatatggaactaggaattggagatggggtaaaaatctttactttttcatattcattatgtattctttcataaaaggaaatgattgaatatatttgatcagtaaggccctttctagctttaaagtgataaatctaagatttgtatatattcagatccctttcattaaaccactagggagttctgaaaatgatagtagatgagtatggaaggacagaaagaagtaacgaatgaaatatcaggctttcaataattaatcagccaatagccattgaccacatactactctaaatgtgctgtgctgggctgagactacaaaacaactgaagtctcattcttacttgtgagaagcttatagaatgattttggacagatatgtagctattgacatgaaagccatcaaggtaaagcagggattgagaagtggggtagaaaatttataattgggttctacgtttcagaaacagaagtcactttacaaaatatagagtgtactgtaaatcttgtttgtacagttaattgcttacaaaacatttattagttgtttcaaagagaatccaaccctttagggttgaaattattataagttttaaattctgaattaccataatgaatttttcataaattgaggtcatcaccaaaatattctgcaatgaaaaggaccagtcatcagaactttaagatgaagtcattcaattgaagcagaatattttagagttatcttaatagatggtcctttgcctaaatgcacaaaacaaaaataattcttactgtgatcagacttaaaacaaggagagtgttaattggtgtttttactatgcaagacagtgtgaatatccaaagaaatatagagtactatatctgaccttcagcaagctaaaatttaattggatgaaaatatggtatctgtaccaataaatagctgctgatttccaaatgagtgtcaatgaaactaagatctatgcaatatcaacaaagaaaatagaaaaatagatttgatttggttttaggagtttgagttaaattccgatattttagctgtgcattcaacaaatatttactgagtgtctgctgtgtaccaggcaaagaggatgcaatgttgagcaattccaaccaaggcttaacccttatgagttgggaaagagcaaactaattgaacacagggttggagccagagggaggcatagctggtgaggtatacaggaaaatataaagtcatgcttaggagctcaatgagaagactagtggggatagaacatatggttactgataaagaaatataggaaacaagaattcctagtaaatgatttcataaaaccgcctaaaacagctcactatggtacatatcaggtaagaaatttggaaaatattgatgtgttatgatattcccagatttaagcttaaagttaggttaacactttgtaaatttactagtgagagattaccttgaagacatacctcacatatcactcataggtggccccagattgatgaactctgttggtatcttaatagatagttctatatctaagactcagttccatagcaattttccaaaaggacaaactacaattacaataaaatatcgatatgtgtctcaaatactgttctgatgtagaagtatctatgcgtcactttaaatatcatctcaaatccccaaattctgaggctaagagaagagtaaaatatatgaaaagagtttgcctcaaaggacacaaactttgattcaaagcaaagtcatagaacctggcaaaatttaacataaattcagctgttttaaatgtatgttcttgatcttctcttccttgaaaagcggaatgactttaaaatagcaatatttagacaacctttgggaaccagagttctatctacaaaaccaattaaatcagtgtaaatggtgtaaaattaataagaaggctcaataaatgacaagatagcttagttataagcaaaggaaataataatttcatgttcaaattaatgctcaaattaacttgagtcggtcagatttctgtaatattggggttttcattgacttctctcttaccataagtccctaggcttgtttttaagctcctctattaagaaccctgatgataaatgttgcctggtgaactctgcattttctactagacaggcagctcccttagggcaatgatggggaatgtttataatttgcttcagtagcttcagtgtctggtgtgtctattacattagttttgttaaattatgtcctgaatgattgacataaattatgtcatgaatgaatgacatggatgaatgtaaagtctgaccacatattaggttgtttaaacatagaatcacaaagtaatgtatttttataaatgatagaaaccttgggggtcaacctctctaacctttttcatttttgagattcagagattgacattgaataattagcctcttactcctgtttaatttttaaccatatctcttgctcacatgtattatattttttgctatcttccataccactgcatttttatacctacataacctaagcaaaatcacagcctaaatattttacttggaaactgaggtttgttcttgacccatcccttttcctcataaacatattcaacattcaataggttctgttcattatacatcaaaatatagctagactttctcctttcttccatcccactattaccttacttgtctatttccttttgccttgactgctgttaagtttctctctgagattcctgcttccactcttgtattcaccaccaccacctcaaactattctctatacagcagccagaatgatcttccagatatgtaaatctgatcacgtcatttccttgcttaaaatcccttaataacatctcagtgtggttgaaataaaatgcagacttactaaagtggtggatgacatctgaattatccaccctgcttacagccccaggttaatcttttgccatgttcctcttggcccactgagcttcaaagcccatgtcctattgaaccacgcatcttttaaataaatacttcttgatgctttaatacttctttttaagttcatggatattaccatcaggaaaggtcataaacaagcttggaagcaatgttgttgctgattctataaaaactgcataagtaccctgacacttgaggtttaaagctgttctgaagggataatttacttcctaccacacatacctgcagccagatagtggccccaaagaagcagggtagaaatatatctgacttcccaggtgtgtcctttccccatctttcttctcagactaggtgtcatgtgatataactggacccaggagaatgaccccacaactgaaagatttttatgaaggatgatttactattctccaacgtactgacatttttctacagcccaatcattgctggggagtaagtacagaacaaaatgtgttgagataaaagatcatttcaggcttttgtggtgagctttgattctggtgagtttgagacacatttcagactataaactttagcgtcaaacattgtcattttcccttcgagtggctattatatcatgttattctgggtcaggttatcaaaaatttggtaattcttaaacaagttttgattttttcagagtctcagtagagaaggttgaaaatcacacaagttacatagttaagcagaaatattttggttttccattttcattgtgcaaatgcatgcacagtatgaaaatgcattttattagctccaattttcccccagtaggtacttccaaattgaaattaaaattatatagatttaccagaagtctttaatctaaattattatttctgttgggatttctggcttcttattttacaaaatggattttatggggaggaaaaatatattaaaattataagaggaaaaaattgactccttttggtatatttgatgtgaatcttagctattaccaaattaactttaatgaattatataatacggaataaaggctttgggcagactactctctctactgcatctttgtattgaaaacttgtttcatttaggcttctccttttttttgtctctctctaaagattttgaatatagcactcaggcacatgtctttggcaggaaaaaaaatcacttatattgagaagagggtagtcctatgaaacaaatgtagagtaaaaagtattgccagagaatctcagcagggccatttacagccatatgaaggcaaaagcttatattaataaacctaatacagtgcctggtatgtattcaatgactgccactgggaagaagaaaaataggaacttgggttaatagacggtcagatagaagatcatttaatcctttgggtaacatgctcaattaaaagtttgaaacaattataacccaataaattcttgtttcaatgacctttgaaatgaatagggaaatgtcttgccaagtttctttgtttatgaaaatccttgttagggttttgtaatgtttccttcagaaaatatgctggatgtgaattctgtattcctaccttggaattctgaaatccagaagattgaatcattttctgaacagtaacaggacttaactataacatagcacaagttgttacataacatgatataacatgttaatataccggaaacatatgttactatctgttaattaatttgggtattagtcaatatttattgagtgctactgtgtacctagggaataataccaaaacacaggagtcatagattcccccctcatgaagatcacagtacttctgtagtcaaaacacacaaggcttataatacaatttaaaaaaaacagtatcaggctctcttatgaaggagaaaaaacataagttttcgaactcactgcttcccattatttactgacttacttgccatctctaaaaacatgtgcagtctttagattcactgttttttctttacacatgttgcttctctgtctagaatgtccttttgtatcttgggcatctggtgaactcccattctttattccagacccagccatagtccaccatttctgaagctcttttctgattattgatttcccaataggcatcactgaggattacgctatctttgctccaccagcatctttcatttttgtcacagtgcgctatgctatatatttgcctttcctactagactatgaactctttgaggaaagaaactggtactgttcatcactgtattcctcaggcaattaggatgatccctggcacatattagatgtccaataaatgctgactgactctggattccccagaaacaggacacatacacacacacacacacacacacatgcatacacacaatataagtatgtatttatattatttttatatattaatatatgtttatgtgatatataaatattttatataatatataggatctatccatctatttagaaagataaatagagacagagaaagagattgatcacaaggaattggctcacatggttctggaggcttagaagtcctagtatctataattggcaagctggagacccaggagacatgatggtatagttccagttagaatctgaaggcctcagaaccaggagacttgatggtgaaagttccagttcaagtctcagttcaaaggcaagagaagactaatgtcccagctcaagcagtcaggcagaagatgaattttcttttattctgcttcttgttctatttgggcctttaacggattggataaagcccacccacactggggaagacattgttttattcagtctattgatttaaattttaattttatctagaaacacccttatagacacatccaaaataatgtttggccaaaaggctgggtgccccacggcccagtcaaggtgacacgtagaattagtcaccacactgactgactgactgaatgagtgggtgatctgggaattctcattaagtaatgcagtcagtgcaggtaggggtgcatggaagaagaaccttgataaaatagggaaagggtggtgacagtgatgtgatgaaaaacagaagatcataccaacttaaagagtttgcttttctgcttttgaaggatttgcctatcctgaattgtgcatacttccaagtaggcccaacaaatatcagccgtattcacaatcaacttttatgagcattgcaaccattcattagccatgtgtaatgagatttttagcttaatagaaagcctcagcctgaattctgtaaaactattcattactattgattataaaccaatctcaggtttttgtattaagaattttacatgcagaagaattaaaattattgtcaaagcttgtagaggtaaacatgtcttcatgaaatcaatatgctcgtgaagagttgcttgcaaatttcactgaatataatgcactgaatagagtattagaaacattaggaaagtttccttttgtatttttaaagatatgcttgttttagaaaaaaatgagcaatataattttcgctcatttaaaaaaagtttattaacataattttctatggatgtataatgttatgtacagtggatatactataatttgcttaaccaattaccaattgtgcaattagcccattttatattttttactattttaaataacaatattgaatacatatgtaacttttctttttgtatacttatgtatggattcctagaagaaaaattgagttaaattggtttttttgtttgttttgggacagactgttgctgtgttgcccaggctggagtgcagtggcgcaatcttggcttatggcaatctcggcctcctgggctcaagtgattctcatgcctcagcctcccgagtagctggaattaaaggcgcacacaaccacacttggctcatttttgtacttttagttgagtcgaggtttcaccttgttggccaggctggtctcaaactcttgacctcaggtgattcgcctgcttaggcctcccaaagtgctaggattacaggtgtgagccactgcacccagccgtggttaaattgctatgatgcaaatttcaaatcactttactgaggtggtgtatcaattcacactttcacagtattgttaattatcattttaagaggttttttgcaacactgataggctaaggtcctatctcatttttgttatattttcagttttaattactagtgaatatttgtccacattagaaatttaaagaatttctatagaaaatcttacattaaagtaaaacaagcaaataataaactcctagctgatctacacattaagtatgagtctgcatttggcttaatgcatactcacagttaagcgacctctttcagtcaccaaagatgacagcagagctaagatgaaagatagttgccactattcattatttgctatctagtaccttctgtaagaaggacttcattctaactttcacatacataaatggcattgatgttcagtataatttgattagattttaagaagaatctagaaagacaacaccatgtgagtttgaggaagaggtggtaaaactattatttaaccttgtgctcagaatagatattataatatagcttgactggaggaaataaagttattaaaatgctacctagaacaatgcttcccaaaactgcctctgttggccctataattaatcaaagatattgatgggacaagccagctcacgcttgtctgattgttgatactgaaatcaagaggagcaggactgttaggacacgttgtagttcatgtctgatcaccacctccaggggaaagctgggtaggggctgaaatccagttctggatttactgggttgattctgtgcagtgcctttataaaattcattccctcagagacagtatcctttcctaattatacaatggggcaaagtatgaaccaccaggggtcctgaggatattactaagaaggatgattccggagaatcctgaattactccatggctttgaaggccagctaagaaataacctagcaatgctcttaggtgagattatgatagaccaggctttaaactgactcttggtcatggggattataggagtccccaaatggccgtctgtttctgggtctcatgtatagtcaggctttcattgcttcaaggatctggaacagtaccaacactacagaggatgttatattggacaaaccccaaagatgattctgagaaagacttagttgatggccttactccttgcctatttttggcctagggcaagaggtcattgtgtgctgctaagcttgcagagctggacaaactccaggtaatctcattattccaaactgctacagactatgttggaaagtgacagagccaaagctcaaatccaactttcaaaatttggatgtctgcaatactctattcaaacatttagagtcacatagaacctcaaccaatatttgtgtatttttttctttctgtaaatatttgatatacttcacagaaataaaatacagaaaacatccacaggaatgtagaaatacttttcaagcttttatttatccacttaactttttaatagtatctgcctatagtatctgggtaatctgcctatactgtttttctttccctttgacatcctttagaggttcattcatttggtcatgtgattgcttcttataagatcacatagggtgaacatcgctggcacttaccagacatgcttaccaggacttcctttgcaatgtccaccatagagcaattgctcttcagccaaccacctgggagtctgtaattttgccagtggaaatgaagcaaaaataaaaaggagtgggagaataaaaaaagggaaatgatagcttgcagagggatgtggcaagtacaggccaaaatgagcttctaccaaatgccctgcatatcttttattggccttctggctgctttttgaaaaggactaattctagagaatgtctctttggcttgcctctattctctgccttttggctaatttgagaatttaaaagggcaaaggaggtctggctttgaagggatgtaaccttcaggctttaatttggagcaaacaaagcatttacagccgctctcctctggcagttgcagagtattaccacactgctgaatatttaaaagcaaggcgtgtttccaaccccaaggtctgtcccccaattgataagtctctttttattaaatgaactttaattacttaataattagaccttccacaggagaagatgtggatcctgatagtctgccaagaaggctagagggcaaatcggaagaatgtgccattttcagattagaatttaaaagaaggaacaggcccattctgggggtgtgtgggtggaggagagacctccctagaggcggcaagtcttggcataaacctggactgtgaaatgctttatttccacttttgcttgaaaactaaagtactttagaattaaatgaatgagagtacatgtcgaaaatattcaaactttctgactgtctggatctgatggaaagatttcttgtcgtctatgcagtgtgtgtatgcttgggtggaagggtagggagagactattgttctccttattttgattctgagagcctaacacttttgatgtccctacagatttagcagctttccattcattgccatggtgattttttacctcatttttttttttttagcatcacaaaggaaaagcccaaatgaaaaatgtttgcttcttttgctattaacatttctactgcctggtgacagcaaatatttgggttgtgcctagcttctgaggaaatatgtattggtctgaggagattgatggccacagccattgcccaggctgtcccagctgggtgaggggctggccctgagaccactgataactttgttcctggggacagtgatgtgaagggaggatgaggaaatcccattcaaaacgtctactgatttacaattgaactgtttgtggcttagataatattttcacaaatgccttatggatagcctctccacacctcaccacctctacaccaacccatctcttcaaatgaaaggatttattagtctcagctcttttctgctttcctgaaaaaaatcactgcttttcccttctcctattttattatttatttattttttaaagacaggatctctctctgccacccaggctggagtgcagaagtgtgatcatagcttactgcagcctggaactcctgggctcaagtgatcctgccacctcagcttcctgagtagctgggactacaggtgtgcacctccagacctggctaattaaaacaattgtttttctttctttcctttttttttttttttttttttttttttgagacagagtttcacttttgttgcccaggctggagtgcaatggcaccatgtcggctcacagcaacttccacctcctgggttcaagtgattctcctgcctcagcctcccaagtagctggggttacagacatgtaccaccacgcccatctaattttttgtatttttgatagagacggggtttctccatgttggtcaggctggtctcgaactccggaactcaggtgatccgcccgcctcagcctcacaaagtgctgggattacgggcatgagccaccgtgcccggccttaaaaacaactttttttttttatagagacagaatctctctatcgtgaccaagttggtctcaaactcctgtccttcagtgatcctcccaccttggactgccaaagtgttgggattataggcataagctaccactccaaggctcctctaactaattctttatgctttcctagttattgcttgtgtttcctaaactttccaatatttagggtctgaaacatttgcttaaactgattatcttaacaatgatatatatttttcattcaacatacgtttgatggccaagtatttgccatacaccatgctaagtgcttacagtatagaataacatagactcggctctgatttgtggaatttacagattagtctggacgatggctagcaaataaattccacagttaatcacaattgaagtaagtgctggagataaaacctgtaggacaactggttctatccggacttggggaaagctactatgaggaagtgagaattctgttactgcattgaactattaagtctcaggtattcaaacacactgttactgaagagctgcaaatagggtaaaacctttactcttccttgcatgggtagttaataaatgttctaggaacaaattggggttacggctgcttaacaggcattgagcaacacttaacaaagtaacatataagtagactcctaatgaatccttttaatgttaaaattagtgttacagaacaatggaagatccttttcaggactcaaaataacaaggtgagacccatttctctatggcagtctcataatggctctatatctcttgctaatagcacccaatgcttactgtacaactataattagaattgttgacatcaatataatttttgatgctgaagcccaggcacttttactttgtattaatcacttataaaatttgaattaaaactgtctttatcatttctaagaagattaaacagagcttccatatgtgtctgacttttccatatgtaaaacaaatgttctttcctttttatagtttctcactaataagttctgatctttgttaatgcatggagatacagataatgtggaaatctgtaagttggcttgtgtgggacacttccaacaacaccaggtgttcctgtatttaaagctgccatagcatcttgggccagtctaggtgtgaaggtaggaactttgaaattcattctgggaatcaaggttttcctaggctaacaatgtaagccctgcaaaatcaccaaaaattgtttgtctgctatttttaatagttaagtacttcaggctgaaatttgtctataggaattcaatgtaaggcagaaagtacttactaaacaacaaagtgtattgagtacagtactgctacttgagggtttgaggagtgaagagtattcacatataaacgaacgtctttttgaaatatttttgtttatgtcagggaaataaggtattttaagaagtataataattcagtactaaacctttaaaaataaccatcatgggctgtgtacagtgactcacgcctgtgatcctagcacttcaggatgccaaggcaggtggatcatttgaagtcaggagtttgagacaagcctggccaacatggtgaaaccctgtctctactgaaaatacaaaaattagctgggcatggtggcatgcacctgtgatcctagctacatgggagactgaggtaggagaatcgcttgaaccaggagacaggttgctatgagctgagatcgtgccaacacactccatcctgggcgatagtgtataagactcgggctcaaaataaataaataaataaataaataaaaataacaatcatactataaacatttgaaagagtttggtaccagttccatctagaaagtggagataataatacttcctaaaagagccattatgaagattaaataaggtcatttataaaagtgtttataatggcataaatgataaaacaatccgttcccaaagtcctctagcttgttaaataatgaagcggggaagtgactccaggtaatctcattattccaaactgctacacagtatgctggaaagtgacagagccaaagctcaaatccaactttcaaaatttggatgtctgcaatactctatttaaacatttagagtcacatagaacctcagccaatgttttgtatcttttttctttcagtaaatatttgatttacttcacagaaataaaatacagaaaacatccacatgaatgtagaaatacttttcaagcttttatttatacacttaactttttatagtatctgcaaattgtgagtactataaaaatttaaaaggtggagtgatgatttccagtaagtacgactaggaaaaagggagagatttttgattgagtacctaaaacatgactagagatttgataggtagatgttagcagagagcgtgttccttttcagaggaagttccataagaaatacagccaagaggaaaccatgtttaggacatctacaagttcaatagatctgagaattgttttgcagaagttgtggaaaatgaacctgaaagggacatagtgctagatacctgggcacatattaaacaaaaaactctttgcctggttttggggcaaaagacaatgccagaacattttgggaacttcaagatttcctgagtgaagcaaaacctttagtgatgtaggagcactgatattttgactatgtttggaatgcattcgagtgaggaaaacagagagataggaagaccattgctgctatcattacaacggatcagatgtggcctaatgagtctgaaccaggctttttccatgaatgggctgtggttgagcaggtaactatttttcacaaggatctagtgaaaattatacctgtatctctctctggatgaagcttgggaatcatttgtattgcattagaacattagatgacttttacgaaaatatagtatttcatacgtatgcgttatagtgagtttattgttcattactagatattcatgcacataccttgaaactatagtactaagttgatagtctataatttcttcttcttttaagactgttgctgggttgttacaccaccatgagatgtaactgctaaaatttagcacaatattgggagcattcagtcaagccttatagagccttataaacttagaattgcttttgaatgtgtagagtttcccatttagagacaaaaagaaaagactatgcatcatgtttataatttctcactatgacaaataatcaactctgtgaaattttcaaacattgcattgttaacttttaaacaggatgcagttctggccctggcttgttaagatctgaaatcatcacagagtgcatgcaattctattagccaattctgttaagtctaattatattaatatgcaatcccagcctttgtatcgaattcttccaagtagatgaagtttacataggaaaccaattgttgagtatcagtttgaattactatttcattttacatattccaggctctagaacctacttgcaaatacatttttgaatgcaaaagacattcggatgtaaaatagatgtttaattttctgttttattatttctttttttgagacaggttctcactctcttgcccaggctacagtgcagtggcacagtcttagctcactgcaacctctgcctctgggctcaagtgatcctcccacctcagcctcccgagtagctgggaccacaggtgtgtgccaccacacctgggtaatttttaaaaatttcttgtagcgacagcgtttcatcatgttgcccaggctggtctcaaactcctgtgctcaagtgattctctcacctttgcctcctaaaatgctgggattacaggtgtgaaccaccatggataaatggtttaaatgctttaaatttatccaatgtgtatgacttctaaagagccataaatctgaatatataaatgtccagattattaaaatcaacttaaaattttattctcacctacatatattaaatacataacttgtgtatattggaaaattattcctgactatatttccttaactacaaaataaaatactagggatgacaaccaagaagaaaactattaaataaaaatcaaatttgtgcgaaactcattgccctacataagcctcatatctgtcactactcattgcagctttgctttgtgtggtagacacagatcatgctctgtttaagtacatgccttaaatccatacctgagccaatctgtagtagattaacgtacttctttggaatagacacaagactgtataatgcagacagtctggaaactggattttgagcaataagcctgggtacaaggtaactaattcctttcgttcttcacccagtggtagatgcagcacagacacagattagttctaactgaaaaagaataaaattagccaagtggctggcgccccctgtaggcaatctgtagtgtttatccaggcatccccatggatccagatttcagagccttagtttaagaatcagatgagtaattttagaatatatatgtgagggataaattaatatttgcatcaatattaaggtttttgcatggtatagcattaatctttcttacaaagaacaatcttaatattgcatctctaggattgcaggtctatttctgtggatgtagctataatgagtgatatccttcagcagcttgtacctaacccacatataattttggtctaattttatatttcatagattcagttattttgtggtccaaaactctaatccctaaaagagacgtaaaatttcaccttcacttagggagggaaagtgaaatagcatcgcttattgtctctcatattaaattatgatttgacccaggtcattttacctttgcccttttggccacagcaaaatttgtatcaggttgtggggaaaattaggatcatgaaaattaatagacccaaattaaaactaagggtaattaaaactgaacacagtagaattttgtttactgaagattaatgagacaatcaagctttctggacaaaatttaaacctggacctggggaatgttgacttaaatctataaaataaaaatcacagtaacataaaatatgattagtaaaacttgacatgaaccccagactgatgaatggatcaaagtttattgtgacatgtgcataaaattaaaacaattctggaatgagtcaaatgaaaatagaaatatcagaatttaactgggatgaatagcaaacataaataattattaaaatttagttgaattttctctaagaatttgccagtggtctttcattgatggcacaattgataccaatagatttctttgtaataatttaaaaaaacacaagaatttcatggtcaaaacttaggatcacaaatatccacttgttcatatcagggggtttgagatggcaaggtgaaaacacctacccctctcatgtacaacgtcatggcagagaagccttctctctcaccatgcttatgcttgtatgcatggtgatgcatacaagcatgtatatgcatgcttatgcttgtatgtaatggccagtttatttgttttattttttcatgcatgcttatgcttgtatgtaatggccagtttatttcttttattttttccttatattggtcattcatatgaatgaatcattttcacatgttatttcatatgaacattgaagtgactatgtgaattagatattaccccatttcatggcccaaagaaatgaaacaagtttccaaagtattcatatgtaataggtggctcaactagtctagaaacacaagctatcctaattccagcttttaaatcttttcactacaccacagccatacctggcaaatgtggatgaacatttaccttaagcagtaaaccctaaaagacaatcctttgttactataattggtggttcctatcatccctctttcttgaagctgctctaggtcatgccgtatgacgagtccttcatgaatcttcatgacttcataatcctttgtccaaagtggggtaacaggaattctgtccataggaccaggattcggaagaacaagttgctgtctgtaggactgtcatctaaaaactgaactccaatgtgggatttcacttctctgaacctcaatttccttatctataaaattaggctaatcttatctactttgtttattttacagggctgttttatttaccaataaataagcttctagagatgaatgacaacatcttcattactttttagcctctgagcatactgtagtgccagacagaaaatgtggtaaagtgtgaagagcaaatgagacgatatttgagaaaacagcttgtaaaatataattttctacaaagaatacaaagtgattatttttattggcgattattgtgctttatttggaagacttattcttccttctttgtttttctcctaggaccactgaggttcctttcacagacagaatctgtcacagccttcatgggagacacagtgctactcaagtgtgaagtcattggggagcccatgccaacaatccactggcagaagaaccaacaagacctgactccaatcccaggtgactcccgagtggtggtcttgccctctggagcattgcagatcagccgactccaaccgggggacattggaatttaccgatgctcagctcgaaatccagccagctcaagaacaggaaatgaagcagaagtcagaattttatcaggtattgcaatgctctttgttgccttcagaatgatattctctggaataagttgaaaaacaatttttttctttaacagatatttgtaattgttataagttctgtattgttcattgcgttttgtttattatttctttcttccttgccgaagcattcaatcaggttgtaccaaaagctgttcttttttttttttttcatgtcttgttgaagtttctggaaaaacagttatctctcctttattcattcacttgttctattaatatttagtgagtatttctttgtgcaaggcccattgataagcatttctcacatattatttcattttcctctgataacagtctaagaggtagttttgattcatttcaaaggatgaaggtgaaaatttgcaacgttaagaacattccctaagttagtattgaactatagatatatgatacatatagatatatatatgtatcatatatcatatatctatagttcaatattaaaattaggctgatcttatctactttgtttattttacagggctgtttttttttaccaataaataagcatctagagatgaatggcaacatcttcattactatttaggctctgagcatactgtagtgccagacagaaaatgtggtaaagtgtgaagagttctcttttgtatattctgtactccattagtcacagggatactgacttaaatgtatcaataaccagtgacaacacttacatttcatctaccaggcaataacagaagcaaagctagcatttattcccagcacatacatgcatctatttacatttccattacatacacaaaattttaaatatatcatacatatatcatatatatcatatatacatgatatgtattatatatataccctatatacatgatatatatcatatatacttgatagatatcatatatacatgatatgtcatggatatatacatgatatgtcatggatatatacatatggatatatacatatgtatatgtatatatccatatggatatatacatatatcatgtatatatgaatgatatatatcatatatgcatgatatatgtcatgtatatatacatcatatcattcatatatacatattttttttagactagggtcttactctgttgcccaggctgaatgcagtggtgcgatcacagctcactgctgcctcaacttcccagtctcaggtgttcctcccacctcagcctcagtagctgggaccacagaattgtggcaccacacccggctaattttttgtatttttttgtaaagaagaggtttcatcctattgcccaggctggtctcaaactcctgggctccagcaatctgcctgcctcagcctccgcctcccaaattgctgggattacaggcgtgagccactgtgcccagcctgaacaatcacttacttgtccattcacatgcttatttctgagaagcactgtgctaagtactaggaatccggcagtggcaaagactgtcccagagcctggcccattagagttctgggtggatgcacacatgtaagtaattacaatagggtgtgattgatatgatgattttaaaaaagtcatttctctccaactcttattttactttctcttctctgggaaatccctaagacactggcctcattttgcgattctaattagttagaatctcatgtaatgcctactttctcttttagccgaacttgtaagactgacttagacgctcttgtgagaatcccaaaaaaggcacacactggagaaattggaactgactacatctcaaagtatggatgttggcttcggtctctgcgctcttaactgtgtatagttatcacaagtacttcagctatgcagagagtagcattcttgtaattctaaaagcaaactggcaattcaattgaaagtttccaggtgctttaatgaggacatctctaaaacctctcttttgcagattctctactccattagtcacagggatactgacttaaatgtatcaataaccattggtaacacttacatttcatccgctaggcaatgacagaagcaaagctagcatttattcccaaaacatacatgcatctatttacgtatccattacatacacaaagttttaaatatttatattcacatattattaataatgcatctgttgagtatatcagatgggaagccaaggtaagctgcatggaaaattggcaagcatatgtttatcttaatatgacaggaaaatctgttttccagtggtattaaggaatcaagttgaactaatgaaatattaaatttgaaatgcagttttaaaagacacagagacattataatcaaatccccatttacctttgtttcttcaccttgcaacagccatttgcattgtaaaccatggagatttattttaagccaaattttgttttcttaatttgcctaaaatagagaacatgttgtacttttgagatgtgtgagcatttcttagctgaattgaaactgatatttttgtaaaggcatcacatcaaatgagggtttttatctaaattatatgaattcaaatataaactttagaaaaaattgagttaagatagtacatgcacgtgtgtacacatgcatgcgcacacacacacaggttattgtcatacttggctaagcctgtctcgtatgctagctgccaaataaagaacctgctaaaggagaatgcttttaacacattctcgagtttgcaagttggtttagaggtcaaattcacagatgcgcaataagtacaagattgagtgagtgcatgaatgaatgaatgaatgaatgaatggcaaatctctgcttctcttagttgccacttagcgttctctcatttcaaaaatcatcgtaatcctttatgaatcaattttcactctctgtaagtaccaatgtgaggcagtaataaattacatatataatacatatgtgtgtatacatgttaatacatacatgcacatatacaaacatcatattattggcatgacttaggactattcaacatggtaccagaatggttagaactcttgaaaggtatatcttttcctggagtcactaaattaccatgttgactgatgaagtaatttatatcttgctttagtttgagatgtagatgttaatgagaaattttgcaactttccccaacattaatttttaccatagttcataagaagtgtttgaatttatgtgtgtttatagttatataattctaaataatatttaatgtaatatacttattcaagtctatgtgaaacttatttcaggttgcctcttttatatatcaggtgtcttctatcaccaagtaactgaggtctattaaattcagagtttaacaaacagtggttttaaagtgctgtctttcagcgaccagtttcactttattcattacgtaaatactttattcaattaacttttgaatgaatcttacatacctgacatcttgatgtttgctaggaatgaaatgttggaataccatgccctacaaaagcttatagtccaatgggagaaatagacaaagcaagtaggctgtgctgtgagagaagaaaacacagagcaccattaccctcataagagcaataccaacaagtactagctaggcaaagagaagtatacaccatggaaaaagagcagcacgtgaaaagcataaagaaaatagagatcaaaagcttttcaggcgaactgtatatattctgtttgactggctcataggcaggaagcgataaaggggaagaagctggaaagaagggagttaaatggtaaggaggatgaggtggaatgctacagcgctcatcctggagagaattgaccaaaagcagctactaaggcaacatcagagaagatccagaaatgatgtttggtttggtcctggaaacatatcacatgtggcttatgggtgaagggatggaatccagactctgacagaagctggttagtagcatttttcattgagactggaagtgggagagtagtgttactgtgtttaaaacaaattatagattttttagaagatattttcccataaagttttatctcttccagattaagataattatttgtttcattaaaggtaggaaaattagtacctagtttcatttgttgattaatgttttaagacaaattgaatttttgctatggaaattatacatatgtaacagaatcagtaatacattgtgctaaagcattttttaaaatatcaataacaaaacactaagagttgagatgttttacaatgtctgattgtgtgtgatggcgaacatgtgatgaatggaagcagccattgtggttgtcaagttcactttattcatgtcgcatcatgtctgagtgccaagcaggacattgaattgcacaattataaatctgctttgggcactagactgactacaattactggcctatacaatggaattctttagtttgcctaatggcctaattgaattgatcaattggtaattcaatctattatttgtttaactacagttagatgactctgagtcctgtatagaccttaactaaatatttatctaattagagaccttggcttttaaagaaataaattggactaaaatatacatgatttttgtctatatttttattaaaataaatattagcagaaaccattctaaaatccatcttatttgaaaggaaaatcctgtcttcagttttaaaacaaatagttttagatttttcttcatcactaagaacttattactcaatggcacattaaacttttcagttttgctaaatattacttacatttcaaaactaatctattttctatgttttctataaaaatagaatgtagttacattatagaaaatagattccatttctatggaataatgatctgtgtaacaaagaggacactttcttcacttttaaaatgtattaagccaggtagttaattcgcgtagccctatgactaacataaggcagagaagggcaaattcaggtacacaattctagttctaaatgaacatagacaaggaactagttgggaaatttggaaggtttgcatagattattacttttataggtcataagggaagaactgtctgtacaatgattccagtagatgataaatgcagaatgagaaattgagctcactttatttataagataaatattcagattaagtaacatgccctaaattgtacaattaccaggtggtgaaaccaagatttgtacttaatcattctgtgtcagaccccatgatattaactacttattataacagttcaagtagggaatttatgcctaggaatttagacttgattcaattaactttgttgatgattgggcattgctgaaggtttttgagcaatgaatacactgacataaacatacacccaaaaaacggaagtgaacagcacattaggttaatgcattacctgatatttttgtctcatatttaacatttttttttttgctgcattgtaggagtttctcatactgtgttttcttttaaaaatctagtttgaagaaaactttctcttataccagggtataaacagggtgcacttagcctttcatagatttaagatggataaaatgatttcttgtgctcctctcatatatactggaaaaaaatgaagtatatgatcttattgtatttaagccagatgaagtccatgttttctagatatatcagatttaattcagatggcatgaaaaggtctgcatatggactctcacagtctatttccatggattctgctaacattgacttaacattgaccagttaataaatattaaaagttcccaacttgaactgttatagtaagtggttaatatcatggggtctgacacagaatgattaagtacaaatcttggtttcaccacctggtaattgtacaatttagggcatgttacttaatctgaatctttatttatcttataaaatgtcgcaagtaataccacatatttcatagggtggttgtgaggcttgagtttgacaagacaagcacaatgcctgtaacttcaaagtcctcagtagctattataattatcttagcattttagagtttccagttttaaataattctattttcatgtcaagataatttctctggtaataaattacctgattttggattctgggtctcataagtattaatttgtctactggtagttcattacacatgctttaagctatttatctgtagtcctagcacatttctgcattttattttcacatctaagagaagtcagagtttcctgcatcttcttcctctctagtaacttattgctacatgattttacctttctttacctctccagtaacattattttcctttgctgtatgatatggtataagaggaactggtttagaaataggagtcaggagataaataagcttgatagtgtttgatcttcattacccatgaacaattctaatcctctcaaacccttagtttccttatctgttaagagaaaagggtggacgacatcagcgtcttcaaatcttttcactataaaggatctcatttattatttcactccatactcaccctcaactctgcctttataatcctagacttcaacaattcaggttagcaagacaaaatctaatccttaaaagctgcaaggccatgctataacacaataattaatggtcaaaaatcaattttatgaaatatgagattgttctatttttagattaataaaaaatagttttaagtcagtttatgctgtcacacaaatcacaccaaaagaagataggataccttttattgtgtacaactaagttccacgtcattctgtgcccctctccacaccagatgataactttagcctgccctccttggtaactagggctaggcagagcacaggagtaaattgacaatcctattgtagtggaattagttatagtaggtcaggtcatttaaccaatgtgcaataaccaaggtaaccagtctttcacatggagctgatgacattccattcagatgtaacaaagcctaatatgttgataagcctaacctgacttactgtggatacatagaccatttctgtttgattctgaattaaaacgtaattatttatttcccaatgctatttggacggacatcaacaaggctcaggattccaagctgaacctttaaaaacttggggactgattacatttttctagtcatgtctatcattctaaaattagtgatctccccctcagcaaatcaaccagtttttttttctatttttattgttgaccttgagtgatgttagatatggattatattatattctcttagctactattccctgaaaagttactatttcctgtaagttcaaaagcaaaaacaatgtatttgagattgtcctccacgtaaaggaatgaatatgtcttggaaaggagagaacctgttttttcccaagagtctcatgaggccaaaatatggtcatttctgcatttacttatgaatgtgatatttaacagccctaggtgggtcatcttaagggtcaggcaatcatccgtgactctcacatgaacaagaaaacctccctgagggtgtgtaggatccagacttataacccatgaagcaaaagtcacaaaaaaatagtgaaaagacctgtagagcttgcttccttctttggcctcatttgccatctatttattcctggaacataaaaaaagacaaatttagtcataaattataggcacacctttattgattcaacactgacaaaatgggaaatagtccaaatgctttggttcattatcaaacaacaagagccaaaatcacaaacccattgcttttctggaaagtttttaatgctgctttatgcatgtatctatacatcatgaagatttttggattctccaaactaactttgacacatcataatggcaacatttgttttctgggattctactgtcagctgcaaaattaaaaaaaaaatctaaaaataaaaaaaaatcacttccttcagacttgctacaaaatgaatctgatagacttaaaatttgctgtgagacacaaggggtagaagccatacgccagtgataagaatagatgatttcctttcttccgccagactctaactagaaatagcaatatgtatgtgtacatagagaaagaaagaggaaatatgaacagatgtaggaatatttacagagagggaatgtcatttttagtactgaattggtgtaaatgaggaaggaaaataatagaatcctagagtggtgaataatagctccggagaaatggcttctttctccctccatgtccaaaagctccttggcttacagccagatggaagttttcatttttttattaaataaattctggttcccgtgatcagtttggattaggctggtttttcaataaagaatattctaaacacagagttaggagtttcatggaatttttcactcagagcacatagtagagtacctactggtgtttgaaggctcacggtacctgctgaatattctaaaacagaactagatgcgggatggctaagcagccagcaggtgaacagtaggttagcttgaaattgaggatgcagacagagcaaactagctctctgaagttaaattaatttgtaactcttatgcctgggaagaaatcaaagaaaataccccacagtagcctgcagtgccctttcatttccatttggaaatgtgtttgatattccatggaggcaggaatttaataaagaaaaccgaggagtacacaatgaggaaaaaaggcttttgcattcagaaagcataaaaattaaaagcaactactggttattttgaggaagacagttattaagttgtgaaaactggtatttttttcttgccaacgcagatgtcaacagtccataatttaatttctctgtgtctcagttattctttagattcagtgccgtaaatttcatgttgaggttcctaaataactgtttagggaaatggccctgttaaaggaaagccgtagtcatcactgcattagcataaattcttgtttactcaggatacatttgatcacatccagtgtcctaaaataattgtaaggagtgtttagggtcccaggttggataatttatatgaccaacctagtcatctaccatgagggaagataaaatagtgtggccccaaagacatttgggaaaatctgtgaatatggacagtgaatatgcccctcagtatgtcacacacactcaattaatttgaccattgtaatgttttaaccttttttaaaacaattctttaaaaaggaaatattctcttcctttaatacatcttcccttctttagggcatggggcctgatgatagttgactttttgtttctgaatatattaagtgtaaataaatgtgtcaggttatatgatccatgatgctatttgacttttaacaaattattgctgaaatatagtaattgaacatatttaattttgcactatcttctcaaaggcaaaataagaggggcaagagaggcagaaaagaggaaggaaggaaaaggggactgaaagagggaaaaagaagaaatatatttatcaatttctatttgagagatacaaaaccatttctatgttgaaggaaaatgggcttcttgagtatttcagaaacatgattaattttatgagactgtgtctgcatttgttctcaaagtatggtagatacctagaactttggaatttcttgagatgctttcaggggatctgcgaggtcaaagatttattttaataataatatatatcttttgagttttttaccatgttggcttaagaatgtccatgaaaaagcagtgaaaattattaattttattgtctcgatccttaaagtacacatctttttagtattccacatgtgtcaacataggaaaatacatacgcaaaaataaaagtataatgggttttgcatggtaaacacttctgaggtcatttgtgtttcaagctgaattagctaccttttttttttttttcttcatgaaacaccatttttacttgaaaggacagtcaatagaaaaacttgctgttcacacttggatacttgttacacatttctcaaaaatgaacaaagtgagccagctacttcaaggaaaataatatttacttccaagaatgaaattcaagtttttaagttagaaatttgcaaaacatgtatctgccactgggagcttgacagcttcccaacattcaagcacctttctgatgggattggtggtgagagtagcaaatgagactttttgctaatctataaatgtttcaacatttggaagatgtgtctaatacaatgtaccaatccaaataaccagtgattgatgtgacagaatcatgcatgggtaaaagatctattcaaaataccagctagatcagtagatttttacataacatagcacaaaacgtttataaatatggtgctagatttcacattacaactaattttcaaaaccctgcttattgagttttgctgaagtgttcaaggatatctctacaattatgtgaaaaggctatcaaagtacacctcccttttccaactacatgtttgtttgagatcagattgtttctatgtaattcgaccaaaacaacataacagaacaatgtcaatgcagaaagtatttttaaattaaaccaataatttttaagatttataaaaatggaaagaactaccactatactcaataataattttgttttggccgacataggtgtttttttaaaaatattatttttgatggggtaaaaataaatatttaatagactgggcacagtggctcatgcccataatcccagcaacttgggaggctgagacaggcagattgcttgagctcaagagtttgagaccagcctgggcagtctggtgaaaccccgtctcaaaaaaaaaaaaaaagaaaacaaaaaaaaaaaaacaagaaaaaaataaaaaatattggctggacgtagtgacatgtgcctgtagtcccagctatttgggaggctgaggtggaagatggcttgagccagggaggtggaggttgcagtgagctgagatcatgccactgcaacccagcctgggcaacagagcgagacagactctgtttcaaaaagaatcaatatttaatgaacaaatattttaaaaatctgttttgatttttagtatggaatgtatttgttgctatatcctgtataatcaaaagctaaagagcttcaaggggatattcaataattttcaaaagcacaaaagttcctgagacccaacagtttgggattcactgtctgcatcgttattctttgttgtaatgattgtagactggtcatcctcaactcaggtaacagattaagctaaagtaggtcaatatttctatttagaaaaaagtgaagaggaaagagagaaaggaaaggatagcaaaggcaacgtattgccatagggtggttccacattttaaggcaccctgtgtagcctgagatcagtatcactgtaatgactgttttctctttatttccataccaccctcttgctgtctgggaggattatctgtactgccaccaggataacaaacagaccagttcaaagaatcaggttaacattttctccccaatagggaaatgctaaactaggcttgagttcaagtaaagcattactgcttttaatcgatttagaaaaatagttacataactttgtacatttacgttcatgagcatcacattaaagaggtatgcttttgtagattttaataccaaaatttgacattagaaaaaaatccatttttttctgctggcttgaataaaactattgtcaaatatgttttctaggacccacgcttatatttttctctcagttttattttaaaatatgccatagatacatataagtacatgaaatatatgtatatcttagagaataaaatggaaaatgaccatgtatgtgtcaaccaatttatgaaatagaacattacaaatttgcattctgataccctctcctgtaattgaactatgttcattaatttactggaaaagtctttatattctattagctgaataattgcatttggatatgaatagtggtgcccatataacgagaacacaaatgatttttaatcagtaattactaatttcatcatggttccattaaaatcaatttagtcaacaagactcacaacctagaattttaagttcacatctcccagggccttttaatctattcttaccgagcttagaggaaaaattttcctttgctcttaaatatgtgcctcgaatgttagtcattaacttttataattgtttgctcctggtacaatttctacacactttgcaatactagagtttaagataactctgtactctaagaatactacatgttattttaaaacctttagaaaatacgcaagaatccaaagatgaaaaaaccacccataattccatcacacaacattaaccttgaaaattgcatctttatcctcctcatttaaaaatataaatatactttcttaatcctcctctctaaaactcatattgtaaataaaggagaaaaataaggcagatatctagtttaataatatttctgtagaacatttcagcagtgcaaaaacaaactaaaaatcaaactgaaataacaaagttatttggtattttaagtttctgagatcttggtttcatttttatgtatatatttcagttattttttgcagcataataaactaaaaaatttaatgactcaaaacagtaatgatttatgatttcttatgattctatagtttatatgaacagtttctctgctggttacacttggcctcacttatgtgcatttggctgagagagaggtttcaagatggcctcactcacatgcccgacagctagtgctggctgttgactgagtgcctcagttattctccacgtgactttctgtcttccatttggctagacttacatggtagtgtcagagacagcaatggcaaaagctgtaaggccttttgagaccgtggctgcagagctcatgcagcgtgactttcaccataatctaccagtcaaagcaagatacaaggccaggccttatttacaacaagagtaaaaggcatcccttttggattagagaatattaaaaaattttttgatcattaatctagcacaaagttgtaaaatgtatgaactacttactattaatgaaaaattgtgttccttttgggggaactttcttactatttgaacttatcaaatgatataaagaaataccaaacttattggggaaataagatcatgtttttctggcaaaagctgacattttcatatgaatgtatgtacaaattccaatgcctatgaagctacgatggtaacaaacatcactgaaatgagccaagtcaagattggagtaatctggaccatatatgctctatctgaaaatggaaaagtcgatggttctttttttttttggctgaataagtccagtgatgcctggaccactgatattttaaaacaaagattaaatattggtaagtaattttgttaaacaacatgaatctaaaagttacatggaaagacaagagacccagaatagagagcacaatactgaataagaagaacaaagtcaaaggatggacaccacctgacttcaagacttactataaagttacaacagtcaagatagtgtggtattggcaaaataatagatccatggaacagaggagagctccctaaaatagacccagacaaatacagtcaactgatctttgagcaaaatcaagtcagtggagaaaaaaatcgccttttcaacaagtggtactggaacaatagaatgtccatatacaaaaaaaaaaaaaaaaagaatccagacatacctttcacaaagattaactcaaaatggaccgtaaacctaaattcaaacacaaaattatgaaacttctagaggataatgtaggaaaaaatataggtaagcaaatttggcaatgcatttctaggtataacgtctaaataatcatgaaaggagaagttgataagttggactttattaaaattaaaaacttatcttctacaaaagatacttttaaaagagtaaaaaacaacccacagattgaaaaaaaatttgcaaaacacacttgtgatcaagggcttcaatccgaaacacacaacaaattattaaaaggaaagaaataaatttaaaaatagataaaagatctgaacagacacctcaccaaggaatatataaaaatggagagtaaacataagaatatgtttaacatatgtcattaggcaattgcaacttaaaacatctattatataccattacacgtgtattagaatggctaaaatacaaaaaaaataatggcaatagcaaatgctgacaaggatgtagaactttttttgctggtggcaatgaaaaattgtacagccacttcagaggacagtttggcagtttctcacaaagctaaacagttttaccatacaatctagctattgcactccaatatatttaattgagttgaaaatttatgtcctgataaaaatgtatgcttgaatgtttatagcagatttgtttataatcaccaaaaactggaagccaccaaggtattcttcaatagacgaatggataaactggtacatctagacaatggattattacccagcaataaaaataagtaacctatcaagccatgaaaatgcatgaaggaatcttaaatgtatattgctgtgagaaaaaagccagtctgaaaaggctatgtactttatgattctagtgatatgacatcctggaaaaggtacaactatagaaatagtaaaatgatcagtggttgcctggagtttggtagggatggcaggagtgtaatgaataggtgaagctcagggatttttaggatgctgagattattccaaatgatatggtaatacatatatatgacatgcatttgtcaaacccataggattatgaaaagtaaagggtgtaaataatgtcagctatggacttcagttaatgataatgtatcaatattggttcatgaattaaaacaactataccacattagtgtaagatgtttgtaataggagaaactgcattgcaagggatggggacctgatatatgaggatactctgaactatctatctgttcaactgttttgtaaataaaaaattttaaataaaatattaaataaccattttgtgttgcatgattttgttttctgataaaatagtttgagtggaaaacctcagctgggcttggtggctcacgcctgtaatcccagcactttgggaggcttaggtgggcagatcacctgagatgaggagttcgagaccagcctggccaacatggtgaaactccatctctactaaaaataccaaaatgagccaggtgtggtggtacatgactgtaatcccagctatttgagaggctgaggcaggagaatccgttgaacccaggaggtggaggttgcagtgagctgagatggcgccactgcactccagcctgggtgacagagaggctccatctcaaaaataaaaataataataataataataatatatataaatgaaaggaaaaagtgtcccttccatgggtaaattagtagcatcgttgataggtcctaggtaatttttttttcttttttagctagaagattaagtagatcttgatgtttttcacaggggatattgtagaacggtattgtatagtgtaagttgtagaaacatttctaccgaggagcagatggtaaaagtaaaatattcaaatgcataggcctctaatatcaaggcaactatttgtaaatatatattttgggaactttcgtgttcaggaaatttattattaagcagtattgtctttcaaaccatatttgcgagatttgaaaagtcactttgaagaaaggaaatgaagcataccatcagcaattttcaaaagttctgagacatttttctacagtattgatataataaagatgaacacatttggaaaatgttctcaatattttcattgtgaagagtatttatttttgttgctggaacaaccagaagcaaatgtgggaagactgagaaagtgtgaaattttatttctccacgcaaagaatactttagataacaattactgtctcaactactagcttgagaactggtgtcctttttattacactgtgatatacctgtgtggagttgggtcaggctaatgaagactaaagataatgtcaaatatgtcctatgtcccctcccactttatattctctttgaccaccagcagctcatgctatgacccgattgggtctgtcctcactcagcgattctcctcaccccgatcctagtttaaaagatttcattgcctcattttctttgcatccagattttgctttgagtctgcaaaatgacagattattggctaatcccactgaatgaatttggttgaagatgacttcaattaagtcttcctcaggagatgtggattttcatgggtacttgaaaacacagcatcttgtctcaaataaactttgagtgacataattttagtcaacaggtctggtcagaggatgttgccatgggtagaacaccctcctccaaggactggttttggtgtgtccccaggcattatcagtagagcttatataggaaggtaaatagaagctcttaactgtccgcaagcctacttgagcattgcatttggggcttagaactttgtgaattttttgcttattccacctgatataatcttagcaactttggatgaaatgcatttaaggattgaatcaaaagacttcctaagtcgcataaagactgtttcagttatctgctagtaaaagtgaatagtgttccatatatagaactagtaaatgcatcagatgaagtagaaggatgcagagaccttcactgacccagggtttcagctctaggggcaaactcactctttgaaatgttgttaaaattaaaaataaaaagccagacacagactagttataaaataaaccaacttcagttatataaatctgacttccttttctaagaaagcagttattttctcagcacctgtgtattctactcttcagtacctgtacgctatttaatacaatttgaatatgtcaaattctaatatatttgtttctcttattttccaagccacagaagcaataaacaatgtagaagaaagtagaatagatattggtggtaggcaaactgaacatatcaataagttttggacaataacatttagaaaagctattgacatttttctgttctctaatgctgataagtaaacaattcctgcttacttatgggtagcctcagatacatgaatagcctcaagctgatgccctataccatgatgtcatcaacagctaagaatatttcaatatcataatcctatacacttgggatgaaaaaaactattttaggagtttacaaatttcattggcatcttttcatttttctttccatcttttgttaggaaaaaaatcaaaatatatcatttatctttgcaatgtttttcatatatcatatgatactgtgttttcccctcatagatccaggactgcatagacagctgtattttctgcaaagaccatccaatgtagtagccattgaaggaaaagatgctgtcctggaatgttgtgtttctggctatcctccaccaagttttacctggttacgaggcgaggaagtcatccaactcaggtatttcacatttaagacttttttgtaaagtgtacttttgtatggtatatgctgctatttatatttctctaatttgatataagtacctacagtactagggtttttcataataattgaatatttttccacatttcttggcatgatacagttatatgaaagatatttagccactgggatgagaagatgaggaaaagatcaaaatccatgggatcaattctgaaaggaaactgaggaagtcagggctgcctttgagatggtcctgtccaaagagtcttcagcagagaaattttggtggattccattataagaaagtggtatatagagaggtttgatccttaatattctgtgtcacacacaaaagataactatgtgaagtgatatgatcatcagttcaactgtgataatcatttcacaatgtatacatataccaaaacattacagtctacactgttattatatgcaatttttgtcaactgtacttcaataaagctaaggggaaaaatgaaactaaatttttctgaattcaaatatgtagcatgtcattatagagtttgagcaattttttttagcttcaactatatcgctcatattcccagctataacaaatatttaagggaagacagaataacttggctggctttgaattgctggaatattaatattaagatacagttagaaaataaactctcaatagaatggaatacttagtctttctgatgaaatggatcttacttaatttcattgatttttgaggactggtattctcctttttaacatatttatttttatagagaaggtaagtccatcaatcataaattaatctttaaatttcatttaccttaaatatttagataacaacaaggcatggcatatgatattacagtatttttgagaacattagaacacacaagaaatccagttaccatttcagcacatcaaggtgtgttctctgcgtatagccaagcactcttagtgcagtatcaaatatggttttgtacaaaggttactaaattggatttcaggacacaggacattgattttcacttcagagtaccacttctctagacctcgaggttctcaaatccaaaatgagagatttggactagattatctatcattttttttttagcactaaagttacttccaagtttaatctgcttcatttatttgatcgctacacacaatcttccaatgggagtagtttaccttgagtgaatttttggatcaataagtgagactttaatcaagcccttatgatacacagtttctttcaagtgtcttaatttgagctttggtggaggtcatttaaagctctgagtatcttgcttaatatatacatatgttaatttactctgcaccttccctatgtcttgcaggtctaaaaagtattctttattgggtggaagcaacttgcttatctccaatgtgacagatgatgacagtggaatgtatacctgtgttgtcacatataaaaatgagaatattagtgcctctgcagagctcacagtcttgggtaagttagtggctggagatgagtttatattgtacctttcaaagtatatcaccgcgacattttaatgctcatcactgaattgattcctatgtttattagtgtgaaattgcaaagtcccaatactccacacatgtccttgctttgctctgattaattgcataggggttatatgcaatgtttgaatacttattaattaaaatccagatatattatgctttagtctaattattccagtgatacagctgaaaagtaccaaaaattattaatggcagatgtgttgaataataaatatgatattacaaaatatctgggaaaataaatgaaggaaaattgtacaaaatatttatccttgaggggaaaaaggcagatgttatttgagatgacagggtttctgacattaaattcagtatgttggtaagatttttttattaacatgggaatactgtgagtgttgaaagtgaaccattaaaataaagtatatgtaaggaaaagttgcatagcaagaatataatttaaacagatttaaggaggattgaggggttcattatattccaaaaggcagggttacccatgtgtcattgcaaacaaataattcttctacatggcagttattcaaacaaacacatatttttatcacttactccagatttattttaaccagttttatttgaattatgtagtttggagaaagtgccttaacatttggatttcagttgctttttttctgtaacaacaaccaaacattgaatcttaggaatttttcctctggaataaatctttttgccttttaaagaatctcagaaaaatcatagtctatttaaaagttattaagtaaaaatgaaaatatatcatatgctgattatatttgctaagttataccatgatattattccatccattttgctttttgtcttcaaaggttattcagaaaacactttcatctgtggacatggtaataatgtatatcatgggttagataatgacgttgcttgttctttgatcaaatcataaacattaaaccaggaatgggcaaaagacttaaaccctggatttagaggtagtattatactaactaaaatattagctgcctttaaaatggcacagtttaattgagtcatatttcatattttggtgaaacaaagaatagagaactttcacatttgtagtatcaaaattcagtaacacaaaatggttatgatggaaattgtattgtgctgtatattactgattataaggcagatttggttatggaatacgctagaatttacactggtcataggtaaagcattacttgcatgaggtcaaattttatttcaaattaatgcacattattttgacatgtaatggttcgttgatatctgagataaacatatgcaaatactgatttctggggataaactaaattagtctctatatatatacacacacacatatacatatgtgtgtgtatatatacatatacatacacacacacacatatacgtgtgtgtgtatatatacatatacatatatacacacacatacatatgtgtgtatatatacgtatacatatatatgtatatataaacgtatatgatatatacactatatatggatatatatacatatatatggatatatattttgtaatttacacaattcacaaagaaaaaatgccagtatgagtatgccaatacatatatatacacatatatacacacatatatgtgtatatacacgtatatacgtgtatatacacgtatatacgtgtatatacacgtatatacgtgtatatatgtgtatatatacgtatatatgtgtatatatgtgtatatatacgtatatataggtgtatatgtacatatacacatatatgcacatatatacttatatgtacatatacacatatatgcacatatatacttatatgtgtgtatatatgtattggcatactcatactggcattttttctttgtgaattgtgtaaattacaaaatagatgctgtttgatacatataaaactatccaaagatgcacaagaaaatatttaataattatttccactacaggcagtgcatttctatacctctgaagtgaatacttttggtatcttggcatgttttattccataaacttctcatatttcattgatgcacatatgcccacataaagtttggtagtggtatgacacttggatgcttctttgatttttccttaggccagatgattagtctctattacaatacctctagtgaaccttgactagtgttattatgtaaaaaatattgaaaataagcatccaaaaaatgctccacattactaatcattagagaaatgtaaatgaaaaccacaatgagaaccaccatctcacaccagtcagaatgtctattactaaaaggtcaaaaaataacagatattgccggggttgtggagaaaagagaaagagaatgtttatacactgcttgtgggaatgtgacttagttcagccattgtggaaagcagtgtggtgattcctcaaataacttaaagtagaattactatttgacccaacaatcctgttattaggtatatactcaacggaatgtaaatcattctaccataaagatacatacatgcgtatgttcattgcagaactattcacaatagtaaaggtatggaatcaacctaaatgccaatcagtggtagactgaataaagaaaatatggtaaatatacaccatggaatactatgcagccagataaataacaagatcatggcctttgctgcaacatggatggagccattatcttaagtaaactaatacaggagcagatcaaatatggcattttcctatttataagtggaagctaaacattgagtacacatggacacaaagatgcaaagtgtgtccttaggtacttgatgtttagtttccaatgtgggacactggggcctactgagagtggagggtgggagaaggaagagaaccaaaaaactatcgagcactatgcttattacctggatgacaaaataatctgtacaccaagccccagtgagatgcaacttatctatataacaaacctgtacttgtacccctgaatctaaaataaaagtttaaaaaattgacaacataaattaacgtaatataatacagttaatatgcattagtaatttaatctatgtgtacacatgtatgtaaaacatgtacatatgcacacatgtgcgtgcatatttatatgtgtatatatgtacatatatgtggatagatatacacatagatatattagaaacagcatttactgagttcaaaccatgtgagacatttatttgttacagtatcctctgtgggaagtacgtaggtcgagcccattagataacaaccctcttgccttctgtgcttctgtaccaagtgagaaacaagaacagcagtaaggcatagggtaagtcaaacatcaccttaatttgttgaagaagctgccgttgaccatggtttgcatctgcatgggaggcacatgcccatctggacatgggcagtgtctatattggcaggatgtcactcaggtgtcagcttgtcccactgcttggtggctggtggcaatggagagcacttgctctctttggtcaggcctgttcccaagagagaattgtaggtgaaaggagtctcttcaaacttccaggctcattaagttatctgtcatgtatcctgatccaggctcccctcaaaccaagaaaaagtgggtactggggagtggtgaggtcagaagtcattccctcgaggagctgcctctctagggaagaaaatatcagtattgaggcagaagtattcaacatccacaccccaaccttaggtgctacttttaatcccgttttacaaacgaaggcattttagcacagaaagataagtggctatcccaaggggggatccagatccaaatccaggcatccgaccaaagagtcttaggcatatgctttactgtctgccctgtctgctccacacattcctattcatcgttttttattatttatttttaatcttactgaaacagctataaaaaaaagcaggtttatgtgatgtaaataagaacaattttaaattttagtttggttaataattagtcacttacataaaataaaatacgtgaccgtaatgtaatgatcttgacaaagcagaaaggctgacaggggagcagggaagaaaggaatacaagctgttctttgaaaatgaggttaaaacaactgccatacttcgaatctgtagacacagaggcaggtgaaaagtgtactcaatatcgggtattgcttattttttttactgtaacttcttgtttattcaaagtggtgtgccgtttgtataatcagaaaaataaatgtggaggtataaaagttgacatgtttatggtttaaaaatgagataaataaaaatgttaaaactcagaaaatattgagattatgctaacatacacataatccaaagacctggactttgcaaacacacacacacacacacacacacacacacacacacacacacacactcacgtttgttttctccatataagtgaaatgtatgctatattgtatcctcattttcacttcaggataaatcatggcatctttctttgtgtgtgcctgtgcacatgtctatcttctccagttctaatttttttttctttttgagacagggtcttgctctgttgtggccttgagttcgtggtgtcagatgatcctccattctcagcctcccaagtatcttggaccaaatttggctatttattttttctttcttttctttttcttttctttttttcttcttttttgtagagacagggtctggttatattgcccaggctgatctcaaactcctgggctgaagtgatcctgccaccttggcctcccaaggttctgggattacaggcatgagccatcgcacccaaccttcagctttatattgtggaacattatcatgtttcttagttttaattaagcgaggtgtggtggcttgcacctgtagtcccagctactcaggaatctgaaggaaaggatcttttgagcctaggagctctagtccatcctggggaacatagcaagatcctgtatctacaaaaacaaaaacaacccactaagttaattatccttaagtatctttgtcatttatttgctcatatctgaaggaaaagtatcccagaaatacttaaaccctcactggcagagcaaaactttgcctcccttcagagtgcattttcccccacaattttgaatatctaaacattttataaaatggagtctccttgtaagtatttatattcctattaaattaagatttcattttatagttttcttggacatttgcattttacattttgtgaatttgctgtcttttttgaccttcatacatttattgaaacatttatccttattttattgattacagaaactctttatgtaagaataatattgactatgttgtgtatgcctttgcatttttacattttgcatatggcaccaaatctttttcttcatggttgctagcattgtcattagacttacatttttattctatgaaccatgctatctctaaaaatctggttatggattacatgttgaatgtttaaattagaagcatgattaatttctaaaaaatagtgatatgtttatattttgagttttcatggtcttggttctttttgtctgtttttaagggattttttttggtaattggacatattttaaaggtctctcatggactttatatcatttataactactctagaaggcataatttacttcaggatttggttgatatgctgttttaattattctaaaaggctccaaaaatgaatatttgtataatgtttgaaataatctttgactactctgatataaagttaggattatcctgcaggactgagtttatatgaaaaattgaatttattgccttcttaaaatggatgataagaaaagaactttattatcaatgttatttaaatttacttttcataatttttaagaatttaatcatatttgtattcttcataagataaaatcccacaagaaatccaagcttctgcttataaaactttaatcacgcattttattagactcttgttttgcctttcaacttgcagtcctttcttgtacttaactgtctgtgaatgtgaaccttcatgaactaacagacttttcaagtagaatatcattttatagactagaagaaaagacattttgttgccctcctcagtaattttacagagtgaatatacattaaatataatttgaagcttagcattttgtttccttcttataaaataaaaatggaaaattccataatcattaagctttttggagatatctttattagacaagattaatgacaaccttatttacaataaataaaatataaataagttcataggtattttctttatcatagccatttatggtagcatttctgacttacagtaatcatcgataaagtattggtggacaccttttgggtacaaggattgcactaggttctgggaagactacagaaacatctgaaacctggcttcagtgggcttcgtataattacaattcgtaaaatcagttggcctaatactgtctgaataaacttttatttaaaaaaagaaaaaacgaaaatgttatatgtaaacagggactctgggaagatatgaagagttggtagtctccactctcatagaaaacaaagcccgaagaggcaggggtgggaggagtcctaaagaagaaaatgtggaaggaggctcttggaatattgttgtcaactttttaatttaattttagccatgactacttgtattatttattttaaaacctaacttttataaaagaagtcaaaagtggtatttttccattcttatgttcaatacgtccagctttctggctcaaggattttaatctgactataattgtgaacatatccttttctgtatctgcccatccccaacttttacccagctccacacaggaagaaagacagtcctccataaatgttctagagatttgccactgctttgggtctagattgatcccatgtctgaatcagtgcagaaatgcataatttaaaaagtgatttgatcttttacaaagtgccaggctttggacaaaccttgtgtactgtccttacacacacaggtggagatgagtgggaactttactgaggatggtctcttcagtaggagccattaagttgaacatcagtgagaaaataaaaatatctttgaactttccagaaatggttctagaattccctttaaagcagttgtgtagcaacacaaaaaacttgtaattgccctctaggaatgtgttaagtagagttctctctatagagctgagcatgtccaccttacacagatgtgttcaataagcctgaagatgatagactcagaatatttatatatagatatagatatacatacacacgtatatttttgtatatgtgcatacatatacataaacatagtatatacatatatatgcaatacatgcacttactctctatttctaaagtttccctttaaacttattattttctttcaaatgcatatgattatctcaaccattaaatgaggttctgattctgcaaatagataatagactaagctattcagaaaggtctagaaaaatcatcttaaaagtgatttaagaagaggccaaataaagatatatgggtgaagttaaatacccctgttaaacattattgttttgtaagatagctggaaaagttcaccttaatagctcattgctcaaaatgctttggaaattttgaaacatatggctggatatacggtgagctaatgaatatagtttctagtcctagatatgcagctgaaccacagtgtgagtagaaaactagcaaccaactgttgagtgcctcttgtgtactaagcattccgccaagtagtctttgggcataagaagatatgacacagatccaagcctcaaggataggtagggaaaaagacaagaagcaggcaattgctaacaaggccgaagagctgttgagaaagaggaagacaagggaccctgaataaagaatgcaacaaagatgagagaatgggggagggagtggtgaggggagagtatgagaatgggggagggagtgttgaggggagagtatctgacaggaggtagtaaatgtgcaaaggtctggaaataagcgggatggggaacgggaagtgaattatgtgactaaagattgtgggtacaaaggaatctgatgctggatgggagaatccatataggtcttgagtattttgctcatgtggttagatttatcttaagggcagtggaaacatatggaaagatttctgattgtggcttgtgagctatttaattttagccagctatgtaaacctctaatcttcaattccttcattattttcttcatatttgtagagctttaggagctacaagtgcagttttgttacctggatatttcccatcatggtgaagtctgggcttttagtataacatcacctggatagtgtacatcgcacctattaagtaatttcttattcgtttgtaaaacaatgataattactttatcataggatttggtgtccgtttgagtgtgaaaagtagaggagagagattccagaataatcaggcacagctttgggtgttctgggaaataaagtaatataagatcccctcctagccttcatgagaagcctaaagccagttggaaagattaagctagctaaacaaaccaagacatcccaaatgtcacaaatattaaaatattctatgtactttttcatatccaattatcattatctataaaatgtacataacagcaactagtccctacgtagttctcatgaattatggcgcgattgatataacaatatctagtgatcaatataacagtatctagtgatcaatataacaatatctagtgatcaatataacaatatctagtgatacattgaaatttctttggcagtaatctctagaaacatagacatccctctgtgggaaaaagatgatgtccatttgtgatgtgttttatgtatttcacttttttctgtgcttctacaccttgctgttcatgctttcttcacagctagatagggagaaacttaaaaacagaagccatgtcttctacattttgatcactcaaacccttagatttttatctatgttatctgagttttaagcataagaaatgcaattgaatgtgcataaaatataaattatctaacttcctatcgaaatgttttgtaagctttccattgagattcatgattttttcattgaccactgcaatggacagaattatgtcctttcgaaattcatatgttgaaatcctaacccccaatgtgactgtatttggagaaaggcctttctttaaatgagtaactaaaattaaatgatgtcataatgaggggatgcctatccaataggaataatgcccttttaagaagaagagttactggagcactctctccacccttgcacagagagaaaaggccatgtgagaacagagaaggtgttgtctggaagccagggagaggacccttactagaagccaactttgctggtaccttgatcttgaacttcctaatctccagagctataagaaagtacatttgtgtgtctaagccacccagtctgttgtattttgttatggcagtctaagaagactaacacaactacagaaaaggtagatgctgtatgcgttacagaacaatcactaaaaatagaacaactgctaaaaagattctttggtcttttttatcaaaagtgagcaacaatgaagacttatattatcaacattgcttacatattggtagcacaaataatcttagatttctaggagtgtaaaaaattcccatttacaatagcagtggatcaaaaataattgctcatttacataataggtcttgtgtagttcttagatccttataaatttgatgtcctttcatcttatttttgttcgctatcatccctttatttaataattactaagtgtaaggtatgatatatattttaggtcttatatttataaatgacctatatcaatttaatagtaaatatatcattaactgtgatgaaattgtattcttttttaaatcaattctcagatatgctctatgaattcaatttactacaaacaagcatgtatatcttcacacaccatcaattcagatttgtttggaaatggaagaaaacatatacttcaaaattgatatggcttttttccttttattttttgcataggctttaattttattttttacggaacaatatgtgatattagctgctattttttgagcatgtattattggccaaattttacctatccatttgcttgaggttagtggttcatctacctcagacttgggtgttcagtctcttcctacttcagcttgctggtagatcaaccatgttgagttttaggtttaggctctttgccataaatgggaagtagttataataaaatatgttaagataatatttatctttttattgcaatgtgtaattcttattttgaatggagttcttttgaatttacaacatcattgcctctgcctacgtagcagtccttaaattttacatatatctgtaattgcccttattaacaggactcctcagtcatatacatttaatgataatagtcataaaagaagtgccttaggtacgtttgtattgattatcctctacaatgtaattaccaaatgaatcatactgaaatgagttaagagagtttttgtatgtagggttttgatcctaaatgtaggatacaggtgtgtaatataaggcagaattaaatcaagaaaactattaaatcccacctattaggtgcttcttcccattgctatgcagattacttatcttagttattttcctcagctgaaactctggttgtcaaaaggtatgcaaaattaagtgcaaaatatgtttaaaagattctgttgaatatttatatgaattagaagaagagacaatgtaagttcagactgtttgttggtagcaaaatgattcgttatttcagttgggagttagaactggtaatggaaatacaagttggattggtggtaggataggtttatttattacacaaatatttatttgagagtctactgtgtgctgggccctccctttcctttctcccttccactggagaaaataatgtgagcattgctttgcatatattattgagatgatgatgagtctaattttttctttcttggacaaatgaagtagaggcccccgagggaaaagcaaagtctatgtactaatacagaccattaaaaaggcaatctaagaatataattttaattatccctaacaatctaagcaaggtgaattgacaatctgtggctcacaaggaggagaactgctgacagtggtggaaagctgcccaagagggcattttatgctaaagttgccctgaagaaacggaagtagacatcatcccagaaggagtttgactctgtgataagactcaaaccacattagacagaaatgttttaaacaaagtcagcaagagttaggatcagttatggttgccaattttcaaagactagggagcaatatatgccatttcttcatacacttttaaataaatgtttttctgattttttattcaatatatcttggtgcaatcatttcagtaactttatgtagtaaggtatggactcatttttattttaagtatagtgtatttgagcagggaatcaccaaaggagtagaattgctggattaccaaacaatgcttggtaatttgaggaactaccagatggtgttttaaaccagtgacacaatttcacattccacccgtggtatatgagtgtttatatttctctgaggttacagtgagtcattatgtatatatgtgcaggcaggtagaatgcaaagagggagatttttcttatttttaaaacaataaaataatatatgacattcttgactcagaagaagatagcagtgaatgagtttttcttcttcctattaggttggtgcaaaagtaattgtggtttttgcccttaaaagcaatggcaaaaacacaattatttttgtaccaacctactacctcctcattcccttccatgtaaatggaggaacaattcagttcccattttccactgtaagcctttttgtttaatggacaatttatgcttatcagttatctcccctaaaatcaagagcatttgtatgattgtgactttatttggtgagacaaggtctctctgtttcccaggctgaggtgcagtggcgtgatctctgctcactgctatctccgcctcagtctctcaagtatctggggctacaggtgcacaccaccacacctggctaatttaaaaaaaatttttttgtagagttgaggtctcactatattgccgaggctggttttgaacccctggagtcagtaatcctcagccaggacaaagtgctgggattacaggcatgagttaccacacccagccaatgtgacttttgtcttaaattctatccatacctcttccttctgccacttgtgactttttttactcctccaacctactccagtgtacacttgagggtgttattgggtaagcggccatgacatatcattcggactctaaactttgtacagtgagcgagtgacacctaacctgcagagttgttaccaagattagacccggtgaaatagtccatgttcaaggcaactccagctcagtgcctagatacacaaatactttataagtggcatcataatcattgttttttaatacattgttatgacacgcattctccgtgattactcaaactcagaatagcaagtctcattcagatcatgtgtcataagtttgatgcttggctgaggtcagtgactcttcatatctgctaatattttagaaaaactcaaggtggaggaaaaaatctgtgataaagattcataccataggtattgtaattctaaagacagacattagaacttaattaagcaagacagtgagatttatcacagcatatgtgatcatgaaccaaactgtggaagtgggagtagagcaatagtagtgagagaagatgagtgatgtctggtagtggcaataagctgtacatcctagttgtttgggtttgaaccagggtctggaacatgtgaagcattctagaaatatacactattattatttaagaaaaataatttgagctaaaaatactacagactttcttgaggggagctcaagaatcatagtatcattatttataccttgccaaatactaagaaaaatatcaacattgtaagttattaagaaaataacccagaaaataagcattcacaattaagttagctttggataagaaggaatattaatcactcacatatataatacatatgaaaactgtcaaaataagtaaataggatttggtttaatgaatatggcctcagtgttgcaatatattaaacctagtcatcagccttaagccctctttttcttataccttacattaaatccataacagttcaatctccaaaatatatttcaaatctgtccacttgtcttcattctgacttcccccaccttatctcttcccccatccaactgctcttattcataacctggaccagtcctaaaacctcctaacttgtctctcttccattcttgcctttctataacccattttcatccagtatgatcttgtgaagaggttaatcatgggatgcaccttcgtagaaactctcaagggacttccacttttttcttagactaaactacaatctctctatcacatcctacaaaccactgtgggatttggtttgtcttcacctttctaacttcatcacattctaccattattcactaggatctatcaatatagctcctgctttccccttatatgcactaaacaattcccagtctcaggatatttgggaagctccccatatgtctagaattctcttctctcagctcttcttgtggctgactcttcgactggatcatagcccaaatgctacctttttatgggggttgtccttgtccattctgattaagaccatctctcatagttactgttatgcagttatttattttcctttgtataacttatcacagtctgttattatctacttgtttattaactgttgtttttttgtctccccagtgaaatataaaccccactggagtgaagtccttattttatgtactgttttacttactatgtccccaaaaacatataaataaataaactctgaatgatttgttaccatcatcatccacattgatgttttcataacagacatttattgggcacccattatgtgccaggcactttgcacaatgccttgatttctcttttcatagtctcaatatattatggagatactatttttaatatttatttttctctccactttaaagatgaagaaattgaggctcctcattatcatcattttcatcatcatcatcatcatgccagaaagtagaacttgaattgacattgttttcctttctcataccatggtcagaggaaagaatagggggcccttgggtgcagaaaagaataccaggataacccaaatgagctggtcaaacaagtagattatcagggattcttctgtcaaacaaaaaatagaacattgtgcaatttggtgtaatctttgtataatgtgtatttctcaatgtgtggtcttcagaccagcagcattgacatcatccatgagcctcttagaaatgaaaattcactggcctcacctcagcctgctgaaacagaacctgtagggttgggtcccaggaaactgtgccttagtaagtcttccaagtgattcttaaacactgctttgagaaaaggaagaccatctggtggtaagtaaaggaaatggaatgttaacaagagtaaggcaagacatttatattcagaaaccaaaccaacgaacaaaagtaggtttagtaggccttgtataaaatgatggatctcttattaaaattggagtataagggaggggcatcatgataaggaagaacagtcgaggcagagaccagagtaagaagtcagagtaggggtagatagccttcaggcagactagatcttcttgtctcgaccactttcactcaaattcttaaaatatcccttgtgtacataagattagtgacagaacatgaaattggactaagcccaaagtagaacaaaagtagctccaccatgattctatttacgctgattggtagaatgtgctcccctggaggatgggccattatgactgcactgagacagatctttaagtttgcagatgactctgaagctgttctagctggggagacaagaatatttggtaaagctgtgtgaatggggaaaataatagcagataaatttcagctgtggaaagtgtaatttaatatatctagggaaatataatacaaactatgctgatatgatgatgtactctttctgctatcacttatttctagaagaaaagatatcttaattgatgtcagctatcccttgaagacagtccaatggagtgtggcagttcaaaaggtcaatcaaatgccagagatcaccaggataaaactggaggaaagcagaattacaagatgttgtttatgtttgaacagagtagtattttagtacttggagtagagttcaaagttctactgagtacattctggtaaggtcataaggcagttggaaaggcctcaaaggttaactgaaatgatcaaaggaatgaaatattatagtaagaccagatgagaaattttcagcacagaaaaatgatgggtgaaaagggacacaatcaaattcctgaccatgaaggatattagtaactgaaacatggacttgttcaacaaattcaagaatactgtaggagaactctcctgaagcttgaaggtacttttaggacaaagaaaaaaagtttaagtctttttaatatagcctatagtaaatttactgatgctgttcccttctagagggttcatgaactggaaagataatcaggaacaaaaaaatatatatttatggaagatgagattccaaatggtttataaaagggaagctgtagattattatggatattttagtgtttaataaaggtagtactcagggcaatatgaaaaattatgcatctttataaaaaatgaagtccaggaattgatgactaataccgtattatagtttttaaatattctttaacatacatatatacatgtttgtgtgtgtgtgtgtgtatatatatatatacacacttgtatgcatatatgtaaaaatgcgctcatatacacacactatatatgcatatacatgtatacatttatatttgctttccttttaaaaggaaatattttgtcattaaagaaacatgtaagcattataggtaaatttgaaaatacagaaaagtagacaaaaattacatgtagcttcattcaccaaagagactactattaatatttcactgtactacttacatgtagtttatatatttcatattttctgatgtttatttttttattttatttttttcttttgagatggagtcttgctctgtcacccaggctggagtgcagtggtgtcatcttggctcactgcaatctctgcctgccaggttcaagcaattctcctgcctcagcctcccaagtagcttggattacaggcacctgccaccatgcccggctaatttttgtatttttagtagagacaaggtttcaccatgttagccagggtggtctagaacttcttacctcaggtggtgtgcccaccttggcttcccaaagtgctgggattacaagtgtgagccactgcgcctggcccattttctgatttttaaaagtaattactgcctgcaggattttgccactaattatgtagactgttggtttgagataggtattttttaatcaaaataatatgaaaatactaatataatgtaaaattcagtttatccatgtttagggtttttatatattaaaattaatttagtctatacatcttttgttttctgtcttaatctggtttaatattcaagtttgttcaactcatgaagtaaccacttttctaatacattatttctttaaatatcccattttatttccaatgccttttgttttatattttaatactatttagtatggaaagactgttttaggtgtgtcttttaatagcatgtgggtgcctcctatgtttgttcatatctaactattttcatgctgctgataaagacataatcggggctggaaagaaaaagaggtttaattggacttacagttccacatggctgggaaggctcagaatcatggtggggcaaaaggcacttcttacatggcagtggcaaaagagaaagagagatgcaaaagcacaaacccctgataaaaccatcagatcttgtaagacttattcactaccgtgaaaacagcatgggggaacctcctccatgattcaaattatctcccgccaggtccctcccacaacatgtaggaattatggaagtacaattcaacatgagatttgggtggggacacagagccaaaccatatcacttaccaatttgaaatattttgccttttccaaggagggtttggcttgttcatatttgttgtcacatacaaaataattatcatgagatatttgaagcaaacagggtctggctttgaatattgatactgtttattagctatattacaaagttgtatgaagattttaatttaatggtagatataaaatacttaataaaatgcctgccacagagtatgcattcaaattattgtgattatttcctctttgttatttatacctcttttgttttaataccattttgatgtttgtttgtatcttttactatatagtttttgttttaattttagtgcaactcagaagatagaagcactattataaattttacaagcaattaactttagactgatagaaataggtatttaaatgtatgaaaggctgatagagaatttagaatgccattatttctgctgcctctttctcctttggatttcattaataatagtactttcatgccaggtacattttctttatgtagaattgtttttgaaattttcctttgatttttcatcctatctgctgtaattactgtgcatatttaatcatgtccatataagcatgttaattgttcagtgacagaagtagaaggtgacatggcaagagaatgactgatgtttagtgaactatttgaagagtacatctgagagttcaagggtacaaacagtaaaaatgttttgtaatctctatatcgctgtgtttttttaattgatgcatgaaagcactttctgcatcatttacacaaggaccatatgtatttacagttaaaatttaaatattttaagacaagaatgaatgtttcacatttatttttattttctggcattcataaaaactgtagaggatattctgagtttatgttgtaaattgtaattttccaaaggactggcaatttatggtttttttttttgtttgttttgttttgtttgagatggagtctcactctgtcacccagactgaagtgcagtggtgtgatcttggctcactgtagcttccgcctcctgggttcaagtgattctcctgcctcagcctcctgagcagctggggccgcaggtgcctgccacgacaaccggctaacgactttttttctgtatttttattagaggcagagttttgccatgttggccaaattggtctcgaactcctaacctcaagtgatctgccttcctcagcctctcaaagtgctaggattacaggcatcagccaccacctctggcttgacaactagtggttaatgaaaatatcaaagtttgacaactaacttgggttttaaatagtaaaataaaaaatcattctaataacatttctcagtctcactttacacaaggaataagaaaagtgatggaagaagagacgcttccctggtaatgtgatgcttaaaatccatgtttgcctattacgatgagaacaatattttggcaatctgagaagataacttaggatgttagatctgagggattgtctatactttgtaggaaatgatacttcgaattccagagttcagctaaggctgaaagttaaaggcaggatcactcaggacctggaactgcagcaccgtttctgcatccaaaactagctgtgcaattgctgcaaataaaatctgagcctaaaggcacaatatttgtccgaagaagccagagaagtcccagtttttctttaagagttttacaagcaaaagcatatagaaagccctgataagtgacaggagaaggagtgggaggtaaaaaatgtattaaaaagcaaaagaagtctatagcactggagctttaagagtagtctccagaccagaaacaggatcacatgggaaataggttagaaatgcaaaattttggatatcttcccccttctaccccagagctactgaaaataaactatacaggaagagaatcagcaatctgtttcatctgggtgattctgatacaggagaaccactggactgtagacttgatcaagggtcatttagtgtgtggatcaacaacttcatctcccactgaaggctctgttttattacatcataagttggtatttatgataagaaaagagtatccaaagttttagttgtctatttattttagtctgtttatgaaggcagataaatcatatatctcaaatagcttctcatcatctttcttgggggcatttgaagtggtaaccttgagctgtgaaatccacttgtgttctaaaatactcaatttctgcacaatatgggataaatatcatgttaccatattgtgacatgccatttataaatgaagaccagtcacacattcctgctagatttgacaattattctccaaagtaacctctaaaaataatttgacaattatgcccccaacctctgttgctggtgctattgtttcctttaaaaatatgaacttaggttttaacaagaaaaaatacctttctaagatttatatgaacaatgcttaagatagatgatctttatagaaaggtaaatgtgttatgtttcttctaaacacatttttctacactacacaaatttaatagtgaaaatatatgaacacagtctgctttctgaaagaatattataaattattcctagacttaaatttgcatagtcgttagaggaaataaatatgctatctggcatattagagaggatatctaaaattacagataactagaagttcatttctagggcattagacattttcattatttctattattgctttattattgttgctcttaagacatgaaatgaatttttagaaatgcccctaaatgcctttaatcaaattacaaaaaagagcaccaattcttctgagttgatgctggcactgccagtgtgcactggcttagagagctgagctgaaggctggatgtcagctccacttgtccctgggcagagacctctgtgcagtgcacaagctgacacagcctcccccaagctgtccactgcttgtcaaccatgggtcacaaactgacaacctaacgtccaaatgtagcctacaggctttgtttgttttggcctagtaagtagaaatagcttcaattcgtggccagtagttttgaattagaaaattttgcagaatcatctgaattcctctggaaaactagaagacatggcaacctggaacttccattcctgactagtaacaattggccggggctaaggggcaacttccctgctagaggaacatgtgctcttcaggtcacagttcccctgccttcctttgtattcatctggcctctgtgaacatctaggtttacaatttggtatgactcaatatagtcatcacctcttccatttttctctccaggtaggtttaacaacttttaaactctgtgtccactgaatcaagtacagatttacatagcagcatctgtaacaactaattgtacctctttgtttacagccttttccctacaagacagtaaacttctgatgaccagagatcagcctattaatccatctctgtaattccagtgcttattagattgagttgcatgataaacatttgttgataagtgaaatgaactgttttttagaaaaatgtatggtggaggtagagaagcatacttcctatttcccttctgtactacgtaggtattgccgcaataatactgtctaacacactacctaaaacttagcaacttaaaatgacattttttttttctcaagatgatgggtctttgggttggtggcagttcatctgggctatgggatttagatcgtagattgggttcaagtctgccctgtgtgcttcttctgggtcataggcagaagggactacagctacctgaggcattttctttccatggtgatagcagaaattcaagggagaaagctccacaatgcaaacacatttcagctcttcttacattccatctgcaaacatccaccttggccaagcccaaagtccaggggtggaaagtaacttccacccaccttgaaaacttggcaagaatgttaatgcagacatatgaagaattgtgatcaataatttaatccagggccaaaattagggtaaggcaggtgaggtgcaaaatttaagaggtgccaaaaatctcgtaataaagatacatattttaatacttaatttttgaaaagcaaaatcaacgcaaacatccataataaacaaaatatacaaatattaaacacagaatctgaccacccatctgcatggctcacctactcacctcacctgcttcattgccctgttgggtcttatctcaatatcgatcccatctaaaacactcctctgagtggcagttaacaaactgctcttgcttgtatcttgagtctctgcattggtgtgaatatttgtatcaaaacattaagaattcaagtttctgggagttttattaatatataattaagctatccctagaaaaacagggtttagggcaagtagtttttaacacaaaacatctttaatttgtaaaaactaaattatgtaaaaataacattccactagaagccttttagaaaagtttgcattttttcttatacaatgcaaactgtctatatatttgtactagtcaactccttatattgtccaaatcctgaatttcatcatctaagcaagaccagtttggcatcagatttaagcaagatatccatgactacgaaattccctatagttggacttgaggggtagtaggagagctgatatagcaagaactttccagtccacttgaggatgtttctataaactttttcaatgtaactgacctcattacactctgcgaaggtgtaactacacgtatcccactgcctcttgggtcagtcaggcaaatgaaaagcaatcatatcactctttaaatgttttagcattttccagcttggactttgggaagtgggatccagtctgctcatgggatatgtgttgactacctcttatggaaggggccgttccatgccatgcatgctgccagacagttgtgctactcctggctgcctgggttccttgaagtccattcccagtgcaggacaacctcacggcaacattgacattgcacgttcaagaatcttaaatgattcttactgaatttcaaaccttgaggagaggacactgtggtggtatcagtaaggatagctgggacatatttaagaaggactgagatgaagtaagacctgaaagacaagcgtccacaatttctacctctaaaaggtagaaaggcatctaaccatttaaaaaatacattatcatgaacaaaacacagaaagatgtatatctctgttggcgttctagctaaataaaataatagcagtatgaaaaatttttaaagggagatagtaactggaaaaatctaaaagaatgttgttactgattcaggatatatattttcagtgtgctgttccatgtgatatcatgggtattttatttttgtgtacaatagcttcatagggactctgcagaagttattcctgagtcctatcttttaccaatatcattatgtttaatgaaatcataagtttcttatccataattctatcacagtgttgatgtgtgtgtgtgtgtgtgtgtgtcttatttcccaaaattggaaaatataatgagacaagagcttctatcattatgaatgatattgaacaatgatattgaataatgatcaatatctttcaaagctatcatttattgaacattagctatataccggatactgtgcaatatatttcatgtgaatttatgcttctcttcattacaacccagtatacatctgtctccctattttacaaattagaagacttagattgagaaagggttaaatggcatgcctacatcactgatagatgtccaagttaggattcatgttcaccttctttcttctcctccaaaactgaatccctatggggcacccctgctttgccattcagccttgagactatgtttcagctgctgtgtagtttcccttctcatcacactaataaacactacattcatgaagggttgttttacagcagactttattcttaacatttacatatatcatttcctttaatcctcatatgtcatatgttgttgttgttcaccattctacctgtaagaaaactaagtctctgagagcttaagtgtgttgcttggtcacacagctagggaatggccaaatcaaggttcaaacccagatcagtgcaactctagatgtcatgcttgtaacccttatgcaaagctgtctccagtcatgccatgcttcctctgtgatacagcaggaaactcactgaattaatagtcacagatatcaggtttttatcccagatgtggctattgccaagtcctgtttctttatctgttaaactgtgattaatagtccctgccctgcacaagtcatatcattgctgtgagacttcaaccagaaacaaggacagggaagcttgaactgcaagctcttgttaaagtactgtcagcaacttgagaggctgagactgctgtaacaatttgctttgtatctcacataagcctagaagagttcttgactctgaagcttatcaggacccagccggaaagcaaatacacataaactgctggtaaaagaaaagtgaagggcatttcttggaaatgggaaaaggctcttcctccttcccctcctgcccctacttaggggcagaaccatcccaaaatgtaatcaagaagaacagtttgaatactcaaggttttatccttcctcattaatatgttttccattatttgtacttccattatttgttcagttctattttcccctaatttgttgcttcttggagtcagcagtgagtaggaaatgccaatggctgatgattcctcaaatagccctgaagatttaatcctaagttctgatgacccaagtatgtgtggtaaagagatgactgctttcctcttgccttcaaagtggttttcagcagtgctggtctcagctctcttgaacctgcaggacagacagtggcaacactcttgtcaaggagccagagtctcagattataacatcttggtgataatatattttgcctgttgccaaagcatttcatttaaaggtttgggcacatgtaaatatatttctggctttccttttctaagttccctcctctaacctctttagtctcaatttgagtttatttccatcatagaaaaaagaatgtagaaggctaaagccccattagtaatacagtagtcagggacatctcacctatttgacaattatttattgaggacctatgtacacaggcactctgctaggtaccaggggcatggttggcactggagacatggttggctgttttctgccatttagaagcttaaactttccatttctatattgtttgaaggctgtgattatcttcctgataatctacgtgctctttttatacttctctccatcaaatttttgtatctgtctcctgattcatcaagttatcccccagaataggggcttttagggaaattccacagaaacctgaatttcctactctctcttaattgaaaacaaactctaatttctggacttactctctctgtgtctatacaaacctgtccatggccattttcccatcctgggtgtgtcatgcagccaggctgactcatctttccttgtaataaatcaactctttaaaaaccatcaccacattataacacatctgagcatcagcactctgacaatagaatataatttgatagcagaaggctctaaacaaattcctttggacaagagagatatagattatataactcacacccaaagatatttaagtcaaatcaatgtggccaggccatttaactcaccaagagagaagggttacagtcggttacttaaaagcctccctatcttttaccttatggatatgggcatatcaagactgaatataggctgggcgtggtggctcacgcctgtaattccagcactttgggaggccgaggggggtggatcacgaggtcaggagatcgagaccatcctggctaacacggtgaaaccccgtctctactaaaaatagaaaaaaattagctgggcgtggtggcgggcgcctgtagtcccagctactcgggaggctgtggcaagagaatggcgtgaacccgggaggcggagcttgcagtgagccgagatcagatcgcgccactgcactctagcctgggcgacagagtgagactccgtctcaaaaaaaaaaaaaaaaaaaaaaaaaaaaaaaaaaaaaaaaaagtctgaatatatctctttagctatgaccaccttgaaatggataatcagcattttctcctaaaattccagatttttattccaaagcatctcctggcttgttgctcggtcctgcattgccagcaagctagaagccactgttcggtaatgtttcagttgagaatgcacggaccttgagggttagtttgccctcaatcacagtgggcaggagtggcactgacatgagaatctctattttcagagttctagtccagaatttctgttacactaacctgcctccatagggcatatgtactttacaaatctttttttttaactttaaaatctggaatgcatgtgcagaatgtgcaggtttgttacacaggtatacatgtgccacggtggtttgctgcacctatcaacccatcatctaggttttaagccctgcatgcattagatatttgtcctaatgctctccttccccttgcctcccaccccccgacaggtcccggtgtgtgatattctcctccctgtgtccctgtgttctcattgctcaactctcacttatgagtgagaacatgcggtgtttggttttctgttcctgtgttagtttgctgagaatgatggcttccagcttcatccatgtccctgcaaagggcatgaactcattcttttttatggctgcatacaagtcttttcaaaataaatttatatttggaaagcagtatgtagactcctatgggaaaagtatcatttcaacttgatgatagctaagtattctgaacatgttaattaatgttttattctccagatatgtagttagatctccaatagcattagggtcaacattgtgtcattttgcataaattgcaaacacattacaatttgtgttattattactaatagttggataggcacccatgcttatttccatgataaggagaatataggcaagtgtagaaatttgcagtgaattgttcaaggatgcccaactagtatgtatgatatggggcagtattttcaatgaagatgtgcacatttgctgggtctatagatgtagataaaattattgtgaggaagtttatatgattttgtattagggctaatctagctttgaaaaagatcaatctatatattatgatcacttcttctctaacctgacacactgttcataaaatgtgatctttcatattccaaatgaaatgcatttttttccctttctctatgccttaaattgtccgtgtccttattttccttattttaatgttttctttttctgaatattttctcaagtattttcaacttgaaaaggagtatatgaacactaaaaataacttcaaacagttcagcagtatctaaaatgaaatgtaaacatcccctctattaatgtcttcctctcatatgcacatcacatctttaagtgtttctcagatatttaacaatctacacttggaatctgcttgatcaagaaaaaatgtgtggagggagaagaccccaactattttcttatctacttatattccaggactgttgtgatgattacataaaatagggtatataaaagtgatgaggaagttagaaaggccataccaatttaagttactgcattcattgtatgaaaagctttctactcagctcaagtacccccttttgtctgtatagctttggcttttgtagtgcttagtgtcatttccataaacagagctaatttacttctttatatgttgacaatcatttaaatgatttctcacttatttaaatcctataataggctgggcatggttgttcgtgcctataatcccagtgctttgggagatcgaagtgggaagattgcttgaggccaggagttcaagactatcctcggcaacatagtgagatcctgtcttacaaatatttaaaaattagctgagcacagtcacacatgcctgtagtcccagctactcaagaggctgaggtgggagaattgattgatcccaggaagtcaaggctgcagttagctatgattgcactactgcactccagcctgggcaccacagtaagactctcctgtctcaaaaaaaaaaaaaaaaaaaaaaaaaaaactcataacattgcctttaatacctctctaatattccttacatcattctacggtatttttatctgttgtgaagtcaaatatgtctctggctcaatccccaagcagtaaccaacatcccttttcaaagaagatatgcttatcaaatatttacgttttaaatgaattaataaacaggtgagttacagaaatatttcaaagtcattgtgaactttcattctcagtgcttagataacaagtcttaccaagacatacagaagtgtccatacatcctcaccccttctctatggttgccccaccgctgttagagcagtcccaaacatgagacaacaatgcacagcctcgactgatgtcttctccagggctttccgcctctgtgacccagtccaaattctcccacaggatatattgggtgattcctgctgagttcaacctgtatctgcctgatccatttgctagtggagtcctttggaccttccagaacagtggcctgtccctacccactgagtcattctaatgtagcactaaggcaagaacatgcagcttatctatttgtatcagtgactttcaaagctgcctgaacaaatggttctggctggatttatttcaaagcattgactacggcaggcagaaagcttcctgccaggcggttatatttaccacacaaatttgtcagcttaaccaaacatttcagtgtgttaggagcaggaatttgaattgattgatctaaagggctcaaacactatgaaagagatgaaggtgcatcagctgacattacagtgtctgcacgagtccaaaatgatcactaaataaatgttacttttcagaaagattgtgctgttatcttatctccctcccatactgggtttgcaaaagcaatcggagtttcatgagtgttggaatgtttaggctaaaacaccatggtgatgttagcaacaattttgaggtgccctgatatgtttaaattatatagcaaaaatactattataaactctgagcaaaattgtgggacacagggatctttgaattcttactacagctttcacatcacctccatttatatgtacctgtgttcaacttccctttcattaaaataggaattattcattttcatcgtattgctggcatactctcttcataatccaaccttaggcttgcaataaaaatcttcacaacccaaataccatgagaatacttgtggttaagcctagaaaatattaactgatcactcaagaatatatataacaattttcagtatactagaaaaatatcactagtttttttttcagtattttttggagatgaaataatcatactgtttgtaattgtcttaactattaccagctttatgtaatttgtcattttactatattctacatatgtactctaatttagtctgacttattttattctgccaatagtcatttggggaaaaattacagtagtaagacagaattttctgaacatttaagatcacattcaagcaagaaacaacatattttgcaaatgggtcttaggaataccctcagagaagcgtagggaaatatttgagaaaggtcttatggttctgcaaggatcttggaatctacaaggcagattaatagcccaattatttccacaaagctattgccaaatttcttacaactgattatttaagaagcaatttttaaaagccacattatttatattaattgaataacaatataaatggagcaaatggagttgattcgttcctcagtctcttgtaagtctattgtggtaaattcattatagagaggagttgtataaatattctaatttcaatttctctaagtcataactgaataccagcttaagttatgtctgtatgctttaaatattttttaaggtggtaaactttacgaacaggtttaggttcacagcacagttgagcagaaagtacggagttctcataacattccctattttcatacatgcacatccttcctcactatgaccatcccacgcctcaatgatgcattcgtgataatcaataaacctatattgagacatgattatcacccaaggtccataatttacactaggtttcacccttggtgttgtacatttgtgttatatgggttttggcaaagatataatgacaagtatccattatagcatcatgcatgatagtttcattgtctaaagaatcctttgtgctctccctattcatcccttcctgcatgctgtgccctggcaaccactcatctttttactgtctccgtaattttacctttttcagagtaccatgtagttcacatcatacagtatgtagccttttaaaattggcttctttcacttagtaatatgcatttaagttgctgtatgagtttagtagaccttttttttttggcaccaaataatattccactgtcaagatttaccagttgatttattcatttacctatcgaggggcatcttggttgtttccaaattttggcaattgtgaatagagtttctataaacaactatgtgtagatttttgtgggcatacattgtcagttaagttgggtaaatatcaaagagcataattgctggatcatatgtgaagagtatgtttggttttgtaaaaatctgccaaactgtccttcaaagtggttgcaccattttgcattcccaccaataatgaataagagttcctcttgctccacaacctggccagcatttgatattgtcagtgtttgggattttggctattccaataggtttgtaatggtaccacattttttgtttttatttttaattctcaaataacataacatatgatactgaatgcatgttattaatgtatacttgcttgccatctgtatatttatcttctgtgatgaggtgactgtttatgtctgttgcccattttaaaaatcaggttgcttgttattgttgagtttttaaaagctttttgcatatttgggctatcattttttttttttaaatcagttgcatgtcttacaaaggttttctcccagtcagtgacttgtcttattctctaatcttgtctttcacagaacagaggtttttaattttaacgaagtccaacttatcaatgatctctttcatggattttgcctttagtgttgtatctaaaaaatcaaaaaaacctaagtcatttaggttttctcctgtgttatcttccaggagttttatagtttagcattttaaatttagatctatgatctattttgagttaattcttgggaagagtataaggtctgtgtctagatttttttttacatgtagatatccagttgtttcagtatcgtttgttgaaaagactgtctttgctccattttattgcctttgctaatttgtcaatgatcaattgactacatttattaactatatttgaaaatagctttctatttctgagctctctgtcctgttccattgatctatttatttattcttttaccaataccatactgtcttgattactataaccttatttagttatagatttatagtagtaaatcttgaaattgaacagtgtcagtcctccagctttgttcttacccttaaatattaggtttgctattctgggtcttttgcctttccatataaactttagactaagtttgttgatagccacaaagtaacttactgaaattttgattcagattcacatggactctatagatcaagttggggagaaattacgtcttcacacaatcagtcatatcaatgaccatggaatatttctcaatttatttagtttttctttaatatctttcatcagattttaactacattttcatgcttaatggattaaaatttgtaaacatgttttaattaagaggaaatatttttctctataaagctcaaatttgattttaaaatgaccaaagttagaatggacttcaatgaaacaggcaggtacactttttccagttgagttcaatttgtcaatagcaaggccgaaaacacgcatattgctttgaatctcttgcaacttcagtgccctaggattgatgtaaatacttaattatttctgagtacagcagacaattctctcaacactaggatagactatttcctgaaacttcgatagaaagaacaatcaaatggtgaagatatgtgaaaggatatgttgttcaaattaaaaggtttgctagttcagtaaaattgaaaaaatgtaatatttatgatcatttatgatctttatggaaccttaatgacctatcatttggagttttctagccattagtttatatattcattcattagaagtgtatggaaaactcataaaatacaaccaatatagtagattataactttgctggaaaaatagacatttataaataattataatataagggaactgaaagtagagcaatcgatatttcaaaaataagtgataatttgagctagttcttaaaatattagtagaatttttttcagcagaacaaaggaactaaagagatgcaagagaagagtgtttttaacaagtatttgtagaacatctgctaaataccatccacataattaatattaataggaccattatctcctgcattttatagacatattttcttttgatcacatatctcacaaatattgtaaatgtgattttaagagaagactataaagtatgtgtgaacagaggaaggctctctcactccactgtgggttttcaggaaggaccatgagaaattagtgtccagggcaagatctgtgggaatagcaagaacaaaggccaggaggtatagagagtaccttgtgctccatgtgcgaagaactcaataggatgtgagagtggtaaatgatagaaaatgaggtttaagaggcaagcaagaacacacccacagagccttgcaaactaccttaagaacaccaagatgtcatggatagttattatcaaggaagtaatatgttcagatgagcattttacatgactgtgcctgctttagcacagattgggagaagaggcaatgttagaagctggaacaccaataaggctattgcattgattcaagatactataatctcctgaattagaacagtggtatggaaaatgaagtgcagcaggaaagcacacaaaaaaaatggagtggcacatgctctggagtgaggaagctttgtttatttctttgtcaaatcagcttgttcttttttcatattgttctttctttttaaattatagtttctatttcttctatccttttattattttgtatgatttattttatagcatcttttagtttttttataatctgcatttttttgtggtaacaatctatcaaaaatagataatctatcaaaaaatagatttagaaatctatccaaaaatgtattcaatacttgtaacctgtaattattaataatattgatctgtgaatggtgtaagttggaaatttgtacttggatatgagagagaagcctaaagtggggaaattatcctcataaagcagaataaaaaatagcttttaataattccatattttcaaaagataattttcaagggtggttaagacacaggttggtattaggatacaagagacaggaaaagaagtgaggaaatatttcaaaactctaggaatcagcagttgatgacctaaactggggcacggacaatgaaaatggagacacggaaacacatcagagacagaaagatcaggacttggtggccataggcatttaggataaagaaggatgtaaatttaaagataactcacctgagtgacagatgaggaggtgatatactcagctggagaatattgaaggaggagagacatgttgtcgggaggggtcaggaatgagttcatttgtggatactctgcttgaagtggctcaaggaagctctgaaagtggttgaagctagaagtaaggatttagagcaagcttgtccaacccacagcccgcgggccatatgcagcccaggatggctttgaatgtggcccagcacaaatttataaacgttcttaaaacactgaaattttttgtaattttgttttttagctcatcagctatcattagtgttagtgtattttttgtgtggccgaagacagttcttctaatgtggcccagggaagccaaaggactggacacctctgatttagaggtcatcaatttggtttagtttttgtgaataaataacatttcaggggggtgagggaagaaactataattgtaaataggtcaagaattgaatcgtgtgaatgaaagagagtaaaaacagagttttaaatgagttcagttggctggatttgcactgataaaacatgaggaagtaactaggtagaaactggtttgcttttcagagcattcatgtttaagccagtcccagaaaattgttcatgttaactcaaatttataagtgatggaagactacttaaaaccaactgattcactagctgtgtggtcttggatgagttattgaaccctctaaacgcaggcatatacacttctgattcaggagctacatttgtatgtttgttacatggatatattgtgtgatgctgaggtttgggcttcgatggaacccgtcacccagatagtgtgacgggtttgctcccctcccttcctccccactttttgagttcccagtgtctgtcattcccaaacttaagtttatttaaattttaagtattgaaaataaaattttgtctataattttatcaagcactagatgcagttttttaaatcatcacacatgggaggcacacaataaataatatttattcataatggttccaatgataaaatgactgccaagcagaccaagatatatctgctgtttttgctatgcatctggtttacaaaataagtcaatatactattcaaagaatttcatgggatactagtatgttttcagagtctgctggtgagcactgagtgacagaaaggttagctgggggaattaggcagtgattctgtatcataattgtagctctgaaccttcttcgaaactttgattttttatgtgtatacattcctgagccctactgacttcatgctagacactgaaattaccagaaaacaacagcaaaatgaaaaggtatagtttctactaacatggactttaagtaggcttggagatacacgcacccacgcatgcatgcacacacgcacacacacaatatagctactcaaaattttcctggagctcgaaatttccctgggtttcaaaactatagattttaaaaaatttctaggttttgtgtatattacaaaccttgtagtgttagagaatgacagattaaggagggaaaacttttatcaagtaaatatccctgaaggattttcctgtaattaaaattttttaacatttgtgataaattacataaatcactacactttacattgccagcagaaatcaggttagacttttacatctttcaacttctgggtctgtcactcatttcttttaatgtctacatttttaatgttgctttaggcctgctgtctctactttactaattgacatactttctttttctttttattctacccatttgggaaactcatttatttttcttcaatcatctttaaaaaattgaccatggttcatcacagtttattacccagtgactccaaaatcaagatgacatatttgatataaatgtgatcatgttcagccaccattgcacaacattgatagaggatcaaagcgtacccaacattatgatatttccttgtactctttactgacttcattagcaaactgagctttgtaatttggcttcctctccctctttaatccctccaacacggttactctcataaaacaagtcaaattcactttctgtgaactccaagggattgttcaaaatcaagaccttattgatggattgatgtttgaagtaagtaaataacaggattaaaaatatttttgccatatagtgatattattttatatttatatttttgtagtaagactaaagtaggtcacacgctgaattttgatggctctttagagagccgtacaatttcattgcttcctataatcaggaccaatagtacccataaacacatgcttatgttaattgagggaacttaacgatttttaaaaactctatgatacagcatttactaaatatttgaaattctatgttgtatgctaagaagttatttctaaagaaaggcccggtgtgggggcctgttgtgcggtggggagagggaggagggatagcattaggagatatacctaatgttaaatgaagagttaatgggtgcagcacaccaacatgacacatgtatacatatgtaacaaacctgcacgttgtgcacatgtaccctaaaacttaaagtataataaaaatataaaataaaaataaaatgcataggacattgtgcactaagacacaatgatagcactgattctgagatctggcaaaactttgtcatgacctattactggatgaaacagcaacgatgatctatctttatatgaaaagttcagtgctacctttctgtaccacaataatggatattggggtccttgtctgacagtttatttcagaactgagccaggaagagggtatacacttccctgatcactgctgaaggaaagcaaaggctcatgctgaaagccaccatctgcatgataccaaacaccacaaagttggctatgcctccctgcacaaatacattgatgcatttgtatggcttaagtcatcgagttagtttcaaaaatgtttgtaaaatttgtttgacttttgacttcaaactatactacaaggctacagtaaccaaaacagcatggtactggtaccagaacacagatatagatcaatggaacagaacagagccctcagaaataatgccgcatatctacaaccatctgatctttgacaaacctgagaaaaacaagcaatggggaaaggattccctatttaataaatggtgctgggaaaactggctagccatatgtagaaagctgaaactggatcccttccttacagcttatacaaacattaattcaagatggattaaagacttaaatgttagacctaaaaccataaaaaccctagaagaaaccctaggcaataccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacaaaatgggagaaaattttcacaacctacttatctgacaaagggctagtatccagaatctacaatgaactcaaacaaatttacaagaaaaaaacaaccccatcaaaaagtgggcaaaggatatgaacagacacttctcaaaagaagacatttatgcagccaaaaaacacatgaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccaatgtggaattcagtgtggcgattcctcagggatctagaactagaaataccatttgacccagccatcccattactgggtatatacccaaaggactataaatcatgctgctataaagacacatgcacatgtatgtttattgcggcactattcacagtagcaaagacttggaaccaacccaaatgtccaacaatgatagactggattaagaaaatgtggcacatatacaccatggaatactatgcagccataaaaaatgatgagttcatgtcctttgtagggacatggatgaaattggaaaccatcattttcagcaaactatcgcaaggacaaaaaaccaaacactgcatgttctcactcataggtaggaattgaacaatgagaacacatggacacaggaaggggaacatcacactctagggactgttgtggggtggggggaggggggaaggatagcatttggagatatacctaatgctaaatgacgagttgatgggtgcagcacaccaacatggcacatgtatacatatgtaacctgcacatcgtgcacttgtaccctaaaacttaaattataattataataaaattaaaaaaataaaaaaaagtgaattaagactccagtaaaaatttggagccaatttgagtagacagctctcaattccatttttaaaatatcaagggatatagatttttttaaaaatttttatctaaagatctttaagtatttttatttctttatatcttattttccataataagcatgcctacatgatttatgtggaaaaaaaaaggcccggtgtgaaaaatgttttctaggagaatgatattaaattgatatataaatatatattatgtataccttaccaagtgagcacatatttccttaatgataaatgatacttctaaagcagaaagcaagactgtgaagcaaagacctgcaaatggatgcaatttagtgaacaaaagagggatgcgactgcctgaacatgcacaggagtctgaagtggtcaggtctggggcacactgagcatgtgtcctgggaaatagtgaagcaggatgaaggtggagggcatttttgagtgggaaggtgttgtggaggccaggttaaagggaaagtatggaaatgcacagggaaaaataccttgaattcttaaccgtttggcccagggtgaacacttggtgcaaagagaattctaacacttccaggaatgttttaaacaatgctgtttttgctttggagcagttacttatattatctggcataccttgttcaatattgaaagctatttctgattatctctagttttttttttttttatccaaactctcagagcatcatcaagtgtattatagtcttagcctttgtaagaattggtaagttcacaaaacattttatttagtgcttaccttgcacaaggcttgagagattttaaaaaggtgcataaggaaaattcctaacctcaaaacatgcatattacaatcactagactttaatggatagagacagccttgtaaataaataattctcttgatatgatatgataagtacagttagagacaggcatattcagaggctacagagcatagagagaataaatagctagtttcatcaatagtaaatttcactctgctctttttaaggaacttacctaaggagacttggaaagaagacaaaaactgtcttttaatctgttatgattgtaatttaattcagaaaaatgctcattccaaaaagggaaattctgaaatagtttaccaacattatagttcagaaaaagacatttaatgatgttgaatctaaagactaacttttcaaattgtccattatttgttaataaaaaacatgaaatgatataaattccaaaggaaaagataaggcatttttattaattcatccatgagggagcctgagagaaactttgtgattgtggcttttttaatctcaattttttttaaagaatcatggattagggctatagttgggtttattgccatgtacgtcaatcgatcgtaattgatttagtagtgtttgagggactgtgggtactattttctagtttaaaaagtctctataactttctgtcacaggatctgaaatcaccagagatttcttaaatgtttaggtcattccagaagtccctacttaaaatttgcttagaatgtctactagtttcctattactgctgttttaaaaaaattaccacaaatgtagtggctgaaaacaatgtaaatatattatttcacaatcctggaggccagaagttggaaatcagtttcaatttgcagaaatcagcgcgttggcaaggctgcagtcttctaggtgctctaggggaaaatccattttttgcttttttcagtttccagaggctgcctaaattccttgattaatggcctattatgccatcttccaagccaacagcctagcatcatctttcctctctgatccctgcttctgtttctacttcttcactctctgatcttacccttttgcatctctcttttgaggatccttgtgtttacattgaggccacccagataatccaggatattctactcatctcaagatccttaacttcacagctacaaagttcctttcaccaggtaaggtaatatatgtgcagattccagggattaagatgaggatatcttttgagggtcattattcaggctatcataaaggtaatactttaaatgttgctgtgatccataaatattatctcagagaagactgtaaggacaaggttcttgaagaaacagactaagtactagaagtcaaggctagattgacaaaacaggctagaaaggacatgcttgattttttttttcttaaaaggaaaactaccacaaaagggtaaaaggaagattcctcctcctccaaactatactgtgtaattttttaaagtacaaatttctaagcaatgagaaggtcataattttatccacttttctttagctgatgctattgccatgcaccttatatatttaatgaccttgcaaatgtgaattccaaaaatagggttaaaactatggcagagaaaagtaataataatttttgtgtttttttctttctgcattgcttgttcttcagaaaggtatttggttatttcaataaatgactttagaatttaaagcttaatttttttaagttattctgaaaaggacactggaaataaactatcccacacacacatttttactgagaaagtacagtgtgtcataagtaatttatatttgtggtctaagatcatacttggtggcaaacccaaacctggtacacaggtttcctgtcttccaaatgagttctctttccactggatccattagctcaatgatttgcacttgagttaaatctcagtgcaatatacaaactacccatgggcatcttcctttcataaacccattaatatgagagccaggaaacattttctcagtacattcaataaactccactgatgtacttggctctgtggggacccataaaggaatatcatgcttgtcttccagaagtgcttctctccattgctaagaacttgaaaatacctgagatagactgctaggaattcttcccaaaaaaatccatagatcatttcccatagtaaacaagcaatcctatctaacctttttcccttgctattttgaagccaagatttaccctgaagcaaaaagttgtttgagcagggggttatggcatggtcatgaataaagagacattgcttataaactctgctaacttgaatgattcactttccaaaaatgagcagcataaggagagtacttatttatttatgctttataatatccaagcaaacaaaaataatttttgtactgtttttgaattgcgcaggcattccatacacttttgagagctaataccctgaacaatctcaatttttttctgtataccctccacccctaaaccctactttgtccatctctgctgtgcagtatcccccaggagactgacacaggctcttgggacagctggcttctggtggagggacagctggcttccagtggattgcccaatcggaggcaccaacaggagaaaatagataggacagtgaaaagcaagggttcaaaagcaaggattcttgggggcttttctccattctgtattggtctgtaccctccttgagtacagctatgttaggcgacagctcttccatggctcctactgtttgtgatctcacgatgggaatcactgtttctccctttgccccttcaggcctatcagtggtcatgactttctctgtttcaaatctctgggtgtatcccttaatccagcccactcatctgtaaccagtctgtttattaagctttgccttaattaatatgaaccacttgaattgaattttgctttgtaataggcttaagtcgttgacatgcgtctttcctgctatgtaagaggaaactcaacagcgatttgaacgtctttggagcccctgtgctctgttttctgcctattctactcctccctctggttggctcaccctatactaatggtgaggcagggaaaggtgctcagaagcagcatgcttaaatccctctgaaatgaattgacacatttccttttcccagtccagtatcccatgtttctgtgggtcttaagccctggtaagtagaatagcccagaaaatgtggataaaaaaccacacaatttattactttggctgtcctggccttgttttaaccattttatatataagtcctattgttttacttcatggcctcattctttttcatggagcaaatccaacccaaacgcctctgtagaccttctcccaaggtagagttaactgagtatggttggcctgcctagcaatactatttatttgatttgcaggtctctttcttaatgacaatgtaattactcaaatgtcaaaagttctctgccaaggcaaccaagtgtataatatgtactgtatagttttgaccaggaccttgaattcaagtgggtcattttatttctgtattcttggtaataatgcttgtgctaataggaatttgcaccattctaagactttgtcttttgaaatttttctttcctgttttgtgtctctctttctacagtgtctgtctctctcttcaagttctggttaatctatactttcttctagatttaccaccttaattttctgttgctttctcctcttctgatatattagatctctctctagatgagctttcacattcaatatgtttgcctcctgataacttcaaaaatatattcggtatatttatttagggaaaataaaaatgtaacccgtatgtaacaatagaaaatgaaatacagggacaggattttttggcaatataattgtggcactttatgcaagtaaaaattagataatgttgtatggataatggatgatgtaatatatgcctatgtagttatttaatgcatcttaacttgagattttagacgcattaaaatacacacattttactttgttcaatggtcatcagatttttgaaatttctctctttgtagttgttagagccaacagaataaagggatcttggaaaggtgtatattattcttctagcatttattaaccatctatactggtccaagaattagaatagattttggtattacgaaatttaataacgcaaagttccatcctccagctaccctctgaggagtcagagatttttaatggatcacgagatggagtttatagcatcttggtagacgttgttagggtaacagagggaaagagttaataactctgaggagggtgaccaggcacattttctactaatagtgagggtgttgaaggatgaattgcaatgcatcaggcagggactaaggaaaagtattatatagaggagagctccatgtgtgacaagacatacagacaggaaagaggcttgtcacagggcttggtggtgggtgggtgcagagggagcagctgtgtcccttattcagcatcccaccctctcttgttatcttggctctatcctttccctctgttactagttcaggaggctcggagtctcactctagctattgccctacattgccctcttcatatcacagcacagacctcaagataatgtttggaatttacctcttaaccatccactcatcagcaatggaaactagattcaaacaaccagtaaaattattctgtaaataatggccaataaaggttgtgcttacagacgcagtggaatctttttagttctcatgtaatttagctagggataccagataaatacaaaataatttgcatcttaaatggtaaatttaaatttaattagtaaaatctaaatttccaataaaatagctactttttagtgtaagcagtttttgtgatatactaaaaaatatttgctgtttatctgaaattctaatttagttaggagtcctgtatttttccacattaaatcaggcaaccctaaatttcccccttcggatgagactctgtgaacctctcacattctctctcccttagcctgtaagttgcattaaaaaacaacaacaacaaaaaaaaacggttctcctggtctcacttttcttcttcctctagtagcccatctctagttattcttgttctctagggctctgctctttgttcatttctttatgccaacatgcttttcctggacaatttaattccctttcttggtttttactgctattcacctatgacttccaaatctctcccaccatccaatatcttgcctttgacttccagacctgtctatccagtgcctactggatgttttcctctggttgtcctatgggcatctaaagcaccaaatagctgaaatgaacaaacaatctttgtctccaaattgcctctcccttgaattccttatattagcaaataacactaccaccaaccaaattaccgaagtagaaacctgggtaacgtctcagtgtcattctttcccctcacttccattgaccattgcctcaatcagccaacaatgattctttataatcctcctttacaaaatgctataaattccctagaacctacttagttgacttacttatctcaaccagattagcctctaatgcaatttccttatttgccccgccccccactctctctctctctctctctctctctctctctctctctttctgtgactctctgtgtctctctctctctttctcatcagtcctctccaacattctaaagcttctaatttgaatatatttcttaattgcttatgttttcataaagtatatttttcaggataggctgaaaagtttaaattagatgaattatattctccacaatcagatccctgccagccttcctagccttatctctgaggattaaagaagacatatgactggtttcattgtttcttgccttgtgtgtagcaggtattcaataagtatttgttgtacgaatgagagaatgatagagatcatttttacagagtgaaagctgtttgcaatgttgtcagagaagagaacattcaaagtacaatgataagagttcttacatttggaagacttgatttgacacataatatttaaaaaattacttaataaagaattatgattttatgggatttctgtatgaatgtcatacatagaaatatttagatacatataaatcttaaatgctcctaggaagatatatatttacatacctacttaaatacactgaatctgttttactattaggaatagccaataaatattgacattctgattgtttaaatcttctgaataattaatcactatttttctaacatttagaatatattaaaatacaatccacactgtaattataggtggcataattaaacctttgtcacatgtaaagatagttcagaagactgtaacatttaatttatctgttataatcattttgatttatgagaaagtggagaagcctattttcagatgatatgtatttttcagttttccaaaactcaaaattatcacataatatataaaatgatttctaagtatgtatatatatcaacattactctccagtgattttaagtaatggagatttttctaagtgtaaacctaaagacatattgtttagaatatggtataaataaatgtgtcttttaaagtttaaagactactcaaagcattgttatctactaaataagtgtgggaaatttaatttaaccttccagataatgtgtgtgaatgaaaagaaattataaatatagcatggggtggggaggtacttgccattcataaaataattccctttggtatgccatagactaagcattgggagaattcatgatgaataacacaattccatttgaagcctctgtagaattatttctatgtagttagtaacaagtggagcttggggtattattaggcaaaattacaacagcagcacaccgctgtgcagagaaagatcagggcatttcgtctaagcagcatcttcataactctggctcctaaaactaatgttgtgaagcttcagttcttttgaattgaaactctggggaataagagagggtcataattattagctaggaattgatgctaaatttgtttattcactgatttttccaccactttctatagtatgtaaatgagatttttacttagaaaaaacattctgactctgagacagatgacagctgttcaaccccaggggcagaaaaaaaacacagctttttccttggccttttctttttcgttagtgcagcttctagagcctcattgaattttcccagaattccctgtgcaggagctttcaaattctgattgattagtcatcatatcagagcttaccactttgtagctcccctgctaccaattgaacattatgaacagggcccagaaaattagcttgctcagcaccattgggattgtggcctgtttagcaatggatgtataattccctatgactctagttagtagaattggcatcagagtggtatgaatagaatgtcttcagaaaggagtctgaacatcttttgcaagttgacaatatcgccttgagatacagggagaggtgtgcgtgtgtgtgtgcgcgcacacacacacacacacgcacgcacacacacaaacatatcttcccagacctcttggcagaggagattatagactgaagtagggaatgacagaagcaagaaaaaggaactcattctggtgggagatgggggagaggtggttttcaatggttaattcttctacctctaccacttttagcctgttacagtctgcaatatccccttagaaatgactcagtgatcacattattggatctcactcttgtgaaaacctcctaaggcagagagaagtcaagttgtgcagaaagttatcacctggcactgatgattgatcttaggtgtgacattttgttcctcttttcttatccctggatctctttcctgctatgtagtctccatacacaacaaactttaacagcacattgaggcatgaattcatcaagcatcctgtgctccctcacggcatcagaacaccacttcccctctgtctcctgacagtgagctcagaaattaactcacaataaggtgctgatggctaatttgaagttaatatgtaacctctctcaaaatgatgtggatttgaagcagagatgtgaagagaaaggcaatatatgaacatgaaagaaacaaatcacctccactggtcaaatatcctggtagatgtctggagacaaaccgtagggcagaggatatatttatatttccttcaaattctaaacataggctggtcctagtgagagtaaacaaaaacacatttatcatacttatcaattgagttattattttaaaatatgccttccacaattaagttgccttgggtggatttgtgtaacatgccactaaaaataccatgaaataaacataaataagctaaaattttcttagccttaaattgctgttctgttttagaataatatgggcagataagctccacagcctccaaatcaggaattagatgtgttaacagctgtttttaaaatatttttatgttaagggaaatacacgtaagtgtacatgaaaatttcttgcttttttttttttttttactctcgctataggttttactccatgtacatatcaagatggatatgtctatgtaataaaatatatcatatatttacatatatgaatacatgtatactgggccaaaagcaatgcaaaactaaggaattaaagtctgccttatctacactttcctcttctttgctatgttagcacaaatgtacttctcatttgagggaacatggtagaggagctgccatcccatcttaatggtacttgatgatgccattgaagagaagacatactatttatttggtgcttagcatttagctttcttgatatccatcactgctttacattaccctcagagacacatcactgaatacagttttgaatggttccatgctatgcatgatttttatgggggtgcactgagctgtgcagtctgcagccactgcattccaaacaaaagaagtaatcatctagacacagagaaatgggttcattgccaacatggaacaggaaagattcaatattcatgtttcgacagaccacttaaccagtgttttcctgataacacggtgctagaacctagtagatattcaatcaatgtttgttgaatggataaatgagtgattgaatagatgcattaggtatcttcaattgggtctttctttatctagatctttaatataatgcagtctatggaagatggggttatagcaatgtatttttaaattgacaagtattcatgtttaataactttagttaaaggaatcataaaatcctcaaatttatacaaatgataaagtttttttaacttatacctagtgtgaatttttaaatcacttaataaactgtaaaagtttattaagttgtactaaataatacgatgctcattttatagatttttcaaattgcggcatgtacaaatactggttacataacttgcttacccactggccaagtaggtttttgctctccctttctcatatttctgctccctaagtaaaatgttacatccttgcatctttcatttccagagctccaactctctgcctccttatttctgattagactagcatgagatttcctttcttcccatattttgtgttccatgcattcacagagagacagatcttagcacctgaagagaccttagtgatctgcagactgacttgcttcttgtggtgagaaaggtaccatctttactatgttacagaagaaattcccaagaggcctagagtatgtaggattcacatgctggtgtgaatagagaagaggatgctagaccttcaggatacttttttcttcttttcttaaccaacacattttcactggaggcttatttatctttcatttctataggagtgataaaactgaatgttttacaatttcattcggtagatcaaagaagattcattgaatgttttctcctgtgctttgggcacactcatgtcctgttgtatgtgtggcggaggtgtgtgtgtttaaataacagatgaccctttataatgggtacagaagatagataaaaattgttagtgtattagaactttttatgccaatgcttatttttaattgaaaaaaatacagtgaagaatatattatacatgtatataatattggttttatttttatgataaagcaagaaatgtagatactaaggtgtgttcaattaaggacaggccagatacaaattttcctgcagcttgaaaatcttgtctacatatcctaagaaagcatcttctgatattgttcacgtaggtagcataatgtcctgaaagtcaagatgcctgggtcttttatctggtgctagtattgccgggtgggagattgaggcatgaaataggttgtcattaaggtccattccagctttaacaagctattaatgaaatgttgattgtcaaacagaaaatgtgcattttgttggttgacggagccacatttgcataaggctgccccaaaccactctgactgttaataaatgccagaggacttgcagcaaatcaaaacacaagtgctgataaaatgaatttataaaaaaagagtgattattttgcttgaaaagccacagggtggcctgtagaatctaatgcagggaggctctgagaatatatgagaataaatagtaacagtgttttctgagcccacgttgtaaggagaatctaaatgatccagtatgttaccctgtcattttccacttgcaatgtagacagctaatttttatttttcagttttcattttaaaacaaaaccaagagatgatgactgcagtgtaagacttactttcctgttgggaggaaattgcactgtgggcatgatgtctttaactttaacctttaaaaggtataattgacttgtagtaattttaggttaaattatattgtgctgtgagttaggtcacatacaaaacactccagacatttattacggatatgttaaaagtttgttagattttatttccagaggatttcatttaacagatttctactctatattatactcgatctcctgaacaatattagaaacagaggacggaccttgtttctcttttgaattttctgcttccttcaagccatcattgttgaccctaaagaaaaaagtccacttcatattagccttcttggtctaccacaatagaacatcacaaactagtaacctcgaccacatataattatctttttacagttctgcaggctagagatccaagatcaaggtgctggcaaggttggtcttggttggggctttcttcttggcttgcagatggctgccttctcactgtgtcttcacagggaagagagagagagctctggtgtttctttcttttcttataaggatacagtcctgttgaattaggactctactctttttttaacttttattctaagttcaggggtactcgtgcgggtttgttgcataggtaaacttgtgtcatggggggttgttgtactgattatttcatcacagctattaagactgatacccattagttgcttttcctgatcctctccctcctcccaccttccaccctctgataggccccagtgtgtgttttccctttgatgtgtctgtgtgttctcataatttagctcccacttataggtgacaacatgtggtatttggttttctgttcctgtgttagtttgctaaggataatggcttccaaatccatccatgttcgtgcaaaggatatgatctcattcatttatggctgcatagtattccgtggtatatatgtaccacatgttctttatccagtctatcattgatggacatttaggttgattccatgtgtttgctattatgaatagtgctgcaataaacacatttgtgcatgtgtctttataatataatgatttttatttctttgggtatatacgcagtagtaggattgctgggtcaaatggtatttctgctcttgggtctttaaggaatcaccacgctgtccttcacaatggctgaactaatttacactcccaccaacagtgtgtaaacattcctttttctctacaaccttgccagctcctgttattttttgacttttcactagtagccattctgattgttattgaatggtatatcattgttgttttgatttccatttctctaatgatcagtggtgagccttttatcatatgattgttggctgcatgtatatcttcttttgaaaagtgttcatgtcctttgctcacatttttatagggtcatgttttttttttgtaaatttgtttttctttatagatgctggatattagacctctgtcagatgcatcatttgcacaagttttctcccattctgtaggttgtctgtttgctctgttgatagtttcttttgctgtgtagaacttctttggtttaatttgatcctacttgtcaatttttgcttttgttgcaattgcttctggtgtctttgtcatgaaatattttcctgtatctgtgtcttgaatggtattgcctaggttgtaggaccccactcgttatccttcatttaaccttagctagctactgaaaggctctatccacaaatgcaatcatatatgaggttaagacttcaatatatgaactttgcaagatgacacaattccatccatgacaacatttaaagctcatttacaaatgtaatctctccctttcacaaatatcttaattcaaaagctgaagataacttcacattttattttccagtctgactccagttgtaaaataaaacattagcccaatggtttcttccccctgaggatattctattctgatatctaacttttaaatatatgttcacttcttaaagtagagggataatagccaccatctgttttcactatcttacatatgcaaacacagagagcttacctctgcatctatttgtgaagggtacacagttcttcaaatgaaacctgtaaaatgagatataatgttttacattattctggaatgtcctcttaagtttgtaaaccttaactcattaattcatgcgataaattgttaataaacacttactctgtgtcaatcactattctaggcattggtgtgacaatggagaacaaagtttctccctcaaggtgctcaaaatgccctagtctaggtaataaaatacatggtcacacttctcgtgcagaaaaatctccttttctgtgtttattgttttatgtcatctttttttttcttacccctcataactaagctcagtcatttttgctgggaaaaatattgagaggaaaatgaaatgaagtgtcttataatgtgctcatctgtaaactgatggatagactagaacagtggtcttcagtcctagctatccattagaattacctggggagctctaaaaatataccctacctgggccccagggattctgatttatttggtctgtgacatgtcctgcccatgaggacatttaaaaagatcccagggtgatgccaatgcacagcctgaattgagacatggaatgaggtgatcaccaagattcttcattgatctcagtgtgtgaattctttggttttctgcccagatgtaaaattatgttctagaataagttggaaaagtcattcttgttcctctgtatgtgtgtatcctaggggctattagtgatgctttcaagaaaagcatatctgggccgggcgcagtggctcatgcctgtagtcccagcactttgggaggccgaggcgggtggatcatgaggtcaggagattgagaccatcctggctaacatggtgaaaccccgtcactactaaaaatacaaaaaattagccggacgtggtggcaggcacctgtagtcccagctactcgtgaggctgacgcaggagaatggcatgaacccaggaggcagagcttgcagtgagccaagatcacaccactgcactccagcctgggcgacagagcaagactccatctcaaaaaaaaaaagaaaagaaaaaagaaaaagaaaaaaaaagcatatctgcttggctctaatttaggacaactcttttgtcttttgatttaaataaaaatcacaaagatcaaatcaaattaaatttgtataaaattcaagtagtttacatgtagcatgaagtgaggggagtgcagagaagggtgggggtggcatgatactgaactgtacagctaaagaggcgcttgtatatcactctaagtgcttccgagtttatcttaatgatgatggttttgccattgaaaaagtattaagaagtggaaaacataaagagatctatgttttggaaatatcacacgagaaagacagtggaaaattgctggaagaggggcaaaaccaaagacaaatagagttcaggagagaggcaatgctagagccttagtttaaggaaagtaaagaaaaaaaataaaaaataaagcaaacagagaagtgggcaacaccttgaacaaactgacactctgcaggtcaatggagaagagaatttcaacaagaaagaggtggtcggcagcatcaaactgcatagaggccgagtaaaaattgctacatgtattgagtaccgaacaattttctaattgctttatgtgtattaagtcacttaatttgtataagaactctggaaggtagctgttattatcaactcattttatacaggaggaaaccaaagtacaggtggtattgtgccaaagaccacacagttcgtaaatagcacagtgagagtgtgaatctgcaggactcaattccagaagccatgcccttaatgacctgcgaaatgcctgttaggacaaagaacgaggactatatccacccttcccgctttacagtctcctatccattgtatcactctgtatgcctttgcatacccatggcttatttctcaaagtgagaacatacggtatttgattttccatttttgacttatttcacttagagtaatgacttccagctctatgcaatttgctgcaaaagacatttcattcttttttatggctgagtagtattctatggtgtatatgtaccacatttttaaaaatccactccatgggtcgataggcatttaggttggttccatatctttgcaattgtgaattgtgctgtaataacatgcaggtacctttttgataggacttttggaaatgtgcttttttaaaaaatatctcatgtgtgaaggaagggtacacaataaggtggtacttgagggtgacttagcataaaagtataattatatttgaagttggaagagatggaacacacttatagtctgttaaaaaatagccaagaggaatgcaaaagatggaggtacaggagattagtcattaaggtagtttcctatgaagacggaggagaggggaaggaatcagtttgactatctcttcctgggagataggaggaaaggaagggaggtgggaaataacagcatttaggagtcagaaagctgtgaaggagcatttacccaagaccactttcattcctccctatgaaatgagtggtgcagggcctgcccagaggatgggttagccttccagtcatatacatgacactgatccaactttctcaaaaggcatggatgttgctaactcactcaggttgcagctgtctttctcagtcagagtattcttcaagttgtattcgtcaaattcagttaatattccctctcccaagtaaggagaaagtaggttccaagcaaaaacacccctcagtcaaagaatagcaaataacaaccttttgcatagcttgtgttcagagttacccatgaggagtctgagattgatttgccattcactgctacctctcagtgtactgaatgagaagagcaccaatgggtaacatatccagtcagattggcagtgatcagcctgtctgtggaaaggatgtgaactgaattaataatactttgaactaaagcataaagaactttggagggaagatgtcttcaaatgaaatcccaagtgtacactttctccacctcttacttaacaggcggagtggttgcaaagggcaacttcaacaactttccacagcagcccagttactgtcagtgttacttgaaaaggagaggggatgtgagttctacagacagcacttatcccctgagacataggcacggctttcgtgttcaatcactgtatttaattcaattatctgcccccgccacccccaactgtctgccttacaggggaggttgggaggagagtgatgcttgatgcttctgcaagtcccaaaagatatgcattctttattagggaattcaatgaaggatgagctcttactcacccagctgcttcctctgggaagtcgtcatgcggctccagctgcctgcagcaggaggatgacatggtctgtgcaatgcattgaattttattttatttttttttagattgaattcaggtagttgtttgttttaaagagggcttattttaattcatctttaaatatcatatttttgaaggtgaaaaccatcacaaagtcctgttcacctctagaaatttcagggtccggttatctagacagttatagtcaggtctaatgattttccctcttttctttctttgttttatctattcatttgttggctcgtttcaagggatgattaggactacttctatacaacaattgaggtagagaagaaatagattacagttcaactaactatgttaattttatttttagcaataattctaataaaataatgcaatttttaaaattgtgacattttcatagcaaaaaattttataacataaaataagtactaaatattatgaaaacttatattttcttaaactaataaatgctcactctgtcaataaaaatgagtcattcagtggttaaagttctcttaaataatcaaaacttgttggttggtgaagaaaattatctaatttatctcaagaaatagttaattcataaagtgaaagaaaagaataggccatatcagagaacttcaattgaagaaatctaggctaatctgattttttcattaataagtcacaaaccttctaattgtttcagaaaacaaacatactgctatttttttttttttttactaaatacaacaataatgccaggaaggtatattataagccggtattttccaaatttgagcctatacatttttctttaagaaaagaaattcccagacccagtaatatacactctctggattttgagaaatactggctaagactttcaaacattccttgaaaatatcttttagcttcagataatcacaacaaaatataaaatttatctttatatggtcaaaattattttatattctgattttggtaaaagctaagaggcaaaaaaccaaaacctgtagaacttgtggacctatgagtttatacccatagactcagtttgaaaaacactacttgatggctatttaaccaacactagaactttttgacagttcttttctttttcatacatgtgttaaattgcctctctctgagccttatatttaattcagttcctgcatcctcctctcaagttttcttcacccttgtagaatctgaacaataatgaaaggattgatgacaatgagtatcttctgaaactctttacctaagggattggcaggcctgttttcttttccattctgattggaaaaaaaaaaattgtcctttgaaaattggtctcattaggagcttatttaatcacagatatgtctctataggtgttgccaacaatatatatttattgagcatcagttaaatgtgagattggtacaattaatgttctacgcaatcaataatattttttgattagaagtagtatacatctttatgtataactcactataagtttactgaagaggacatttaaaacatgtaaatttacatttttcttggcatgttgagtatgttgatggaaagattaggatgattcacatcaaaagataattatcaatacaagtaaatgagtaatgaaaaataaacagttatagatgaataatggagagaagagtttggggaagtgaaatttaagcaggatcttgaaagaaaaatagaattaggatagaagaaatcgaggcaagaaggcattccaggcaggaaacccaaagagttagagatgggaaattttatttggaggacagaggttagaacagaaggctgaaaccagatgcttacataaagagctttctaagatagcttcaaagacactgattgctaaggactttggactcagttgctggaggtgttgagcaggggaccaaaatgaagaaagccatgcttctagatgattaaatttacagagggaggatagaggggcaggattttaaaaagtatggaacttgaaaacttaattcagggtattgcttatttttgttgtctacagtggtatactcacaagagggtatagacagagttgtttttcatttcgagccatttccccagtgacaagtaatgagggcaatgcagcagatgacaaattgaggatggttatgacactaagagtttctcttctaaggcctgcttctcccacaggactgcagagttgagccagggaagctaaacactgtatatcttctctacctttgttcattgcccttcttgcctgctccttatgtctcctgcttagggcagcatttctcagactcagcaatagtaacatttgggcctggataattctttgttctgggaggtgtactgtgcatgggagtatgtttagaatcacccctgcctctacctactagatgccactagcatcctccttaccttcccaagttgtaacagccaaacatgttttgagatattgccagatgtccccaagagcaccaaatcaccctctgtagagaaccactaggttcttatagattatcctgttgaatgttaagcatttgtgatagaagagggataatttcccttcttgatggtaggatcatgactaggctttcagctttatgaggactgtaggcatcggagaaccacaaatgtcaaacatgcagtttcagatgctttctccaatgacacatccaactttcaccctcttcttctccattattgtattgcctgataataatgtcaactctccagttaactaataatggatcatcagtatctcctggtttgcctgggagagtgctggtttacatctgttttccccatttctatcttgttagtaactccttttactctataaagtgtctggggttggaaggtaaattatatgatgattctaatatgggaaatcactagaatcatgagaaggcaacaagtgaatattaggaaagtaagaggtgaaggggcaatttgccctctagcttccccgggtaatttttcctagaggagacaccagagttaagacttgaaagcaacattaggagttaaccaggaaaaggggcaaagacatttacaagacaaagggaacattggatgctttgcagggtgagacacagaagtggacaaattgaagaggcagaccaacatgctaatataaaaatccaaaagttgtttttgcaaactttacttcaatttttaatctacctatcaaatttttatcctatctgggaaaatgggcagtgacatttttaggctataaattctaaatgtgaataacatttatcttttgtaaaagaaataggattgattgctataaattgtccaaaagagaagagggtcagttccctagctttgggtttgtgtatgtggtgatattgaaatgcacccgtcaccttcttttccttttatctgaatgtttgtaactaagacgtaactagagaagatccagcataccattacacatatagatttcaaagacttgggaagaaatcttatttcagcatctgtagctggttttattaaaagcagtttaaattcctctgcctagagcagtctggaattatagagatgggctgcagaaatttacattttaattgaggcagaagacaaaatagggcacggtgcagcattcacacattacaaggaagaataaataagatatgtatcagctgggagaaaaaaatgactggtcgtttttcattgcctcctgcacttatttttttcatatggcactgagctgagttaggcctgctaagcaaagacgatttttccagtcaaaatgtttactatttcagaaagtccttgtgttgaaatattttcacactatggaacaaatacacaaatactcaaatgggcctgcatttggttgtcaaagtgtgtatggcactgtttataatgtctcaaatgtctataaatataaataacatgtcccaatgagctatatagaaaatgatttaaagtatgaggtataacagaatgattgatagacataatctatctgttaaacactgtaatttgagctattttatagtttcatagaaatagaataaaattttatagaaatagaatttttctctatagataaatttcatcctttgattagtgtggaagtccctccaaagagtgggaggacttaggttttcaaacttgaggatttacctgtgtttggtaatcactttgagaaaccactcattggatttttcttttctattttttgttatatgtttgatcattaatagaaaattaagttgaaaattcatttcctcataagggaaaaataataaacataaaaagtgtatcatgataatggcttttaaaagtaagtctttgtattagtgtaaatatgttttgtagaaatccactgtaattaagtgtgtttatccatttatttaagccttcaacttttattatatcttctttcagctgtacgtgtatttttacattcatacatgctctttgccaatcataattattttgttagattaattatagaatttaaaaccaataaacaacacattactatagtatgattatccaattatgattccctccagagctaagtactataattggacccatagtaagaaaatgtaattctttttccccaagtatgtgcctctcaagcatgacggtcaaatagattatctacttttagccaccaaaacatatcttaattttctttattatttgactatgactttccattttgctttttctagaattttaaaatgacattttattgtctttaaaaaataataacatgcctttaccttatcactaagattacatatttcttaatcacttaatcaccacttaatgtcctattattaaagtgaaaatacatttttcttaaatatcattttttcccttggagctctctggttctaattcgtgttgttgattgttcggctctaccacgtaactgtcatttcaggatatttttcctttttactcctagtccattcttgttaggctatgcttactgtttttctctctgtctgcttcctccatgcttgggtttcctttttggtttttgtctttcatttttgatattcataagcaatgtttcagaaaggtatttgaaaaaatgtttgagtccttgtaaatatcaagcatcattattttcatcatacttacttaatagtacagctgaaagttcaaaataattttccctcagaactctgaagacattgctttattgtcctatagcattcaatactgctgatgagaaagatagtggcaatttaattctccttcctttgtagataggcaatgtttcattttggaagcttttacgatattctaggaatctttggagacctgatattatcggtaggtatgggtcttgctggccacttaaccgcataacaaccactgtattctaatgagtgccgtcaatttttcagtcacagggtatcttttaactcatttttttcttttacttttttcagccatcttatttactatgtctttttttttcccttaaaaccattattagatagatgttggcatcctggattaattctctatgtctgttaatcttttcttattgtttctatttatttatcttttggctcaatgcaaaatgagattcttcaactatttaagcttttctactagtttcttactgatttttaagcttcaagaaccctttcttcttggacttctccctaaaactctgttctggttttatagttacagcagtttcttaaatcatcaatgggactattataagcttctttcctgttccttgcattatcttaatgccttttagggttggctgttctcttgggttaccttagttcctttggcctttgttattttctcaaggtttttagtaatcattgatagttcattcatatgtatgaaataggatgttaagtaatgtctctgtcaccatggaaaattttatccccaaatttctctctgctccaaagtggggctgaccaactaggttggtgacctggctgctttcactatggagttctaggaggactagcagtatgttggaagcttacagaatgagaatgacttaagtctcattcctacctgcgaaaatcattaagtttctttagagagtagtatcataattttaggaattaggagaaatcttattggtaatgatgcttcagcagggaccagacagtagtgggcagcgaatggcccagatatttcttagacagactttcctattttcctgcctcactttctatatttactttaaatctctgagtcttagtcataaagagtagctcccacctcctaagaggctttgtcctctgaaagttttaagtcttagtttcgcctgctttgtttaaaacagaaatatgttcctcttcttcttctctcttccatatatctatccaaaaagctgctccattgaggcctagttatcttctcaacccagtcttttttcagaactgttataagtttattggtttttatttttctcttctaatttcagtaggatttttagaagaaggcaaaaaaaaatcctgtctgatattttgtagcagaagctatatatatacacacacacatatatatacacacacacgtgtagtatatatatacacatacatatgcatatatatacacacacgtgtagtatatatatacacacacacacatatacatacacacacacacacacacacacaaacagacatatatatgcgcagtggtgtgatctcagctcactgcaacctccgcctcccaggctcaagtgattttcctgcctcagcctcccaagtagctgggattacaggcgcacaccactaacacctggctattttttgtatcttcagtagagaaggcttcaccatgttggccaggctggccttgaactcctgacctcaaatgatccactggcctcggcctcccaaaatgctgggattacaggcgtgagactccgcgcctggcccagaagcaataattttaagattaaaaacaaaacccaaatatggtttcctccccctttctatctatactcacactctgggtaagaagtagcaaaagcaatcaggttttcaccagacaaggagctctgtgattctcagctctgtcccaacagcccatgcacaatggctaccaaaaacaaaaacaaacaaacaaacaaaaaaccccaacaacaaaacacagataagacaaaatgccaaaatgcaaagcactgcagatttccaagaaactctttggtttgcaggcctagtatgagcaaattttttttacaacgtaagaccatccccttgtgacttcatcatttgttgaccacacaactgctgccaaaccctaactcaaatattctccaaggtaaaacttggaaaaatacttgggttttggtccatgattaatcttcatctatttctatataggttatctcattatatcaccattaatataaagcaggtgggttacatatctgaggaaatgggcagggggacccaaatggttgagttgcaacagagcccaccactgtagttattcacttcatctgtgtatgtagcttaccacattcctgggaccacaagcatggaaacttagagcaatggtcattgacttttttctcctctattattctcagtgttgctcctgaattctctggcttaccacactgtgtttcaactcacataacacaaaaattatttccaaactgtctgcacaaatgtatttcatatacttattccttaacctaatgcatttcattctactgaaataatagttttcccttcttatcaatattgcccagcaagaaactcaagctatttaaacagcaaagctgccaatatttacaaccttttaagtcagtaaaggaatttaggtaatttgtattttagtgtttactggttggttaatgaatattgtgcttggggttttatttatttatacagcacctcattccaaaaataaataatctgaaatgtcttggatattacagaatatagtatgcaaggaattagaatctgaatattgtgtgtttagcacatttttagcaaattagcttgccaggttggaaaacatcagaggtttatctgatgtaagcatattttaaatttctgggtgtttctgtaaaaaaaaaaaatcagtctttcctcttactttatacaattattaaacagagataaaacaaagtccatgtactgcagacctttctattttatactgaaacatccaaatgattgacaggttttaaaattctatttataaaaggattgctcctctgtagacataagaaaaatcatttcaaagagagatgctctataagagaaattcttaacatatttaaaaaatgagagactcctctattgtgtaccttaatctggctcttattcagttttctattgttatacattctgttataaaatctataataaattaagactccattgttttaaaaaaacatggtaatataagcattgtagataaggcattttgctctcaaatatttgtttctattagtttattttacttctgtttatgtgttgtgcatataaaactttaatctttctattaagaaggaaaaagatgtgacttatgtatgatgaaatttgctgtaacctttatatatgttcttgaaggagccttggttgaaaaaaatcacacacatgtaattttttgtgggctatgcaccatccttatacatactaaatattgcattgcaatatttactattagctatgaattgacttgtaaatggcaaaacactccaggttttttacatggtattattttgaaaaatccaagcgatatccctttatcattactacaatgttctaactttgacaacctagaaaatagatttttttttcaaaagatacataacagagaacatcccttctatttgaaatctctttaaatgttgtggttttaaattcttataaatatttttctttaattacagtgagtggagggatagagagaatagtttaattcatacaatatccacctcccaaaataataatacttcagattatagttttttaatcttcagaattttgaccacaattttatttattaaaaaatatattttataagattgtttccttggctgggtgtggtggctcacacctgtaatcccagcactttgggaggcccaggcgggtggttcacttgaggtcaggagttcaagaccagtctggtcaacatggtgaaaccctgtctctactaaaaatataaaaattagccgggcatggtagcaggtgcctttaatcctagctactcaggagatggaggcaggagaatcacttgaacctgggaggtggtcgttgcagtgaaccgagatcacaccatggcactacagcctgggcgacaagagggagactccgtctcaaagaaaaaaaattgtttccttgctgtgattttggtgaagttagtcactgaacattggaaataaattgcaccttgcctcattttcttttcttgaaaatagaataaatatagataagatatgaatctagagaacacacacatgtactcacacaacaacacaccatttctcccttccctggcaagtcaggtttcttttacaggaatggtaaaagttataatgacataatgggaattctccatcagttaataaattagatgatgaaactaattctgactgctactaggactggagtagcagaaagcaatttcaatctatcaaagccatgtagggaccagagatgggggctatggctacagctccagtacccacatgtccactcactgcacaggtagagacagaggtctgcagccacttgtctatatcaggcagcatctgagatgtaaaaagatactgcctcgattttggttaataccactttggaatatgaaataattactggatctccagcacatgtcttctgggtaagaaggaaagacactatattctctcattttacagtgacaaaattaaagctgagatgttaccttattctttcaagcaaccatagtaagttggtggtatacgccagagtagaacccagagatgctaattcctaagcagtgatcttttctcaatactagattattctcttgtatcctagataagatagttaacatttaaaaaataagcaaagcgggcaggcgcagtggctcacgcctgtaatcccagcactttgggaggcagaggcaggcagatcacctgaggtcaggagtttgagatcagcctgaccaacatgcagaaaccccgtctctactaaaaatacaaagtcagccagttgtggtggtccatgcctgtaatcccagctacttgggaggctgaggcaggagaattgcttgtacctgggaaccgggggttatggtgaaccgagattgcaacattgcactccaccctgggcaacaagagcaaaactccatcccaaaaaaaaaaaaaaaaaaaaaaaaaagcaaagctccttttttgccacaattacaaaaatgatcaaagagattgtataaataaattatcagttttttcttgcacacaattctcttacccacatgcaatacctagtttctatccaatccccctaagcatgtattgatattttgaagatcacaactggaagaatagcttatttgtgttaaattgtgtaaaagaaacaatttttatagaaatacacatagaataaagatgaaacagaccacagtgtgccagattcatagcaaaatattattttaagccaatagaagaaataatagtaggtttaacgaacatctttacatatttcagtgtgccatgcatgagccaatcaattaatttaatccttatgaaaactcttgataagtattaattttcctagtttattgacgagggcattgagccaagacaggttacataaatcgcctaagttcatacagctagtaagcggaggagacacaattcaagcccaaggatttacattagtgcagataaaatttgtcaaagcttacctacatatggctcgattgtggacccatctcattcataacaccttatcgatgtatcagatccacactattctgttgtttctgttgcaattgtagaacctgtggcatatagcagcacagtttaaactcacaatcatgcaattggtctacctagtctaatttttttaaatttatctttttttgttttaagtaagtgtcatctatttagcagtctgcaaactttttagaagtatagatcttatttttctttgatacagcataaaatccaagttatgttggacagagaatagatattaccacacacttattggcagattgaagggcgtattaggagagtaaataaagtgtgagtaatagcagatttggttgaataaggctgtacattctggctttctctctaagtggtttattctgccaaccccaatgtctcagctcttaggctgaacttctgccctttcctctgtgaatccctcttcagtttctctctctacatgatttcacccattccctctttgtgaaaacttctaaaacttgtcatcccatcttattccctcatttaccctctcgattggtactgcaggatgcttcctgcttaaactgatcatatctaaagtgcactagttattttatctttatggtaacattcctgcttctaatctacaatgctattcagtctaacatcaccatttgtgagaatcctggatgagtggtcatttggatgaattcagcagatctttatgaacatttatggtatgccaggaactgtagtaagtgttcagtacaaaagggacaatatgttaccatttcttctatagctagcagctaaacaaatcacttattataacgcaaggtgggatattttaccatagaagtctgcaagggatgctgtgaaaattagcatttgcacttgcgcagctctcacaatttaagcaattttgaatgcaagtttaatacaacctcatgaggtgttattattatagtctacaggttctggaaaccaactgacttgcctaagtgctccccgccttgtccgccctttatgcgaatggtggaagcatgacgcttagtcattctctgtttccttccccatgggagaagaagaaagcggttttgcagatgtccttgaatcccaccaccctagtcagtatagggctgaatgcacaggagctcccccaagtgtttgctatttgataagcagaattaaatgcaatgtgttgtgaagacagattgcagctcactgtgagaattttcagctagcctgtttagaatagggtggatttgtctcatcctctagaagtgctcaagcagtttctgtagaaaccgttttggggagatgaacaggttttatgcatatgatgggatatttgtataagtgacctctgagtctccttccaactacacgtttctctggttaatttctttatccagttcttctacggctatagactgagagcttatctttccttaaaagatgccagataccacctccttaagccactgattcttaatagataaagagttgctatttatgacagttgtgcaaactcataatcaatcagtacaacacaaggtatgtgattttattgaaccctccccctgatgacttaagacatctgtggctcatgcctctaatcccagcacttaaggaggccaaggtgggtggattgcttcagggcaggagtttgagaccaccctggccaacatggcgaaatcacatctctaccaaaattacaaaattagctgggtgtggtggtacatgcctatcgtaatcccagctacatcgggaggctgaggcaggagaattgcttgaacccaggaggcagagcttgcagtgagccaagatcacaccactgcactacagcctgggtgacacagtgagactctgtctcaaatttaaaaaaaaaaaaaaaaacacatgtgaaatgagtttattacaatcttcagcatggtgcaatatctagttagaggactgagtccagtaatcagtcttttttttctaaatgattgttctagttgccataaaggtaagttaaataaagttagaaaatatctctgacaagaaaaggataattattttgtaacatctattgagacccacaaaacttgttgaaaagtggctgcaaggcatgatgagttagtcaaaggcagagggataagaaaagttcttaactggttatagccagttttattttgtgtagagatttttacgtaggatgtaactccaacttactagaacatttggcaaaggtacaataatgtgcttggcggtggaagaaagtataggaggagcacattataactctagaatattctaactcctgtataaaacacaatgaaaatattccctctcacaacaccacactggtcacctctaatattaatggaatgtctgttaccatgaacatttaaatgagaaactcgggttctattattgcctcatgtggttgtgagtattggctaaggagactgtattgtcaaaggaaatttgggatagaaaagggtgtagagttatgatcttgcatggttcaagttcagacttggacagagacaaaaagatgaattaggtgagttttttgaattcccaggaagtaatatggattggggacacatagttctgttttcctgggtgcatatttctgctgtttcagtgataaaattatagcttctactttgcgggaataagtaactaatagttctcatttttataagttctgagaattttctatgattttttttttcatgttacatatctgagggacatactctccactctctctctctctctgtaatgtggattaagataagtaaggagttttcttagaattagggcaagtttttaagcaccatagcttattttgccttgaatgatcaggcattgcaccatgagaccttcttataggtatagctaagttgagagttgcccacactgacaaaactatccagctcagttatgttaacaaaaaaaggaatctcaacttaggtaagagtagccactatgtctcaggaatagtcctattgcttaactctcttacaaaatgctaaaattaacattgcccataagattttctataaaaagcagccatctagatcctttgagtttcattgtttttctccttaccagttgaatttattgacagaatactctttttaaagaccatccttgagagtgaattaagtaacagattcttggcaaatctttctcaaaatttccaccaatttaggaatgtgaggaaagttgggggttgggggaggcagggggtaaagtggcaatttgtattccaattacttgatttcctgagaatagaaagttgccttaaattaaacaaggaagagaaaaacccatgcatcaaataaattgaggaattcatttcataccaggcttatattttatgctcagtttctggtgggatatgaacgtacgattctcatacttcagtgagtcagtgtgttatgtaaacatggccttagtggcaattactattataaaattggtgatagatgtagcttttgctttactgactgcaaattaaatttagttggaaagataattctagttaaatgttttaattagcaaccttttttgactattctatttaataacaaagatacttctggtagcccagtatgccaaatttattttatgaactcttataatggatcaaatttcacattgcaaagagatctgacaagcctgattgtcccatgatgttttaatgtttttggacattcataggcaattaagtttcttcttggagaatgggcatacgtatggttaaagacatcttgagattgatttttttctctaaatttgtcatttattcagtaatagtcatgccaataacaaataatattctcataacaaatactaacttctctaacaaacataatcctcaattgtattttaaagaaactaacagcattttaagatattaaactcctctatgcaaagagatgttaaagcagtgcctaaattaacatgaatttaataggttattaaacccagcaaactggtgttaaagtggtgcctaaattaacatgaatttaataggttatctttcaaaagatttaagaaaacaaatgcctctgttttcagctatttattgctttgtcaacatctaatatggacctagaactacataagtgactctacagccgaaaattccttagtgttttgtggcacgtgtcaggcttcttcttatccaaaggttaagtcagcagatttaaagtcagcagcaagaagcaaactcggatctgacttttatgccaaatcagctacttactagcagccccataatcttgagaagtaacttcattttgaggcagttcggttttctcttttctaaagttttgaaagtaatatttactattgcttgattgcagagaagaaagttttttgtttttttttttctaggcctcaaacacagcgattgtgtttggttaatatttcttccattttctggctcttccccttccattccctctccttactaccttgtgaaggtcagaagaagacctaggtgaacagagcatactttctaacatctcaaggctgtagccctagaatggtgtctccagcctccttaagttctcagttggaaaagcttaaatctgccaaagatatttactatcgtaaattccagctaacatctgaacataaggcacctttctttcagtctctgtgggaggagaggagcctaacttcagtaagtatcagttagcaaacccaaatggcctagtcacctggactgaaccccctttttgcccttgagtgccttttccctagcactccccagctttttgtttctgtctcctgctttttttttttcccagtgaagttgcattcagttcaagtggactctttcctctatttttcaatagttattgctgagtaaagactgttcataccactttagtgtccagctttgtttacctttgacaccattcagaagcgtttccatatttgtcatcatgttaaatgggagcttggctgtggcagggagatggacaagaagactacgtcattaggagagcatgtttagtactgcatagcgatgtgtaatagcgtaaaattatgaagtgcatacagtgcatacaccatacagtgccactcaacctttagtattttaaatcttcactttaagaagttttattttatataattatatatttttctctaattatattctaattatattgttgtttaaaagaatgattctaacaattctcaccataattgcatgtctgaggaaaagctacattaatcttttgaggccttctattttggtttaggggaattatgattgctttcaaagtaggataacaatcttttaggggactgatttttggatatatttatcaacacagcctaacttcacattcattaaatatttttgagagattgtatgcaagcagtattcttcactgataatttatttcaaattccagaaatttttcaccctaaatctaccattgtttttctcagtacttttatgttgttttgtgttgcagtcactgataattgctatcagaaccatgtataaattgatcaaatattgtatgagtaaaatatttaaaaagtaaaacaaaatgtttctaataatcatgctttgaaaaaataagttcaccccaccttgccacacactctacttgatttatttctcttctcaaacacatcacctttttctttttttttttttttttttgcctctctctgaagttagaaacacacacacatctccctctcgccctctttctctatctctttccctaccctgctgaaatctaatttgactaatgatgtcctaagctgtgaacattttgttagatagctattttgataaagacacacagcaatcaagtattaactggtccgtcaatttatctcttgatacaagtctcagactccagaaaaggagctaatgctcatccttacacgtttgtatcccttctgcctagaatattgcctaattagaaaacaaacaaaaacaaaagccaaaccattaagacattatttgttttgctgaacaaaacaaatatacaatgtatccactgagttaaacagggaaggtacaggccacatctgcatctggagaaggaaattgaggaatctcagtcctggtgacccaccttgatcttcacctaggagctgtctctgacagatatctacaagcctccatcccttcatattctacttagaattttgttctttaacacagatgtagatagatttttggacttctaaatatgtgaatagcacaaatctgggtaaaagagtttgtccaaggaagacttattcaacattttcaaagatcgtagaaggctaaaatatggtttgaaattacctagatgaagtgtaatagacacataaaaacctaagtctccattcaggattcacatatgccaaaatatgataggacagacttgacttattagcagttagtgtgagaacttgaagaattcttttaattaaatgtaaattttagatgagccattttctgccacgattgtggatttgaatctaagatgtgcattgtgcagtatggtactccaggtaagaaagagtctcatattgtttgttctacaggtaaaaacaaaacgtgaacatagaagtgccttgaaaactaattttacaaaggtcagaacaatggcatttataccaagtgcctcatagctagattttgtgtccaaacgagtattcgcagttttttgttttcaataggttcatttgctcctgtgtgtctttatgatattctttctagaacgctttctcccccttgtcacctggcaaatttcaacatcaagacccagctcagacatcacctcctcagagcaactctctgtaacctcagagccactcagccataacctcatctctcaggttcaacccttctgtgctggaaactatatatttattattctatttatcaccatataggcctgtctattccatcagacctgtgctgtccaatgcagtagccgttatctgcacatggcaattaaaattaaaattaaaattaaattaaaagttgagtttttcatttagcttgccacatttcatatgctcagtggccatatgtggctagtggctatcataatgggcagtgcgggaatagaatatttccatcactgtggaaagttctattagcaggaattgtgctatagtgagatccatacagaagactttctctccctgatctctccatcctcatcatctggggttgttcctagcatatggaagacagtaactaagtactgaacacaactgaactaagaaatagtgggcaagcttatatggaaacagcatcacactcagaatgcatcgctctagacacgagcataaaatttctgattcacgaaggtagatttctcttaatagacttactgggaaataaaacaggcttctttttagatattgagctcaggccccaaaatctttccattaaagccaagtaatcacctgccaggactccagtataatggatcccttcatggggttggaaattgcaactagaagagaataattgagattcagtcattctcgtgaccaatgtttgagcaacttttatgaaactctagagaaaattttgactacttgtcacgtcagcccctgactgtcaacaatgatccttgctttgctgagaatatctcgaatgtgtacattgtttttccctaggatcacttttactgaaactaatgtagctctaaaattttatattagtttttaggtttgtgtgtgtgtgtgtgtttgttttacaagaaaacctgtctggagtacaaaactgaattagcaattaaatcgttgtcaggaagcaagtactagccttaataaacaaagtataattgagaaaacaatgtcatatcagattttggcgtcattgactaaaagggagtgtggacaaatcacactaatttttcagacatctgtgtttccaataactgaactcagctgtatttggggctatggacacagtgagtattcaacagctattgaatgcaaagggactgaatgtaaataggtctgctttttaaaccacttctgctttgtgcagtgaaagccctaaagagctgttggaccaattaaataatttgttttttcttctggggcaacaacattttttttttgtatttttatctttgtgtccaaagacagcatgcttctaactgtaaaacagcacaagctctacagacattaaaaagtagctcagaaatgggtgtttttgtagacacagagctgtttttgtcactgaagacatcaggcaaaaatgctcttttttatacatgaagttaaataacccttgggatagaatattttacttcatttgtggagggatttgtgcaccctttcctgtttagaagggggcttctgtgcggatggagcatggccagaggaggctcagagcaaagcctgagaaagggcttcagtgactaagaaagtgaatttgggctttaataaaaacactggccttatatctgacaaaatctgttgctacactagatgatgtgggcagttgtttttctataagtgagagagcttctagctctgctaaataggaaaataagtatcttccctttcaaaaccgtaagagaaatgatattgaccaaacaattctatttaggagagagacttcatacactggaccaattattatcatccataatttatgaaattattggcttaacacctgttattttttgagctgtgttatctgaaaagatatgttgaagtcctgacccctagtggttctgtgaccttagttgaaaatagggttcttacagattttattagttaagataaggtaatactggagtaggataggcctttaatactggtgtctttataagggaatacatagccatgcagggagaaggccatgtgatgaaagaagcagagactgaagtgatacaactataggccaaggaacgccaaacatcaaccaccaccaattaagagctaggaagaggcaagggaggattctacccagggtctcagagcaagtatagccctgctgacatcttgttttcagacttctggtctctagaaccgagacaagaagtctactattttaagccacccagtttgtggtactttgcaatggcagtccttggaaactaatagaatacctgaaaggcttaatcagttcaggttcttatttctaggtaagatatttgataaatgaaatgaattgaaattgattttgtaggatcatatagtaagcggtgccccttgatgatgcttcttcagcccccttcacattatcctttattgactacgtcagccttccctcattacttgccttgaaatggcgggggttgtaaggagggattgggaaacaactccctgcaattatacgtaaaacttggtgtctgcatatgtacaattttctgaggccaaagttctataggttttttcggtctctccaaagagagtctaagacctaggaatgatcctgtttttaatgctgaggggtcaccatgtttaggatatcagcttacattctttttttttttttttttttttttttaacatccagaatccaacaggccaacaagtcagggacaggaactcagtcagagccagtcagagccagtaatgtgtcacagccagacaaaagtcagggacaggaactcagtcagagccagtaatatgtcacagccagataataacagctcatgaaaacccattgataaatgatgatgatttttcaaggtggtagttaagcacaaccggtattaaaattaaattatataaacttatacttgaatgcattatattaaaaacaaggtaagaaatgcttattactcatcacttcctaattacttttagtacttttctcttacctacattctgagggtttttttcccatcgactgcatctgtgtgataggcgtgaggatgtgttactgtgcatctcttcccaactttatgttcagtgacatcaagttggtcggtagcttgaaatcaattgtgggaaatcagatcacaaaggcaatttgcaaaacgactcccgccaacccctaagcaagatagttggtagtatttccaggctaccactgattcagacttgactgattaatcacgcttttatccctggggtttctattattttggacattacataagaatattggactagactcaaaagatggccattgaataatgttcaatagcgccttctcttataggagagttcataagtttgtctaaaagtgctttatgtctagatgtgaactttaagaatataaaggagttgtcagtcctccaattacaaaatgttcagggaataaggtgccatcacctttcttataacttagcattaccgattattattttaaaatgaatctaaataaaaacgttcataacctcatcaagaccttttctcttctgtatcccagattttccatgattgagtagcaatttatgagaacagtaagtcacttttgcatttgaaaataaaacgttttctcttggataactttctgaaaagtttcagtattatctataagctacaagagactgtttcctgtttgattaccttaaactgataaatttctctgggttatttgaaataaatcatacacgtgtttttgttttctttattgcctttcttttttcccttagaagcaataatgaattttatctggatgagatatgggaaaagtccccctttaatcttaatttttctttggttatgttttctaggattggccatgtgagtgtgaccatatgatgagaaacttatcctggtcacctaatgcaaatgtttctgaaatttttctgtagtttaatcaacctccattgtataaaaactgtgtttacaactgagcaaattactggagtagtaaaagaaacattgctagcctttaccccatgaaaaacacaataaaaaatacttactttcatggttctgtaactcaaatagaaaaggagatgagaagatttttccaaactgcaattactttattgttaacacttagtgtctagagttggaagaattaagtaatgacactaatattgttcatctagccacatgtaaatgtgctttagtttcccagcttatgcacgtcttaacactatgtttgtgcttaagccttttgcattgtgaaatacagcaaaaagttttctgggcagtgtgaatgagagctaccatgtgatagactggcccaaatgatgctgtcttctctgggagggaaaaagtaatcctcatcatcacgaaatgtcaaatttcaaaataaaatacttttaatacatacaatacagaaattataaatgcccctgacaatacagaaattcacctgacaatacagaaattataaatgccccctttagataattcagcttgccgcctcttgtggttaaggtgacactgctgcaccacctttttcttatcatagggaaagtgacccagaatatcaaggatggtgagataattcacaatagactgatgagtactatttgacattttgtagattcaaaatcaactcatttctgattaaacaccacaactctgtgcatcattccttttttttcctctcagaattttgataataagcacatgccagatatttatttatttatttattttattatactttaagttttagggtacatgtgcacaacgtgcaggtttgttacatatgtatacatgtgccagatatttaaaagaaacgtttatttttgaatgagtgttagccttgaaaagacaaatgggagaggtcgaaatgatggaaagatggatttgcacctgatatattcataggcaaggctgaatggctctccagtgaggagctgtatcagcacagggtctttataaaagctgggagtggaagtggcaagttcctttgtgtttctttttttgatcccaacatattaggaggctgcctgtcaagactgcttgaaaaagaaaggaacctctacccttaggacatatattttgttttgtaggagccaagggtacatagctttagggggaaaagttggtaatgtgctgaaaacaaacctctataaccagattctaactaagcaaaaggaatgctgtcaggggtgcagaggtggaaagtgacttgacgtcctctccagtgtctcttcttccatttcctcagcaacttggcttctcaatggtcagaccctgaatgactaattagaaggctgcaagaaatcaccatcctttaattaaataacggattattgaaggcaaatcattcgatacataattgaaaatgctgttaaactaagaggtcccttcctcttggatctgtaatacacattgaacttagtaacatggccctggggtcagtggcggagcctgtgtggatctaaggggagagattttggttgggaccacacagatgtgggaaaataggtcaaatactccctctctctcatcatctgtgtgctctctttgtaatttctcagtggtgttcatgggttttagatgttattaatcatgaaagttgtaaggtgcttggagatggtcccctttgttattttagaaagagaaagaagagagtggctgtccaaagactttctatacctatctcagtgcctgttgtagggataggagcctcagactccaatttatggtgaaggttttaggtagggaggaaaaggagacttttcctcccttttttcatgcatggcttaggaaaactggaagagacgaatctcaaaaacaagtttttcataatatcacagacataccatacacagagacgcacctctttaatattcaccttctgctaaggcatgcatgagtgattagtgttcatatttaacccattctgtgtctggcttcattttaatgtttgtgacagtcaaaggtctacaaggtgtatcaggcttttaatttttttgtatatacatgctacatacatatattttatatacaactctcatcaatatttcactcagctattcaccactacttggaaatgtcacttaacctcattgaatgccagttttctcattaacgaaatgggacaaatcatttattatgttgtataaaagtgaaattatttgccatgaagtgtttagaaatgtgtttggttccttttcagtgctggttttaagggatctttcttatggtttagggagtctgtgaaatccctgaaaatgtgtgaatgattttctgtgtatgtccaaaactactttttatatggagcttttatcagattttgaaagggccttagccctctataatttcacgtatcagttaccatttgaaggtaatccattttcagataggaaacatctgcatgttaatctttaataaattaatctctctgtgtgtatgtgtatgtgtttctctattttttcctcaaagcagcttctgaattggtaaggaattatttattcagtttatcacagttatcctgtgaaaaccacttctttgggtggcagaataatttcttaagcattgtcttttgtgtgtgattatgaaagattttaaaaatgcaagaatatacagaatcagagaccccagtgtactccccacacaacaataatacctcctaatttagaaatggggtgaggtaagatggtttctgttgcagatgaacttttatacattggcttctcaaagttgttcctcaagatctgtttttgtttgtttgtttgtttgtttgtttgttttttcttgccttccttccattatgtgtgattccctgtgccagtgcccagagatgcctgtgtgtgcaggatctggttattcctccttggatcaaatgagaagaaacacactttagagaagtttctattttatcattgctgtggtttcaatgtactctccaaagttcatatgttggaaacttaatctccaatgcaccagtgttgacaggtggggcctagtaagaagtgattaggtcatgagggctctgccctaacgaatgaataaatgttgccctcttgagactaggtttgttataacagtgaatttagccccttcttgctctcttgcttttgtgctctcttgcccttccacttttcaccataggatgacatagcatgaaagccctagccagatgggggcccctcaatcttggacttctcagtctctagaactgtaagaaataaacctctgttttgcataacttacccagtctcaggtattctgttatagtaacacgaaacaaactatgaccatagtaaaaaataattgaagcagttatctatttaactgaagaattcaattctgttgacattggaatattttaggaataactcattcccactcccatctttttcactttatattataggtaagtaagccaaccatctccaaattttcctatatggatattacgtcaggtaacacactgataaacacacaaagactgtgtttgaaatgcctacttataaagaatcttgtcgctgagcatggtggcttacacctgtaatcccaacactttgggaggccaagttgggcagattcttgaggttaggagttcaaggccagcctggccaacatgacgaaaccccatctctactgaaaaaaattagccgggcaaagtggtgcgtgcctacagtcccagctactcgggagactgagccaggagaatcgattgaaccccagaggtggagcttgcagtgagctgagatcatgccactgcactccagcctgggtgacagagtgagattctgtctcaaaaacagagaagaaaagaaagaatctttacttaatgtgtgttataattgtttgttggttatttttcatccctatcatcatttgggtttgatgaatataaatatgcatgtaatatactatacctttgcttcgcttattttttctctctggtcttccctcattaacaaagccctgtgtacctacaatgttggaacatgggttggaagtatgggatcaatgggattcctatagtatgttctatgttggcagttcattaaagaagattcaggggttgctggatgagacaatgacaaaatcaggcaagagaactcagataggattatttctgtggttgctattttagcatttttgcagtccacatatatgtgtgtcttcagtcattatgctttcatgctcattttctttatgttaatacaggaacataaaaataattttgctgacataaagatcacagaaaattcaaactggctttatgtctcatgacaaacaaatagaatttatcttctgaacctgctaaagtgagatttgtaaatgatatgagccataactgaagcatccagtcaggtgtctcctacctagattgattagagcaattattcttaagcatggcaatgctcatctcaaacccattcctctcctctgggtcaatgataagtataagacaagggtatacattcttaactagggaaaatgcaacctaataaaatgaaaaatgatggcaaaaatagaagaactagcaaaagagaaactagagatgtatttttgtgatagaaatatttcctgggaaaatgtaaacttggggtaaatatacatattctgctctaacacagagatgtggaactgaagaatcccacgtgaatgctaaactgtagatagataaggttgataacaatctgataaaatgaaactactgcatgttatactgttagttttgacttatataatgaggttggtcattcatacaagctaggcaggaaacaaaggcagatgtcaaactatcatgtaagcacagctgtttaaattaatttcatcattacctatgagctgctctgaccttgtaagttccgctgagtagagtacttaagttctgagacctgtcaataaatatgtggctgctgatccacttccaacagggcatgacatggtcataacgttttgcagcctcccgtttctacaaatggtaatgaccatggattccaaagagattgctttatagcatgtgttgtaccatcagaaatggtatattcaacagaagcttagtaatcactataggctgatttgaagtagatggcgaaccaaatctgtaagaatgccatgaagatttaaaaaacaaatgaacaaacaaaaagcagaaaacaaaactgtaaaaacccctggctgaagtttgtatgtactccaagctttatacatagaacaaaattatttgcatctggccttattggacttaaatatctagtctttgttggaaaagcattgaggttgaattataatggctatgataatttagggctgtgtggttggttacttgtagagaaacccaagatgacaatgataaattttatagtaaatttacggtaggtttagacgtgaatgtcagccaattaaatgagcaatcaaaccacaaatataattagtttcctttgaaatgccagctccatggagagccccattacttgacaaaaatagacaacttatagaagaaatccatcaaaatatattgtctggaactaaataagagctgaggtagcaactgtgtttattaaggagggaaacctaatttggaatcacagtgaacaattaaattttaagtaaaatatactgagagtcagtgacaagttacaggcttgagaataaaaactaaacttcctgtaatttttttctctgtgtgtatatatacacacacatacatataaaataatatataattacacaaactacacatttatttgttccaatatgtgaaccaacatttgggaaatttatgttcccaaaatttccattaagtagctacaagctcagaggcttaaggaccaggaaattaatatgaacattaacatgaagtgctcagtgttataaaatatagtagcaaatgatgggtgatagggccatttgggagctcaagacataaagtcattcccattcaactttgtgacctaaaaaccgcctttgggctcattcaaatgctggtgatttgaccagctgactttcagatttgggaactcagaatgaaaccattaaataatcacttaagccaaattcacctgcaaatatgctatgtaaggatgagagagattttactattccaagattgaaactatgaagcaacaccagaatttgtgcataatattactaaataatgcttctgaatcacatagacatatttttaggactgtctcctgagaaatctgactataataagaaaatatctttttgtgatttgttttgaatatctgttgaaattgctctgctaatgaatttcattcaacagacttagatcacactttcatgtttattgatagcactttgctcagttatttcgcggacttgtggaccatttttaccattgatcactagtatctattctacttaattatagttctgttggtatctcagtaatttccatttaatttgcttccatggaagtggttggaaactgaaacttttaaacatttccattactccaagatatgtttctgtctggtagaatttatctgttttcaaaaaagaatatattctctggggaaaataattagaaaccttttttgttctacgtaacgggttcttgcaatgtaaaactttacttgtaagtgaattatcaggatttcaaatatatccatattaaatattacataagtgtaaaatatcttaagctgtgtaactttttttgaaatgagccattttagtaccattggccacatttctgaagtatgccattattactcaaaaactttgtaaataaatgaatggatgaatacactatacatacagctcttaatagaaattgtaaaatatacatttagaaaaaaattctcaatacatgctttatcagtactgaaaaaaggtactaattttgatttattcagaaagcaaaagcaatagtagcactggtttttaaacaggttacaaatgaatttcttcttgcatcaataatgtcagaatcactaattaaaatagtgtatattaaaactcacaacccgtatttctaacctgagaagtttagcttatattaaagaaggaaacatatctttcaacatacctgtaaaaagtagacctgaacatttaggttaagatgatgagagtagaatactctaatcatcatcattaatcatcctcatgccgctctgtggattcctcatctcacagtaccacaatatcctaatttcacaatatttgtgagtgctgggaggaattttatatatctgagttgaccatatgttgatcctatgtattgaagcatgatgtctttcttatttatttaaaactcagcctgaaaaacataagatgatatcctataaatgtatttataagcttttattattttctgatgcttgaaacccattgtttcaataaaagatggatataacataataaaaatcaggaatgttcctcgaagtccagaatccttagtcattatattaaattttccctggcattaccattggaagcctgggatttactctacatatgatggtgtcaataagacactaaaactgtgtcactaagttggttatgctgaagtggtgtcagtggttctagatttagggtaaaaacaaaaaagagagaaagtgaaggcaagaaattgttaaaactctgaattcaggtttggaagttaggtgactttttttttaggccatatgttggagttttgtaccaatgcatgtttctctatctgtataggtcatggatggcggcataagtttgtctgttcttcatatatgttagtaacaagacagacaacatttttggcatttagtggttgtgttaaaatttcatgattagatatgttgtaaattttaaaacagcaatcacattttcagatactctgaaccagatgctcagcattaaaagtctaactttcccatatgcttcccctgcaggctaactcaattggaaaacctctgccctattggttctccaagacaatggcattgtcaccaatctaatcatgtcttgaactatattgttgaatacccagagtgatttctctaggtagatgcgatgaagcagcaggagtaactctgggaaatgcatgtgacagatgtttttaaaatcaaatccatcaaatattactactttaaattcactcaaaattgattagacccactcctgtgatcttgcctcatactggttttgtttagtttagttaatgttgcaattaatctctgcaaaaatctaattcatccccaagcttatttcatgccatgatctgtttgtgtaaatcttctgaagcaaaataccctgtctaatttgatctgttgtcatgattgaaaatactaagttgatatcactttgtttctacactgatataattaaaatgcccacgcttttctaattaatctaatctaaaattgctttggctattagatatcctaatagaatgtaatgcattgttttttttcttatctctgtcattagtcaagataattaattttgccaagtttgaaacacacccaatatttatttgcatatttagatttcaatctaagccagacttctttgtcgaatattatccattactattaaatagaattactctaaaaagccatgttaacaacgttcaaagtagaatatataagaagtaatgtgttatttgcatacatactgtttacatttaaatatatatgtacataggtgtacatattcaaattaatatatttagagttaggcctaataaatataatatatttaatacaagatattaagtaagacacattatatgtaatactatatttaggtacatacataatatatttatatacccaaataattatttataatgtttatgatatactttctgttatatttcaataaacaaattaaatactctttacattacacactgtaagtaagaaatataaaaaagtaaataaagacttagaaattcagtaaatggccagtccattttggatatattgattgtcattatggttcatgtttagtttttagaaataagaaatgtgaatattttatcataattattttagggtataagaacataaagtggtggatactcttcattttaattgcttattttcaaaattgatattaaatagtagcacttacattacaaatgcaaatttaaattgcataatatattaaatttatacaaggtattaaatatgctgatgaagctactctttaaaaacatccctaaactcattttacaaatactctgactgaaagcaaaaacaagagtatgtaaataataatgaacgtgataatgttggttgtaagatattttgataaattgttgtgtttaagtgtgattaaaagcagctaatatactcaaagatatctgcatctcacaaaaatcttttaaaatattctatttggaaaaataatcctgtttttaattgcttcattgaatattttataatgtattttattatttaaaacacttttgaaaaaatataaccccatattttttagctttgactgtattttcctcctcatatttaaattcaatactttattttatttttcaaagggatatttttactgattttgcaaagagggttacaacttcagttcagaaatatgccttgtatagcttaaagacttaaaaagtcaactttttccaaaaaccatttttaaagaaatttttattgataataaaataaatgaatgggaagacttacaacattgagataaaattgctatgtaaaagcatttttaatggagaaattcattttgtatttgcatatgtttagagaaacatgcagtttaatttgaattcatagggattctgcaactaaacgacacttaggtttctatttattaagttcatgggccctacctcaattttttttttctaccaacgtattccatctccttcccatatttttcatattaacctatatggcacaggtttatccagtccttcatccggtcacatattcatattataatgattatataagctataactttataaatacgttacaaaatgtggattgttttgatatagtgattaagaagacaaaatatatggaaaactactcagtatcgctaggcatcatggaaatgcaaattaaacaatgctgaaatacccttaggcacccaccagattatttaaattaaaaagactaataatgcaaaatgttggcaaggatatggaagagctggtgtgcacgtatattattggtggaatgtaaagatgaagttatcactttggaaaactctttgacaatttcctgtaaatatatgtcttccttataaaccagcaattctacttctaggtatatatcctagagatacaagtgcatcggtatataaaattgccaaaagaaggtattcataggagctttattcatagtagcaaaaatctggaaacaaccctagtatacatcaacaataaaataaacaattttgatgagtcaaaaatagaatactgaacagtaattaatgcacaaattgatgtacactacaatatgaataaatcttaaaaacattctgagggaacaaaattaaaatagttcctactctaaaaatatatttaagtgaagctcaagaaaaggcaaacctatccattatgatagaactcagaatagaggttattccagtgggaagattttaaccataatagggcacaaaagtttagcagagatggaaatgttttatctcttgattttgttggtgtagacatatacataaatatacacacacatacacatatgaatattaatcatgtgatacagttaagatttatagattttgccaaatgtaaattatgtcaataaataaaagaaatacagtgagttgttacttaattaaaattagagggtttttatcagcattgatgagactaaaacataaaatacataaagaccttaaaatcacaggcaacctacagaatgggagaaaatttttgcaatctctccatctgacaaaggtctaatatccagcatctataaggaacttaaacaaatttacatgaaaaaaatgccccatcaaaaagtgggcaaaggatatgaacagacacttctcaaaagaagacatctgcagccaacaaatatgtgaaaaatagttcattatcactggtcattagagaaatgcaaatcaaaaccacaatgagataccatttcataccgttagaatggcaatcattaaaaagtctgtaaataacagatgctggcaaggactcagagaaataagaacacatttacagtgttggtgggagtataaattagttcaaccattgtggaagacagtgtggtgattcctcgaggatctagaaccacaaataccatttgatccagcaatccccaaaggattataaatctataaagacacatgcacacgtatgtttattgcagcactatttacaatagtaaagacttggaaccaacccaaatgtccataattgatagactagataaagaaaatgtggcacatatataccatggaatactacacagccataaaaaatgagttcatgtcctttgcagagacgtgggtgaagctggaaaccatcatcctcagcaaactaacacagaaacagaaaaccaaatgccacatgttctcactcataactaggaattgaacaatgagaacacatggacaaaggggaacatcacacaacagggcattatcggggggtggggagtgaggggagtgagagccttaggacaaatacctaatgcatgtggggcttaaatcctagatgatgggttgataggtgcagcaaaccaccatgacacacgtatacttgtgtaacaaacttgcacattctgcacatgcatcccagaacttaaaaaaaaaaaaaaaaatctgagtctaattcttcttcagcctgactacccctgcttttctcaagaaatatgtcatatagcacacttccaatcaacactcaaaaactcttatttccttgggaataaagaagcagatttcaaattatagattattgtgcacagtgtctacttctaaaactgagttactgtatttgaagactggtgaaagtttcaacgaacacaacaataaccatagatagatacttatacatggtgaagactgtaccattacatggattatttcactgttcctcatggcaatattaatgaaatggatactattttgtaaccttagtgagccatggagctgtacctcaaacccagtcacactgcctttagaagacctgtccttaacaatatattatttttgtgctagatattctgatcgtaatgatcatatgaccaaaacagttggcccattttgaatcaatctacatttagatcattgtaagtaattagatgaatcacttgcttattggcaggtaagctattgtgatttcttaagcatatatttgaagttaaactgttctttggaacatatggataattattttttttattacattttaagttttagggtacatgtgcacaacgtgcaggttagttacatatgtatacatgtgccatgttggtgtgctgcacccagtaactcatcatttaacattaggtatatctcctaatgttatccctcccccctcccccctccccccaccccacaacaggccccggtgtgtgatgttccccttcctgtgtccatgtgttctcattgttcaattcccacctatgagtgagaacatgcagtgtttggttttttgtccttgcgatagtttgctgagaatgatgggggataattatttatgttcttccaatgtaggtacttaaagtagaatgtttttctactttaaaatgaagtgtattagctttatgaaatttaaagagaagatacaggaaggcacctatgagaaggctcacgtgttcaagtctgaagaaaaaatcattggttttaagtttggaatccctaagttacctttagagagaatggctgaattgctgcataaacatctgaagctggcaggaggaaatttggaagaccaaaattaggccatcccagaaacctactttatgatgatatctgtgtgatggagtaatgtagaggaattgacatctccatttaatttaattcccaagggagttcaagaaaatcctttatgtatcttatttaatatgtgttcttcccctacacaattaaaattagaatgcaactaagactctactaagggaaggaaaatacaaatgtaaaatgatcattctttcaattcccttagaagtttgataagtgagagaaggaatgtcaacaattatgctcagattctagactatcactagattttgcctctcgaaaattcttctgcttcctgggaaaataattgctaataagctgtttaacaaagataatcccaatctgactttaattcattcaaaaattatttatagcaagtttaaaatatgaaaagaactgaaacctttctgatctgaccagctggctaaaatcttggaacagagagttttagaatgaacataagctttatgcatttagccgaattaaacatcatttaatttgtatgactctgattaatcatagtcactcttaaatacaaatgcaattttagatttcctctagctcaagtttattgaacactttgtttctgatgtagactaaccttcagttggttgtgtttagttgctagtggctttagatgccccttatgtgagtgacagtaatatttagagggtacatgcatgtgaagggaaaatcttgaaatatttatgttctaccataaggaaatctctttttttcttcagcttagaagaggttatatccttacgtacaaacattatgtttacaatgttttttaaataaaatggtatttttttattgcaactcttcgtctacaatagagatcgatagacttactttaccatatgatgaacaaaacctaaaaaatattacttgtgaacttaaccacaagtttagacaaacaaatgcactgaactgaattttgagtaaacttatgtatagccaaggattaagaaaattccattacagtctatagataaactcttactaccattaatatatttttcaaaagcttgtgcattatgaagttcatgtctctttaaccaaaacatataaaaatatatggtgaatactttgtcaaaacttgtggaattcattaagtataagaatccacataatccaagtttactactatttaattttaatccatagctgaataatgaaagtaaatgaacagagccaaaaacatgtcacttttgagaatacatatgtcctccaaataaagtacatttatttgtattattctttgtctgtccatcttctcaagctccattaaaaaagaaaatatatggaagtgggtgaaagcttgaggactaaatgtgtagctgcaagtacattcttaattcagaacttaaaaatttctaggtagtgtttaaacctattcaaccagaaagggaaacatattccactaaaaccattgataaaaaattatatgatggttacattcaaaggcatgtcctattttgctctcaaacacagcaaaatagcaaaatagaacatgcctttgaacataagcatcatgcatttagctgaaataaacaatgcatttgcaaatttttgccttagcttttgctataactttaaatgatacatgtccttgagaattatggtcaaattttaaataaaaataaaaactgaaaacgtctgttatgttagtttccatttcattattcactagaaataatgaaactaaaatgttacctaacatatttgaaactcatgacataccaaattaaagctaaatatatattaaaattttaattattttgtttatttaattttataatgggagtgagagtactttgtcttttgagactagagaaatatgtaagaggaaatgctacagaatcaaacatttttgcatatgtgtcaagttatagaagaaattagcaaagaatatctaactatatttgttttcaaaagattttttacgtctgccctttaatgtttacagcttatcagcaactagaaaattgagtcaagcatttatggtaagctgtttttactgaagtatgtttgctggttgataaagatgtcctctgtgagaagatagaagtagctagttatcttcagccagaggaatattttgtattaacatgcggcagagtactttgaaaagtggtttattgaagttcttactcactttagttttataaaaggcaatgtgacataaatcatggtatgttttttttttctttttcttttctttttttttttttttgagacggagtctcactgttacccaggctggagtgcagtagcgccatctcggctcactgcaagctccgcctcccgggttcacgccattctcctgcctcagcctcccgcgtagctgggactacaggcgcccgccaaagttgggtgaagggtttacaaatgttaattttcttatgcttcataacatgcaaatataattttacttatatgtgatatttttgcgtaacaacttccagtaaaaattaaaattaatatgccactagtcattctaaaggaacatataatttaagcaagaaatgtctttcttttcagtctttattaaagtgggttatttttagtggtttctatctctaggtatctaattgtcattttaattaacgatagtttataaacaagtatgtccagttttagaagtttgttaatttcttcaataaccatactaaattctaagtctgtagttactgggtacaggatgcagtcttaaactgggatttatattcatgatattcaagggttattcttaggaacaatggtccataaagttatggggaaatgataaaactaggaattatcactccttctagaaaaatgtatacatgctcatagatgtaattttctaaaataaaatctaatataatagtctcagatctcctaaaattcatccattgctagcagcagtaacatcatttacttttactatgccaaaaatttgtagtattttctttttatacatactactgcaggttccgtaaagttgtttctaatgtagatttcgcctgagtttccccatgtcaatttctgcatggtggcaatgtttcagttttcattgcctgttcttaattcctaagtttagaacatttgggttgcaacagcatttatcaatgcaccaacacaatctgcattccactgacatgtacataatcttgtcttgatctttgatgttaaatgtgagttttacacgttaatacaattgcttgagaaattccttgatgggtgcagcaaaccaccatggcacgtgtatacctatgtaacaaacatgcacattctgcacatgtaccccataacttaaaagtttaataataataagaagttacaaaagattggaagctagcatcatattatttctacttaggcaacatgacaccaactcctgtatataaaacaaatttgtagaaataaatactgacattatagagtggtgtatgctacagcgtcaagctgtcagctgcgttggttttacctaaattctgaatataagaatttacccagttgctcccaaactggctttaaggaagatacattcttcactaacctcgttgcctacgtctcctctttttttgtgcaaaagtgtttacatattccattctctttatcagaaatacttatgccctactaactatacttttgattggattgcttcaatttatttttgatacttcaatttaaatatctctttctcagggatgatttttctgtacatgtcctttctctatcaaagcatgcaattcattttgttttctgaaattaaaaagaccagggtttattatgttgcatagaatatggtatgtgctcaaggagcatttcatgttgaaaattaaatgtacaaatgaatagatgaaagaacaaatgaatgctataacatagtgcatactgaagatacacctgtttgatgaataaaacatgctctttgccttcagttttagagatgctcatgacaaaaactgaaataattgcatttggactttcctacatatactatctttatatataatcttgttttataccaaaatcatgattgtctatttttcatacaatgttttttcaatgtcttttcttcatgtagtctcctacattccttaagagcattaaaacactagatttcagaaccaaggagagttccaagttgatgtcaaccaacaaaaaacttggtgcctgaattttgtaggagaaaactagtaatgtactttaatcagtggttaaaattggccgctgactggggccaatgctgtctagcacaattattttaacaattatcatttttacaaacaagatagctgagagctttcacgtaattcaatagctgactttaaaaattcaggatcatttttcccaactcaatgttacttcaacatcacttgaacctatggctctgataattgatatcaaggctgaatttctcttttttgcctatatggttcatagacatttaaaaagtcaacaccttttatttttacagaagacattggaactacccctgttacttgtgaaaagttttcagataggaaatgagactttcaaaatgaagaacaacttaagccattgtcatgagctacttttcctagggttggtaccttaagaaaactcactggtactcatatccccaatccaggcaaactttttattcccaggatttacatactcttaatagttcatcccaccagccttatcctggattctgccacctcacttatccttaagccttcccacttccttttcataaaatattaaatctataaatgaaaattccaggatatatatcacattatcttttgctgtgatatattccagtttatctgattttttagaccgggaattggcaaattaaggaccatggatcaaattcagctgaccatgcatcattttttaaaataaagttttattgaattacagctagggtcatttgtttacttattatgtatggttgcttttgtgctgcaataccaaagcagacagcatgtaacctacaaagcctaacatgtttattgtctgaccctttacaaaaaggaccttcattgactcctggatgtagatattaggaattataaacatggttttaaggaacatattagagaaaatggcatttcctggagtcacaaactaaagtgattgtagccacatgcaggtaaactaaaagtgatcagacttggtataagaaatgggaaatgatggacactgtgggaactttgaaggagcatgcttagtttcaaaactacatctacaacccagccccaggtcaatttcccttactagattgtagaccatgtattgctaacccttctaccttttaaagaaaagccagatatttatattctaatgtgacactttcaaataaaaaaaacccaaatgttttagggcaatttatgcccaaaacatacttttggcttgatttggccatagatcatcttgttataatcccagcttttattaaaaatagttcttttcatgaaaatttaaaattgcaacatattgcagagccaaggagagatcaacaaattatactttcttagatttctctgaaaatatttataatagaattcctaacacctatattaacatgttcataaaaatgtcactgttcaagtctctgagtgtttcgctcaaaattgaacctgcaccaaaagttattcagaaccagcaataatccaaacgaaaaaggtctcatactgtatttcctaacaatgtggcatgtttcacactcattagttcctagccctagtgtacatgtaaaagtcatccaattagccttggatgaacaatatctattgaggcaatgagtaaactgtaactaatactataattgcatcttctcatatgtttgttttaaaatacctctcaggtcaacatatttcccatttagaagggtatgagatctgtagggtatggtggataagtcagagtccctgtcccccttagctagggaattagatagaatttaataaagtggcttgtttttaaatgagggggaaaaatttagggaacaagagagagtgcagagcctgcggattaatggtagttccaatagctcattaccacctctagaccaatagaagaaaagcaggttccaagttatgaaacctggagtgagaagctaatggctacctgacaagaccttttactagactgatgcaaccaaccagctgtggcttagaagccagggagcagagaggaaaatatcctgaccatcctctcaccttctactgatttctcccagtgttgaacccactgacggcctgagggaaagggcacttgctgagacagtccacaaaggtcggcttcctcacacacacgtcagggtatggcgaagacagaggttggctctgaaggggcgaagagagaatacctggccccgtgttcattctttcttgtggcttgtaggtcagtgttctaacctctgaaatctgtgtggttttctgaagctgaaaacacagtaatggagagcatgaattggaagatttttctttaaagctattgaagtgaatgagctgtgagtgaatacttgagcagagagtatcacatgtgtctgttaatgactattattatatcgtgttctattatgagtctggcaagctgagaagtcaagtgagggtgacaggcacagtggaaactgtgaaataccatacctcttctagcatcctctgagaggaagtactgaacagagaattgctattctatataaacttacgtgtgtgtgtgtgtgtgcatgtgtatgtgtgcctagaaggaagaattctcatgaagaaaaggataaattgtacacttatatattggagtattccccagcactgaactcaactacttaattttgaagttcaattgattgctttaatcagaccatgctcttgcagatgtactgtaacagagagaaagaaagcacgtcactgttaattctagctgtaggctggcctaataagaaaaataacttggatgacttgatggattttgcacaattctggaaaaccttaattagtattttgggaaaagcaagcagttggttaatggctgcatttggttttatttggactttattcaaaagttctggtttcacctacaaataactacatcaaatgttgctttttgggttaaaatttgcaaaattgagtttgatagtttagttgcaattaaaatgttgggaaagctatattttgtcagctgtttccaggttatattaatattctgtttcttcatgtttacataatttatgtcagcatattaattgatctaaatatttttagtgcaaaatctatattataatgtatatgtttgaaaatatcttttcaggaaaataaatgcaattaaatattcaggatttagcatgaatataaatttgtaataacctattttaaaaagggttaacctcaaattagatattcttattttaagatgggttgagaacatatgctttagggtcataatatctgggcttgatcccacatctgccatgtattatctctgtggagttgggccggttgtgttacctttctgtgtcacttttcataccagtaaaatgaggataataatactatcttatgagatagttggaagcactaagggttaattgcaaagtagttaaaacaatggcaggaacatagcacttaataagtcttaattattatgctttcactaaaaaagatacatacatatatatgttcagtattttttatatatatatgtgcgtgtgtgtgtgtgtgtgtgtgtgtgtatcactaacggaacaccatgggaaaactaggaactctaaatttatttaaaaattattaccatattgaaatgggtgaagagatcataatgtgtcactagtatgcagattatttttctccttttgccctgttggtagaactactaaccctatgatgcagagaattgtcaaaagcatcaatacactggatacttcttgataagcctttcttttctgggtgacttagtttctgaaatttaaatgtgatgactgtaaaaaaatcctgaaaatgaaaaaaaatcaaacaataataagttttgtattattggatttttccagtacatgagagctcatcattcaggtctcttcctaagtctatgtcaatgatatccccttgaaagtttgaagtaggcaacgaagggagtattaataccacacaaataggttaacgctataaatctcgactttttggaaggctggttgttaaaaacttatcaacatgctgctatgtaatccctacatttgaagagtccaattgaattattctgtgctttgatgcactttttctagttttgtaataataaatgtaccatagtaattagtactacttaacagtatagaagtatttaccagtctataataaagctgtttatataaccacaaaaattgtttaagaaataatttcaagattcttctaagaatatacagttttgtgacaaggttgacctttagtagtcgactgtttctaaagaaatgttttcttataagaccctaaaacttagagtataataaaaaaaaaacataaaaaaaataaaaataaaaataaaaaggacaaacacatatataactcagaccaaaaaaaaaaaaaaaaaaaaaaaaaaaagattcttcttatgcagcccagattttggtaatacgtcttcaatgttaaaaatctggaccctgtgatgaaataatttgtgtaccaaaccccagcaccacgcaatttacccattttacaaacctgcacatggaccccctgaacctaaaataaaagctggaggaaaaacaaaatctggaccctgtcgccaggcaaaactatatttgagagatgcttcttcatttactagctaagtgattttcagcaacttgtttgtcctttatgatactgtgatctttaaaatggttgtttataataataatatagagtttttagaggctttaaagaaatgtctgtgaaattgaacgcagtgcctcacttcaaaagcctcacttatgtgtggattgatttgacagctgctgtatgatctgctttccaggattgtacatagaaagcatgctatcctgcctgcagatgccccaaattccacttgatcgtctagttagtggaattattttatttctattatctggaaaatttagtctaaaatgtgtatctatatgttatggttcagttatggttcagatgaataaatttcaagggatgttttgcctattagatgggtagaatcaacaactctataacttgagtgtggagaagatagacagtgggtaaaaatgtgtttagaatggagaaaattgacttgaagaaaatatactaagagcaaaatgtatcctatttgcctttagctcaggacgtttaacttttaacaagaaacacgctaaattttctcttaaaatagtttactctgaagtgttagatgaaagatatgatataaaacacatataaaagacaagaatcaacatagggacaaaacttttgggaatagggacaaatggacctgatgttcttttgagtataatcttaggcaggccaattcttcactaaggacttttgtttgcctcccttgcaatctctaaaatttcacaggatcctcctctgagcttgatttgtgaggttactgtaaatatgttacatttgcatagctctgaacagtattcaaatgctttttactctcattagctgagggaaacttcccatgagccaaagagcccatcaaagtaatgagggaagaacagaggtttcatccactgaatcacagcgaatgggaaacagaaatgtaattccacaaaggagacccaatagttcctagtaaggaagccaaggactattctctgatgactgctttcttgtggggttctagtcctttgatctacttttaagtaatagcaacattctaattaccaattcaatttaaaattcctaagccttgtaaaataggtaagtattagcaaatgttaaatttttatgagcaatgggaaaagggattgtagttgttgtttcttaatagatataaattatgtcttttatagttaatagcactaacaatttgctgtagcttagcatgttaaaaataaaacactctacctgtgtatacctctttgacctaccatcttcatagaaacaagataaacattatcattgtaaattttcccctatcaaaatgcatttttatttacataagtaatacaggaacacatgcaaattgtattaaaagttaaaatataatggagaaggctgattcttgaaaatgcttgaatttcacaaaaagatgaaaagctttaatctatgacccatgagcttgcccttaaatctggttaaaaattttggaaagttataagcaatcaaatgatgtatgaggatttactgacgagtcactggaagtagatgagaattcgtgaaaaatagctatttaaaaccagtatcctgccatttttaaaatgatatcactaagctggaagatcgaaaagatttggtaggaataaaaaaataaatttgtgctatccttaaggaaaatattaaggactgtaggttaacggggtagatttctagtgatgtaggagtatacctaaaatggaagagagatgaatgggtatcagttaacaggattgtttgccttagggtttgtaccttggcccttccctgttcaacatatttgttaaaggctgatgtaatctgacttgaggcgcagcccactagtaaacataagattcaactgtgatatggaagtctagctcccaacagtagtttaatgccaatccttattatagcatcactattccagaataagactctaatatctgactctgatgcctgattttatgatgttttacccaaaagttatatttatcatgctttgcctagcatgttggatggaaatgaaaaccatactacttgagggacatttaaagtaactgaagatgtttagactggagaatataagattaaatgggcagagaatggcagatttaatgggcaaaaactatgatacacacacacacacacacacacacacacacacacacataaaacttccatatctgagggtattaaactataaaataggtcttggtggaataaattaaaatgtggtgtaaaataaatataatttattttttatttaatctaagaaaaaatctttatactgtttatagattttcataattagaataattccctgtgaaggaatagctttttcaacacagaaaatgttccaattcagcttggaggatgacttttcagggtgattggtcatgggactcatgtgagttaataaaataatatccaagaacatttaaaaactgaagtcctcccctactccataagtctatggagaatttttattagtgtaatttttttggaagatattgatatttaattatctttattttaatgtgtacttattaaacttaatttagaaaattgggtgaaaaaagaaaatttaatgctctgtcacattggtacaatgttgtttctttcttttctaatatgtaatgatctctctttatttgtcttttatgtcttatctatgtttcctccaagtctttttagccatcacttaaaagttatgttatagagcattgtcaacttttcaactttttactaggaagcagtgattttttgattcaacattctaatggctggctttccttcattgaattttctgctttccctttagaaaatgtagtctgaattaataactcacacctaggaaatcctcattacttgctaccacaacctgtctttaaattttattattttattttatagacagggtatctctctgtcacctaggttgaagtgcagtggtgcaatcatagctctctgcatccttgaacttctgggctcaagcgagcctccttcctttgcctcccaagtagctggaactgcaggtgcgtgctgccatacctgactaaaatttttacttttatttttttttatagaaacagtcttactatgttgtccaggctggtcttgaactcctggcctcaagagatcctcctaccttgacctctcaaaatgctgggattacaagcatagccactatgcctggcctgaccccctctttctttaaaagcaaaatttgaagaagtctatgaagatctagaagggtatttccaatttctgtctaatgacatcccatctttgaaagaatttgtctcatctttctcagtcatcacagattatccaaaaaattatttgtaattattgaatcccttttattattcacttaaaaaatacaacataaatgctaatttcctgggcattcttaagctgacagagtgctgtatttctttctcatgtctcttattcctcaccataacagcctggaaaagcataccctccttaggacaattgggttctcgacttctactacactgtagtagaatagcaatgctgctactttccttggaggagtagagatatctggttcctgttttatagggacactggagtaaaatccactgtttatgatgaatgtggaaagggttgatacagctcagcaatgaataagcctcagagaatccatccttatgagagatattgtagaggcaaatctagtcaagtaacgttaatattagcatcaacaaacattaatatagttcatcacagtttataaagtttataaagagctctaaatgtcattcggagagccagtttgaaattgtgtataactatgaataattttcaggcagggaagctgatgttcaggaaatgtcagtgctctgacaaaagtagagcttcaggtcctctgtaggagaaaacccaggtaaatcaatgctttgtaaaacatttcggtatgtccatacttggacacatctgagatgtcactcatagcagcagtcatttccattttctttttttctctcttctttttctgtcaacttttcttctcactcctcctttcctttcttttactttccctcacttccagcctccaacttcttttacagctttactctcctactgatgttagcaataacttgcgtatagttttgacgcacgtcaagagcagttattttttttttctgttctaatctctgagaatctggccaaggggagacagtggcattataaagggaggaagtactggattcatatgagcgagtaaggtggtcttagagcaaagaagtgaaggcaggttagcatgaataaagataaccatggagacctgaacagtgatatatttaagaatactgacaaagaaatattagggaacatttagcagtaatcgcataatgacaggcatatggacatttttattaaagcccaggtagccagtctaaaatacactgtgtccaagttaatagcattgcagaaaacacactctcatgttgcctacatgggcacgttcaactcagacaaataatgctatcaatggtaattggaagtgctattatccatatctgaatgtgcctcaggtaccattagcagcagcactcttttcgttttgttttgatttttgctttctcaactgtagaattcacattatttttattaaaatttgtcttgcattaaaaattgtatttaataatcacgtctttctctcagtcaattaatgaagcccctgtccccccagctaaacagacttgcctcttttcaccacttaatttctaaagtgaagaaaaattatataaatagctaactgcacaaaattacatacgcataatattcaaagtattttaccagaaattatatagttataccattatcagccatattaggtagttgttaaaatccttaaatcattattctaattcaggctagtttaattcttttataacttcttaacctaatagttcttttattaattatttgcaaaattgactgtttaaacatttctcattgcagtttaatatgaaaactctgaacaaggacaatagtctcaatgttaaacagtagcctctacaatacttccactggactttttatgacatgcaaatatgccaaatgtcccacccaaccagtgttactgcagctatgattgcaacgtatgaccatgaaggaaacaattagtataccacaaataaattcagaaatgtctctccttatattcagcttatattcagctatgtggctgagaattcttggaatgaagaaaattaccttcttagaaagtttcccagttttttctttttccatttgagctatagttttaagagggagaaatgcatatgagccatattttgtctttacaactaattcacaaagaggtgaactaaaaattaccaaaatgtggattcatatgagccatattttgtctttataattaattcacaaagaagtaaactaaaaattacccaaatgtggattcatatgagccatattttgtctttacaattaattcacaaagaagtgaactaaaaattacccaaatgtggatttttagccagttataactcattagaaaatattagtagttggttgaacaaggaaacacagatatatgggggattaataattttgctatgtgggttaagaatagcctaaaataaatttctattgcttcattagaacagtgtcacctgttcatgagatcctgaaatgtgcctgaatgtaatgcaatggcatacaataaatgtttattatttgcctatcatatgtaagttattctgctgggacttttccaaggtacatttagggtagaaataatcactgggcagagtcaattataccttctccatgatcccacagcaaactggaaatgcctggtttgtagcctttaccatacttcatggaaattatctacttctatattccagttgctgtcactaggttttgaataacttgaaggcagattctatgtgtcttttttttatctttgtatagctacacaaactcagaggtgcatcatatatcatattgttttatttgattttgattgaagtaaccacaaaaccctatcctatcattttgaggggctattcagcctatgcccctcctccacttactcaacagtcccatgtggcttggtaaggctgtgtgtggagagagcctatttgtcttagatcagtcctcatcatcattcgtcatcatctaagcttgcctggtctcttaaagatagttgactcgattgtttttgtgctgagtttgagtactgaggtatttgttgaagttgggagccctgggctctagaatctagcctacctagatattttatgcagccattcacttctcagattctaccgtcttctcagagcagaagagggactctttctggtttagataaatgttaagtctttcccctagtttaaccttttaagaacttccttttcttcctcaaccctcctggaatgtctagcacaatgcactttgttttaggttataaaacaaaagacaagaatggagatggtctccaggaaacttaggctttcagccaattattatccccccattccaccccagtaaagtaggaccactaacttctggctaccttgctagaataagagagataaaagtataggagatatatgcacacattgacatctcagtacattttctaaccataattatatatctagtgcagggaaggttctgccacataatatatactcaataaagtgtgtggaatgactgaataaatgaatgggactcttcaacataaagaacagggtctattccattttcatttctattttagtattctatctagtattcaggattagcattgtacatgacaggaagcactcttctttaagctggaaatatgttcactactaatttatgaaaacttagctgttcttggacctattgctataggtctctgtgctatcttgagtaataaccagaggctatgctgtaacaaggcccccaacttagtatgtgcctttgctttctagttgaggattagtggataccacattctaactcaaaggaaagaggtttctgattgaaattttgggcatcatcctggtgggagaaatattttagaacggagcacagtgttagttgcattccctcacttcactggggcctaggcctactaacagtaactctgttgaaatgcattcttaggagaaacagtgaaatgaaatacatatacctgcacactaggaggcaggtgacctggaattttatctatcaccttcttgagcagtgttgtccacatccacaaatggggccacattacctatatattagactatgaatctctcttgaaatatttttctggctgggtggggtggctcacgcctataatcccagcgctttgagaggctgaggcagatggatcacgtgaggtcaagagttcgagaccagcctggccgacatggtgaaaccctatttctactaaaaatacaaaaattagccaggttttgtggtgggcatctgtaatcccagctacttgggaggctgaggccggagaattgcatgaacctgggaggcagaggttgcagtgagctgagattgtgccactgcactccagcctaggcaacagagcaaaactctctctcaataaaataaaataaaatattcttttctgtcttgtgatcccttagaatcttgataaaattatttcatagactagatatattgcagtcttgttgcattgtaaattagagttcctcatcttttctgattaaaatcaactttttttcactctaaaatattatgtgggaagttggaagttgctaaaagtacagatctttagagtactggagatgagggtccaattcttttctgttgtaagagtgataactgatttggatcagacagaaatgactttgctgtatatctgcaggacttagttatttggcttattcaaattttgaatacaaaataaaatttgagtgaaaaaaaggaaagggagattaatagaactaaaaaaattttcaaggaaatataagacaaaaataaatataatattagggttcatcaaaattatatacactggacaccaatctaaaattatgtttaaataatttcttcagttggctaaagtatttcaatgatactttcttgggaaggactcctaaggttttgtaacatactctttgtagcatatgtttttaattatattgaaaattaaaaatcattttatagatgtgggagtgtgtatgtgtgtgtgtgtgcattgtatgtatgcaagtttaactaattttaattttctgttaatgcatttttcaaaaaggggcattttgatgttcttggttgaactggtccagcaatataagaatgtgatattttagcaaatatgcaagctgactagcagatggtgtgattttgtgaaatatgtatattgtactcaggaggtcagccacagattttcctgttgtttgggtacagaagacaatgtcatcatctagaaataatacagaacatactttcatctttttgaatcagtttattttttcctgccatgaagatttagaatctcctcaaataaaaaaatacaaaacttgtctagaagaacgtgagaaagagaattgattctaattttctctatataaagtcttatttgggaggaaaaagaagaaaatatattaaaagcccttttacctgaaagaaagataattttctggaaaataggtagaccaagtgtatgtatttctcatttgatttctttgttgtcagctctttgcatggaatacagaagcttattgagttaacctttttcttgtgatatatgaggttgcttgtgttttgacaaacatattttgcatgcatagcatgaattttgaataaaagtctaattttaggtgcattgtctttcatgtaaaaattcttttaggatttaggcatctttggtcctatgcattgtatctgtggattcactacctatcgtcatagttcctgaaataagaaaatctcaagtttccacacttaataattttgcatttatatggaaaaaatgaataagaaaaatgcccacgtggtaaccccttggagatgaagagctagtatactctgagctactgtgagagctttagggtacagagtgcatgaggacatagggattcttttctgagcagagtttggagccctgtagctgactgctggggaaattagtttctaataaaaagaaaaacctgcagttcaagtcagactaacacttgaggtggaaatggtgactctcccagaaaactccctttggctctaaatctgagttttctcagcaacccacataaaatctttaaaagcgtaatggcatacctagttgttcacataaagactcttaatgagttgagaattctctgctttagtatgctttacattcaggttaaatagagttagtctccatgaaagttagcgctggttctgtgacaagtgactgaagactcctaaacagggtaaagtcaaaagggaatacaatgacttatagaaataagaatgttgtgggtgaggcagacttcagttggagtgtaatgaaggaactcaactggcaaaaccccaagcatgccatggttagctcttatttttactcagtctgcaactagactcctgaagccaaacatgggtggaagacaacccaagaccttgctggctggtctccctaaattatgttgattcccagcttcaagtgagacttaacggtgtttggtgatctaacaccacttgatttcccaagcactgtgagatgggtgactctttcgcaatgtttcctttctcctcattccttcactgcgtcttgcatatgttgctctcaattgatgactttgctttccatttcactgagaaaatagaagtcatcagaagagagtgtccatgtattctaaatatatccaatctatgtttgcgtcctgcatgctgtctcagcctctctatcaatgcacactggttcccattcctccttgagacgctaacagcattgttgcagcatctgtcttctgtctctcctgcatcatctatttttccctctgtgctagatcattctcaaccacatacaaatatgccataatactctcctatcttaaaagaatgcactttttgaactccctttccttttagatatcaccttattcttttagttgcttttactataaaacttctctataatgtagtcttatacagtctgtcttcactttcttttctaacaatccaacaaaactttgcttattaaggtctccaatgacctgtatggttatttctcaggccctaacttacttattagcgatatttggcatggttgtcataccctccttcatgaaacccaatcttcatttttcttttgggacacctcactggccactcctttcagtctcatttgctagtttcatctcatcctcctgatgccaaatgttggatttttcccacctcttagttctcacttctcttctctctttttgagagagaagatgatattcttcagtctcttagctttaaatactgtctctgtgttgatagctttcaaattgtttatttatatcccaaaattctgccccgagctttagagtcatatacactctgcttagatatctaatagatatctcatgtataacatgatatctattcatacattcatgtatgttccatacacatttgcctagttgtttccaaatttctcatttctcttcacagcctccttatgtcatcatacctctccagaaacatttcccatcttagtattacatcaaatgcattatttctttgttcaggcccaaagaaaataatacaaagtcactttcaacatctttctttctcctccctcacaatttacctctagtccatctacaaatcccattgactctaatttcaaaatataatcaaaatacagaaccttcactactaccatgccatgctggctcaaactaccattatgtctcccctagtctgtggcagtagcctctcagctgatctccttatttttatccctgttcttctacattctgtccttgacacaagcaaccagagtgatcctgatcaatctgtcatattaagtcacttatctgctccaactttttttttttttatggttttctctatcagaatagaggccaaagctctggaaatagtccataaggcctgaaagatctggcattggtgtgctcatctgctcttctctctcttgctcttgctgcaccagccatgctggccaacttttctgttgcttggacatttcaaacacattcctgacttgagatttgctgttctccctgcctcagatgttcttactctctaaatagcccattcacactaccctagctagtccttcccactttcctacacaattcttcacatcctctcttctcctttatgtactttttgcatcacttgttatcacttactgttttaaaaatttattgatatataatagttgtacatattttgaggatacatgtgatattttgatacatgcatgtaatatgtaatgatcaagtcagggtaattgggatatccatcacctcaaacatttatctgtgtgtgtgtgtgtgtgtgtgtgaattttgggaacattacagatcttctgtttaagatactttgaaatatacaataaagtagcctatggccataccacccgaaatgcacatgatctcatcttactattttctatctcactaaagtacaatatgtgctccctgagaatgggaatttcttttattttctgttgaatcctcagtgcctaaaacagtgctgaaagcaaagttttaaggtcaagattttagatatggtctaaagattctggatttcactatctgcagtattacctggtcaaactgatataattagactttccagtgctaagtggaaaatgaaatcaagtgtattttataaaattttaatataattgttatttgagaagaatataaaggttaatgtgaaaacttaataatatttgtctctcaaatattatgagcatattgctcaaagccgcttgcttaaagaggaacattatagcagcgtagggaaaacttggaagcagcctaaatgaacgcagcaggggctggctccattctttggtatgatcatgtaacggggtagttggcagcctttatagactgcactatcatttttattggcttcatattaatctataattagtttaaataaaccagtcattgtagtgtatatttgatccagtttttctcctttagaaacagtaatggacatccttatacacacttccatacatatttgcatacttgttgtcatattatccttagagcatttagtatttcactattacaaataatacttcagtgaatatccatgctcattcatcattgtcaccaactctacttatttttatagactgtattcctcgatgttggacacttggtaagagggaatacacatttcgagggctctttatacatcttacagaattgctttagagagtatcaatttatctttctttcagatttatattatagtgcctgattcatttcaagcttaaaaacacttggtattaggtttacaaaaaatttaagaagatattaaagattctaaaaatcttttcccaagtagattaggatgtgtacctacacaatttatggtatagtcagttctactataatgcttgttttgaaaacttggacttcttccaagattgatctattagggcacaatttgagtatcttgcaaaatttgcactttcttatatgtgattttatctgcaagcaacactaggtgaatagagaaaactgcacccagctgaaccaacaagtgaaggaatacaaaattcaaatacctaccagttacattaattcacctcttgtttatgagccacacctatgtatatctgattttgcaactttctatctgatttcagataacgttccttctgctacttcactgtaacattgtgatgttttggaacatgtgtgtctcaatacagtaaaactgacttcatgtgatttcaacatatatcataggttacgtctacactgggtattatttctgtgcatttgttaacagcttagataggtagcataggtagctgaatgctattcaatatgcacccctaatcctatctgctttttaattgtgcgtggagaaggcaaatgagaaagcagaaattgaaatggaaaaggaagtgttcagagtagttggtgtaagcaatattggaacacatctgtttgcaaaatatgctttagaggcttggagatgtgttctttcaggcattgctttccatcctgggtacaattgaatccttcagccccttagaaagataaagattagtctgaagctgatatacattttcaaggtagcagggacatgagtatttttcaagcaggtagtagagcaggatccatatcaatccttaaaactctgcaaacatagaattattttcatcagtttcaggcaagagagctgacttctctttacacagagtaaaccattacggggacatcaggaaagaccctttcctcaaagaggcattgtcaactcagtcaatgatgcctaaagagttccatcccacagctagagattaaactgcaagtgaagccatcctggatttcgtttctttgtgttctaatttagattcaggtgcaaatggtgtcaagtccacctaggaaaatttggaggataaatgaactggcaatgtgtagttgaagaagatagcttaaagggaaacaactggaagtaaacatagtcacagaaaatgacatatattgcctacttaacaggaagacagtggtctgacctcttaataaggcacaatgtccacaagtgagggtagacattgaaagaaacagaacctgagatgattttattgttcatggtcatttgtacagcctcgctctgttatccatttgcatctttgcctcttggtcccgcaagagcctctctcataaactttgagtagaagatcataaaaaattgttacttaaaaaaattgaagtcctaaaatttaccagctctgaaggaatataccatactgatatagaaagttcaatgaataggtagcaacagaaataagctttgataaacaaagaaaaccaaatgatgctatctgaaagcccggtctttgaaatcaggtggacttggcctcattctcacattccatttatgggttcacaacgtggaggatgtcactcagctgtcacgagactcacttcttctgtaaaagcacaactgatgaaaacacttgaaaggatttttttttaaatattgaatgagataaaatactgtgaaaatgttctataatgtttgacattggaaagggtaggaaatgaaggttaacagaagagtaaaaataagcaaatgaaaaaacgtaagaacattatgtcaaagctctacctttggaaatagatctcaccctagagatggacagatgatacagtctcaaatgcaaaaccaacaggtacatttgagattattaccaatatttagcgctgttatcttttgatttattcatgtattcatttagccctcaacaaatactgagtaactatttataagacattaagctaggttccagagataaagcaagagaccagtccctaaacttacttgtacagtaaattagaacagggaattctgtttgatatttgataccttagaattctgactattactggcaataataatacatatgtaataattactattgtgttagattgggctgctgtaataaaatatcataaacggagtggcttaaacaacagacgtttatttcccagagacagcactattcttatcatcgcctaccctcaggacctaatctaaacctacttacctcacaaaaggcatacctccaaataccattactttggaagttagggcttcaacacgcaaagtttaggagtacatattcagcccctaacacctatacactatcattaaggtagaagctccgcagaactttctctctcttatcctcaaaatcatctcctttagatagctattagtatcctcactttacagatgaaagctgagacccagaataggtgaattcattgcccccaaattccatgaccactaagtgtttataaatcagaatgaattaattggccaaaaattccatagccactaagtggcaggagcagatattgagacacaggcttgtctgtgattactcagcctgggctcttttaacactgtgccttttaataccattagagtagtattcacagaatatcattcagataggatgacagaggatggtcaattggtgaagccaggactattccttggattagtagaaatgcattaaaaaaaaaaaactcaaacatgtaagggaaggacacttgacattagaaaagatgaaatttctggagacacaattgtgtgtcacctaatcagctgtcacatcagggaaaaaatatcttggagaaatgttgaggtcgccaaacccagggagctttttaactgattcatttcatcttgcatgcatcccaatagttttagaagctgctggatagatttattacacaaagtctgtgtctctagctttcagcaatgtgggatttctttttctcagagcccactgatcaaaccctgcattcacacgtttactgatgtgtcatattttaacatccaggtctctgcacaatgccaagattatgcagttctatggagttaacttagaaattttgtcctcacacagtattctatagttgttaattttccatgcaaatgaaaacatttatataatttctgctgtttttatgtggtctcataaaatgtgaattacaaaactccatctttgaatttcctgtgctgctccactttcattctctgtaaggaatatttgccagaggaaggtctatgttgtactttcgtagccaactagaatgttaaaaggattggagaggagatttactgcatatttgtgattattgttttttgggagtgagctgaggtcccaaaccacctattccaagcccatgctgtggcagaggttggaaagaggcttcttgactctacttgtcctctagccaagagggaggctctccctagcatgacccttaggcctcacctccacatctctctgtctctggcataggttattggtcattatgtcacctctttcttggtaggaccccagagaatttcacatcctaatcacaagggatataaaaactgtcaagttctatggatccttttcacttttccttcatgttttaatgtagttgttcctcttctgtaatagcaatgatcacaccatataggtattaaaaatatgttccttctttttcctactggaatgtccattccttgagggcatatctattgtctgtgcagctgcagtgcccaacacaatgcctaacatgtgggtgctcagtgggtgtttgctaaattaatttaaactgtattgcccttagtaatggcagtcggagtagaaacagcaaaataaataggtattacagaggctgaatgtcaaagcttgacactgattaaatgcagggtgtgaaaaaaagaaaaagtcaagtgtgaaaaatatagataacaaactgagtgacatggatagaatgcagaaattcttctgataaaataaaaatagtagctaaaatttattgaacagttactatgtgctaggcactgtgctatgtgctttgcatgtattctctctttaaatcccaacccaataacctgttttactaatgagagactaatcaaaatgccaagtaattgataatgccaggatttggagtaagccctatttctctgtattctgtaaaaccagaatttctcaaagtgtgatttaggagctacataaaccgaaaagcatatggaagtggtggttaaaatgtgtattcctgagtttcatctcaaacctgtcactgaatcagaagctctgggtgtgaatccaaggattctgcatgtttaaaacacgccaagcaagtctgttgtcagctaaatctttagaagtagtggatttaattagatttagtaaacttttatgaagcttctataagattgcagaatttggcccaggcgtgggagttataggaatacacataattcctttccccaagaactattgaattaataggaaaaaacaaaccatcatagcacactgtaataagtacttgagtagctttgggatctggcaaactaatcaaggaacgagtaactctggacatgagcaaatttgaagtgagaaaggagacagagtctgaaaaacccaccagggagctgcaaatgtggaaccactgagacaggtcaggattgaatataatggtcatccatgtagagataaaagttgaagggtgcaggcagtaagaatgccaaggataagatttgaaaataagaggatcaatagattgcaaaaaatttcttccattgtgtaggttgcctgttcactctgattatagcttcttttgctgtgcagaagctctttagtttaattagatcccatgtattaatcttggattttgttgcaattgcttttggtgttttagtcataaagtctttgcccgtgcctaggttttcttttagggtttttattgttttaggtcttacgtttaagtctttaatccgacttgaattaatttttgtataagatgtaaggaaggggtccagtttcagttttctgcatatggctagccagttttcccaaaaccacttattaaataggggatcatttccccattgcttgtttttgtcagatttgtcaaagatcagatggttgtagatgtggtgttatttctgaagcctctgttttaaagttccatctgtttatatatctgttttggtaccagtaccatgctgttttggttactgtagccttgtagtatagtttgaagtcaggtagcatgatgcctccagctttgttcttttttcttaggattgtcttggctatccaggttttttttggttccataagaaattaaaagtagtttttttctaattctttgaagaaagccaatggtagcttgatgggaatagtattaaatctgtaattactttgggcagtatggccatttttatgatattgagtctttctatccatgagcatggactatttttccatttgtttgtatcctgtctgatttccttcagcagtggttggtagttctccttgaagaggtccttcacatcctttgtaagttgtattcctagttgtattttattctctttgtagcatttgtgaatcggagtttgttcatgatttggctgtctactatttgtgtataggaatgcttgtgatttttccacattgattttgtatcctgagactttcccgaagttgcttatcagctttaggggttttggggctgagatgagattttctaaatatataatcatgtcatctgcaaacagagataatttgactcctctcttcctacttatataccctttatttctttttcttgccagattgtcctgaccagaacttccaatactgtgttgaacgggagtggtgagagagggcctccttgtcttgtgctggttttcaaagagaatgcttccagcttttgcccattcagtatgatattggctgtgggtttgtcataaatagatcttattattttgagatatgttccatcaatacctagtttattgagtgtttttagcatgaaggggtgttgaattttatcaaaggccttttcagcatctattgagataatcatgtggtttttgttattggttctgtttatgtgatggattatgcttattgatttgcatatgttgaaccagccttgcatcccaggtatgaattcaacttgatcatggtggataagctttttgatgtgctgctggattcagtttgccagtattttattgaggattttcacatcgatgttcgtcaggcatattggcctgaaattttctctttttgttgtatctctgccaggttttggtatcaggatgatgctggcctcataaaatgagttagggaggagtccctctttttctattgtttggaatagtttcagagagctaatatccagaatctacaaagaacttaagcaaatttacaagaaaaaaaaaccctctcaaaaagtgggcgaagtatatgaacagacacttttcaaaagaagacatttatgcagccaacaaacacatgaagaaaagcccatcatctctggtcattacagaaatgcaaatcaaaactaaaatgagatactatctcatgccagttagaatggtgatcattaaaaagtcaggaaacaacatatgctggagaagatgtggagaaatagggacacttttacactgttggtgggagtgtaaattagttcaaccattgttgaagacagtgtggggattcttcaaggatctagaattagaaataccatttgacccagcaacccagcaattccattactgggcatatacccaaaggattataaatcattcttctataaagacatatgcacacgtatgtttattgcagcagtattcacaatagcaaagacttggaaccaacccaaatgtccatcaatgttagactggataaaaaaaatgtggcacatatacaccatggaatactatgcctccgtaaaaaagaatgagttcatgccctttacaaggacatggatgaagctggaaaccatcattctcaccaaactaacccaagaacagaaaaccaaacagcgcatgttctcctaagtgggagttgaacaaagagaacacatgaacacagggaggggaatatcacacagtggggcctgctgggggttggggggcaaggggagagataacattaggagaaatacctaatgtagatgacatgttgatgggtgcagcaaaccaccatggcacatgtatacctatgtaacaaaccacattctgcacatatatcccagaacttaaaatataatgaaaaattaaataattaaaaacaagaggaccaggaagaaatccttggagattacttctcatctgacattttattctccaaagcctagttccctgaataagcaaaccaccataagcaattaaattgcccttttaaacggccaagaacttcagatcactttatgagttttctttgccaaaggagagttttggaagtcatttggttaacatgttacatttcaaagatgactttaagagggaaatgtgacatcactgaatggcaaagttgtgttttagatagtttcttcctaaagtgtatgctttaacaatctcattactctgagttagatacttttgcactatgaaatcctagtaaactattaattctgtggataaataaaaacctagccctgctatcctcacacaccacactcactattctgtgatgccatttaactcttccattaaagtactgttactgtgcctgtgaatgccaagaaaaaagaaggatcaatttaaattgcctaaaaatgctagaatgtatttccctagatctaatgggtaatggcactgacagcttcaaatatgtttcataaagagttcgatattactgttcttgcctactaatatccggattattgaagaattaataaggaggtattacctttgagaacaagaaacatatcttctcctttcaaagggacaataacaagatagtctgctgggaagcatcttcaaaacatgaaagaagagaatttggagtcagtgccattttgccttccatgtttgcttgatgtataaagcaaaggcaagatagtctcttttttggtttggaaaaaagagaaaaatgaatatttccttgttcaggaatcatgaagtgactgcacaggccattgaaatgctttgataacttgcatagtatgtatttttaaatgtagtttggtagaagagaaatgccactgattgaaattcaggaagcttgagttctagtattgctgctgatatatatgaactgtgtgatgccgtagaaataagccatttacccttaactttttagtacataaaatataaggcatggactagatatctaagactctttatagctcccagttgattaatcaaattagcatttactcagggctcattactttaggatataaagtaataaatacttaagtagggttctcttctcaaagtacttacagcctacatttctgccccacctgaaattcaggcttactaagaaagaaaaaataaccagacagaaaacaactccttaagtaactcataacttgacttctaaattaataaatttatttttcttttcacaatgcagaaaatttgtaccagctttaaaaatatgcatgcaatagtagaaagagtattcatatttcaggttacatttttgttaaaggcatgtcaacgagtgcaaaaacattcaagggcataagtatggctatagaatatagatgtttatagctatatatatgtatgcatgattcacaaagtcttgtgttgattaatgtgactgcttatgtttgacatatgaacagatataaaatgtatatacagaaacaaacaaggtaaatatgaatgataagtatgaaaatataccagggatattttagaagcttctgagaagcacatgttttttaatcagaatcaatggatggattataagctttctaacaagctttcctttaattgatgaataatatggtaagtacaattatgcaaatactttagagaatgagaaggtatagaaaggattctgtaaaactggaagaattacataaaacatttcctcaagcttttctttccaaccctttccaatgagattttaagcataagaggatttcagtctgaaatgcaaggacaaaaatgtaagattacagcaattcttagttagccttacttttggcccttgtagttcatggatatagaggagaggaagaagtgtttccttgaggcttgaagagtattagtcacaggagaagatgtttagggttacaaattattttgtgtctgagttgactgccttatcccaaatgacaaaggtggccatctatagcttaatacacacatgtgcacatacatacaggcacacacacacatacatatgctgcatatgtttatttacaatatgcaaggtcctctaaagtgcaagaccgatggcagggatttaagagtagaaatcttaatagtcaatgaaaatccctagacttcttttgatttgccctgctgttaaacatgcactagatttcgctattttgtaaaagtctaatgtatgcctttgtcatttcccattaatacattccattttaaagttcgatgagagttcttcccgactaaaataaactttttgaaatagaaatgttttattccgaattaccactatgaattacacatgaattttataatcattcctccttggcttttaaatattcagcaaatggtcaaagactgttttcatcgactgggcaggaaaccattcaagtttgtagatggctcatgtggtgagattttatgaatctaacctgtccgtttcacacatacaaatgctttttccatgatttttgaaatcctcacttataaagcagtgaaattactatgaactctcgtgttatcttcaggtagataactaaacactcttttggccaaaatataggaatgaaaagacaaatagagtctcaaagctggaatataatcgatgctggaattagactttcaccaagtaatcctaaaaatacatcatagtaagtgttgatttgaaagaaatactgtcatttctcaataaggtgttgaactaattacccttaaactgcctttgagtcactttctgtgattttcatgagatggtaatgttggtatatattgttttaagcaatgcattaatgcttgccaaatattaagtgaaaaaataaaaagcaaagtgaaaattttatctattctttcaagatcaaccttatgtgaattgttcaagctgaatagcattgaactacccatacatacttccatgttagactcagaattttaaaactggaaaaaaaaaagcctgcagataatttactttttttagcagcagaaaatgttctgatagaactttatattaatgtggaaggtcagtatatagaagagatcaacataacactaatttgctggaaagtgttaaaaagttgggaaaggcaatacaagaaccactccacctacagtaacacttgaaggaattccacataacttgaaaacacagattacagttcaaacttctcaatttacaaagtaagaaactgaagtcaagaaaagttcagtgacttgacacagtaatgtttgagtttgcaaacatgagaagttacagaaggtattctggaccttctagatcttcaaaataggaaaccgaaatccaggacagttcagtgacttactctaaagagtccgtgactctctctacaacacagccagagctgggagtcagagctcctgtctttcatttttttaatgcagtggcttttcccaggtcttcctgtgtttgttctcctttcaccgaatttgaggtagaaaacattctgttgttcttttctccacatgatctccctgaagggtttatatgcttgtcaccagcaactacagtttctctgaattgttttcaagccccagtggacaaatatgataaaaagaaaaggaaggtaaatatgtttatcaactatttataactcatgtgctgtttacacaagctcttacaatttccaatgaattctcctactccttaaggctatcctggtgagccatccctgcaggtaggatatatatatatatatatatatatatatatatatatatatatatatatatataattttatatatatatatataattttatatatatataattttatatatataataatatgaaatacatattatacataaaataatatatactttatatattatataaaatatgttatatattttatgtattatatattttacatatatatatatatatatatatatatatatatataccatttttgctattgaggaatcttttttttattaaactgagaagtcatatatacttgcgtgtctggaaatacatctgtaataactgaccctacccttcgttgccttcaattgtaaaatcatatttgttaatggatttcactttgcaagtctcaagcttttacacagacatattgctttttttcagctcatcacaaagcctatagagataggaacctattgctttaattacagcagagagataatctttacctctctgaggcatagtccaggtaacagacgcctggagtctgcttaccactaaagactttgtgaccttgggcaatgtacttaacctctctacgccttatttttctcttgtgaaaaatgaacatgggactaatacataattgaatacatgaatggatagatctactattttcttttgtgttttccttcgagatgtgtgtgtgtgtgtgtgtgtgtgtgtgtatagtttatgtatttaaaattgtttttaatgttataataatatgccagccactcttagcttgctcatttataattaggaaaatgacatttccccacactattaaaggcatatttttaaaatctttgtttaaatagcctttttcttttgagttatgttttgagaatactgagtctctatttgttgatgttttaagcctttattttaggttcaggggtacatgtgcaggtttgttatgtaggtaaactgcatcacaggagtttgttttacaggttatttcatcacccaggttataaggacagtacccaataggtatttttttttttctgatcttctcccttctcccaccctccactcagaaaaaggcccaagcgtctgtggttccgttttttctgtccatgtgttcttgttgtttagctcccgcttataagtgagaacatgtggtatttggttttctgtttctgcgttagtttgctaaggatgatggccttcgactccatccacgttgctttagaggacatgatctcattattttatggctgtgtaatactccatggtttgtgtgtgtgtgtgtgtgtgtgtgtgtgtgtgtgtgtatacatatatacacacacatatatatgcatatgtgtatatgtatgtgtgtgtatatatatacgtatatacatacatgtataaaaaatgtgatatatgataaagaaaatgtgatatatatatacacattcttttatatatgtatatatgatatatatatatacctattcttttggatatatactcaatgatgggattgctaagtcaaacggcaattctcttttcagctctttgaggaatcttcataatggctgaactaatttacatttccaccagcagggtataaggattttcttctctccacaacctcaccagcacctgttattttttgactttttaataatagtcattctgattagtgtgagatggtatctcattgcggttttgatttgcatttctctaatgattagtgatattgagcattttttcatattcttgttgactgtatgtatgtcttcttttgaacagtgtcttttcaagtcctttgcctagtttttaatggggttgtttagtattttttttgtaaatttaagttcattatagattctggatattatgcctttgtcagatattatgcctttgtcaaatattttatcccattctgtaggctgtctgttcattctcttgatagtttcttttcatgcagaggctctttagtttaattaggttccatttctcaatttttgtttctattgcaattgtttttggcttcttcatcctgaaatctttgccaggtcctatgtttagaatggtatttcctagcctatcttccaaggtttttaaatagttttaggtttaatatttaagtctttaatccatcttgagttgatttttgtatatagcttcaggaaggggtccagtttcaatcttctgcatatggctaggcagttattccaggaccatttattaaatagggagtcttttcccctttgcttgtcatgttgttttgtagtagtagtaactggtggtaagtatgcagcattatttctgggctctctattctattttatttgtctaagtgtctgcttttgtaccagtaccatgctgctgtggttactgtagccttgtagtatagttagaaattgggtaatgtgatgcctccagcttcgttctttctgcttaggattaccttggctatttaggctctttttcttttttggttccatgtaaattttaaaatagtttttttttctaagtctgtgaaaaatatgattagtagtttgatagaaatagcattgagtctataaattgctttgcgcaatgtactagtcagggttctctagagggacgaaatgaataggtcagacgtatatatgaaagggagttaattaaaaataactgactcacatgatcactaggtgaagtcccacaataggccatctgcaaattgaggagcaaggaaaccagcagtggctcattccgagtccagaaacctcaaaagtagggaaaccaactttgtagccttcagtctgtggccaaaggcctgagagcgcctggcaaattactggtgtaagttcaagagtgaaaaagctgaaaaacttagagtctgatgttcaagggcaggaagcatccagcacaggagaaagatgaaggccagaagactcagcaagtcagcttcttccaccttcttctgcctgctttatctagccacgctggcagcagagtggatggtgcccacccccattgtggatgggtcttcctgagggtgggtcttcctctcccagtacactgactcaaatgttaatttcttctgttaacacccagaaacacccagatacacccggaaacaatattttttgcatccttcaatccaatcaagttgacacttatccatcgtgggcaatatggccattttaatgatactgattcttcctatccgtgaccatggaatgttttccatttttttgtgtcatatttaatttctttcagcagcgatttgtaattcttgttgtagagatctttcaccttcctggttaggtgtattcctaggaattttattctttttgtggcaattctgaatgggattgtgttcctaatttgactctcggcctggatgttgttggtatataggaatactactgatttttgtacattgattttgtatcttgaaactttgctgaagttgtttatcagatcaaggagcttttggacagagacgttggggttctctaaatatagaatcatgttatccacaaatagggacagcttgaattcttctcttcctatttggatacattttattttatccttctacccgattgctccagccaggacctccagtactatgttgaataggaatggcttggaaattttttaaatgcaaaaaggaaaagagatatatctatacttgcataaccattgaacactttcaccttggcatgtttacttccagaggcagttttccaaaaaaacaaaaactttcagaccaggtatagtggcttatgcctgtaatttcagcactttaggaggctgaggcaggaggactgcttgagcccagaagttcaagacaaacttgtgcaacatagtagatgccatctctaaaacaaaataaatacatttgccaagcatggtggcgtgcgcctgtaatctcagctactcaggagagtgacatgggaggagcacttgagcctgggaggtcgaggctgcagtgagccatgattataccattgcactccagcctgggcaatggagagacattgtgtctaaataaataaatacatacatgttcatgtttttattcaagggcataattgatgaagtccctgctgaaaaagaacatctctcatagcagatttaccttctcattcctcctctcatttgcccacctttggatctttagtatctaaagtatttgtttcaccctgttcaggtttataatgatggaattcttttcagtaaccattatttccattgtgtttacttttatttctatatataaccatattcaaaacataccaccaattattttactacaatgcctaactgggtggctgatgttcttaattgcttagattttgttgttaggtttattctagaaagtgctgtatttcctgagcacttttcataattgacaaagtggatttgtatataaaagattctgtataatattcttgggtaacattactccattgtattctgatattggatattatcatatggaaatctgattccctttcacttcttgtagatgtgttttgattttggtttttctttctggatgttcaaataatttactcttcatcttatatcttatatatctttacgcctcatcttgtatcttaaataagatatatctctatcttttgagatttatgtactcagtttcccggaaacacagtctttcaatctgaaaatttattttcccagaaaagtatcctattctttaactttgaatatatattctgtcccatttgtgggcttatggcatcaggaatgccagttattttaatactgcatcatctttctttgtactctttttttttgtacaaactcagccctaattactttaattccttcacccttctcatttacattcactctgatgatatcgagtctgatacatgttggtaatttgatatttggtggcatctattatgagacttgtactttctaatttatgtattagttatataatgatgttgttttggtccttgattcatttccttaggtccactaactcccttttcatttaattctgttgttttatcctccagtctttgacctctagctctattgaatttattttcattttaaatgaatccattgtgtgaagcaacttgaaaaatttctttgtgtctctaccctatattttcttctggattaagttctttgtttcttaaattaaatctctctcttctcttcctccctccccatcccccctttttctttcactcttttgcattattgttggctgtattatgtttctatatttactatgcctgtcttttatcttgatcatgtgggagtggcactgtccagacattctacttgctctaatgtagtataggttacttctagacttacttgtcatccttcttgggatcccttaagctccagtttgaagtctggatgtttcacgttttgtgtacttttaaataaccaggcatggtaggggaatgagtttagttgaagcagcattcaaactcatttaggatacctagctttgctggctagtactgtctcctactcttgtttgtgggagaaggggctgttctcaagtttccaattagctgttcatttcattgatggtccataagccttaccttactcaaaccaacctccatcccctgtgtgtctcctcaacagtaattgcaacttcttctcaatcagaaaaggaaatgccaggcacgatggctcatgcctaatcccagcactttgggaggctgaggtgcgaagatcacttgaggtcaggagtttgagaccagcttggccaatgtggcaaaaccgtgtctccactaaaaatacaaaaattagtagagcgtgatggtgtgcacctgtaatcccagctactcggaaggctgaggcaggagaagcacttgaacctgggaggtggaggttgtagtgagccgagatcgaaccactgcactccagcctgggcaacagagcaagactccatctcaaacaaaatcaaaaacaaacaaacaaacaaaacaaaacaacagaaaagaaaaggaaaacttggggctattcataattttgcattcattgatgttcggcggtgttagtgagaattcttagactttcccccaaatttcaggaaaatttctggggtttaagggaagataagaaagtaaatcctttttctgttttactccagaaacacttgttttgattttgttgtttttatttgctattgctatgctttcttttcattctttgactgctgtgggtgatttttatgtgtcgatgtatatactaggatttactttttatttcattaggaattaagagagggaaattcagttatgtgttataatctaccattccctcatagaaaatctactaataagaaatgggaaaaacaaattttctattatgttttagtgtacttctgtaatgcagttaaaaagacagagaaatagttctcatgcatgacagaaacatttattctacgcttttagaatagccacatcttttcctctcaaataccaacagggaatactagaaaatatttgactgaggaaaaataatagctctcaaatttctgtcagtatgcattgtttgggaacaggataatttattttggatatttattatttgtggcatcaaacaacacacatgatttaacacttaaatcttgttttccttaacatggtctcatttagttcacagctaaaacagaaaattcgacaaagaaagacgtttatcaattgtatatgtatggatatatatttgtgtgagtctatgtgtgtgcaggacactttattctgtgtgatcatatattttatatagaagaagagtggtccctcagtatttgtgggggataggatctaggtctaggatctcctgcagataccataatctgtgaatgctcaaattcctgatatataatgttgtaatatttgcatataacctacgtcaatcctcccatatattttaaatcatctctagattactcatacttaatgcagtgtaaatgctgtgtaaatagttattaagctgcatttacatattttattttttatagttgtattgttatttttttatctgcagtcggttgaatccttgactgtagaacccacagatatatatgaaggaccagctatataaaatcttaattctcattagagaatgtataaaattatctcatatgagaatatatatataaatataaatatgtgtgtatatgtaggctcacacacacacgcaagcttaattgttggagagttgccaataactatcaaaagccatcaatagcacatgaattatttccagccactatattaacaaaagcgtagcaataatgtcagtaagtatatagaatttggacccagagataatcctcccattattattatcacaggcttgaacctcacaaaattgtgctctcagtttgatcctaggctccacaattagagagatggaaagcttagtctggatttagaaagaagcaactctgattacaggaagagctggaactaaggaagggcaatgggattatttgtctggctaaagaaaattgtgtggagagatctagaatcgtttcctagcatatatgaaggacactaaatgttcttcattcccacagcacatacagctgaatttttagatagaagtgtttctcagcaaattgtgctcacgagaagtatactattagggtttgaaaataaaattcaaaggtctaacattttatttctctaggattattaaaatattgtcattgccaatgatagcagaatagcttactatttgtcctaatattctataggtgcaattggtatgaactttagaataaaagaatccccttatatcttaaatgttgttccccgcttagattttccaaagcgattactcatctgcagccagaagatgactgattgccaagggatttgccgttgaggactgaactacacttatgcctggtcatctataaatatttatgaagcacctatcccatgcttggccttggggacacaaagataaataagacaatccatgttcttaaggcgttagtagcttagtgaattcatatccagattgatgccacaatgggatgaattgctgtagaaccaactgcttttctgtcatgtggttttcagtaataatatatttactttcatttgagaaaacatgtataaaagtaaatatcccacttgggcttacacctgtgtcaggaaaaaagttaatacatattccagaaattgtcagagcacccaagcacattcccctcatcatggaaataatcactgccagatgagattgaaacatcttttggaatagaaaatgcttagaatgaaatccataccttgaaatccatttttctagtacagtagaagggccattcattattaatagaatgtaacttaagtatgcttttatttccaacgtgtaatacattctactctcttaaggctagaaaccaacttaacctaaatgtttagacagtatagtcaggtatgtgtgagagacactcgtatggagaatcaaatgcaaatctcaacaaccaatcctatgagagagtacagatatgtaggtaggagaaagtaaactagagagaaatattaagcagacttcaagtcacttgtcacgtaagaaaaggccgggagagaagctctgaataggacagaagatgcatcatcacagcaccttccttaaaaaagaggggaaggaaggagtatgcatttaaagatcaagttagccaaatacaagttactttggcaacaaaagttggtgcaggaagaatagaaactatcgggttgcatttctcatctcacacttgacaagtctcttagaaataccgttacctagaatgagaattttgttaaggtatgtttaacatggaagcttgtatttataaagaatatttttcctcttaggtgtattagtccattctcacactgctataaaggtactacctgagactgagtaacttataaagaaaagaatgtttaattgactcagttctgcatggctggggaagcctttggaatctcacaatcacggcgaaaggcaaaggggaagttagatacatgtcttcacaaagcggcaggagacaggaagtgccacagtttaaaaccatcagctctcctgagaactcactatcatgagaacagcatgggggaactgcccctatgatccagtcatctcccaccagatccctttctcaacacacggggattacaattcgagatgagatttgggtgggcacacagagctaaaccacaccaatatgttatctccaaacctgcattcaatgccagatggcttccttcgtagtaatctgaatgtggttgcatgtgaaacaatggctccttaaagtgaaattatctgtttatactattttgatactgcacttgaaataacccatttgttttggatttagaggtagcccaatttggcagcaaactcatcctagacatttggtgtgattagtcttttcaaatatatgcattccagagaagattaatggccttattatgtccagtatttcaacaaaaatgaacaaatgaagtccaaaggcacatggctccagggaaactagctggctttccactgttctcagggcagaatcacagccactcaaagattatggttatttttttttctcctaataaaatctgttcatcaatctggttttttactcagtttgtgttgttcagtcaccagagtggtttgtgctgcctattgttaatttaaaccaactgcatggttttaaaaatgcattctttgtcatttcaaagagctgtggtaattctttggaatatagtgttttcaaagttcagataatgcagagaatactatatatattacagtgatattttaaaattgacccatatttattacatacctaagtaactggaaaagaatagctgaatagctaagtaacttctaaaagtaaaaaaaaaaaaaaaaaaaaaaaagcaagtcttcacctatatggggtgttgctgaaaatacttatgggcatttattatgcgaaataaaacccataatactatttaagctgttgatgatgactttgtttggagctcaaatcacagaagaaatttcattgtacagaattcaaatgggtagtcatggcatagaaacgtttaaaaagaaaaacagataaatttaaagaaaacttttacccaaatttaaggtttgcctgtacaactcttaacaattgcagtctggaagtctcccttatgtattatacctttctaaatatgataaacacttttaaaaaacagaattatattttttctacatttctatcacttattagttttggttgggattccttgtctcagccccccataaaaatgattctttatgtatatactagaagtacttgcaaaggtcctaggaaacccagatctgatggaaatgtggacaatttatttctggccatggattttattttattccagagaaggaaagtacaactgaaatcaatatcttgcctgaaattcttgaaacattgtacatgtgtatgaagcttttctctgaaatggactaatactatgtaaatggaacaatttgataaacttaaaaattcatggtacttttattagtcattaggaaattgctgccaaccaaaaagcctaaagtagtgaaatgagtccttccacagaagtgggagaaagcgtaatgtgcaaagggatttaaaaaacaaacaaacatatgcttcaggctccatctttaagaaccttaatctggttggtaaatagtgatatatgtgaaagataacttatataataagtagtgtaaaagttgaccacagagatagaccactgcaagaagcagaagaaagctactctcagcttcatggaacgttatggaaaagggatatgtgagctgcttcttggagaataaatagaacatataacatctgaggaatgcaattccagacagaaatccatggccagaaatgtgctgaagaaatatatccatggccattgatgaatcatattcactctttagtcagtttttctatctgtaaaataaaacaattatattaaatcatcctaaagagccattttaactattatatcctgttttaatagcaagtagaattagtttaagtagattaaatgatttctacagaaaaggaatgagaaaaaataagatttgagcagggaagtttttaacctctgagttattaaatataaagttacaagcttggtctttattctgtggacattgaaagctcattgacaacattttgagaacagaagtggtataatgaaagttttctcataattttttaaaatggtacttcccattaccctttaattagagatgactttatcaatttgtgttgagaatataggactccagagctgtgaatagtataacatgattatactttgatcctaaattctaggaagcaatcccaaaatgggacaaatagatcccagatcctagtctgatcatcactgagaaaaaaacagagatcaaaaaagggaaaattgggtaaactttatttgtctgctgccttgcagaatagtgtaatcatcaaaaatatattcagttacatattgatttcatgttagcctgatagagccacttccactgagaagtcacatactagtgtcaagataaagcacatgcacaaataaatacagtgcagaagaaaccaagtcttaaaataaataccacagggtttccaaaaggagagaaaatttttcaagaaaaaatcaggacatccttcttggagaagtagcctcatgaaggataggtagggtgtctgtattagtccattctcatgctgctgataaatacatacctgagactgggcaatttataaaggaaagaggtttaattgactcacagttcagcatggctggggaggcctcaggaaacttacagtcttggtggaaggggaggcaaacatgtctttgttcacatggtggcagcaaggagaagtgtggagccaaagggggaaaagcctcttataaaaccatcagatcttgtgagaactcgctcactatcatgagaacagcacgagggtaactgtctccatgattaaattacctcctactggttccctcccatgacatgtgaagattatgggaactataattcaagatgagatttgggtggagacgtagccaaactgtatcagtgtatatattatagagtgaaacagtaaacatttcagggtgagaaaatagaatttacaaagacttagaattagaaaagggtcatttgtttcattgagccatggggtatatgtaagtcacgtgtggatgataagtttaacaagtaagcagtaatttggtcatgtattatttaaaagaaaggcagaagagctttaacctaattcctaatccaacccaagcctgtatgtttagacctttttaagaccctctcccatgttatgtaagtattttaattccttttgctcagcgaacttggaagatatgctttaatatttctgaaaagtattctaaaataatcaatacccgttattttctctaaatagtcatggtacctcattcttcactctttattttttcttatcattaattgacttttttatgacaagaaaataatattattttgtagatatatcatttccatggcattatccgaacttcttctactcatcttctaccaatattgccacagcaaaggatgaaaatatgcattttgttgcttgagttttttattggcatcagtagcaaatctttgttgagcatgtactaaggatgaggcattgtactaggcattgagatatggagaaaaatccttagcccttgtctttatgatatagtccactgatgactgataacactgcctaatagacagtatatttcagaaaacatgagacttagactcattttttttttttaagacagagccttgctctgtcacccaggctggagagcagtggcacaatagcggctcactgcaaactctacctcccagattcaagcgattctcatgcctcagcctcccaaatacctgggattacaggcatgtgccaccacacctggcttatttttatttgttgctgttgttgttgttgttgttgctgctgtttagtagagatggggtttcactatgttggccaggctggtcttgaactcctggcctctagggatctgcccacctctgcttcccaaagtgtggctgagccacagtacctggttagacttagactcatttctgattcacaatattgctgtttggtacttcaactccccatttaagtgagaaaagttattttttcccttgcctgctgtctgatatactgtgaaagttagagaatctgaatagaaataaagatatcaagatagccagagaagacaaggtgtccagtgtgatgacggaagcctaagaaatatgagaaaattacaaaatatagattagaactcacatatacgtttgtaatcaggaaataattgttgaggcatccctgtggtacttaacaatattacaactataataatacggctaaatcagattattttccccttggttaatcagaaatcactctattttattaatcaatgtaagagaaggttttagggattcactacgtgatcagctttgctttatttagttccattgagagataataaacaggaaaatgagtcctacaaccccaagttggaaaaacagtgaatctgtgtgaaactgttagaaaacagcaatcacttaaactcaatcatttgttttttgagaaattctgttatgtagagcacactatttttgacattgagaatatagaaaactactctaattggagaataaggaaataacaaaattgaaaaaaagcaagaggctacatacatacacataaacagacataccacatttatgtattttagtatagttacatacaataattatgtttgctaccagtgatgtattgtaatatatttttgcatttattttatttatcatgcaattatgcactgttatttgcaaacattaactgtcattattctcaattcttatctcgaggttatagatgaggatagtaacagaggcactcgcagtgagagaaggacttgagatttaaatccagcccaatctggctccattatttgggctcttgaaacttctcttttctcttcttcaatataaatttggtgttctcttctctccctttctcttctccctctatattcctaatcctttctattcctactctctctttctctctctgtgtgtgtgtttgtatacatacgtaaacgtatatatttaaattttagtctcaacccagtcaattgatttcaagttctaatggatgtgacccaaattttgaaaaactctaatgtagacataatgatttcagaaacagaaaggatggatagattcaggtaacttttatggtaccaggaaagaagaacttaaataataaagggaaaggagggttagaaaggtgattttatttaatgactctaattgcttatcacaattatctctcaggctctggaagtattattgcagtatctttctgccagaagtttcaagtggcaaaagagacagttatagcaaatcactttagtacataggcagggaatcagactgtctggcttcataatttacaagctgtgtaatttggggaaagttatttaaacaccttgtacttcaatctctccatttgtaaagtggggataatagaacctgcttcaggtagtgggagagataataataaatataaagggcttaggataataaactctgcattgtcagctctcaataaatgtttggcattgggtattaaatgaacccttgaccaaagtctttgggaaaacagacagcagaatggaactgtttccatatattcaactaatacttctgctcagaggtattcaagtaatatttctgatatcttttggtttattgtcagtgaatttgactaaggaatcaaaaaagccttatactaatatcatcaataattaataaataattttagccaagttgtttagaggtccaaatattatttagttactaatcagggaaataataaagaaagagagagatcattcagtaggaaaaatcaggacttaaatcctgagagtttttaccagctcttttatttttctagaaggcaatggccatcaaagattggacattagctttggtgtcaggagaaagtttttctgatggctgttagaaagagcaaaatacagcagctacttaggcaaaaaattagcactcatcactcactgagcataacaaaaatgacaaaaacacagtctacctttggtaatggctactaaaaatacctatccattttctatgtgaaacagatcacggctgctacttcactgtgaatttaatctggcttctcagtcaatataatatttaaatctgatgtcactcttaagtttccccacagaagagaataaacattaatttttagaatttctttctcctaggcaaggttttgtgggctaagcctgagccaagtcattagcaaagatgtgttatatttataattttcattcaattgcaaatttccatcatagagtaactagtgttacgataattaagaaatggaattaaattagtatatcacatgccatgctgtgaaaattataatacagtatagtaatacactacagtagataattgctaagacaataagaatgtggccacagtaaagatgatataggcattgtgtagttccctatcaccatagccagtttcaacagaaaatgagtccatcacattaatcctaatgaaactctagaattacaggacaactgagctttcttatcttatcctctgggttgtctcagttccaccagcttccctttctttactttatcagaatagtttccaaagacttatgtacttttcagtgtgtaagtcaattgggtacataacacatggatattcagaatgtttattatgtatgttttttttttccaaaaagtgtttccttttttctttccttgtggcagaacaccactaactgcaactgtttaactgcatttgggggaacaaaagatttgttttataatagttcctgtataataagctaagagcttagggaatgatttgaattataaatattttctatcccagagcagtgttttaaactcagtgaagacctcagcagcatgcaagttcacatccccacccactcactcacttttttttttctgtctttgcagttccgccatggtttttaaatcatccttccaacctgtatgcctatgaaagcatggatattgagtttgaatgtacagtctctggaaagcctgtgcccactgtgaattggatgaagaatggagatgtggtcattcctagtgattattttcagatagtggtaattattttgtttcatatttgttttataatcccattcattgttttctatttttttcacttgtttttatttcttgaaaaaaaaaaaggttcctgttggagattttttgtgatgtgttaaaaaagttattcaaataaagcaaatgattttctagacataagaatatttgaactgagaaagagtgatcaaagaattcagccccctggttttacagacaagactttaaaacatacaaacaaacaaaaataaatgaaatacagacagcctaagtatttctgagtagtttcacagtttcactgctggtttatcaaagagagtttagaacctagttctagacttaagccaagaatcccttacttctttgacttttacccattttaatacagttttataagatatgatacttatgattatggaagtcttcacttggtaatacagacagcttttttttcctaccctgccctgtaggaccagcttatcctacatgagccattgagaaaggcagtggtgatgtggtaatgaggacagtgggtgctggtggcattggtggctgcagtcataggccatgaagaaccagagtacacattgctttgtaatttccaatactggaatgaattgaagctaagaggaataacttctatggtttactataagttttagttcattttctatccctattgtgggagataatagggatagtggtactctattcactgagttgttggcctggtacacatggagtgctcaataccttccattattgtagcttttgctgttactggcagaatgcttgtctcatttggaaatgctctatgaaatctcacttataggtataggttagcattggaggttctgattttaggtatatgaatatatgagagcgatgtaaagttcttttcaaataacaaagaacttgcagctacagaagagggttttaggcctacttatgtttgagatgcagacatgacactttcaaagagctgtaatctagccaggtctcctgggcagaatgagactagagcatagtcatcctatgagtccagacacaagctctctccatcgtattacaatggcctttgttgcaaagtgcctcttccacaatcagtcgactttcagaaactttcataatatctgtgtgcatgcatgttggcctactataaaggttcttaaggaatacatccataaaggacattttatcacttttattaccacttattatttttcacttttagttgcatttgtttaattggttagaaatagagtaagaaagataaaattttaacttttaaatgccacagtgatccattatttcctttaaaggcgatgttatttccactaccactgaattaaaaatgatctgccaatgggcactttaaaaagtgttgtatacgcctaaaatatatgctacttacacttaaaggacatttttcagtgcccttaaggacgtattgtaaaaggcaacatttatttttttctacattttgaatataatctttctcccagcatgactcattacagccaaccaatttaaattcttcttttataggtgaaagaaaatgtaaggtattgcccgatttgcattaaattgtgcttaaaaatatttcctcaacagctccagaaatttgagagccattttctgtcacacacttaacattgagcacaaatagtaagttatatgaaaattcttaattagaagttagccagttttatcaaagaattttacatcagctaggaattgattacaagacactaaaaacaattaagaattccccatgaggtaatatttatctcttaatgacttcaggggaggtgatttaacacgtttcacttacttaactaattcttacactaatatcgaagataaactgaattagtataattaaatgctatctctagatcattttatcatccatccttgaaaaagatggtggctcaatttctaaataaaaggagttaatgttgctgtatttaatctataaaggtgaaacatttcagccatacaataagaaccacatgggtgtaaaatattcaccatactcccctctccaaaccccaaaagcttatatgtcaaagccatcacaatatttaaagaatttttagatatttttctgggcaaacgcttccagaaaatatccaactttgatttcttgtcctttagaattcacaaataccagtatttataccctttcttttttttcctgagcagctactaaacctgaacttccttcaataacaagtaaaagaatgagatttcttttcatggtaatctttgttgcttctataattaataaaatacttgtctgttgactgctcatttaggtattgaggatggtgcatatttttgtcagcatattatttaatgcagatctaggttaaactgatgcctgtgaattcagaaaagaaaattgggaaggtatgacttttcccaggtggcataggacacgtctgcgaggctgagacccctcatggcctctcctcttgtttcttctgtgctgttttatcaaactttggtctcatctaagttcattttgtcaccttgcattttttgctttctaaaatactttacctgctttttcttttccctagggaggaagcaacttacggatacttggggtggtgaagtcagatgaaggcttttatcaatgtgtggctgaaaatgaggctggaaatgcccagaccagtgcacagctcattgtccctaagcctggtaagacaatgggaaccttgctttggtacctggaatgaaaattattcatagtctgttggtaaaatccatattgtttttcctacccctcaagggcaatatggcaatatgaaatcatttagttaattaaggtgtatacttgtgtattgatgacattttccctctagaaaattgtgtgtgtacatgtgtgtatatatatatatatatatatatatatatatatatatatatatatgtgcatgtgtgtatgtgtgtgtttgtgtatatatatatatatataaaatctccaatgagataaagtcatcatgaataatagggcctctgcttttcaaggcaataaccactaaattattaccttctccctcttttgtggcctgcctttcttcccagcattccatttaaatataaaatatataatatataccttgcatatatgttaggtgtatattttagttatatatgtgcatatatacgtacacacatatctataaatatatatacataaggactgtacatattttcttatatgtaatcttgaatcaatggaagttaattagtgtattagtctgttctccactgctatagagaaatatctgagactgggtaatttataaagaaaagaggtttaattggctcatggttccacaggctgtataggaagcatgatgctggccatctgctgggcttctggggaggcctcaggaaacttgagattatggcggaaggcgaaggggcagcaagtgcatcttatgtggctggtgcaggagaaacagagaaagagggggaagtgctacacacttttaaacaaccagatctcatgagaactcagtcactatcaggagaacactaccagcagggaaatctgcccctgtgatctaatcacccccaaccaggccccacctccaacactggggattgcaattagacatgagagtttggtggggacacagattcagaccatatcaaaaggatcttgaaaaattactctttttaattataattgcaaaaaatgtcattttgttttatagtcttttggaagcttaatatattgctgaattacagaattctagtataagtccgggcacagtggctcatgcctgtaattccagctttttgggaggccaaggggtgaggatggcttgagaccaggaatttgagaccaatctggacaacatggcaagactttgtctctactgaaaataaaaaaaatatatatttaaaaacaggcagccacctgtagtccagctacttgggaggctgaagcagaacaatcgtttgagcccagggtgttgaggctgcagtgagctatgatcacactactgcactacaacctgggcaacagagcaagactctgtcacaaaaaacacaacaaaacaaaaactagaataaattgatactagacctgtcatgtaacagctctataacaacacaatttcttgggaggagagacaaaaataaaaacaaaagaaccatcctgctgctctgaaatgattaaagaagtttaaaacagggacaagacagttgttaatacagatccaaatacttcaaaatgttaatatctcccataaagagttatctatcatgttacatacatttcaactcttttggaccagttttcttccttttgacatggctcgcttttgtgttaatcttttcctgaagtaagtttaatagaaagtaggaaaagcatataagacatagtctttctctggcttttatcatttaaaatgtgcctattaagtccttatattgtatgcaccccagccagttagctgaagattcacagcagtgctcacaaagatgactttctcctatttccttgattgaaataaaaataaaataactatagaacaacaataccagatgagtcaagaagctaaaggaactatgtaggaattaaaaggagcaattaactctggctcaagatcaccagtttctctgatggacttcttttccctccatttgatgtgcttaagtgtcagtgtaacttcattggtgtgactaagtatattattttctgctgaactagtaatgcataagtaggagaaaaggaacctttaaaatcagggtctctaatgtgagccacactttttttcttttaattttattattattatactttaagttttagggtacatgtgcataatgtgccggttagttacatatgtatacatgtgccatgctggtgtgctgcacccattaactcgtcatttagcattagatgtatctcctaatgctatccctctccctccccccaccccacaaactgtaccatatcattagtaacaaaagtatgggtgcctttaagctgatattggctgctacgccagtcacagaacaggagaattgtaggtgagtttgatttttcagctaaggccataaagctgatgacaatgcaagataagtgacttcgtgtttctaaaggaggtgtaagatgtatcctcctagcacttggcactgaccaaagaagtccagtgagcatccctgtacctgctcacagggagggaggattctttgaagtgctagaattcataggatgagaggttgtcatggtattttctctcctgtaccagccaagttatacagactccaagaaaaccttttagactgtgtgtgtgtgtgtgtgtgtgtgtgtatgtgtatgtgtgtgtgtgttgctggggactgattgcaaaaatgggaaatgggcaactttattctgctatttcatggtctatacaaacctgcccccagtgtctgaggaagctgagagaccaaagaaagaggctgacaaatctagtttcttagaaatacttaatagggacttatgaacaggagccatatctgtgtctctggcagtgctgagacaacatggtggcatggggatgccactagcccccagaccgagggcttatataccatggggagaagtggttttgaagggaagtgtgagatgatggaagtacagtaacaccaaagttttctgacctaatggcaggatttatggtaagtacctgctgttacacaaggaaaattgataaacaggaaatcttagaggccttcccagaagaggggttaatcagaagccaacaaacatggtggattagcttccaagatggagttgctttcgcctccacactggctggaaaccacctggagctgtccacaatgcagggaagagaaaggagaggacaacattaagaagaagctctatttcgacccttgagaagaacaagggtgtcagttccacttgaagaaggcaaggctgaaggtttcttgaaaggacttttcccaagaggtcctgtctgctgaggctgtgccaaccaagacactagagtgatggcgcctggatggagctgagctaggagggtggcgcaggtcagccagagagtgctttgccaactccagcaggggtccagtgactgcatttctaaggtggggattttctgaagaactcacagaactgctccacaaaaacaaaaaaaaaaaaaaagaagcttgcagaaaccttccatgagtgtggacttttgaaaggacaagctgagaaaaacagtctttgtctctttattccaaatccatcctcccctctctgaccctgaggaagccctaaatagaagggagaagcgacctgagagactgaaacacagatgataggcagtcctactgcccccttccctatttacaatctacacttgctttgagagatggaaagaaattttaaattattagttgaatattttaatttagatctcattgaggtgtttgtgtgttgtggggttggggggggttgttattgtgtggagttctgtttgttttgtttttgaatacctgaagataaagcttttttttttttttgagacagaatctcactctgtctcccatgctggagtgcaatggcacaatcctggctcactgcaacctccgcctcccaggttcaagtgattctcctgtctcagcctcctgagtagctgggattacaggcatccaccaccaagcccagctaattttatttgtttatttatttattggtattttttaatagagacagggtttcaccagattagccaggctggtctcgaactcctgacctcaggtgatccacctgtctcggcctcacaaagtgctgggattacaggcctgagccactgcacccagccaataagggcttttaaatacttacctcaccccagggccagaggatggacccaagttacaatcagggttgggaagacagagctgacagtgtgtgtttgaagacggatgacagcagaaaaataaaaagctatttccttctaatttccaatagttgagcttattcagtcaacccattatagatgttcaatttcacttctcccaggaactctacaggtagcctttaattcatggtatcttgcattccacttgggccctgatttgtttaggtctatgtgaccataaagtgtcaaggctctcctgagcagaaatggcgtttaactcctcactagagcccaggaaaatcttgaaaattcatttattttccatctagatggtagagtgttgtcagtggcatctactctcttggtcgttgtttattgtatttggcattggattcaaaagaaagtaaaagaaaatgaagataaaaatccgaaagcgtgacaggacaccattgtgactgtcttatatttcccccttacacatgatggattgctttttcctggctatttaatcaggtcttcaaagaatgccactccaattcctcagagatgcagcacaggccgcgtgcacagatggtagagaggccagctataaattaagcaatgaggctgaccatggtgggaagaacatagccctctctgtttaagttttgacaataaacggtcaccatatattttgaagtacattgtgggcgtgcattacccagctgttcagctttagcctgtccacaggggcttgtggctgagagttactcttggcaaccataacaatctgcttctcgctggagtacagacaatgacctatttgagccagtgtctgtagttgtcggatatttacataagcctaatgaagtttcaacatagtcttttatatatagttacctattccctctttagcagttagtgacttaggaaataaaatgaacataatctgctgaattaaattgagtgaatgacttgtttttctctccagaaaatgctagggaaaaatatttgaaatgtatgcattttcaaatgtgaaatgtatacacggtttcctctagataaagatcaagattaaaatcaagaagatcaatggtgtttttaaaaatcgttacactacaggaggttctatcaataatggtacataagtaacataatgccatacacacagtgctatctatgcaattatttattttctgtctctctctatagaacacatgcacaaatagaggatggattcctgcacacatgagactttgcatatattacattaaaaatatggagccatattatgtaagcagtgtgatggaaagttaattcagtttagttgatttatatgatgtgtattgtttattaatctctccttagatctggggacagagttttattgttgtttgttttaattaatttttgaaggggagggcaggatgttggctaagaagtctcctttctaaataagacattattactgcaagtatactattcagtgaatagtctagcaaaaaatgggttaagaatcaatgtgttaggactgggtgcagtggctcacgcctgtaatcccagcaccttgggaggacaaggtgggcagatcacctgaggtcaggagtttgagaccaaactggccaacatggagaaaccccatctctactaaaaatacaaaattagttgggcatggtgacacatgcctgtaatcccagctacttgggaggctgaggccaggacaatcagttgaacccggagggcagagattacagtgagccaagatcaagctactgaactccagcctgggcagcagagtgagactccatctcaagaagaaaaaaaaagagtcaatgtgttctgtgttacaagaataagaagtttcagtagccagagttgcaaacaggtaagcaataagttaggatcccattggcatactggatggtgataaattaattactcccatgttaccatccaataaattgtagtgcaggtaggcagtaattaaattaaggaccctgtttggtagctgagtggagaagttagcaattatctggagctggggagcaggagatggggagcaaggcaggaacaaataataagatgaatttaagatattagttatctctgagtttcttatcctggttctagatgttgcatggcattccgttttctgacagtgtctgcagcggaaggttgttggaagtacctgactgctgagcagggaagtggagggccgtggaactgggaatgcacctacgataggggcatacgtagtctgggatgtgtttaatatagtggcataaatgcgtgaagacagaataaagttgccatgggaagaaataatgtattcattatattctaccatgcacaaaatggctgtgggaaaaatccatataatcataacaagaataaatgctattatagatatttcccaaaatgttggtttgcttgggcaagatatagggtctatgtcttatgttaatattgcatatttggctgtgtggtggagtagacagagcacagactttggagtcaatttaagtacaaatcacagctctatcatatattagctgtgtgacattaggccagacacttaactccaagccttaatattatatcctgcaaaatgtggatagtactatctatgccatcaatttgatgggagaattaaatcagaataatgtaagcaagacacatatcacatctaccacatagtaactgctcaataaatgtaatctgcacatttgatcttccttcatctaagatatacacctgcttttaagcaagcatggtttcttttattcatttgtcaaatatttttgtaggcctactatctgctattggggaaagtaaattgaaaatagaaaaagagataaatttcccactttaaaaaataatcacgtttttattggaagaggaagacaaataaaaaaaaataaaaataggcccggcgcggtggctcaggcctgtaatcacagcactttgggaggccaaggcaggcagatcactaggtcaggagatcgagaccatcctggctaacacggtgaaacctcatctctactaaaaatacaaaaagttagccgggcgtggtggcgggtgcctatagtcccagctacttgggaggctgaggcaggagaatggtatgaaacctggggggcggagcttgcagtgagccgagatagcaccactgcactccagcctgggtgacagagcgagactccgtctcaaaataataatgataataataatgaagaataaaaaaataaatgctggttttatttttttccctctaacattggttaaaaaaaatagtttcactgtagtaggggaaatatattggttagacgtttagaaaaatgagaagcattatcaattatctgtcctcccctggaaaaggttactgattacaaatgatgttgaattttaaacattttattaagtcagtatatcatatagcttggaattcagaagagtcaatcatgaacatcaagacgtaaaaccagaagtattttatatctgttttcatgagttgttccttatcaatataagaagaatacctagaaatccaaatggacaaaaggaatatactaataaaattgtatatatattataatataattacattataattatagtgtttcctactacatgttgattctgacatactaacttcactgagattcagtgtgaagcaatgaacattgaataattagttcaattattaagatctattagaatttactttttcagtgtaatagcacctaagcaactacgtatgagagattgaatctaaagggctgtacttcttactttgatattaactactggtggagaattaagttaaattttgtctcttatatgagaaaagttactatgatttaactgtttcattgtgtttagtgtaggatcaaattgtccctggagttctgtaactaatctagaagagccaatttcatgtgccatactacaatgttaaccgacccaagcaggtaaatgggtccttatagtttcctcacacaaacagagatgctcgttaacactacaaaattcctctttaaagttccatcattggtccaaatgcataaaagtgcaacttaatatttttgaaacatattgcagtgatattatagctcataagcttccctagaacgttttcctttataagccttggtaattaattgtagctaagaagatacagagccaagttttttcaaagtggctttgttaacttcagcatatctgatggtacatttattcaataaattgtaaaattatttttgcttataaagttaaaaataagagaatagtaatgtatttttttttattttctacttcaaagtctccctcccgttagagaaatgttgacacccatgctaacattttccctgagtgattcattgataatctaagtttggcataaagcagtcatttgatctttgaccatataatactcacctagtgtatgagatgtgtccacatctcatttctacactcttatccagtttacttgtagagatttaaaaatgtattggaatatagtgtatatttatgaagagattcttaggcaatattgcctaacctttccaagtctctatttcttcagctgtaaaattcagtagataattgtctcaaagatttagtgcaataaatgtttgtaaaagggatttgtgggctgtaaattgccacacaaatgttagctattatgaagtcttttgttggttttgtttagtctcaagaaaaatagcaggcatttattgggatggataaaatgatagctttcttctagcatatttttctaccctacaagaaaataattagtaaacacatattttaatgacaatgtccattcaaaatttaggtttttagcctagtggacaaggttaagggaaaagtcctttttcaaaatgactgctagttgaaagatttgcagcacggtttgcagtatcagtttaataatgacttgctcatgccagttttatgtaggcagaggtttctcagcaaataaaggcttgtcattcaccttgtccttcattcagcacgtgcttcaggtaggaagccagctcagtgctaatcaagaggatatggctgtatggcagactttgaaattagaaatgaattctgcagtaatatgaatgtactgagaccagtgataataataaatccatacaatatggaaaacttgatagattcataaatattgatcacatcatacttcagtggtaaatataccagagtgttatcccattttttttttttttttttagctctctagagtagaaaaagcggaagagaagaatgctggtttttatattgaatccaaatgattttgactttgaatttgttatatttttatctttcacctgtatatcaccatttgatgaaagatgtgcgagtgcacacaaaacatacatacatatagattatatagtatgtagatgctgtgcttatatgtatacacagaaagagatatatattccttttgattagagaagtcttatttcctggggaaaagaagaaggttaatgagatgaactgtaacccccaccagtgcaactgcaactggtctcaaggctgcaattggtactatttccctcctgctacccgctgtaaattcctcttactctcagctagcatctctgctagtttctgtggcttacccaaattcctgtccctttactggtcatatatgctgtactagccaatacatgatcaaaattggggaagggagtatcaacagatactccagtagatcatcagaatgccaatcatattttccttctttcccaactcctcttaatgacctgggcaattattttgccaggatagtatcctgccttgcctgctggtattttggcacaagacgtatgatacaacaaggcagcagcaatagctcaaatttcaatgatagaagcattcctcctttgtgaattaggacttctgagtctacaagcctagagtcatagggatggtaaacagagattctccaaatgggtcactgggagtcatggtaagcagtttcatacctactttaatctcttgtgtttgtttagtctacctattgaggacatggtaccatatactggccattgatctagacatatactagaccctagaaaaaggtatcccttttgcttagggtatggtctccagcctggctccttaattccacctctgaaggctttactttggctgtatcaagtcagcagctgttgttgatatgtgataggattagtagatcccgtggcaatgcatttatgcctatacctctttttctgtagagtaagttatttgattcttttcaatataatgagggattccatgttggtctcaaatactttgtgagtctgagatggtggtgccggtagaagccctgagaataggaaaagcaacccatttccagaatatgtgtttatttcagtcaagatgaatttctaaccttttcagaagagaagtcatccaagtaaatatgtcacccagagactagttggttttcttaaggaatagtgatttgttgggagctcagcatgtgtctctgttgctaggagattgggcatacagcagtggtggcagcttctggtgagtagcagaaaccatgtaggattagagcccatgccagtgagcaatgcataggctccattcttgcctctgtagccttatcatttgtgcacctttatgccaccattggatgctggctgatgtcaacaggctgaattgttccatctacataattgcttagtgactcttccataaattatacaatctggtgtttacaggggattcaaagatttttttttaacttggtgttcattcctgtgggcctatcaacatgtcttttccccaaacctttttgttcctgatctttccatcattggccaatcagccaagctatttgaccttgttcacatgtatatatatatatatagtcctaccttgagccatttataatttcatataaagtaggtggtgtggtatactcaacattctaccttgggaaaggttctctttaccactttcttttggggctatccctcactgagctgcagtgtagcagccatccaatttggggtgtacccacatacccacagaccaagctgaccacctggtcataagtgtgagttaaaggggaaggtagttgtacaatagtgattgaaaacatggaggtctgggcccctcctgttatgtcctctggtcccgtttttccctgatgccaaatgtaattcaccccatgaactgatgatggtcctgtctgaccttataacttggtgcatctcagagaagccagggtatgatgagcagttctggtcagtggactctcccatggttatttttctcttactttgtgagtagggaaactgctgcacagaaaagttaactaacttgtccaaggtcacacagctagcaaaacatctgacttttcagcctactttctcagccattgtgttataatgggtctgtctacccaggctttgtccacacatggaggcttctcagataaatgggtgatatttcaggtttatttgagtctaatcagactagttttagaattactaataaaggttaaacactggaaattaatttttaaagtctaggattctgccactcaaatgatctctgttcaactttccaatatgatagggcccattgctaagtgtgggttaaatgtgtgaaccgtcttgaggtgaatatcacataattgttgctatccagaaatccatagtttaacaaagagtaaattcgatataactaatcttaattatcaaatgcaattaaagcatagtgatttgcaatgctatattcattattcaatatttatcgagtacccagaaatatataaggaatcacaaattagagtgttgtgatatgcacttgcagtcccagctacttgggagattgagatgggaggagcacttgatctcggaagtttgagactgcagtgaaatatgatggggccactgcactccagcctgggcaacagagcaagaccctgtctcataagcaagtaagtaaatacataaataaattttacctagatattgattttttaacaaagaatcacaaatgagagatgttagatacaattcaaagaaacattaagtctttaaagttagtcttaatactcctcaaacataacacagccagtgcctgacatactattttttgggtttgaccctatcttacgaggatggtagtgtcatttgccacacagaatgacaaagcttctattgtattgaaaagctccttcacttattgttctattttgtttaagtgaaaaggtctaggttacaatctaggttaaaaaaaagagaaataatatttttttatttaaagtatctattcagagttctttagcttataatgtagttccatcaaacaataattaatcagcctaaatagtataggcaatgcacagctgtctttgttattttgtgttgacaaatatataccaagaatctataggtgaccctaactttccctgaaacattgacaaaataaattttttcatctagatgatcgtctatgatgaatgtgagaaaattcacttgaaattaaaatgccccatcctcaaattaaaacacacgtcattataaagcaagaaaagtccaacagaaaagccagtttcccatatttcttggtattcttcaggtccagttcctatttaagttgacctacctgctaatcagaactgatgtgttcagttctggcagacatcgcctgagttgtatgaaaatgtaccaaagcagaacaaactgttttgaacaaggaagactgattctttctttaagtgattttctcctaacagtatggcacttagttgtaaggaaaagggaataaaagtactatgtagcttatttcatattcctcccttgccttgtcttcttgatttcataaatggaaaaaagaatggagaagagaattggtagcctatacataagtcttttgatctcatgaattccatgtccaatttttgacacgtagaccacctgctttcttgttatacttgagccttacttctcattatttaatgtgaggctttgagcccaattttgataaaatattttagatcttctttaatacgcttgcttatatagaaacagatgacccttggggaaattcaactgataaaaatggtaaatatctttttgcttttctagatcaagaaaaataacaacactaaaacctcatactaatgatgtagttactttgcacatgaaacatcctagaaaaagttatttctactttctgaatgcacgtgttaagtggatgcttaagcccttagtctaatagggaagtttggcatagaacaaatttattttgaatcccaggaatatttaagtgcaagatataggggtaagaaaaaggagatagcacaaaggagaacttaaacaactctttcaatgggaagaggaattcattgctgaagatgtgacatctgagttgaaatggactttgaagtagggatgtggtttggccaagctgccaagaagggcaaagaaattgctggtagaagaaacattacatacaacacatgggagcatagagcagaagcaaaagtatgtattcagtgaattatgtgtggttctgtaaggctgtagagatatgcaggggctggatcacagagtatcttttagaatatacaaagaaaattggactttttgtctagactatgtgggatagggatggctaaatgtaaaagataggcttgcttctatttctgttttttaaagataactttggaagctgtgtgagttggcagtggtagaaagagggactagaaatattgaaactagttggaaagctgtatcatcagtaggctaagcaagagagaatgaggtcattgacctcaactgtgcaagaagagtgagttaatgtattagaaggtcctgacagattggagattgagatgaatatgtgcaggtggattaggaattggggctgtttcctaaattcttgacttaactgaatggatggtaaagccatcacttaagaaagaggaagaatgacttaagtccatctccacagaaagagcctggattctgagtcctttgaaggcccatgtcttgatcatctttgtatttccagcaggagtaaagggcctgacaatgacagactctcaatgactcattaggaagcctaaaaggcaaatactttgttttactgattaattgataatgccaggtataaactatgatattgtaaaaggtgaagcaaaggaagtaaatatcccaaagactccaaaacatgcaattgagaaatttataatcaaaataggcaaaactagtaggcttactgaaaagcatattttgctttgtgtgttagatcagagcaggaggacagatgaatgcagaatattttgtagtatctccagagggaaataattatggcctaaactgagtggcaactctgctcatggagagaatgattaattcaaagaattatatggaagaggaaacggttagcagtttgcatttgaattgaaaaggagcttttgatgctgactgggaattctgtaagttattggcattgctgatggtaatgaaaagcttaagggagagtgtgacagggccttatcatgcatctttagttccttgatagggtataagtgagtcattctcctactgatgggatgattcctccttgctggacatattttacccagctttgagaaaggaactcattgcactgccatcttggaataatgagttaaagggttatgcattaacataagataaccactgagcactatcgctgccaggactggaatatattgatttgattaatccttaaatatcagaaggtaaaaactatcactttttccccccctcccctctttatttcctctgtctgtggcagacacagattagaactgagaaataaattagaaggactaactttggctttctgccacctagaaatagactaaatagtttaatatggatttatgtaatgagttcacaaattgattttgcagagtaagcttgctttaggaaataaacacctgtgtactatggtttgaatggcctacttctatgtgcactcatgttgataaaaatgaattttcttaaaaaaatctatcttatggtcacttcatcattccaatatttttgaaatccacaaatcaaaaaccaaacaatgatttagaatctctagatatcacctagggaaagcagtctctattgggtatcagtgataatgtcttatctttgagtgacaggattaaaaagaaaaaaaaaaagacctcctccactctctgtgaaacctccacttctccttttcccttgtttaagaacgtcacatgtgcctcatttaaacattaattatttagcttgaactgtacacagctaatgtgtaaaataaaatttcttgcaagtttgaagatgaatccagaggtaccgcttgtaagcaggcccccgctttttctatctcgggtggccaaattatgtgtaattgtaattggtgatggatggtgactgttgtgtcagccaatcattctaggaatggctactaagatttgtaattataatgtcccttattcctatttaaattaaacagtcttcacataactattctttcccttgaaacatggaaatttgggtgtgggaattggggacagttaagggtcagggttttacctcttaaaagctacacttttgcacagtctgtcccatttctctaaggcaccgtagatgggggaggccagcgatcaagaatggtaatttacaatctaagagtgcttaatctaaaatctgtccttgtcaaaggagaatgcgttggtccccatgcagcagtaatggaaattttatttcagcataagcttcaatgggggctttcactgtattctttaaactaccctcgtccttatcaatttatgccatgtacaggttttgtgggtttttaacatcattctactttaaaagagaaaacattaaatataataaataaatccacatttggaaacctataaactcaccttgcaagcataataacaaaaattgttatatggttatggctgaatctagctttattattaatcatttttcctggggattaaaacttaatttttcaaagagatccttttctctaacacactagtttctcttttagggtaacacttttataataaaaaattattttccttaattttcactgtcatatacaaagagcttttcctgttaagaaaatagatagttaagaaatataatactccagggcaaaaattggaccagattaattaaaataaatatatgaagactttataattgtttttgttcagtaacaaattagtaagtaccatgctaaatgaagacaatagcaatgacattatacattgtaaattagtaactatgggtattttgttttaaatctatttactagctcttgtttactaaaaacctctaagtatgtctctttcttatagtttccacgtggtatgtataaatctgttttattttccttcagaaaacacacatgctaactttattatatcttcttttctggcctgggattagttaactaggatttatatttatcttctatgttctacctcattaatatctatctcctatgttctacctccactccctcattcctagactccagtttgtgcctccttttgtggatcctgaaattctacatctcactgaattttatatatgcctaccactgtaacactggcccactttgttcttcatgctagattctactagagagcaattctaaggtcattttttttttacctttgctatttctcccacaaatttttccaagtcattattggccagaacaaacaaaaaaacaacataatcatcaaaacatctattattctctgctatctgtttcaatacaattttctgttcccaaagctcagattctttgtttttcgattgttccaaataggagtgacaattggtgtgctagagatggcatactgatgaccatgaatgagatatacatagaagattctatatattgttgccaaaagaaatgtgaggtatccaggtatccttgggaaagactcaattggctataagtaaaatttttgatgtctaaggcctcaggtatggcttggatgattagcaacatgaaagaacactggcaatattaaaagtgcacactgtatgttgtcagtttcccctacattttatacagctgtcaagaatactaaaagaatttgtgagacccctttttgttgactatttgttagattcatctaaggaacagttaacattctgaaaaatattactgagtcaaaggtcttcctgtaactgcaacattacttgcacattagtttttagaaagagtacattttaacactcttggctattcaaaataaatttcaagacctacaaatacaaaaaaaatatgatggcatacttctctttagagagcatcatgtgaaaaaatctagctctttgtttacatgtgcatagagacctgattaaaatttgggggttgtcatatcaaatttccttactatgtttccagatattcaaagttttggggataaaatgaacagctataaggaacaacaaaaataattgtttacagccttcttttgtagcagagacatgtgaatatcaaaggataaacatgaatgcggtggatttttactgtatcaacttagtcaaactgtaacaacctttctccgaatttccctctctttgtggttctgagttagtgtgggccagaaaaggcaaatagatgtaagggagtagtgtcttagtccactttctgttacttgtaacttgaaactgggtaatttatttttaaaaaggaattcaattcttacatttatggaggctgagaagtgcaacgtttaggagctggctctggtaaaggctttctttctggtgaaggctctttacagagtcccgaggtggctcagggcatcacatggcaaggaggctaagtgtgctagctcaggtgtttcttcctgttcttgcaaagccaccagccttactcctataataacccattaatccattaacctattattccattaatctataaatgagttaataaattgatgatggctctgtcctcatgacccaatcatctctcaaaggaccctcccttgcaaaactgccatattggagattaaacttcagcatgagttttggaggaaataaatattaaatacactgcaagtacctatacttttttattttttatttttgggaggtttgtgcaggatatgagttgctgctctctggtggctcacttgttgggacagggcaatacctcagccagttgctcctccaggccctgccagatcttctgtttcagcttttctaactggttcccagctttgaagacagagcaagggctcacaagccaagcactgtgggtggacagcctctttaagtaggaaaaggcaaggagatgaattcatctttagagcctgcaaaaaggaatacagctttgcctagaggacatgcgagacctctaacccaaagactatacaataacaaacatatgtaatttgaagacactgagtttgcagtgatttgttatagcagctgtaggaaacaaaatttgaattcaagattcttccactaattttgcatctacattctgatcattttggaaaattcttacagaaattggacaatgttgaacaaatagtgatttttaaaattatatctaggactatcattgccaagggactttgtcttgatatttcacaagaagaattttggaactatgaaaataggggatcccatagttcttactacaagcatagaatgcccaccaaacaatttaaagccaagcctattatccaggtacccagagaatccagcctccagaacagaaggaaacagtccccactgaaagaacacaaaagccaggaagccacaaggaattgccctcaggttctgaaggacaagagattgtgcattcaatagcttttgcaggaattaataagtgaaggccaagggttataataaacatctaaaggaagaatttagcacaaacaagaccacatagaagaagaaaaatgtatgcaagaaaaccagtatgaaccacacctagaaacctagtcagggattttttttttccatctaaaataattaaggatctttaccagttccttagcacagagaaatgtcaggaaccagtgccttgtcctcattattctttatgtgtaagaaactggagtaaacaatgccaaattattattccaatttgtaggttaaataagctccccaaatcacctagtcaccgtcttaaatttttaccttaaaaatcctacagggtattattataatggatttcctgaattgctgaaatattacttaatcaaagggagaagccattaaaacatagaacatgctatgttacagggctgacttctgtttacttgtgcacattttttttttaaataggaatataaagctaacttctcaggtgggaagatggtagaatcatcactgccatctccaaaactacacttttgtgatgctggcttgaacttagaccatacaaagttactcattttcagatgtttgtcaaaatgatcctccttcaaaaaaaattcagttattatggtctcagtaattgtgaaatgcaaacagaatcatttaagaaggataaaattgaatattttgtttcttacataaaatccagacctctgtcatttcagctttggtggagtattttctcttcttcttcttcttcttcttcttcttcttctccttctccttcttctccttctccttctccctctccctctccctctccctctccctctccttctccttctccttctccctctcctcctcctcctcctcctcctcctcctcctcctcctcctcctcctcctcctcctcctcctcctcctcctcctcctcctcctcttcctcttctcttcctcttctcttcttcttcttttcttcttcttcttttcttctttccttcccttcttcttcttccgttcttcttcttcttcttcctttcttcttcttcttcttcttcttcctttcttcttcttcttcttcttcctttcttcttcttcttcttcttcttcctttcttcttcttcttcttcttcttcttcctttcttcttcttcttcttcttcttcctttcttcttcttcttcttcttcctttcttcttcttcttcttcttcttcctttcttcttcttcttcttcttcctttcttcttcttcttcttcttcctttcttcttcttctttcttcttcttcctttcttcttcttcttctttcttcttccttcttcttcttcttctttcttcttcttccttcttcttcttcttctttcttcttcttccttcttcttcttcttcttcttcttcttctttcttcttcttgttttagggtacatgtgcataatgtgcaggttagttacatatgtatacatgtgccatgctagtgcgctgcacccactaactcgtcatctagcattaggtatatctcccaatgctatccctcccccctccccccaccccacaacagtccccagagtgtggtattccccttcctgtgtccatgtgttcttattgttcagttcccacctatgagtgagaatatgtgatgtttggttttttgttcttgcaatagtttactgacaatgatgatttccaatttcatccatgtccctacaaaggacatgaactcatcattttttatgggggcatagtattccatggtgtatatgtgccacattttcttaatccagtctatcattgttggacatttgcgttggttccaagtctttgctgttgtgaatagtgccgcaataaacatacgtgtgcatgtgtctttatagcagcatgatttatagtcctttgggtatatacccagcaatgggatggctgggtcaaatggtatttctagtcctagatccatgaagaatcgccacactgacttccaccatggttgaactagtttacagtcccaccaacagtgtaaaagtgttcctatttctccacatcctctccagcacctgttgtttcctgactttttaatgattgccattctaactgctgtgagatggtatctcattgtggttttgatttgcatttctctgatggccagtgatggtgagcaccttttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgtgaaaattttctcccattttgtaggttgcctgtttactctgatggtagtttcttttgctgtgcagaagctcttgagtttagttagatcccatttgtcaattttggcttttgttgccattgtttttggtgttttagacatgaagtccttgcccatgcctatgtcctgaatggtaatgcctaggttttcttctagggtttttatggttttaggtctaacgtttaagtctttaatccatcttgaattaatttttatataaggtgtaaggaaggggttcagtttcagctttctacatatggctagccagttttcccagcaccatttattatatagggaatcctttccccattgcttgtttttctcaggtttgtcaaagatcagatagttgtagatatgcgacgttatttctgaggcctctgttctgttccattgatctatatctctgttttggtaccagtaccatgctgttttggttactgtagccttgtagtatagtttgtagtcaggtagcgtgatgcctccagctttgttcttttggcttaggattgacttagcgatgcgggctcttttttggttccatatgaactttaaagtagttttttccaattctgtgaagaaagtcattggtagcttgatgggcatggcattgaatctataaatttccttgggcagtatggccattttcacgatattgattcctcctacgcatgagcatggaatgttcttccatttgtttgtatcctctttgattttgttgagcagtggtttgtagttctccttgaagaggtccttcacatcccttgtaagttgtattcctaggtatttcattccctttgaagcaattgtgaatgggagttcactcatgatttggctctctgtttgtctattattggtgtataagaatgcttgtgattttttcacattgagtttgtatcctgagactttgctgaagttgcttatcagcttaaggagatttggggctgagacaatggggttttctagatatacaatcatgtcgtctgcaaatagagacactaaaataagagcagaactgaaggaaatagagacacaaaaaacccttcaaaaattaatgaatccagtagctgtttttttgaaaggatcaacagaattgatagaccgctagcaagactaataaagaaaaaaagagagaagaatcaaatagacgcaataaaaaatggtagagtattttcttaaaccattgctacctggagtttctccataatgatgccctttttattcccagcaatgattttctattattttgtgttacatttaagttagctttcttattaacaaagttaatgatcatatagttctcattgtgaatattaaaaaagattagccagaaacgagcattaacccaaaacacttgattgataagtttgtgatacttgataatatgaatatgctctaataagtaactctatgcagttgtgtattacttaaaataaatatgaccagacattcttcatggtaatgtgactagcttagttattagttttataaatcaatgcaatgattgtactcacttttttgttgttgttgttgttgcttgttttgagacagagtctcgctctgcctcccaggctggagtgcagtggtgtgatctctgctcactgcaacctctgcctcctgagctcaagtgattctcctgcctcagcctaccaagcagctgggattacaggtgcctgccaccacacccggctaatttttgtaattttagtagagacagggtttcaccttgttggccaggctggctttgaattcctgacctcaaatgatcttcccacctcggcctcccaaaatgctgggattacaggtgtgagccactgcacccggccgtactcatgtatttttaagtaattttttcctctttcatgccttgtgtctacttctgcctcattgtctatggaaaaagaaggcatttatgcttttgcaggcctctttcttcatgaaaaagttactaattttataactgctttggaataaagatgaatgtaatccaggatggacttattttttcctcctaactaaaaaaaaaaccaaaaaacaaaaaacaaaaaacaaaaaacttaaaccttctttatgggcacctaaaagtactgtggcccttgacacagtgcctactgtgctgattggacaagtcatccctattatatagccatatcgtggttatactttaagaaaattgggcctaactttctaagtgctttgaagtcatgtgatgcataaagcagtgaattgtttcattatctcaattttcttatgatgtaataaattgtttttagtttaaaatcatttttatgtcacaggtatattgtataaggtgtcagttaattttttaatcaatagaattgttatttttcattaacttgtgttactgccacaaaggaattgaatattttataccaatttccagtacaaatagcatctaacatttaagctttgagaatctttggctctactttctccccactcccctcgctatttggcacactattttgtcctcaagttcatgttctgacacatacatgtgtgtctactagttgctaaaattttaggaaagttattttctaatgaaagtcattatccctaacttacttgcattgtcgcttggtatattaaaatgtcttttgtttcttaaaggaagaaatacaagaaaatgttcttaatagcaactgtatttctttaaaggcaaatagttatctacattaagtagcaaatacaactctaacagtccatgaggccagtacattctctcactttctgatagtgaaaaatatcttttctgggtgctagaggttgtctcaatactatgggctatgcagaaaaatgtggaagaactagcattttgaggggtgacataaagaatgtattggtggctcacgcctgtaattccagcactttgggaggccgaggcgggcggatcacgaggtcaggagattgagaccatcctggctaacaaggtgaaattccgtctctactaacgatacaaaaaaattagccaggtgtggtggcgggcacctgtggtcccagccactcggcaggctgaggcaggagaatggcatgaacccgggaggcagagcttgcagtgagccgagatcacaccactgcactccagcctgggtgacagagcgaaactccgtcccccaacaaaaaaaaaaaaaaaaaaaaaaaaaaaaaaaaaaaagaatgtatcgtgtttcttgatgctaaaactatcctaagcagttcaattgagttacaaagcttaataatttttcaaagttcaactagaatgtcttaggacgtaggacaatttgggggaagtatttccaccttaaaggaggaaatggtggtggcatggtctacagttattttatacccttgttctatagaagcatgtgtcctggggttcctgagtgtctccatactgttaacagctcctctggcaactacattgtaacagagtgtcaggagttggtgcagaattccagcatcagttccaaatgctgaaccagtaatcgatttcccaaggaaatcaatcccagcaaaagttgagccccaactctctatagcatgtgaataaaacagaaaacggctatcttagagaatacatggtaagctgaagaacgtaaattagacttccaataaatttgatgctttgtgtacttagaactcatataggcattatagatccaagcagtttcagctagcttttcatctctctcaaaccctgggcgaatgataaacatcaaagagaataacatgaaaagaaatatttactttgaccgttctaccaaatatatatatatataaatatatgaaaatatatatactaatatatataaatatatatgtaaattatatataaatatatatgtatatatacacacacacacgcacaattcaagcataataatatgctttagactgagtggcttatgcacaacataaatttatttctcatggttctggtgaccggctgagtttccctagtctgagattagggtgccagcatgatggttgggtttctggtgaggacccttttctgggctgcagactgatggcttcttgtatcctcgtacggtgcaaagagagagagataattccctgggatctcttttataagagcacaaattctatttataagggctccatcttcatgatctaataacctcccaaaagcctcacctcctaatatgatcactttggaggttaggatttcaacatctgaattttggggaatatgaatgttacgttcagtccattgcatacactgtacatatatctatctatctatctatctatctatctatctatctatcaatctatctatatatatatatatatctacataaatatgtctttaaatttgatatatttatctttaaaatattgaattctgaataccattggctagcaaaactatgggactgaaaataatctgctgatttctcatcttggcctttgagatcattaagaaccctgtgaactatctttatatgacaattatttttaattctaggaaattcaatacagtagtagaatgctatagaataacatgttcattttttgtgttcattttcgtcacataaattgacttcttaggcttcaaaatttggagagttttaatgttaatcctaacatcaaaggtaccttaaattttttaaatattatccattattagagtagctggtaggtttataaagaatttagtgtgctctgagatctgtatttttaacaagcaactcaggtgactcttaagcagatttgggaaccgaagtcgtaagcaagtgaactatgtaaatattgtaccctcttgtctttctttctattttgcctgtcactctctcctgcagagataataatgcataataaattaatagaggaatcaatgactagtctatggttagacatggactttataaagcaagcactccatcatttattaaagcatataaaatatatatcataacatatgttttaactttattgcaacaatccattttatgaataaaaatctcctaggtagatattttgacacagtcaagaaggaaactgaatctatgactgttctatgagcctgttagaattgatgaaattcaagatctaacatgcatgaaagcattttagatgtggagttagctgatattatttgggtggcttttctctcacatgtttattttgctattttgcttatagtcatcagtctacttgtccatctacccttgctgtaagaggtcttatttttccttccatataccaatccagtccccatcacagaccctgatgtatcatagaccccgaaacaacttgttaaggaaatgaatttctattcaaacatgtacacacacacacacaatctaggcaattttaatgctagcaactgaatcacaagaatggaataaaagatacattctatctctgatatgaacaactgcattactatttaaaaaaaagtgggccaggtgtaatgacttatgcttataatcccagcactttgggaggccaaggcaggcagatcacaggcagatgacttgagaccaggagtttgaggccagcctggccaacatggtgaaaccccatctctactgaaaatataaaaattagctgggcgtgggggtgcatgcctgtaatcccagtgggtggctgaggcaggagaatcacttgaactctggaggcggaggttgcagtgagctaagatcacaccactgcactccagcctgggcgacagagcgagactctgtctcaaaaaactaatattaatataaaataaataataaaatgtgcttacatagacttaatattgatgataaaaattttgaataacacgttactattgcatagcacatcttattgctcgaaatgagacctaggtatatgacatttgtcaacatacatcaaaagattgttgatttgggaaaatgatcataaggctgataagttttctcagttcaatacatttgagctcatgacatgttttgaactctgaccccctaaaaaggaagcgttaggcatgctaatgggataaatcagccaaatcccatctatctgaccttattaatgtaactctaggatttagattctgaccttccataattattgacacctatttaatttatcttctcatcaatagtgaagcctagtgcagctgctatggcacatgtaaatacatcactgttgccagcacaggctgattggcattcatgcttgagtgtcttttttattttctccttggctgctgggagtagcctgagcagcgcagacactaaagagcttcatctattaggcatgacagatttgtattcagcgataaacgcctgaccttgctctactctctcatccattcccatcatcccctcgccagatgaaagagtctgcttaactcctgtttcctggctgtttccttggcaacaataactgagtcagtctgacagaataactaatagaataccttggtagtgagattaaagtgctttaaaaaaagtcgtcacccacagaattataaatgagaaatgtttaaaatcggaattttaagatgataccaatcagtgacattatgatttccttattaacccatttcattttgtggtaatatttacagacttttcccaaggtattttaggccgggaccagagtatttaagcttttaggatccatttgtgttatatgatgaaaacagattggttttgtaataaaacttgtattgctttagatgttgaattagtgggtagaagatatgtacagacagtgtcccaactgggaagaaggactttgtaatgaaatatgtactatctatttttctcattcctcttctgaaggagatgtacctttttaaggcattataactagaagatcataaagctacaagtatcatctccctttaggattctgtcacttttagcccaattcttactatctgaaagattcatcagcattcttgtttcatattgttttttgacaacacatcacgaggttgtcaaaagtctcagaatccctgtggaattcttaaatttggactgcaaattatagcataagctgaaagctaaacttctgaatttttcagtgaaactttgatggaattttatagaataattttagattactttatatcttcataagaatgcatgcagctaatagatacaatatagagagatggagcagagagaccatttgggtaaagcattttctactctgaatgtctccagtgattgcatcatgatttattagttttgccttgggctcaaataaattttaaatgatttctaaatatctattttttctattattctaattatatttttctaatctcatttaatattttctgaggccacctaatatttggatgtgcttaactgggtctaataaataatagaggacagaaataatgtaataacattaatttagataatctactctagaactctatattaaatgaaagcttatcatttatgattatgtcttgctattactacacattttgagagtgcaattaacttctattatcacaatgataattacagttggcaacagaagtcaacaaagcctatttatctgttttgcaattttaaaaatttagacatttccactcacatttagtacctctgattagaatggacattttctgctttgcagtctttttatagaggtttaatataaatttattccaattgttattgccagtgctcatttcaggaaacctgcttaaccacagaatgaagtctgaaggaggtgagcacatcaaaatgtagagatgactgttcaccagtcttcagatgactggatggtctgtttctgtccccatggatatcagaagaagcagttgtctttgctaatagatttgagagggaaaaatctttcaaatagtgtgtttgacttgctctaagaacatgaaacaaaactatattagcatccaattgctgctgtaacatattaccaataatttagtagcttaaaccaacataaatgtattattttaaattctaaaggctagaagtctaaattcagtctaaccagctaaagtgaaagcatcaatgaatttcttggctcatggccccttccttatattccttcaaactcctgctcctcctcctatcctgattcagaccctcctgaatcaactcataagacctttgttattgcattgagcttatttagataaaccaggataacctcctcattttaaaaatccttaatttatttatatccgtaatgtctttttttaccatgtaaattaacaatttctagggattgggatatggatatctttttttttttttttttggagggtatggggtttttttcatcctaccacaaaaacacttattcttctaaaatgtgtgcatacagagtaggcagtcggtaactattcctcaaaggtataaatgagcatgaatacacagaaatgtgcaagaaataatatggaaaaacaccagtggccaggcacagtggctgaaggctgtaatcccattgatttcagaggtcaggagttgggagacatgacaagaccctgagatatacctaatgctaaatgacaagttaatgggtgcagcacaccagcgtggcacatgtatacatatgtaactaaccagcacattatgcacatgtaccctaaaacttaaagtatagtaataataaataaataaataaattttaaaaaataattagccaggtatggtcctgcaagtctatagtcctagctactcaggagtctgaggcaggaagatcgcttgagcctgagggcccaaggttacagcgagctatgattgcacccctgcactttagcctagatgacagtgaggccttgtagctaaaaaagaataaaaaagaagagaaaattaacaagagcttgtaaaaataagaagtgtaactttcaataaatcatttaagagtaacctaacaactgcgtggtcagatctctagttgagtaaaatagagaaaaggggatgaaaagtagagtttgaatttgcagttgaatggttagttgtgctggcctctagattttgtttgtgtgattccatgggagactcaaaattaaggagtggagaagatataagctaagaaaaataaggcaattaaagacatcaaaataaatataatggaggggctatgctttagattgaagtttatagcctcatagtgaattctagatcttctttagctttattctactagataccgctagggagagagaagcaaaatagaaggaaaagaagcattaagcagagagtctaagcaattgtttaaaaatcagcttgcagtttgtgatatgataattattattatgatcctcgtctgtgatagcattaccataattactatgctaaaaatatcataactactttataatgaagtaaaatgtattaatatttagagtggtacattttacacaaaatacattctcaaagggtttacaaagctagataatgtagttaaaaatacacatcaaaagaaagaaagaagaaaggaagaaaagatgaaacaaaaagtggaggtggacttcactgtacttgaagataagtctttagggtgtgatattaaggttgaagggactaaaacctagtgagacaaaaagttgtattactgtgcccatgcaataataaattgcttaatacatttaattttctatccaactgattaatgagctaatgtagacaatcttttgttcacattcatatatcttctgtttttagttttctccatctttaaagcattgaaaggtgtaaattgagtcagttgttgttgatttatgaagaaatgggctgatcacttcccggttgcccttctatgtctgggacacctaggccattatcctgctaacactacatcctgttgccacctatatggtttttctctactaatcttaaaatatcataaaggcatttatttataaaattatgtgcctaacttctatatgctggacctgatgtcattttaaaataatatatgtcttgaagtagcttaaacttgattggggaagatagatgagtatagcaataaattagaccagattgaagcatacatatttgattttcatacatcttttaaggctcaaaacgtatctggtctttattataatgctgtactagtcagctagggcttccatcgaaaatagcatggactgggtaactttaacaacagacacttatttgctcacagttctggaggttagaagtccatgattaatatgcaggcaaattcatttactggtaagggctctcttcctcttctgcagaaggccaccttcttactgtgtcttcgcatgactttcttttgtttgcatactgaaacagagagagagagatttgatgtctcttcctcatgttataaggataccagtcttattggattagagtctcactgttgtgccctcacttaaccttaattacctccttaaaagccctgtctctaaatacagtcacattgggggttagagcttcaacgtatcaattttgaggctacacaactcagtcagctgaaggcatcagctgatgccttctcagattacatcagtaccctaaaatgcccctgttctctgacttcctacagagtacattgtctaaatttcacaactagaaattgattttagaattgttatttgaatattttgacttatatcatctcaaaattgttagctcagtgtagaatggtactatgtttcattttcagaatagagttttttttttaattctgaaacaattccaagcaatgaaaagttgcaagaatactacaaaagttgtaaaaatagtagaaagaattcttatgttctctttttacagagaccttactaagattttgccgattatcccaataatatccttgaaagtaaagggtaagatccaggatcattcattgtacatagttttcctattttctagtttctttcaatctgtaacactttttccatttttctttgaccttcatgaccttgagacttttgaagattacaagccagtcacttcatagaatgtccatcaacatgaatttatccagtgtttcgtgatgattagacctaagttatgcattttgagttgggctagcacagaactgatgctgttgttctcattgcatcacattgggtggcatatgacatcaatttgtcccatgattgatggtgataacttagacatttattaatatggttactgccagatttccctactttaaagttactttgcccccctttataatttgttttctggctgggaacagtgctcacacatgtaatccaatcactttgggaggctatggcatgagaattgtttgagcctagtagtttgagaccagcctcagtcacatacgggagaccccatccctacaaaacgtttttaaaaataagcccagctgtggtggtatgtgcctgtggtcccagctagtctggaggctgagacagagaggattgcttgagcccacgaattcaaggctgcagttagctgtgatggcgccatgctccagcctgtgtgacatagcaagacctcttctcaataataataataatagtaatagtaatttgtattctgtagagaggtattttgatgcagaataacggcctattcctcatgttccttttctccattagttttaatagccacttatgtttcttgcctaaatcagttattactaataagttgccaaatggtaagtttcaactcctatagttccttccatttgtattggtttgtctcctgaaagaagaacattttcttccccctatgtatttatttattcatttatattcatgtggactcatgatctttattttattcaatgggttattacctgttattatcattccttattttgatattcgaattgtcccagattcaagcagtaggagtccttctagcttcctactatgccctttgacatgttttaattacattgtaatctgaatctttcctgaaatactttacccacaaagctctaaatgatgcaagcacatggagatccccagaatatagtttcaattctgccgttgctagtttcttcctagctgtgcagtttcaacaagtaaaacctgagccttaatttcctattctgtgaaatggaatgggaattaacttgcccagttctttaataataataatagctaatatttgttgagcactatatatttgtcctctaatgattgacaacaggtagggattaatctgtttttatctgaataactagtaagttcctaaaggaggtttgaaccccaaaaaaggggcttcagggtcatagcaagaagataataaaggtaaattctattactattacatgttatttatattgtaatgagagttgttctaaataagagttgtcaacattgttgccttggagtctgaactagcagaggattcacctaatttcagctagaagttagaggtatatgagtttcactcacttaagagacttttcttttcttttctttctttctttttttttttttttttgtttgagacagagtcttgctttgttgcacaggctggagtgcagtggcacaatcttagctcactgcaacctccacctcccaggttccagcaattctcctgcatcagcctcccaagtagctgggattataggcaggcaccaccacgcctggttaatttttgtattattagtagagacaggggttttgccatgttgagcaggctggtctgcaactcctgacctcaagtgatccacctacctcagactcccaaactgctgggattacagtgtgagccactgtgcccagccacttaggagactttccatttcccttatacccttagcatgaaatgagaaaagagtaaggggagtttttgtgatttactctgagtatcaggagagacatatataaatttacttgttctaagataatagttctaattaaagaagaatttttagcaacctcttagtttcaaacactataatgttcacagcaaataaatagaaaggagaaagaaactgtttcagtgttgaagtaaagtcagagaaaagagagagacagaaaaaggagaacgaggacaataggtacaagggagggagggaaagaagaaagggaagaaagggagtagagtcagagaaaagaaagatagaagaagcaggacaaaagggacaaaggaagggaggtggggaagaaaggagaaagggaagaaagaaagggaaagccggagggagggagagaaagaaacaccgagctacctgtgtagcagaggtctcggggatcggatgtctagttgtgctggtcccatctcttgataagccctgagcactcatatatcttgtgtagtaaataacctaattctaatagcttccaaggaaagcttgcaaaaaaaatgggcagaggaatggagagagcctgttttaagatagagagagggctaccatccttgcatgtggcatctgaaagataaccacacagagcatattttggagattcaatttttatgtaatgggtgtcgttactatccagaccatgggggaggaagacatgcaccctttaatcctgtagcaccttcaccttcatcttgttccacacaattaacatttatttggatggctgtcttttttgctttcctaataacagtgtaattttactttacatgtgagatatagcataacaaatcgaataggaaataattataatcatgaaatactctcacagaggcatctccttccagctagttccaggtggcccaaggtcgattgtgaacactcaggatggatggcgtgtctgtcctttctctggaggtgtcttgggcacacagacctatatgtgcacttggcattgtgcttgttcacaatgttaaagttgtgatgttagcaagtcagagatgagtaggggcctgcagaaagagctagttagattaatccttaaggagtgagccatgaaatatttcatgggctgaaatgagaggcatgaccagtactaaatcagcagaccttgggaccctttaacagcggtgctaacccaaaatatttttaggcctgaaaaaaatgggcaaagtgatctttacataaattattctctgggctgctagtcacacaccagcatgctgggaacaataagctcacaggggtatttgttcaaaatatttgatttcccataaggctacttagccaagaaaacgtagaggacaatttacttttcactgacatgtttgttgtcctttcttctacagccattctcccaggatgaggataaaatatggagtcttgattctgagacacagtttgtctttactagagatgccatcaaggttctggtgattccctaggacaagtggcagtgcttcctgactaccactgggctgtgtgtgtgtgtgtgtgtgtgtatttgtgtgtgtgtgcgtgtgcgtgtgagtgttgacattgatttctctcctcttggcatgtagaagtcccaagtgccccactgacccattacctgagcctgtaattacttcaggagtagggaatgaaaagggcatatctcctctgctttcagggaatgacagactcgggaaaataagcaggccctgcattaaggcaaatctctcaggagagcttaaagactcaagtcttgactcggatgcatttttacatcagtagaggccatgctcattaccagtgaagactgctgaagttgtggagttggcatatgaccctgaaactgcttcaccataaagacagattttaatgcccatatgtgacatgcaggcacaaaaatgtaatcgctataattagccagcatccctttttcatagtgctactatttcgtgactacttgcctacttcattttgttaaagataaaatgttcgtcctatttttaaaaagtaagttgtttcttcacaagccatttttagggatacattcatttttaaaggtattttatagggagataagtgatcattccgtgtgtttttattcttttgattgtctaggatctagattttgcaattttgtgaatctgtttccaaactctgcaagggtgtctatattataagttatataaaagccctctgcctaattttttgatgtatatgtatttccagcctaatatccaagctgtattgatgtgggtgagtgagcattgctccctcagacagtctgcttagctgatttttgaagttaattatggtgcagtgaaatctaaaggtcagaccacatctattttcctggtttgttcaatgctatgggcatacgggcaccagataaatcccttaactgctgacctaactaataactttcctgtacactttaacctatttcctgttccaggttttcagactctttattgtgctgtagggtcttcttcagaatgggttattacagagcacatcacccaaaggctaccatgaagacccccttaggaatttcaaatcataatgtgtaaggtagcctttctgcaatacacccccaagttatcagtgtatttcaccgattgcctggattatttcattttatccttgccacttaaggagaaaattaaatttcagagagaattttgaaaaacatgaaatgcttagggttagttgctaagggatggttagctcacagttttgaaaattgtcttgttatttatacgttcatacatttaccccattcatttatgaattcattcattcagtgatttcttattgagcactaccctaggatatatcaccatgcaaaattccgtggtatacaaaaactcaagaatcatagaacctgacataattacatgatcataacacgaactacaaatccaggcccagcttctatcagtgagagacagaaccagggtacatactctgtgcagtgcatggtagcagaaacttgaggaggttcaaaagaataggggaacacaaagcaatgggaacccagggtagtaactaaagcagcatgttttgtatttgtttagggtgtttttaattttaagttttatttttttcttgaagcctatgctggagttcagtggcatgatcatgactcagtgcagccttgacacttgagcctgggctcaagtgatcccttttgcctcagcttccaagtagctagaacttatggtgccttctttaaaataactcataatgttcatccatgattaaaataatgtgctatgactctcaatgaaaatttaaagccaatagttgtcatttgtatttgcttatctaatcctaaatcagctgtccccagaacacttctgttgtactttcatgaaacgcttgatccttttaggattattgttcctctaatttaaagttctatttcttaatattcttagaacagtattaaatttattaagacattaggttctgaatggattcttctgccacagtttgaatctaaatattctcagtaggaaaaggttaagcatgtgagtgtccttattcattatttgcctttatattaactggaccaatacatgggggtttagaagaagaatctagaaacacagctggactagggagaggtgagtgaggcactttcttggggtatacaatttaaggggattccaaagcactctgtaatcaagataatattttaacacaataatttttaaaaattaaaattaatgctaaaatgccaaaattcacaaacaacataccaaaatcttaaattcagacagaattggtaatactgattttcctcttgctgcaggcttcagtgtggtgcagcatggcagtgatctagaacagatggctcttgcattctataacagttatagagctttaactctgggctacatcatttctcagaatcttttaagacctagtgatatggtttggctctgcgtccccacccaaatcttgtcctgaatactcacgtgttgtgggagggagcctgtaggagtggaagataattgaatcatggggcaggtcttttctgtgctgttctcttgagagtgaataagtctcacaagatctgatggttttaaaaatgggagtttccctgcacaagctctctctctttgcctactgccatccatgtaagatgtgacttgctcctccttgccttccaccatgattgggaggcctccccagccatgtggaactgtaagtccattaaaacttcttcttcttcttctcagtctcaggtttgtctttatcacagtgtgaaaatggacaaatacacctagctatttgattttctggtaattcaaaaaaaatgcaattgtttatcactggaacagttttacaaataggcaatgagcttgagtatgtctggattatctttaaaggtcaaactatagccaggaaattaatatggattaattaaccaatgagtaagctgcagagtttggccttgaactttcccttctgacttctggttcagtgatcttgttaagtcatcatactacttgggtcccgaatgctcaagaggtagaagtaggttatttatcatttagatctcctgtctgtgcagtctcctagagaggttctatgcaaattcaatttcacccttaacacaaaatgaatacaccacatgggagcagacagagaagaaaagtaagttaattcccatctgtgattatgtaaatgcattctagttttcatgcatgcatttaatgggttggcaatcataattttaatactactggaaatggtactatttggagatttgtaaattaaatgtgttcatgtattaattggcatccttagatttctagatcttggaaaaacagggtgagaagatgctgtgactaaaaggttctatgcatggaagaaatgtgttctttctggtgctatttcttgacacagaatttccttagcaggcagtttagatttccttaataaagaaagccaagcatcttcttgggatacctgaataatattctgaaagtggcagactactcttgttggcaactgaaaatgtacaagggccacaagggctgttagattcaagcccatttatttcccgagcttatctgtctcggaaagatcttagtcacagagtgtttagccccaaatttacaaacattgtttttctctcatggcccttgctttataatggggctctagtacaaggaaatgatgtgtatttttatttatttgtattttgttaagtaatcagatttcagactacacaagtaggatctaacacaaaagagttaaatacatgtatttgcagaacacaaattgtttttgaaaggattgtgattttattcatacactggcttcattaacaccatgacgagctgttcacattataagctaagttacctgatttcatttatgctttgctgtcccctcccacgtgcatatcccatttttagaaggtgctttctgtgcctgggaagtagaatgcattttttgcagcgaataggttattttcttatcagtctctgacaatttgtagtctcataccctcactttctgccatcatgcctgcctggaagaatcattctagtgtgaccaacttttgaatgtcctctttagtatatttgtgagtgatgcctgaggcattttgtctgttcgccttctttcacacctccctgtgacccaagatgagagagtaatctgacaagcagaggcggcaggctgtttgaaaccctagcttggctttactcgatctctgtcattttgtattttatttgactgtggcagtttcatgggtatatcagagccccccagttatcagttaggggaagctaataaaatccctgacacatcagattgttttctctttctttctattgaactctttggcaattgggcttgatgggttaagactcaaaggaggcgtcttatttcccattgctgcctaacctagattcttagctaaggacagctagcttcttagcacattttgccatctgccaaatgcagagtggaatgtcctgttcccagctttctgccatgtgcttggttcttgctcgcatttgggactcatttgcttacttgcctgcctggtactgggaaggtatatatggtgcttccttgcaagctgaaactctgggcatgttattctctccaggtccagaattcatgtttcttcaactcaagaacctgttcagcgggtgctgacttggatgtgtgtgttatggcttggccacatggtactcaagatgtaataagaggagataattcactctgagacttctaattaaggttcaacaattgaagatctaacaacagattttaagtcctcattttgttactggaaagggatcctgatctagaccccaagagagggttgttggatctagaacaataaagaactcaggaaaagtccacagagtaaagtgaaagcaagtttattgagaatgtaaaggaataaaagaatgactatgccatagacataggggagtgtttccaaaagcatgagaaagaatgtgcccaccttaggcacaatacttgtttcaatataaggtaacaaaagcaaaaaatcatggggtagatgtgctctactacaagaatgcctgataaaagattgttaatcttcgtgtaattactgttttccacaagaatctgtattattatctttttaaagcgaaacttattcttaaaataggaatgcttttgttcttaagacatagggacatcaggacatttcatgaatctgttaagtcctgggtctggtaaattctggatctgtttggtaaacattattaacgtgttttcttaaccataaacatcctctaagaatgcctaacttcctgagaatgcagcccagtagatctcagcctcattttacccagcccctattcaagatggagtcactctggctccaacgcctctgacaatttaaatgtagaagaaaaagtctaagattgagtagagatcaaagttgtgtcaagaacagaaggaaacagtgagacatgttgcagaataaccacaaagagtcattttacctactgcatgtcttatgtgatagaagtagatccttctattacccttctactgtcttttatgttcttaaattgggcccatttttctggcctttcaaaagagaatttctgtttgacagtgaactctaaattgaaaaactttaaatgactatcctatagaagagaattgtgtctgatgctctcttacgtttataatctttacttcaaactttgatccaaaaaaaaaaaaaaggaaggaaaaaaaaaaaaagaggaagacgtggttcctaacctcaaacagcttatactaaagtttgtttttctccctcaatcagaacttagaaagagtctccagggagatgacctgattaagaaattaaactgttcataggtgaccatgtgttacttaccacagatagcatattcatatttaaagagaggctttctgcctcgtgatgctgtaaagttttaaatggtggtttctgtttgccatcgtataatagctagacttagaggacaataatctaggtgagagtaagggctatgattttcctgtgctttatttaagctcaaaatacatttacttatccattgttttctattacgttttatttctgggttttatcttttttccttgtttgtttatatttatctcactgttctctttcacttcttttttctctttactaccctcaaatagataatcactggaagagcaatgcatccgagaaaaataaattaactttaatccaagagtaaaactcaacgtatttttcagaaatttagaaactgccagtttatatcagtggctttttgtgtgtttgctttcttttatatattttctattatgaaacataagacttatatggaagaatgcacgtaaagacatacacagaaaaacacacacacacaatggaggcagctccatcaattctcacttaattcctttgagtcaagaaacagaacattgacagctcccaaagaaactccttcaagacctttctaattgcttgcctatgtttcacaccaaaggaagacactgtcctgaattgtattgaaacttctttctaagtgatatatggtctaggaagaatgtatccacacatttctacagctacttagtaccaatagattttgtgaaaggattagttataaataatcaatgttgattttgttagtataatgtaatttaattattttctagtttgaacttttaaaatcctatttgttgtcatatattacaaattttgcgtatgtacataaaaataaatttctttgatagattgaaaagaaaaaccaaaaaacttgtttctaacttttatgagagttgtacttcccaagcacccatccagaaacactctaattcagtagttgttgaattatatatgaatggaatcccaccatgtatattattttgtgtctagcctttttttctgggcattcttttgggagagtcgtccatgttgcatagctatagtttgctcaatgaattgctattgagtgtttcatggtatcagtataccataatttacttatgcgttctaccaatgatgggtgtttggattgtatctgatttgtggctgttttgctagaatgaacatgcttggacatggctttcctatgcagcaagcacatgcctttctgttggtgtacatctaagtgtggaactgcacattttcaaactcattagataatgtccatctagttgccaaagtggttatatcaatttatattttcacctagtacttataagagttgcaattactctatattctcataaacactgtcattttaattttagccattttatgggcaggtatagaatctcattgtagctttaatatgtacttccctgatgactaatgagggtagtcagctttttgtatatttgttgaccgtttgggtgtcttttgtgaaatgcctactcaggtctcttgtctatttttagattgataggttttccatgtgtattgaatctactgatcagtttatagagacagtacaattttaatagtattttaatattttataatatttaataattcaatcttccaatactggatatctggtatggtgattctttgcaattttgactaagtgttctaaaacttcaatatttattaaatcctctttattattttttaaaaatattttatagttttctgtgtgcaagccttgccaatcttgtattagatttatgttagaatttctggtctctgtctctgtgtgtgtgtgtctgtccgtctctgtctttctctttctttctcctcttccttcattccttccctccctccctccctccctccttccttccttccttctttccttctttccttagctggttcttccagtagagcagtggttcttaaccccaggcaattttcgtctgctgggaagatttggtaatgagaagacatttttgactgtcattaactgagaaaacactgctgatatctagtaagtagaggccagagatgcctttaaaaacttatttttaaatgttgtccttttttttccttccagtagttctcaatggaaaggtggttctgagttttctggtctaccattacaggaagcagaattcttgttttatttgtctgtgcatttgttaatttatttctaggtaggaatctaagaaaatcagcattgaaaactctgaaagtattttttttttctgggaaatagtgcatattcaactgtaaactattgaaaatgatgacgtatttaacaagatatgctcatttcatagaagtcctaatttgaatgaaaaccattttttctttaatttctataatcatagcttgaagaatgtctaactcatacttatgcagaagagatgtccacttgctctcactatccctgagttagaaacgaaatatttaaatgattaaaaagtaattctggaataaagtgagatgacttgttgctcctcagtttttcagctgaataaacacagcttcataaattgtgacattaatatcatcaatagttaaatgtgttgacagataggcaaagcctgtagttggcatttctctcttctcagtgttatgtgggtatattaaacgactgttccatatcatagaagtagattggaggttaagcaaaataagataatttagcaatcagcaagttttaaatttttaagaacatccaaacccaaccaagaaaacaaaagagggcttttgccactttggtctaagtttaagagtaagatctaaatccagcagagacgtctaagtctaaagagaccaccaacttaaatttacaagaaaaaaacaaacaaccctatcaaaaattgggcgaaggacatgaacagacacttctcaaaagaagacatttatgcagccaaaaaacacatgaaaaaatgctcaccatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgtggcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattgtcagtaagctatcgcaaggacaaaaaaccaaacatcgcatgttctcgctcataggtaggaattgaacaatgagaacacatggacacaggaaggggaacatcacactctggggactgttgtggggtggggggaggggggagggatagcattaggagatatacctaatgctaaatgacaagttactgggtgtagcacaccaacatggcacatgtatacatatgtaactaacctgcacattgtgcacatgtaccctaaaacttaaagtataataataataaaataaaataaaaaaagacaaaaaaaagaaagaaagattaaaaaaaaaaaagagagaccaccaactttgggtttgaattctctttcctgcttgttagttgcagcagctcagaaaaatgtccactctgatatccctgcttccctcataaacaaggatttttacaattttaggttatcagtctgcctttcaacaatacaaagacttgtttaaattgctttaaaagaggaagaaaaaaaattatctcatcatgtttagatcctcagtcttgattctgagcatttatgctaatgggatacatatatgtccatcttgtacattttccctggaaacctccaatcctgttggaattaattgaataactgcatatgcaatagaacctctaagtataatgaatctgaaaagaaatgagaacttggagattcagccaagcacaagtcatgttagatattttagttgttttgcaatttgcagtttcaattgctgaaaattctcttgaatgcttcattgtctcactgatctaccaggaaatgagagttgtgttaagagggaaaaaaagagaagaaaacacccatttcatcgtggcctgaatgttgatctgagtggatactggagactgttttcacgattgcttttgagctgcattgagtgactctaggcatgcatttagaagccactacaggggtaaaaaaaaacaaatcaaaaccaaaaagccttctaaataagtaaaatcttgtcttatatttaggagatgttataccaaaaatgaatttaatgcattttaggacataaaaacaccgctaacattgaatgaagaaaaatacttagcctttatattaatagcccatttttctatagcagtctcttcttataatactaaaaaaaaagtcaataactatgaaaattaagtgaatatatactctgctaagtactttttattcactttataccccataaaatcctcacaacactatcatgagaaaggttctattgtacagttgacacaaataaatagaatttaaagtggtgaagaaactcgccactcactcatataataaatggcagcttctggatttgaacccagatctgcctttattaagtgcagtgctgctgcattgagtgtgggtgactttacagtgatcaaattatgggtgtatgaataatgtaatggatttatgagagtaatccataagctataacatttcagctgccctcagataagctgtatgtaaggaccttgagacatgttttttagactcttaaagggcctccttaaaaggatgggaagaaaatctattttacttcccaccatagattccatattggcaggattcttggggtagaattggatattattcacactcaaaagatcactgggcagtgaaacataataaggccacagaatatggtgaagtactctgtactaccttgaaacatttttagctttcagcatccaattgtgtaattgcaatgtgtgttgtcattagtacttataagcctttttgcttaattttaaaattggaattaaaatactgacttacattttgaaaattccctaaaaacatcatcctctttcctttggattcttgctcatgactgattcatagaatcaataatatgcagggccagtattgtgagagattttcttttaaatgagtttctagggctccagtgattcaaaaaatcccattaaagtatattttaaaaattaaactgaatccaccaaataacacatccatgaatgcttatttgaaaacaatgtaaaagagaaggttaaagaagttgatgtatattttattgtttttaaaatatttatatgggatgaaaattcagtgaatcagaatcttttattcagaggctgctcggtaaataaactatagaacacgtaagatttatttttatgtagttggatataatttattaattcgatttcaatacagtgagagacttagagtgatttaatgattgacatgataatttataagacttatatttaccctcattcgtgtcccttctggaaatctcataatcttacctgtatatattgattttcattagttcagatatttttcctttaaaaaaacagattctatttttctttatttgcttttatttgtttactttggcttttttggtaacagctttattaagatataattcatatagtataaatcctattattctttagtcacatggaaataaaagttgaccttataccagatcaacaggtattgtaattagaaaagtttagaatgtagattactttcagaattattaaagcaaaagcttttatttttgtcaaaaacctgcttttttttttaagaaatagtatatgcatttcttgtcttaacaaactaatggtaaatcccaggtgttaaacggactcaatcccattaaatagccatattttctttcatttttaactgataaatttcagaaccatactgcttcactttctgtcattttattatgtaatcttaactaagccttgccaatgatgttttaattatacctttactatattagagtcatatttattctattgctctaaatttctgaattttctgaagctttcattctctctaaatttcaagcagaattttacagttctgaagatttaaattgtgaacatgaagatagactataaattactgattgaaaaaagacaagtcaaatagccctctggaaattggtatcccatagccctttgcaatcgtaacttgtgcataatgcactcatgtttatgtaaatgacatcctaccaaacagtcatttataataccagttagcatttgtattgaatcctggcagtgctttatttctaaattgtacccatttttaatgaacaccccccccaccccaagtaatgtcttaaaaagtaatgtcaggtgcaaattatttttaaatagttaggttttgtttctgtataagatatttaactttgaaaagaaaagtgacagcctgccaagtgcataatgcactctcctgagtatcagtacttgcatattttaagagaaatcacataaaaaagtaatagagtatctcagtataaagcaaactcaaaaagtgtttttctttcatgttagcttcagcatattttaaaatctggtgggccattgagaaaacagttgcgatgttatttttaaaatgtggaagccacaatttttttttaaatcaggcatgttgtgtagtgtacataccaagcccatgagcccacaaaaaggaacagaaaaatatattctctttgcaaagtagagtggtgggttattgacatgcagatcagccacgttggactgaattgctcctacacagaataactgaggacttcaaatcactttgaaaagaccaggccagggctatagatttctgtgggccctggctccttgattacatttatggttggattcacaaatttataaaaataagccagttcgtttatttggggacaaatggaatacagatgaagaaatttttatacacttgatgaaagaaatgtgtccaagtgcaattattattttgaacgttgaaagcaaggcccactgccatcaatgctaacacatgaactgttgcattctctgcgttgaaagctaagcccttgtttgaaatgaactcttaaggtttttccctttcttcaagaaggccttccaattttcaggtttttctccttaaaaaaatacttaatatttattagctaaccaatgatttggagaaaatagacttttcaagaggaaagggaaaaaatcacactcatggattattggtggtaatttgttgtatggcatagcagttcactggttgtatgccaatgatggttttctgaggtgtgggagatgaactaaaatctttcttaacagaaagagaattagcattacaagaaatacacacaaaataaaagacatttccatgatgatatctaatatattttcatggagacttgagtatctatgtcatctttgaaaattagttttgcttgttttacctagcatattaaagttggggtgtgtgtgtgtgtggttagtggcagatacgggtgggggcagggtagtatagaaactagtagtgacttaattgaatgaaatgactagaagatagctttctaaatcccatttcaaaactggaccatccaatttcactcttagatttgattcccccatcccagtgctagaattcggccagtagttgtaaaaaatacaagcactgtggtggttgcattttcttaatgaaggtaacatttgagttaccaaacagtttacctaactgttttgtacataaaagtaagagatattcttttatgataaaaatctattttaggattctcattcatttaatgtgtacatttggttatttggcattaaaagtaaactcaacttgaacaaaaatttttttgtatttgctaaaagataattatgagatgttttaatgggaagattaaaaattttctttaagacgaatatttttcttactatactgtattctgtggcaactttatgattttttttaccaataatctcgagaatatatgcaatggaccagggacaaatccttacccaggatgtgggagcggggttgaggggggtgctgtggggaatggttcaaagtagattagataaatttatgggtctgccaaatcctcataatgggttgaacgatcgtgacacacaatgttacattttgctgacctgttacttagtaaaatgtcaaaatggagccagatttgcaacacatgatgttaatggtggagagtgtccaggttcttggccacttgaacaaagaattggacaaaacgcacaaacaaagcaagaaaggcacaaagggatttcttgaaaatgaaagtacactccacagtgtgggagctagcccgagcataggagctcaaaaagctccgttacagaatttttgggagtttaaataccccctagaggattccattgtttatttgggatacgccttatgtaaatggagaggaagaagtaaagtgacaaagtcatctagttggcctgcgccctatggagaggatatttcctgtcatagctgaatcagccttatgttccgtgtctccagaccctgttttcctgcttcaatggaatgacttcaactttagttacatggttttgttttcctgatgtttgcaaagttacctctgtcttaactaggataggttcatctttttttgatttgttacacagttgcagctattcattattgcatctttcaaataaacatgaaagtactcttgggtttcagatcaggaattattaaaaatgatttgtagcaaaggaggttgctttaaatccagttcaatatcatacacttcttctacttcattctttgtaaaaattaatctttctaaagttttccttcgatttcaattgaatatttctcaccttttcttgatatataatatatattgctaaccttttaaaaaacagtacacatttatctcacccatttccctaattcctatgtctagactaaagggcagatcctccatattaagttagttttgaaaaagtaaaataaatttattttctcttgtgaccaaaatagtttagattttcaaccagcccatcaagtgaactttcaaataaccaaattcacattgaactattttttagatggaaagttataatcaatgaaaatccagtaaaatgcatatataagtctttcaaatgtcaaaagagaatacctgaactaagctttggaatactaagcatttaaaacattctccattgaaggcatccatcctttattaaaatttgcttatgtgagatcatttaatccatttctacattgggagttattttggctggattgcattggtcaatattacctttataatactgcactgtaagaaagtttacttgctccgtatgaaatttccaatatttgatggtttttgacctacaaaagcagcaagtttcacttgcttcaaactaaaactgcttttcttaagctcctttgaggattaaaggagaataggacagaaggaagcttcagaatccagaccaaattttactactcatcctccaccctttcttttgtcatcttctcccaaacttttatttgcttccaatctttgtgttgctgaatgtttggggctctttagttgttgaatttgtattgctgtttcaaaatcaatggttttccatctgctgcttatatgcagacaactatgagagaatcatggaacctttgcactaaacctgaagattgaattaagggcattcagatttaaccgctttttcaattaaaaaattcctctacagcagaggtcagcaaacttttttttgtaaagaccaggaagtaaatatttcaggctttgcaggccacgtgatctctgttgcacctcctggactctacagttttcaggcaaatgcagccacagaaatcatgtaaatatatagacatgcctgtgttccaataaaacattatttatggacactgaaatttgaatttcacattcttgtcacgtcatgaactgttcttcttcctttgatttttcccccattcatttaaaaatgtaaacattcttcttgtcttatgggccacacaaaacaggcagccagatggatttggtcttcaggtcatctttaccagcctctacgtcacagcatcactgacatgggtcatctgacgtcatcataaacacctctgttgatggggagttgattacacacaagtcagcaaattcccaatgcttcatttgcatttatcagaaatgtagtagaaccatattatgtgtgttattttttatcaaacaaaagacaaagaaggcccccaataatatttttgcagtgacatgattattattacttttttctaaaccagctcttataggcaatattatcttccaaaccactgtgtataattttcgattatctgcactgcaattgtaatatatattttgactactaccttcgtcaaataatactgcatcatagtgtttcgtatataaagcatgtagttttataactagaatttcagatgtcacgcataaagaaacctcatttgagtgattattccatgtcattcttggcttttacgaaattttagacatgtaggttgctttcacttgtttcactgacgattgcccttgtgcatattgttaaatttccaacacttatattcattcctttgggaagaattccagaagtggaattactaattctgagtatataatcatcataatctttgttgaatttactaaaatattatggtccctgtataagtggggacaatatacattaagtcctttatgtgggacaggcaatgcgctaaacactttaaatacattattacatcgaaaccccacaatagttatgtaaaaatataggtcattatccctgcttgtagaggtagaaacatgactgacattaacagttcaaattagaacttaggtctatctgactccaaagcctgtcgggaggcattttatcacctcttaccatttataaatttgcaatgctaatacacccgtaaggtagaatgctactttaattttttttccttctctctctttatcaggtgaaattcaacttaagttttaagtcttattttaacattaaatctgccacaaattattcctcaaacccaacaaggcagaatctactggtcattcctctgtgctcccacctattagaagtaaaggcttattccagtgtattatttttagcatcttgaggaaggtactgtggtacatttatgctgtgtccccctgaggtatcacaaagctttgtacaaagtcagagaccaatgcatgtccacccagtattactacagtgggtcaagatctgcttctggaagcttcgtttcattggcgtacattctttatctctgctataagtccagtaaatcaaatactttggtcttgtccttattttatcatctttgttctcttttctggtatttatctcacctctcaccaccctactgccctgaaaatatcatttttgtgtacttagcctccctcagaatgtgttcctggctcaactctctcaccagcagatagcatgaggctgaccaaggcctccatcctcacatattagactctgtctacttaggaaaactagagactgaaaatgagatcagggccactcttgtagaaattagaaaccttagcaaaccacaaatggcacagattttaactggcagattatttcttattaaaacattttaaaatagttctagttgtaagttgactcagatctggaaaggtatgtgataaagctattttcattgggggttctaagtctaaacatgtggctctgtggagaattaatctgctctgctgtcattgtcttagcatcattatcatcatgattatcacattgttgtagtttccagtcacctcttaggcactaattgaacagtaaggttgcatcaccgctgttggtgctgcttaggtagtattttcacctctttacacattgtggatcattttcttactgactttctctggcctctatattctacacatcttggataggatgtgatttgtaaaaaggaatatacaaattatgcccccaaaatgtagaaatttaacaatctgatgttatataaaaactgttgataattcaactttgtcctagaaaaattatattcaagttatagtctcattaccctgaaattttttattgagttttgtcataaatataaacagtgtacaagtcatggtatatatccagctgtatttcaaccatgaatatgttcttcaaattctagaaatctctatgcgtaaatatcaataatttttatatgaggtgtttattacaattctgaaattaaaatatattgtgtctgaaacttcatggtttgttaatcatgtatgtattatgtggggaagatatttgtataaaatactattcatttgcttcaattagtatagaataaaaacatttatagaattgcgttttaaatttagaatataaccttagagaatgttatttttatttggcataggtttttttcatatattagacaatttgtaattggataagacaatcttcagttgaataaaatactatagctgtattctttaccacatataggaatcaactcttacttaataacaggaagctgtatgtttgctaatgagaagattacataatgcaatttaagtttatgttctgcttacctttatgctgaacaaaactgtttgaatttacaaaaaaatcagaggaaaaattgctctgctaataagcccagtaaagatgatgaataatgaatgttggaatgttattatagaataaagccacaagctatgatatatcttgctgctaaattattttaaatgctgtctgataattatatacttgttttaagtctacatctgtacatgttaaaattgaaatcagagtttctaatcaatactaatttttccttcttggttgggtgggaggagaatgttcatgatagagaatatgttttacagttagaatgttaaaagaaaatcatatttaaattaatagatgtttgtttagggcaagtgttactccagggcagggattactgaggaaattttagaaaaacattgaagtaagactatgatgattaatggaattattaccctgatgtattctgtggaaagaattaagggggaaaatacattttatcattaaggaaacaaaatatgaattgcatatttaacacttcattaaatatgtagattgctgtgaaatctggtgagaaagttaaggatagtgagatgccataaagccatcatccaacacacgttcatttgttctatccatgataaagtgagaaaaattagaaaagagccggagagccagagttagacagacatgaaaaatgggacattggaaacaaaagcaaatcgctggggatacgtatttccaaaggtaaactagggaccattgtaaccactctgaaatacaaaatatcatttctgtaaactgtgaaatactgtaagctgcatttaatagtgaaaattatgttaaatattatagcaatgccaaatgaagtgattggccactgcttgtttcttgcatttttgatccaagtgcacatttcttattgttgtcttcccattcagattcacaagtggtcagacaacctctatctcagatatattacgtaaacttccaatcatacgcatgtctttggtggttttgatttgaattcatgattctacagtctctgttccccaggattatttaacttattaaaatgatacttgtaaatctatttttaatatttgtgaaagtcaaaactctcctttgtaatttgcatatttaactcttttttcaaatacaatgtaatactaacggagcagctattaggtgcttgacactgtggttaataattttacatgtatttttttaaatattaataataaatctgtttggggtacatattttatgattaaaaaattacaaaccagagaagttaagtaacttcccttgagttttatacctactgctcacagttctataaagcttactctgtacttaattctactattagtgaaaagacattcagtttttgtaaaatgatttattggagggtttgaggatccactcagtgataaataccctgaggctctatgcaaaccctattttgagaaagaacacaatttaaagattctcttctaagtgcctaacagcaacgttgtattttggaagttataagtgaatttattcaattatttcttctctagttgttgttatccaattgctgcatgagttttaaccaactgagtgactgattttaaaattttcagttttcaggttggcttgcatataaactaaatctaagagattgcttgagaaactgaatgccaatggcctaaatgcccttagctggtatagttgtgatgctcagtgctaattttactgtaatagatatagaaatagaaataaaaatagttttaaccattatattttggttaactcattaaccaattggcttttcttttcttatggaattgtggtatctgatagcaatgtaagcaaatataatttttcaaaaggggaaccagaatttatgtagatgcatagatagccccataatcaccacttctcacaatcacaatcttcttgcctgagaaaaactgttgttttaatggagaacataaagtttcattaagatacagattttttttcagctgattcttctttatttctgtaaaattcagtagtctagaaaaactttatcttggaaaacatgtagtaaacttgattgaccatattagctttgctccaccattaggccattataccgaaactcttagctgtcagattcaattcagactttaattaaattgccttgtggtctgacctgaaagagtgaatgtcacaggacttctcaggaattaacatgatggttattgcagaagtagatagaaggaatggaaaatcacttaaaactagttagtgtgaaagccctattttgggtatttcccatgttttgcaagcatcagctctttctgacctttagccttccaaaaatcactctaaccattttatctcccttttgcatgcatatctttgccaaatgcccctccttccatattcagtattcagtcattttcttgtgaattctagaacaaccaaaaatagttcttgtatgtctactaagtgctttaactcctatgctggacactgtacagatcatcgtgagcaaaacaggcattgcatccaccctcaagaagcttatattccaccatgggagacagatgttcatcaacacagtctttgcatatgtcataacaagttactataagtgctacaaaaatgtatgtgcaatatgcaaatacattggagggtactaggaaaatatgtaacagaggatcttatccaggcttttctaggaaattgacatttgagttgagatctaaatgaggcactggaattcactgggcgaagttgggggatggtggaggattgagtgctggtggtcccaaactggggaacaatatagacaagacctacaaaaggaagaggcaaggctttcagaaactgaaggatgggttttggggctagatcagtgaagcagagtgggggtgtgaagggagctagagagatgaacagcagcagttcccagaggccctgcaagtcattctaaggcctcaaatctgagctcattagaaaattctatgtgcaaccagccttattagggtcatttaatgacttcttagtttattcctcttgaaataatttaaggatacctagttgtaatgtgtttttaagtaggaatgctctttcttgtgaagtcattttctgttttagaatttctgccaattaggtcatagctatttttcctttggtttttctttgtttcattctttctattactttcttccaccttttctgcttttgaaaataattttcatgtctattcacagtcttcatctctcccctctgtgattatggcacttcaacgtgtcacggtccttttctccacgttttcttgctatacccgtctcatcttccagttctttcttcttggctggaattaagtcctgagtaatcatttttctcattgctttctttactttctggatgatggaatcatcagtgaggcacatcaggaacatatcagatgatgggctctcagctgaatcacactttgagcagatgcacaggtaactgaagcttcccatccctgaagtgccttccctgtatgccatttttaaatattttacagaaaagatggacccacagttttccttcatgagattggttagtattctattcctgtaataacacttttcatttttcttttgttttgttcttaaccaattgctttctgttgtgttttcttttaaaacacttttaggtttaactttattatttaatacatgttcaatctctagaacactacaactaatgattctaagtaatagaacaattaagcacagtgtaacaaaaccataatttgtaaatatttaatatttttaagaagcatttccaagttgatgaaaaactgtatacataataaacaggcaaatactagttagtttcaagttctatcaagttcatagtcagcaatttcagttttgtggggttcttcaaaatgttttgttaaatccacaacattgtttactatggcaaggaaaaggactggaaaatttgccccctgcttgttgaactctctacattcttatgataccacttgacattacttagttgtgggttatttaagataatcagttatttgttcagtgagacaacattgctctgtaagagggtcctgtaagactgggaggggagctcagtgatcagatattcaatcagatcttcttgcatttcccttagtaacatgatactctgggccaggctcattcctgtaatcccagcactttaggaagctaaggcaggtggatcacctgaggtcaggagtttgagaccagcctggtcaacatagtgaaaccccatctctacaaaaaatacaaaaattagccaggtgtgtgtggtggcacatgcctgtagtcccagctactttggaggctgaggcaggagaatagcttgaacccaggaggtggaggttgcagtgagctaagatcttgccactgcactctagcctgggcagcagagtgagactccatctcaaaaaaaaaaaatgatgctatcatcatcatcattttcatttttaaatatttccccaaacataaaatatcctgttttaactacttttaatatatcttgtaacttttttaaacctagaaatttgaaactaatggtaagtcactctattatcaaagcagtaatctaaaattatccaggaaaataatcttttttctgagatctggcacataataatttgctgatctaccaaagacgtatggattttaccgaaataatagttttcatgaggttaggagttttattttgttatcctttttgcaaaatagtacctttctttttcacagagaatttcttctcccattaatatcacggtagataactcagttgatggtgactgtcataatgctctttaagttctaagggcactctaagcgtcatcttggctctgacactgccaagtatgacttggattttctttgcttggaaagttcttgcatggtgctctctcaccacatattcccatcccctgaaattgcatgttttcattttcttagcaactttttctttattggtactcatcttataggtcttcccatttgttgggtttgatgtttggctcaatattgtcactaaagcaacaccaccagcgattttccaggccaaagtattacattaaacaaatggttccatagaatacactctcatggtgctgtagttgctttcattgctaagtctggttcctggagcaccaggcattagaccttaaccatgccatctcaacacagatttggaccacacgcagctccgaagtgtacacacagacacagtgcttcttttatactaccattgactaacttaacacgagttcccagagataagcacatcatatacaagagataaatggagtttgtggataatcttttttagttcaccacagtgtatgaaacagatacattatacatctgcctgcagggagcatgtgctgatgtaggaagacacacactgaacaagtaactgcaagttattgagtgtatacaaggagaggttgcgtgaggatatgtgaattcaggaggaaggaacctcacctgttgatgaacttaacttttcttcagaggaagagatattttaaagagacatgagagaaattccagctaaccagataaaaggactagggattgagaggcagagacaatagtatgggtgagttcaaaaaaccagaatgtggtattctacacaagctggagattttaaattcacaatttttgcatgtattttgcatagtaacataagacttcttgttgtaagcatttctttggctttcacccctgggatactatttgtgcctaggatttttgagaaggtagcaaaacatttctataatgcctcaactctctatagtgagtacattacctaactggagtgagatagtccacagatgatgcaacctttgcaagctggaaagcactttcctcttattttatcatggaaattaggtatttcattgtgacagttacatgaggcattatgttgagctgtcgctaggagcagttagtattatctttttgggctttaaaagcacagaaaacagttgggggaaagtggagctattttggaatagcacaaacaatctgggttggtcattgattttcttatgaatctcatttgactgttccagataaatacaaaatatttggagaataaaagagtacagattcatacgtatcactgaaaactgttcatcttaaagttcgtgttctttgttgtcatcattttcttgtaatgctggcagaatccagatgctcaggtcaaataagaccataagtgagaaataaactgtggtgacatttgagttgacagacataattctgacacgtagaaattattgggaagaaaaacaaaaatcgaaactcacaaatgagagcttaaaatgaggttatgctgtctacttcagaattattttatcacacacccagtacttttatgccaaatatgcctgggtttatgcaatttaaggacacaagagagaaagataagttcttcgaggctttccaggagccaaagtctggcaattgtaggtgcatctctttcagactgaacacatattagagatcagttttaatgacactttttggaaggatttactcaaataagtgattctccctaaaatacgagactagcttttgatcgttgtttttttttttttttcatttaaatttttttttcatttttaatttttttttgtagggatgggggtctcgttatgttgcccggtctggtcttgaactcttggcctcacgtgatcctcccgcctgagcctcccaaagtgctggggttacaggcagaacaaactgtgccctgcttaggttttaattcttaatggtcatcaggattattcggatagagcttccgattccctcatactttcctataaatcaacaaggcagagaagccctaaaatttgccttgctgctctacattaaactggcttcagatattgccggtgttctcccagtctgcagggtccctagaaatccacattcaatggttttaaattttgcaaatgttgcctatgggagggtggctctgattcccactatcaccagtcccatttaaggatttttggttttataatttgcatcatttggatctgtttatgtttggcagaaataaaatgtatgactttgaacaaataaaagcttagccactagaatattaacttcaatatctacataaatatttttcttcaaagtagttactttggaaaatgacttttaatgtttctggaattctgccttttagaagtggtgccagagtcagctcacaagctgcacagtgaaaacactgtcactgctttatagtcgaaacttattttccctataaatccaaacagtgtgccattcaactggaacaccaaactattcagtacctatggcaccaaattatttttgtttctatatgtttcttcttaaaatcgatcattctgaagtatcaaaatgtctcatagcttaagtatttataaacaacagactttaagaacaatttcaaaaaagttccccaaattgttttaataacctcagattctttacttgcataaacatagctggcaaagtgactccttgaaaaagacaacactcatttaagtgttaagctatgttacttatgttaaacttattaatgaataaacctaaggtcacacaatcatatgtcttaaaggcaatggttgcaacttcttttctcacttaccttagtacgaaaatagcatacattttttaatgtctgccctgtatcatgcactttgctaaagattttacataaccatgtttatttgtctctaagtttttattggtagtcattttgctaaaaataatgtggctagtcttgaagagatgttgcatagaaagatcattgtacaaactcagcttaacttggcttcaaagcgtatttttccttctaatatttgatggtaatgctgagagattttactcctctctctttccttccttgcatccatcctatcctaacgacaatagtgacatctgaggatgggctatcagctttcagcatttgcaaaccatttcttctgaaactcttagtacccagtgttttcaaagcaccataatgttaactttctcttttagcttttgttttgctcttttgattgcattgactttaaaaatagttttattgttattaaagaaattattaagcatatttttagaatcctattcaactcagaaagtggaaggataaggctagggaggaaggaggcaaaggaaaattatactggtttcaattttgaagacttgccttcctgaaacagttactgttaaaatgttagtacttacttttaatatttgcctctctacgtctatgtgtatacacatacacacacacacacacacacacacacacacacacacacacatatatatatatatatatatatatatatatatattatttggagtcttgctttgtcatccgggctggagtgcagtggtgcgatctcagcacactgcaacctgcatctcccaggttcaagctattctcctgcctcagcttcctgagtagctgggactacaggcatatgccaccatgcctggctaatttttgtgtttttagtggagatgacgtttcaccctgttggccaggctggtctcaaactcctgacctcaagtgatcttcacacctcagcctcccaaagtgctagtattataggcatgagacactgttctcagcctctatattcttaaataatattcatgaataggcatatcttttagatgttatctattgatttctattatggaaggtgaatattttaagttttctaccctcgcacttttctttcttcatgtgacttttcattttcatttgaggcataattaatatacaataaaatgcacacatctcaagtgttgagttcactgaattttgacaattttatatacatctgtaaatatcatccaaaataagacatagggcatttttattcctctagaaagttctcccatggtcctatacataagtttattattcccctctccctcatatacacatacaccattgtctgatttctaacaccattgcatagttttatccgtatttagatttcatataaatgggaatgaacattatttcctctttttttctggcttttttctttacactaaaaggtttgaggttcatccatggttgtgtgtgtaccaatacttcattcttatttttttgctgagtagtattcaattacataggcaagtcctaatgtatttatctactatctactattttgttgattaatatatgaacgctttctaatttttgactattattaataaaagctgctatgaacattcacagacagatctttgttagcacttatgttttcatttcttttgggtaaaaatgtaggaatagaattgctaggccatataaaaaacagatgtataactttataaacatctaaaccctagagtagttctacaacataactaaaataaaataccattttacaattcttccagaaatggatgagaagcctattcatcttcatcaatatttagtgttggattttaaccactagtcttaaatttctttatgtgtttcttgtgttacctgtttccctaggttcctttttactttttgcttgtctatttttcttgtaggaagcgttcctcagattctagcaattgcagactacccattcatatttaaaagtgaagcactaaaaatataattgaaaattgtgttagtaggcaacattactaaatgaggtttcactttagaacaaccaggtgaccatctggcttttgaggatggtctcctaaagagcagctttttaaagtctttactctggggtggctcagatttcccagagaaaaaaacacatcctcttatctttcactttggatctataaatgtggttcccaggttatagagcccggtggataaagaggtataggatttctgttctgtatacagattttatttttctttttgtttgccgtctcaaaactctgtcttccttttctgtggatttgttgtctccaagtctagggattttaaggttaagttctccccatgtgatacctattctctcctgtccaggtagagaaaacccactaagttgacgtatgtggtggagatgggaatagagagagcagggtgtgcctaacacaaaattccgaacaattgtcttgttttcaacccctgacttactctggtcttctgtattatcaggctgtcctgggatctgtagggtgggtcctttgcttcccaaccatgtcttaccttagtgtccttaggtttgtgctttttcagctctgctgaaaaacattctctacctgtcttctcttcacattccataatccttgattatgtgtgttttctactttcctgaaatgtattgtttttttctcgatttctgtgttttgggggcttaatgtgtttccaagttttaattgtacacgggatgttcagattacactgtacttgaggcttgagggcgatcgaattagagaaaaactgtatttgctgatgaacagcaaatgtagtgtttctgaagagttaagcctaatggggccatttagttcattttcaagaatgcttaaaaggctgcgttagaaaataacacaaaggaacttcagaacctcagaatagggatggcacccagactctcttcatcatgagggttttgagggtaaaagttcaaacaaaagatacattcaccttttaaaatgtaaatgaactgcaatatcagcataattttcttgtactatctttgaaaaaaatacaagcacattcacagtttttctttattctctcaagaagggctttgaaaacccataattatagaatttattaaggaaaaataactaataaatacttctggagaagaatattcaaaagcctaaggattgctagacaaaatatctcatttttagatcaaatcttggaaagatgcaaaagttgttaccgacaaagataagttataaattaagcatattggaaacaagaggaaggataaaacctgacaaattattgatgttgcaggaggtaaccaaggaaggctgtgctcaaatggcactttgatgacctggctttgtgtgtgatggttgatgtgcgggatcacaggaaaaatttcccgcatatatcagtaaacatatataatcaagaacctatgacatgcccatcactgtgtaggctataaagaaatatgagcacactcatgatttcaaacaaggttactttggtagaaaagacagtcaaataaagagatgacataagggaatagattctgagtgccaaccaagtgatacagacagtaagtgtcaccttaactcagaagagacagagaaaatcataggtaggtagagaattgagtcagcacagcaaaggccgaatttgtcttggtcttaaaaataaatcggtgcaaatcaaaatggatgatttaaattttacagcctataatggcacttggcaaacatggtatcattgtctctaagtgatttttttttttttttttttttttttttttttagctatattaccctttggctaaggctaagacagattcttgcagttcattattgtttagcagatagcaagctttttagacacttttatagtgaaagtgtgtcttctcgctttatttatatacttatagaatcatctttgaaggcataatcaccaactgccaaatttgaggaccttggcagatggagacagatttcccagggaaaatttgaaatggcggggagtctaaccagtgatgtgctgataagaaaaacatccctgatttggagaatttgccagtttctgtgatacaaatagtctcacccttgccaatttcaagctactaacttggggttattgaatcctgacttggaaagagttgagcatgatgagtcgacctgagctgctgtaggcttgctccagcacactgcggaagctatcagacattcacatttcatctagaaagacatggggagggatgctgatccacgcttaagtccttcccctttccattctgatcctcacttggtcttccaaccattgttctttttcagatatatggctcttgtgacaagattataaaggtcaaagatgctttatcccaatatgtatcttattcatttaggctgtcaaatataatttagtttgttatccatagcagcagtgcctcattgcttgagcaggcatgcggcagtgatgtgaagagcaggagagagtggtgtcaggacctgaaagggtgtgcacctgtggagtagctgtttattaggacttgttcctgatgcaagcatgtcaggccagggttcatcttccaaaaataggggtagcaattccagagtcctccactgatttatggagaaggacccatcattctgtaactctgaaagctatgccaagaacaggttattcatgtgagacttcatttcctttaatggatctgggacaaaacttgtagtcatgtttacaagccatgagtgcctgcaccactgtggtggcatcccaatactaggatatttacctagagctatatgaagcagaatcatcaaaccataagtaagaatcttgttagagtttgtttagccacaggcctactattagggaagtactaactcccttcatctaaatttctacatactctaatagtcttcttagttatcacatggcattgaccattttcttgttgtctgtattagctcctgctgcaacggcagttatgaaatctgactgagtttgtgccaaggcacagctgttctcactggtcttgcagatgcccagcaagttgctgggaatacccagatgaagcctaaagctgctccagatataaaactgtccacactagtacaacttaaatgtagtacaaatgctgtaagtttgcaatatccctcagagattttaatggaaaatccaagtactgttttagtttttttccttttcttttgctgataaccccttttacaagatttaaagatgagtccacagggttggactgagttcagtggtaacacattctctacccctttgccctgagatactttcctagaatcacacatgtgtgttttattcctttcttgggagtattctggttttgatcccttaacctattcaccaagggagctctaaataatatcatccaccactttcatgggccactcacatttcataaagattgcaaaagagataaaacagaaaactattagtggtacattagctacaactcctttctcttccttttcactgaacacagtgaacagaaagactcattggcttgagagccactgtgctgaaaggcttgtttatgagttcccaacatcttcaaataggaaaccactcaagagaagtccagataaaagtcaagggttagttaaagccaggagatacaacaataatgccagctatgaaaagctgagccaggtcatacaaagaagaataaaattcagagtttagatgttggaattaagaatgcatgtcagttaggctggaaaaatagttgagaggagagaccatgaattttattggagagcaagagactatttttatggagtaccagctaggttaatggagtcagatggggtgggatatgtgaactgtctagaattatttactttcagccagtcatactcatgactgcaaaaaggacaagttgaggctgtgcctctctttagaatgtctgcattttaaatatctatttacagcaaatgatatgttgctgtactgcaggtttattagaacactagcatatgtgttgacaaggcaaaggtatgttaaatatctttctggagagtcaatcctgataaagcaggacatgcacttaattatagtcatttaacagtggcttttctactttaattatagttttatataatctatgcatgacaagtctgaataataataaaggaggaattataagctgaatatggagaaggttttggaccctgcctgcttctgaactacactctcaatctggattatatataagcatatataaataacatacactcctctcaagaatgctgcattactagagccttacactgttcttaaatatgaaggagatttgttttcaggttattggagatacagagattcacagaactgccttgagggacacattttttatgtacaaatatagcttttacctagccagttggtaggtcaaaacccaatggcccagggaaatggtttatctcttagctcagaatttgactctgtggtgggtagactatagttaaaagaaatgatttttttgacattggtcagaaagttatttccttatagtgacttattttgtccattcacttgtacctagaggttttaaaagacagacacattaaacctgtggctagaggtggggcttacagaagcaagagtgacagtcttcaccatcaaatgcagttgacgtttgcaaatgacaggagacaaactggaaattgtattccctcaattcctagcagctgattccgactcattcataccaatattgtaactgttgtcactcttcagagtccctctgggacattagtactaggttgtcagttgtcctgtagttaggcatctatgacgtgaacaccaataggaacctataattgctagaaactcttattcatttgttttagtgtgttgaaatccattatatttgtaatggattttccaagtctcactatttgccagacaccctctctgcacccttgcttctcagcttattggaacagactgacgggaaaactatgccgctctcttggtttctagggtggaatttcaggggagaatgatgggagaggccaggtaataaaaaagcctccttccagagatgatataacttggcagccttaagctcaagagatggaggtgggatcaggatgaaataagagcatgggaaatcaggattcatcacacaaataaattttccattaatgtttgtggattaaggataataagggaaagaatgccagcaaaaaacatgtatattttatgcaggaaaggcaataaaatttgatattttgatttttacactccttatcccacatctgaatataattgtctaggattgcaggaattattttctgcaagtgttgctggtaattcttcatccagtcttcttccagtgtgggtacagttacgaatattgccacctagggctgacagctgctttcaactggacaaggttttatggtttctttgtctttcccccaacccacaaatgttctcaaacctcttgcatttatttatgttattttactttgcatgaatgggggaagaaacagtgttcagcaattcaatgatggctgaatggaataacagaatttcatttcctaagggaacatttgagagtgattgaatcaccctcaatctacaagccacatttttgcactatttttctacttgactaattgattatgacaggtgtcacccaagctttgcagcttaggctgtccccatgctaagacagagccatagcaagcaacttctattgatgaaatagaaaagctatgcatggttatttttccttattgattttctagtatatgatgtcagttaattactgagagccattcactgcatacatgtaagtagtcattataaccatattttcaattgattttttccctacaaacataatcagttatttgtttgagctgaacagaaatgtaaatatctgcagttgtaaaaaaaaaattggatgtgtgtgtgtatgtgtgtatgtattatatgggtatattctttatgggcatgtgattttatctatctatctatctatatatatatacacacacacacacatacatgcatatatacacacacatacatacacactagatataatcaatattatatgcccatcgggaatatactccctgtaacatatttacaggtgtgtttgtgtgttgtgaacagagaaagaacagcacatgtcatggccatgctaacaattttggttactataccaaaagggagatttctaaagtattgagctttaagtatattgcatttttagtttcgcaagacaatgaaaaaattagcctatctaccttatgtggagggaaagaagccagatacaccaaaaatttatttgtataagtctacttatataaaattctaggagatgacaactgaatatatagtaacagaaagaagatcacaggttgctaggaactggaggtggcaggagggatggaccacaaagggttatgaggaaactttagggttgataaggtatcttgtgtctcttgcttgtggtggtgattttttggttgatgtacctgtcaggattcatcaaattgtgtatgggcacagtttgttgaacagaaatcatgtcccaataaagttgttttaaaaatgaggaaatgtatgtctcagcatttgaacactatttggagaattaccacaaattttccatgtttctaataatattaaatcatttctacatatggcaggaacttcatatttctcagaatatactcttggaatggaagtgattatatccatgatatatattgaatgtccaggccctaaagggccattcggaagacatttgagtttttttctagttgacttgataatttctacttacctaggaagaggagagcaataactaacctttgaaaatttctcatattgacctacatgatagactgatatattcattttcaattagtgtataacaaattactacaaacttagcaacttaacataacacacatttattatttcaaaatttccatgtgtcaggagtccaagcacagctttgctgaatttgaggtctccccaggctccaatccaggtattggccaaggttgaggtctcatcagaggcttgactggggaatgatccacttccaatctctcagattattggcagaattcttctgcatgtggccataggtctgagttccccatgtccttgctgactgatacctgatgactatcctcagaactttgaggccactcagcgttcctggccatgtagcctctccataggaagctcacaacatgaaagctcacttctttgggatcagcagaagctcttctttcagtctgctatgacatagctttgtaaaatgttacttaactatgaaggtaaccacctttgccatgtaatgtaatctaaccaagagagtaactgttttataaattttgctatattgtattgactagaaatccaactgtacccagtggaagtacagtcatcttagatggcttgggccactttagtgcatatctacctcagttgttttatagaggacccttgaaataagtaactttctaataatatatttaataaagaaatatttgaataaatttatatacatatacttaataattttagcagaatgtcattcaattttaaataagcaagaataatattactatttttttttcaagacaaggtctcactctgtcacctaggatggagtgcagtggcatgatcatggctcactgcagttgctgcctcctgggctcaagcagtcttcccacctcagcttccccagtagctgggactactggtgcatgccaccatgccctgctaactgttttttttttaaatttttgttttgtagagacaggatgttgcaatgttacccagggtggtcttaaactcctgggctcaagtgatcagtccacctcagcctcccaaagtgctgagattacaagcatgagccattgtgcccagggagtagtacttttaaaatctggtctaatttatactggtttaatttttataaaaactctcaggaccctacctattgtgtcgtcagggatgtctctacatggtgcaccaggccatgaaggagttaatgtgcctctctaatgctgtcaatttccatcttcctcgtcagtaaaataagacctataatttgcaaaatgaatccacattcttgaacagtgactgcattaaaaaacctgagtattttaataattagctattcaaattatcttatggttgcctactattcataaagtcaaaaacataatataaaataacatagatcataatattagttacagatgtcagcttacttctatttttctgaagaaaaggtgttaatgaatttctctagaatgatttctgacataattgccaggattgtacaatatatcattctacatttatgccagcaaattagcatctgtgattcatacagtggtagctttcttaattttatcatgtacaaaatacatgttgttttgatttttcaaaataactcatggctctctgccttgtagactgaagagaatttacaattttgtcgttgaattggtgaatatttcaaacaatatgacagacactaacaatatacccttgggtttacagcagaataaagctgctactctgataagctaccaaatactgtaaatgcatcaataatttcagcctgaaaaatattacttttttaattgatgcatttttctcatgacaattatacaatacttagcacgcaatattcactttctaataccagaaaggcagctacagatggtgtcaatataaattgtttgtaatattctctgtgtttgtacgtactatatacactatgattacatccaagagctcaggtttgcagaccttttctgcccttgtatttgtgaccttgggtgtacttctgcactatccaatgtctctcataatgcaaaattacagtaatatccacttaatgttcataggctgctttgtacaattacagttacacagcgatcactcaaaacacagtgataatacaattcctcatcaaaataaaccattactggccaatgtttgtgactttttccggactaagccactctcctggggctggcaatttatggtgcaaaaagcagcagaatgtgctatttataattatgcagctttcttctgggatcagaaaatcactggacctcattcctaccttactgaaagaggaaatggtaatttatgttgtgttatttgtctttaaaatgaggaaatagggtcaaaggaaggataaagtgtccaatgtcatgcactggtaaaactggaattagtagttaccatctcatgatctgatttctagttgtttgtttggttggatttttttctttgttgttgttgtttgttttatcttgaataccttttttgtttaacaaaaacttattgtgcacctgctatgagtcaggcattctgtatgtgttttataaattttaactcagttgactttcaagcttaggagttagctgctgctattgtcacccacattttataggtgaggaaaccgagacactgagaggtgaggcagtttgtatgaggacacataactggtatgtggcagaggcagtttggctctggaatctacacttaaccactgttctttgccacctctccttctcctgtgtgacttgtctttatcctccaggtcagaaacgcatcacataaggcctatttcctcccaccatgatcactagtgcttatactctgtttaccatattgagtcagtcaccaaggaggatacaaataaagaatgtgagctccaaaaaggcagacggtatttatcttgcttactgaatccccattacctggaacagtgcctgatacatgaaaaatattcaacaaaaatattttgcatgaataaatgatcagatgaatagatagataaatggacagatgtatgagatagatatgtaccttgttttaagggagcttttagtttaagaagacaaaccataattcagctgaataaaacattttatgattttttattcttttcatatccttcaaagagtgtttctataaataaaactatttcagtcttggtgaaacagatttgctcagttttaaaatatatattagaaaaacatatgttaaaacccaaattaaacaagcttttatctgcatggctcagtgtcaactcagattaatttggtagaggtgaaaatgaattctttcgcagaaattatcttgccatattttaggatgatgtttccgtatgggtggcatttttatgagaggaaattgagagcagaataacgaatggagttgggagaatattgcaggtgtcttcatcttaaatatgcccccaaatataatagagtctgcacagagattacatgctggagttagtagaaaggattcggtagtttgttttcatatccttatcatttaaataaaacattgtcatgtttatattttttcactgtaggtcattcaatttctctcacacagagaaatatgccgaagtagggacacattcaggaagggaaactagtaatcaagagacaaaaaattgatttttgtataaagactaatatatgctgagggaaaaagagaaggaaaatgtcagtgtgtggtaatataggaggtttgagtgattgattaaagattggaaagggaagcccgacaaagggaatttcatcaaaatatataaaaccaaaaaagacatgataggtggctattgatttattcaataaattgtagtatccttcaccccaagaatctactcaaactttagaagagtttgttttaggatgagttataaataaattcagataataaactcagcgagaaatttaatggcacaagaagttcctcaataagtcattaagataagtgatgagaatttcagtacacatccctaaattttgcagttggtgtcagagtcagtcaaatgtttataaagcatgaatcctggttaaaaaaaattatgtcagagaaaaatctaccatactcattgattattgagtttataactagagctttcttcatgattattattgagacaaatgatgatgaaagtccctagcgacctctgtttcctgtttgttaaagggctaaaaaatagtgaaatgatttgaatatagggaatgggaaagtaagagaaccactgtgtatgagtgggtatcctccaaaataaattgggctatgtttctgagccaatacgtatgaaacaaagggtggaccagaatatatgtaaagtgaaatttaaaattatttatcataatcgttaatagtcaaagatggggaaaatccaggaaggcaaaaaagttgaaactgctagcgaaatgggtttcccagattagccagaatcctaaattgccgtaaaggacacactaaattgtctggaagttcatcctaggttttagtgatctgtgatcattttaccctggactagcatgaggagcgaactatgatgtgtaagattttggaaacactatttcagctgactggattttgtggattctttcaatgacacattcctttcatcagagtcattggtatatactcttcagtaatttttatgttttgttttgtagctttcttgtggtacattgttctactgctcacttcttgcctctctcctctccatggttgtgtgtttacaaaaaaatgaaacttcccacccgcaattttgaattgtattgtcctggttatgattacttttcattttcttgtcatccttgatactgtgaccagtctttctcagggaagtacattgaacaccaagctacctgtggtatgtccatatgctcatatgctctgaaacaaaccctgtccaacatgttgaattcctttccctaggctctgcctaagtgcaagccttgtgattcgcttagtccatgccctctgggaatttgctatgcccactggagcacaactgtcttcccaccctgccacctttaattttattagctattagctgttacctaagttgaaaaatggaatgacacaggaatgtagttgaaatccagtgcattactccctaggatgaaaaacaaagtagacacacaggctgactggtgccaggtgatacaaaagcgtcagcatgaatcataaatgctctggtggatgacacttctcagattgatggctgcagtctgaacgctttgtgtcttgggcctgtgtttggaagtcgggtggtgcacattcttttccaccctttagaattaatcttttcacactggctgatagatgttagctacaaacacagtaagaatcctaaaacttaacactgtcgttgttcctttttttaaataagttctttactcagaaacaaatgatgcactcctaatagataaacatccttttattatatgtcttcatggagtctactcttttttagacaaacactagtgctaaccacattagcgctgatctttaactataatttaagcaacagtccctacccctctttaaaataaacatttttatatattgtagaataattttacatttacatgaaaattgtaaaaatatagcagagctcctatataccctttacccagttttccactgctaacgtctcacatgactgtgtatttcaaaactaagaaatcgacgttgctatattactgtgaactacagtccagtctttatttggatttcattaggttttccattaatatcatttttctgtctcagaatccaatcaagggaacctccttgcatttatttgtgatgtcttcccagactcctttttctgtaacagcttctatctttcccttttttcttgaccttgactgtcttgaagaggattggtcaggtatctcaatctgggtatatccaaagtttttttcatcctttagactggtattctttttggaaagaataccacagaggggaagtgtacttcttgccacataatatcaaggatacgtgacagccacatgacatcactgaggataataacttttaccactcactaagtggtggctgagttggccagggttttactctgaaattaatattttttcatctccatactcttttctttggaagcaagcatatcaatctagcccactccccagcctcctcacctctttttttaatggctgcaatcaactctatgactaagatctaacatgattgtaccacattctgtgttaattatctaatacaactctagatagttaagaaggcagtatagccagtgtgctgacagctgtatagcagtgattcctccttttgagaatacaggttggttgcccagaaagagtttaagaataaaactcttacaatctccagatttcctatcccttacctctacccaaaagaattagacaccagaacagatagtttacgtgtttggctcatgacatagctggatggcagagaggggtgaagtcacctctggttcatcttgaggatttttgtcttattttctagtcatcccttagtgaatttctttaaatatcatgttatggtttgtgttcagaccctagagcagcaggaaaccagagacaagagtgagttaggttttgtaactctatcttcatgcttattgcagagtagctgcagaatcgcaaactacatgttatagtcagtaattttaaaatgtttcaggaagcgtggcatcaagttgtgaactttacacaggtaattttttccttctgtcaaaatatttacttatgaatgtgttatataatttactttttgctttaagtagccacaggtgcgagaatgattgtttccatcccatttgaagcttaacaaattttcacactttgaaggtgaaggccacagtgttttgtattcttatgttgacatttattatactgaaataattctctttggtggaattaataattacttggaggatgaagttacaatagaatattcaaagatattgaaatgaaaggtacatatgctgaccctttctattatcatcttttctaactgtagcttacttaccaccttcttctctttgaataggttgatatgtaacagctctgcatattagggatgttaatgcttttaataatatggaaaatgtctcagattgtcattcatatttccatctccctattatgtttcctcatgtagaagtttttgtttcaatacagtcatatttatcaatatttcttttcatgggttctggtttttacattttcttagaactcccttcccatttcaatggtgtattagtctgttctcatgctgcaaataaagacatacttgagactgggtaatttataaaggaaagaggtttaattgactcacagttccacctggttggggaggcctggcaatcatgatggaagagcacgggacatcttacatggcggcaggcaagagagagcttgtgcaaaggaactcccccttataaaaccatcagatgtcatgagacttactcagtgtcatgaaaacagcatgggaaagacccgcccccatgattcaattacctcccaccaggtccctcccacgacacatgggaattgtgggagctacaattcaagatgaggtttgggtggggacacagccaaaccatgtcaaatagccaatatctattcacttctgaatttccaatatatagtaaggtggtgaaatagtcaagtcaggggctggtgccatttgttttcctttatattttgagactgtacgtaactgaactcaaggtactttatgggcattatccactgtatttgtgtcttgatggtcatgtgggagaagagggaagtttttacaatgttttcagtttggaagaaattcaggaacaggagataatataataaggtcatatcatcaaattttattgcttttatcccctaattctcatctttttctgtattatgctatctttagaaccagtgtgctatatggtctgagtgtttgcgtccctctaaaattcatgttgaaacttaatccccattgtggtggtattaagtggtggggccttttgggaggtgattaagctgtgagggctctgctttttttttttttttttttttttttttgagaccgactcttgctctgttgcccaggctggagtgcagtggcgcgatctcggctcactgcaagctccgcctcccggttctcgccattctcctgcctcagcctccctagtagctgggactacagtcgcccgccaccacgccccgctaattgtttgtatttttggaagagacggggtttcacagtgttagctaggatggtctagatctcctggcctcgtgatccgcccgcctcggcctcccgaagtgctgggattacaggcatgagccaccgcacccagcccagggctctgcttttatgagtgcgattcatgccctaaaatgggctgaagggagctgtcttgccctttctaccttgtgaggacgcagcaacgggtgtcatctatgaagcccttaccagacatcgactctgatggttggtgccttaatcttgggcttcctagcctccagaattgtgagaaatatatttctgctgttgatagattacccagtcaaggatattattatagcagcccaggtggattaagatgcagctattacttttagaactggatagtgaatctgtcattgagttccaaattctgtcccaaatttggatgaattgttttcaactagaaaacaagggggaagaagagagaaagaaataaatagaaaaagaagaagtaaaatagagagatggaagctactgttgcttcatagcttgatagagccttagtagtgattttagggactgatgtacctgcacctggaaggtatttaaccagctgataactggaagagaatatagtcctttgtacttttataacaaaataccacagactgggccaggcacagtggctcacagctgtaatcctggcactttgggaggctgagatgggtgggtcacttgagaccaggagtttgaccagcctggccaacatgatgaaaccttatctctactaaaaatgcaaaaattagctgggcatggtggcacacacctgtaatcccagctccttgggaggctgagtcttgaacctgggaggcagaggttgcagtgagccaagatcatgccactgtactctagcctgggtgacagaacaagactctgtctccaaaaaataaaaataaaataaaacaccacagactgggtgatttatgaaaaaaaagaaatttatttcttacagttctggaggctgggagcacaaggtgaaagcatcagcagatgtggttgtctggtgagggctgctgtctgcttctgggatggcaccttgtggctgcatcctctatggagcaggaagttggtgtcctcacatggtagaaggaatggaaggggcaaaaactggggcaaactctttgccaagtccttttataagagcaatgattcctatttacgagggcagagccctgatgactcaatcacctttgaaaggccatacatcccaatactgttgcattggagattaaatttcaacctgaagggtagagggacaaaaacactcaattcatagaaagccttgtctacaaagccaattctataattctttttactttattcaagaaaaaaaaggtcactgattatacataccacttacatcttgatgagaattagtgaacataggaatacctgccaagcgtatgctttgcctcagctacaatagcaacaaggaattaaacttaaaatagatacatttgttatggtggatgaacatctgtatcctatgttttagtattccacatgtgctgtgttatagtttgaattaatagatgtattgatcaaccataattcaaatcaatatggatctttaggtaaataatacatttaatgatttttttaaattaaaaaagacttttaaaaagacccatcttttctagaggaattaatattgttctatttagagtgaccagggggaatactgactttgatgcacagccacaatttatgatcatataatgtgttttattaatcatctctggtgattattgtttttattgtcctactttatagatttaaggtgtaagtactaggttcaggtcaatatgcctcttctatggttgatagcttagatatcattttcttcactgcagtacattaagaaagaaaaagaatgagctacatgagtgatgactcagctgtggttgcaagtacatgctcaccgtcctccttctcagaaagaggactagaagtagtcggggcctttttctttctctctctctcagaaatatagaggcctggatggtcatacctaaaaacaaaaaggaatctaaggaaacatgcttcgtatacatattatgcccccttttgttttgcagtgacttcataacagtggcataatactctacgtctatgaacttaattggaataactaataatttatcttagttttataccctcttttatttgcttcatttttatttccctttaatttgttttggtggctataaaatttagggatgggtagcaaggggtaagagccaagtgcactgcacacaaatgcttaataaacctcactgccatacacagccagtacattcttggcctgtggtgccacctcacacacctgttattatcctgtctatctgaaacacagtgtttagtgaacctgtcattctgcaactctgattctcagataattttttttagattgaaatgaacatatcctagaaatgagcatttccacagctatcctgacaccatatccttgagtaaattattttaaaatttattgtaagtcctatagggagagttggaagttagccatcaagtatgattggagccattttaatgagttgcctagtatcctacaatggtaaaaagagctcttaaaatgacctacattactaaagagagtagcttaaacctttagttcttcttacttaagttgtattatcttccatgtatctttacttgagtttctcactggaaacatttagttgtttaacacacacatacaaaattaaactccctagcattgataaaattatttttttccttaacaacacaacttgtcagctattttactttagtagtgtctcataaccaaaggaaattgcagggagaaagcactgattcttaaagcctgacatactgatctatatcagcaacgcatgtgttctttagacgttcttcaccggcagaggacaggattgcctgccagcctgggacaaagcaccatatggctgggatgaggggaaggatggtgatgcacatgaagggtgggaggggagctgtcacagcctgtcagtctttattcccagaggaaactctggtgacaagggagtgattgaaatggcacgtttggggtctctgggcatggagaatggataaacaatgactgggaattcaatgacataaactcaagggaaagggtggaaacaaagcgagctgcaattgggtagaagcataactctcctgtagttggggaaagatgccaggaagagacattgatgagaaagatgattaaaggtggcctcacaaagccttggaatagtgacagatggaaagggtgcaatgattagtaagaaaatacaaagagaaaaaagagacctgaaatgaaataaagtcttataggagcagaaatatggaacaatacaattttttaaaaagaaaatgaatgatagatttttctctgcaacctgaaaagttaagtagagaaggatgtacaagtgacgacgtactttccttccacagacgaagcatgcttgtcctcaacttacttgatctaccagactcaaaactagctcagaacttcccaatgcctttttttttttttttttggacaaagtctcgctctgttgcccaggctggagtgcagtggcatgatctcggctcactgcaacctccacctcctgggttcaagcaattctctgcctcagcttcttgaatagctgggattacaggcaccccccaccacacccggctagtttttgtatttttagtagagatggggtttcaccatcttggccaggctagtcttgaactcctgacctcgtgatccacccgcctcggcctcccaaactgctgggattacaggcatgagccaccacgccccgcctcccaaagcctttctatgagagttcctacatctccagacagccattaagaaactggacgagcagaaataggctttctgctctcaagatctaaagatagacaaataacaataataacagccgtttattgaatgcaaatcatatgctaggtatggtgagcagcccttagactccacttctcattatcacttaacaactctgtacactaaatattttgtatccacttttaatgtggaaattaaggcccagagaggctaaatacctttccaaataacacagtcacagagtttggagtagggagcaaggttcataccatttaattgcagttcgctagtcaaatctatttatttacatacatgatgccctagccacctcgccaagctgcctgtggtacttgctgtatcttcataaactctttaaaaggcactttcctaaataagcaacttggaaataaagaaattattaaaagcatatgatatatgtttttacatacctacaatgtgcagatttgagcataaaacctttagttgctcacatattggttggccagtttatcagataatatttttctcctccttttttctgaaaagagctcaaactctgagagctatagttatcgttgctgagatgaaaatacttcccgaaattagtttctcagtttatctctttgtgtggccataggaaatcctttttagcatacaacttttatttggccatactctttgctgtatgattctgggataagaatcacactttctataacagacccgtaggtccccttctggatacaaggtcagcccaaaccaaattttcgagcttcctttttgcttcttaatgaaagcattatttcccttaggaagcatcgttatgtgaacacacctactttgtttggcacaatgtagaaagcttgccaccagggcttcctctagggatcaaggctgacaaactgtgacagagcaggctgtgatatatttccccttctccatttggttcaaaataaaatgttctcaccccaaacctgcatttccttagaaccttcctctgagcttggtttttcattctactttgtaatttatctgcaaattaataataatgaacataactagttggcagtaatgctcagtcttctcccagtgcatattctcaagcaaccactgtacagagttctgaaaaggagtgttccagccaaagtcttaacataatctcacaaatttgcaaagccttccgtttagctggaccctgcaataatttaatgtatacctgtgatatggctaacatacactgtgataatgatggaggattaaagtgataaacagtttagacttggttccttctttcacagagcatacaatttgtaataggatcacaacaacaataacaaaaatgaccggattgttggagtccagggaagtgccctgacaggagagtttgtcttgtccagatcctgtgaacacccaggtagaggggcctaagccaggctggagatcagtgaggtgacactctaactgaaacctgaaggaggcccccacgtcagggcagcaaagcaattggaggaaggtattccagctgagtttgcagcacacaaaagtagcagaggtgaaagcatgaggtcttcctggaattgagcaagttcagcatggagaactgagaggtagcaaggaggctgttctgaaagtaaagtctctgcacactcctgaaacctagctccgcactctcagagaccctcaactgtatctttcaggcttagatccttcaggccctgtcatgctgaagacaactgagaaagtatagctgatatggaaggagtaatgttggaggtggcagcaaatgcatcctggagggtcaagccaagctgagtagggggtatgaccaagctggttttccctctgggatttgaaaatggattgaacagcttctcacccagtgccttgcacaaagtatgtcttcaattaacattgaatggattaataattggatgcataaattcattttatcaaagagtacatacaaggtatgattcaattccatagcactattattatgatagttaatgtacaaattaaataggtatctggaaacagaatagaaatcatttagtgaggtggtgtgttctaatgtctaaataacttttctacccaaactctagaatggaactcatttgtaagcaagtgactgtctctaacttttccatagtcttacacaggtacatcttgagtcctcaaattaattgcctgttctctaaggtcaaaactcagggcttaaaaataaattattattagcttcatgcgtaacagtaggaacatgatagatattccatcaatattcattattcatttttatctaaaatgtacctatccaatacattattttatgtgtgtgagataatgcattgtcaattagattttaccatttcacaatgtatatatgcctcaaggtatcatgttatacaggataaaagcatacaatgttatctggcaattaaaaacaaataaataaatgattatttaatgagattttatggagtacattaagtttcatctcattaagattaaaaatggtttcaaataactattttataaaatctacatttcttactttttctaaagttcttaatctactaccacaaaagtcatgattctttccattttgaaaataatgtaacattttagaaaaaatattatttcattttaagttttaattatacacaaccatgcttctttttttgataattttatgaaataactttatgaactgtaaaaacttaactatcatttaggtttatccacttcttcatttagacaataaaaagctagagtttagtgtcaagggaacaacaagaaaaaaaaatcaaaaggagaaatgatagttgtttgctcttaggaaaattaagtgtttctgttatttcactgacaatatctagttacatattatttttattaaatggtgaagatgcagactaataaagcagatgcagctaataaagcagctagttgatttggtggctacatttgtaatattttagtgagcaacatggggaatgaaacaaggaaataggtctattggcttgtttgaggtttaatgtaaattaaacatttttgttgttatgagtaccccttatctttcatatacatcatagggaatgaaggtagtggactatcaataagcttagaaaaaaattcatgttcataaacactgtataataacgtgtgacagaaaaagtccttggtatctagaaaaattgaagctttatttaaaaaattaatccaatagcatcattgttaccaaggctattgcaggggacctaaacaaaatattattttttggcttcaaaactatgaatatttggcttttcgttatctataaaaattatcaccctttcctggatttggctattattaaaaaatttttaaagatgttcttaaaagaaaaaaaaagactgtcattatagtgtggcaaattcacctcctcttctccatgacaacagataaagaagctgtagctatagcaacagtaatgggccagagagattagggccagactggagattaggcctccaagagcaaagaaaagaagtcctgattggttctttattgagaccttatttgaaggcaagttactgttgagagaaagcatggaggattagtaagaacaaaattaattcccctgtataagataagaagccattcctttgttaaaactgtgttcctccgttttaatataacgcctgtttaaactgaggtaaagagtccgtgattaattctatgctgagctttgtgccatctgagtctagaccagctctgtgagaagacactccctgaagcctaaggagaaaagagggaggagcatctgcctgcttgccattgccccttgccctcctctctggcactccctgggtgggttggagatgccaattggtttgtgatgttgacatcatgtaggagtgagatgctcttggaggaaaaagattggaaaacttccctcttgttcgtataaaacttatttgtctaacttcttgaaaatttcaaaaagctttcaccaagttataattaattatatgtttaaaaatacgtttctcaaaaatctagtaatgttcccattttttaataactggtaagttatagaggtattacattttgagtaaatgtgctatctataatttcagattgatatactgatgaaggagggatttgttattttttaaataataaatttataggaatgagaatatctggcctgatgctatgaatttttttaaaaggattttgccacatttacttctgaacatgtagtgctcacacacacttcaactgagagcctgtgagagcgccacaccctggccgacatgagatattcaccttctttaaagtggtctccgatagaattttttcagactctgttttaatgtgtatttcttgcattatttgtcaagttgaaccccacttttcaataagacgatttattattttaaagatttaaaaacatgctttttaatattatgttacttggtttttatatattttctaaatactttcagtcagtctttccacgggaaacaacacctcaactaaaccaagagggaaagtaggagttatacagatgagtgagaggggcttgttaaggtttgggatctgcttctgtgaaggcctaggcaattgcagggggctcagcatgaggagaacatacttaatatagaagcatcaagaagccaaggagcttccacataagcaccatgagaacattggcttcgtctgttgttccccactctctcttctgtgcttagacaaggaggacaggcgatctgagctgttcgaatatttgctgagtgagcagagctactgaacgttgctaactgtgcacctctgcaagcctctgcccgaaggtattttctgtcttgctgtaggaacacactaggccattgtttaggaaaggcaaatcccctggaatcaccctcaacaaatgatggagaaggagtaggtagataaatacccctatccactactctgagggatgaataactctgaggcatgtcctgtactgactcccagagtccccgatgggatttgcccttccgtttcccacaggtatagccatatagataatgcactcttcagataggtccctccctgccctgtctcacttcctgattctctgcagtatttctgggatcatctcccaaatgtagtacttgaacaaaagtcctcttctgaagccttgtttacggagaaagccacccaagacccatggtcagcaggagtcaggccagcaagctaattaagaagtttgaagcttgccctgaagacgatttgtggaggaaaaataagtagtagagtgacacgaccagatttatatttttataagctcattctggatgctgcacagagaatatatttgaggaaggtgagtttaaggaaggcagaggagctgggggacacttgtggtaattccagttagagagtgcaatggtgtcaatggaagcatggcagtggagacgcaatagtgtgggtagattaatgagatgttcaggagcggggaaccctagcatgcggtgagtgaaggagagtcaggaatcaaggatgggcttcgggtttccaggctgcacagctgagaggacaacttgaatatcacccaggaggagaagcaggctgagggggagggagagaataaattcactccagtgtgttagtcttagctgcctgtgatgtgtggaagtaaaagtttttgtcaagaagcttaatatcactcatatttttgagagagatacgccatccccaggcatcaatcttttcctctccctcaccactctgctataaaagattgactaactcactgccactcttccatttatttaaaatactgtactgatccagagagcaaggcgaaattttatctacaaagaaatagtcaaagaatctatggagtcagaaataactttgaatactttttttttttttgccattctttaaaacctctatttctctgtatagctagtaagaattgtatatcgataatgtttctggaaccattagaaaatggggtatttccactacccagatgaatttttctagctagcagaagtttaactcatggcagtgataccactcagccagtcgctatacaaagtgaatgcaagaatgaagactgactttgataaagactagggaaaatggaccacaaaagccggtttgaagattttatatccgcaaatgggtacctgtgatttgtggctagagatcacctgtcgagatgaaacacgtattccctagacttgagaactttaacaaacataaagaaaacagagttatcacagcaaagctgaattatgaattcacacacacccaagcagacacacactacaaaatatacatgcacatatgtaatagaaaaccctgtcttacatattattaattcccccaatttgtgaaaagacagttttttaattgtgaataattcagagttgttcttatgaacaagtccatgaaaattgcttctactttttgttaactttcatcagcttttcatttctgctcttaattttctatggtcttaaaaaatacataaataaaccacttcaaattgtttccaaacaggctgggagaggtggctcacgccagtaatcccagtactttggaaggccaagacaggtggatcatctgaggtcaggagatcaagaccagcctggccaacatagtgaaaccctgtctctaccaaaaatacacaaattagccgggtgtggtggtgtgtgcctgtaatcccagctactcaggaggctgaggcagaaataaattgtatcagaacagtgtaaacatgtagacagatactgacaggaataaggttttgtgataactttttggttacctgaagcatttatgaatacaggtaagtctgtggctatgttatagaatattgaggtctccattggtttgacttccaaattagcgctttattaaactcggtgtcagtgtttgtacacctacttgggctgtatcttttctactatgaaacatattttaactgtgaaatgaatattttaaagaatcaccttggggccaggcatggtggctcatgcctgtatctccaggactttgagaggccaaggtgggtggatcacttgaggtcaggagttcgacacagcctggccaacatggcaaaaccccatctttactaaatatacaaaaattagccaggcgtgggggcacatgcctgtaatcccagctactcgggagcctgaggcaggagaatcacttgaacctggaggctgaggtttcagtgagccaagatcgtgccagtgcactccagcttgggttgcagagcaagaccccatctcaaccaaaaaaaaaaaaaaaagaatcaacttcgttaccattttttaatacataagaagagttttatagtatgtgatttttctttgtcagaaatcatgtggtcttactgtatgttaaaactatatgattacatttttttctacagtaataactgcccccaaccttgtaaaatcctggagattatggccctcttagctcttcttagaactgttaaaaatgccaataggttatctttgacaaatagtcactgtaaatttagatttatatttagtatatcttgagtttatcttctgaattgtaataccgtcttttacttcgaatatagatacatgtgttcattcgtttattcatttatccatatttttacttattcaacctctgcttcattccagaaacaattcagggaaatattaattacttaaaatgatttgtcttttaccaaagacattttctatcatcagttaaagtcatgagaggtgtaatccttttacaatattgaatcatattatccacagttctaaggtctttctagaactcaagtgcttgttaaaaattcacattgccaaatttctctccccttttcttccctgagcagacatttttttcccttattgtcatagatcccatgggtaatagaaattggacatttaagcagtggaattgtatacatgtcattagccacactttaaaacccaagaaatacaaatataccttttattccatttactgtgtgcattcccttggttttcttccttgctttagaatcaaggtgactatgacatggagatgcttgctaataggttggctctgccttcctacccaattcttacctatggcagcgacacctctgatagcctcctcttctttctccttagctatcccaagctccagtgtcctcccttcggctcccagagatgtggtccctgtcttggtttccagccgatttgtccgtctcagctggcgcccacctgcagaagcgaaagggaacattcaaactttcacggtctttttctccagagaaggtgacaacaggtaggtgatgctaccaataaaattcagcttaatcggtcatctctttaagtcaatacggttgggtaatggcaggaggagatcttgggcaggaactttggagaggctgtgaaatctctactatgtccttcactcattccccagtggagatgtgcacttttaaaaagcagtgttgttgacacagtctaatgaaattatctgtataaaaaatccttgaaaaaggtaagaatatattatgtcaattttttatttctttggttttcagagtcataaacagagaacagaattaggctgtatattagtagaacagtgtataaaagcactactgtggctagcttgtaatcccatttctgtcattgacatcacatgagctccaaaaaaccacatgacttctctgagcctcattttcctctttaataaggagaaattaataatacctaccttaaaatatacaataaagtgtataattggattgtttgtaatgcaaaagacaaatgcttgaggtgatggatgccccatttaccctgatgtgattatgacacattgcatgcctgtatcaaaatacatcatgtatcccataaatatgtacatctattatgtccccacgaaaattaaaagttttttaaaaacaaaaaaaaatcaaatttaaaaaaataatacttaccttgcaaggctttggctagcattaaattaagttgcatatataaatgtcatatcagtgtccagtacttggtagaagttgttattgtggatattactattgactaagcaaaagtgagctgtacatatctggtttcaagattacaatccattgcatttttttctcaacattttccccttaagatatttcaccatcttatgactttgaaatttgatgtttaagtctgaggtaaatgctggataagttccacttcaggagaagcagggattcatgtcctagggttctagtccctcaaatttgtgagtgctgtaaacatgtgatgatctttagaattcaaaaggggacatatacattggataaaccaaagtgttatttagttcaaaatgggacagtctggtgctcaggtggtgcagtacagctcctcacctgctgggtctcaaaatgctctcctttgtagttggcagcaagttcaagtttagccttttaaagtttctgttatcttttacaaattgaccttactttaaaatgaaaggaaagaggctgggcaaggtgactccacgcctgtaatcccagcactttggcaggctaagtcaggtggctcacctgaggtcaggagttcaagaccagcctgaccaacatggtgaaaccctgtctcttctaaaaatacaaaaaattagctgggcatggtggcgcgcacctgtcatcctagccactcaggaggatgaggcaggagaattgcttgatcacgggaagcggaggttgaagtgagccaagattgtgccactgcactccagcctgggcaacagagacgccatctcaaaaaaaaaaaaaaaaagaagaagatgtaggcatacccatattgccttgtgctcactaagattattcattactgtgaagaaacaggcgttcgttttagtgttatctctgtaactatttgtgatcttacgatgcctcctgagttccttggatttcagtgtgtgcagctgtgaaaactggaagcaatgattcttgcccagtcatcatgtttttacatggatttcctggaggtaccttaaattcaacctgcccaaaacatactcactttctcctccttatgtatatttttcctttcttttcttagtttatgttagtatcttccatccccgttgaccaagcaaaaaattcatgccatgttttactgactgctgcctcccaacactaccattcctcgtgaagtcttgtcaactttaccttggccatagctcagccatgcttcctttattctattattttcaacatctttacctgatctctgggaatcgctcctcacctgccaatccatcttcctcactgtttgtagttacctttttgaaatatagttttgatcactcactccactgccccaaaatgtgactggttcttaaatacaataaaactgctatacaaatatatgcacatggaacttcagacttctttcaatggaagtctagccccaatctatctgtatctatatctgtctatctgtatgcatatatgtaaaagtgtggtttctataatctataatggttaaaattttttcactcaagtcacaagagctagatttgaaaatggtcctactatttatcaaatgtgtgatgcttctgtatttaataatgtattaaatacgaataatacttttttggtaaaaggaataaaaggaagataaattctacctgttagcattgctatgaggactgagggaattcagataaagaattcagggcagtcactccacacaggaagaatggaagggctcagaatagtgtgagctcagagacaatgtggaaaagaagttgaaatttaggctcaaagtataggaagaaggaggatgaggaagagaaagggaaggagaaggggaaggagaaattgttgaaattgctatgtttgggtgaaccatttattttcataattgttcacaggcctgcttatcatacaattttgtcctttcctcttctcttgagcttgttcttacctttcaatcctaagcatcaatcctctatacccccttggctacttgctgccatggttataccatgaaccttgacaacaccaatcactgcaacctctcattatctgagtttcaaatcatattcttgcctcactctccagactcttgtcttactatcctttatttaggactctgaacacaacgaaactttgatttcatagagatctgcaatctgttgatcctatcccttatagttcctgttttccttcacttattccatagctacagttccatggccagtaaacacagcaattaaatatttgctgacttgcatcaatgttttgcctgctactctcatttcatattacttgcttagcaaaaaccaactcaagtaaatgtaactttctacctactctttacttgtgctcttgtagctgaatatagctagatggaaaggtgtaactgggctgattcgtctcactttaaattcatagctactaatctcctgttgcccattaatgctactggcaattatactacatttatcaggcagtctctctcacatacgctcctaatgatatttcatgactttttctctcttctcaaatctccaacaccttccgcctttcccccactcttagctgaccttgattttaatttcatgtaatataagaaggggaattctacatgctttcatatgtgacttttttttcacccaagtttgtcttaaagcgtataatctgtctttcctcaaatttccataaaacaactgcctgtactctttaaagcgaaactttcacttgtgcacaagatcccatcttttcttataaaagagcaaatcttcagccattctttctctcttctgtgccatcagtttctcccactaaggtgaattacacctatcagcatgtcagcatgtagtcgaatcttccattgcaacaaattttgcttcaatttcacttttctctcctctaccactccatgctctgttctctttcataggaatattccttgaattgtctaacttcactccaatgtcttacatcatattccaataattattttgttcctagaatgtaatagcaactgctcttatcaaggttcaccaataacctcctgttgctaacccagtagtcaattcctggtcttcacattacttggacaatcagcaaattttgtcacatttgatcatttctccttcggtgaaactcattcactcagtttcctattgcacatgctctcctcattctactctggctactcattttcaggctctttttactttttactcccaatttatctgatctgcacatatcaaattgcttcaggactcaagcctttcattcacttcttgactttatattctgtgaacatgctgatgtgttccaaatttgtatctctggtcctaacttttttacctgcaatccatactcatatacacgtcttcctacttgatttctcaacatcaatatcccacgagcatctaaaacttatgaataaaaccaaatacctgttatgcttcaaccccaattcctccccaccaaatacttcatcattccagagttccccccacttttgaaatcttcatatttctcattatcaggccaaaatctttgaaataattcatagctcgtagttaatttttaattcttattatgaaatccgtcatcaactcttggcagtaccatcaaaatatatcctgaatccatgaaatagtataccaggttttgttataaaataatattggaaggctggttatgattttatattctgagctgagttatggaaataaagtatttcatcatattattctgcctagttttatattgtttaaattttcataataaacaattaaaatcaaataaataaaaacaaaacatggccaggcatggtggctcacgcctgtaatcccagcactttgggaggccgaggtgagtggatcatttgaggtcaagagttcgagaccagcccggccaacataatgaaaccccgtttccactaaacatacaaaaattagctggacgtggtggcacgcacctgtaatcctggctacttagaatggtgaggcaggggaattgcgtgaacctgggaggtggagatggcagtgagccgagatcgtgctactgcaccccagcttgggtgacaaagcaagactctgcctcaaaaaaaaaaaaaaaaattaagaccagaaacaaaatatatactgagacctaccacttcttacccacttcttaagtacaaccaagtctcattggaactattgcagtaatctcctaattctagtcttaccatagcagctggagtaaaccttttaaaagataagttagggtatgtcattcctctgcttcaaaaccctgtgatgactgtttttctcattcacagaattaacagaactccttgcctttttctcatgttacttctctaacctcatcacgtagcactttccttatgtttcctaaatattcaagaatcttcctctattgagatctttgcgcttgctcttcagtctgcctaggatgttcttctcctcagagatccacatggatcattccctaatttctaccaaatctttgctgtaatgtcacgttctcatggaagcctttcttgatccctggcactcactatgtactttttatttttatttttctccatagcctttattaccttgtacttacaaattttgtttccctaatcccctttctcctcaccagaatataatattcctatgggcaaggctgtttttatcttctttatccactgagctattctcagcacctggaacagtgcttagcacattatagatactcactaaatatttttcgacttgatgccttagctgaaatgtcaactactgtgtggaactctccatagtcctccaactcagaattcatcaatttcacctttatctcaccccttcattttgattacattactgttatggccttggccaccttttatcaagtttgatgtttggctgagtacgtgtgtatttctttccctgatgattaagactagttcttattcataatttcatgctcaagtgtccagtatcatgcctcatgtaaacataaactgatcagaactgatatggtagaggtggcagagagatatgatattctcgatagatttttttcttacccagtaaaataaattgtgttactgaggaggatgaataagctgactacagttcaataaaaactttaattccaaaaaaagttgatattaaaattttattctaatatctccatttactttgatttttctggctttcaactagagccataaaatatgccactgtctcttagcagttagctgtgatgtttgtttgttcatgtaggtttatttagctgcttgacacaatacctttctaaaacgttgtgaatttaacatttatctcagattagcaataactttgtcaggaaagttattctagctcagatcatcacgaatctttctgacttgttaatggtgtagataatgcaagtgccataattcaaatctttttatccaaccccttggggtgcttttatttcataagttaaagagcagcatatattccaaaacatgaaagctagaattcacagtgaagtaattgcctcatagatatctagctatcccctcttagtacctaaaaatcattaggaatgaaaagtgatctttgagatcatagtctaacttcctgctacctaaacattcagagaccaatgatcagaggaaagtccatgcccaaggccacagttttatcatcaacagtgacagcaagcatttattgggcacttactctgccagatactaggctaagcatcttacataaagtatgtttaccaagatgagacttaaagaagaagtttatacctccattatacagctagtaagtagtagaactagaatttcgtgcagaccatagtccaaagcaggcactctcaatccctttttcatcttgcttccttagtggattaacctgcaagagaactaaatgttcttgatatttatagaattatgacatgcaattcttttatatgtttcattccaataattttttgacttaatggctaagttgatttgcattatttatttaccactaataaaacacactagtgaatttttattgttgtatttattttgagagatgaggttttgctatgttgctcaggatagagtgcagtggtgtgatcatagttgacttgcagcctcaaactcctgggctcaatggatccttccacctcagcctcctgagtagctaggactacaggtgcatgccgccatgcctggctaagtttttgtattttatatatataaaaagaacattatacctctcacttgtaactaaaatgacttatgaagtataacacagtatagccaaaagggtaaggctatgtggctgtggaattgaaccacctgggttcaaatcctggcttgttattttaccatctgtgtgactttgggccaattactagtgactttgttttctcacatggaataataatagtatctgatgtgtaaggttgtgatgagtattacatgaagttaaataaaagcacctaaaacacttgctctttggtgcacccacaacattccattcttattagctaatgccatgtgcaaatcatcatgtgggttgaaaattaaaataactgaaatacaagggtgtttcttaactcttatttagagaggactttattactttcataagcattcacacatttgatcctcagataaggtatttatgatgatctccatttcacaaatgagtatgcctttctctgttcagaaagactgaaaaatattgctaagaaaccacactaatagtaaatattagaactgggatttcaatgcaaggtttctagtccagtgatctcttcactgtgccatacaaagtgaaatacattttctgaaaaagctccatataaaatacagtgggagtgcagatgagagaattaaaacaattttatgagcatcattcaatttaatcctcacaataatactgtgaggtaggcagataagggactggtatcttcattttgcaaatgaagcagagaaggctccaagatagcccctgacttgctcaaggtcacacactgttttgtggcagaacaaaggctgaactaggtgttccaacttgcagcaatatatgcttcacattgctttatgctgcctcagaaaacctctgctcactgttcaggattagaaaccagctttttctgactgacatggaggattccttttagaattcatggtatattacatttttgatgtggtgtttacatattctttccccgctcttcagagttgaggactctgcagctgatggagcttgttatccatgagggaacatattgtgatggaaaaagaacaagactcagaatcctaagcatgacattctggccctggcttaaagcttggcaaagttagccttcttcttagagccccactctgcttctctgtaaaatataaaatcatggccctgtacctcaaagtgtttttaattcattgaatgagagaataatgattttatttctccagtggacttaatgcatattgaaaaatgaaacatgccatccacaaatgtcatatataaatgagcaaatattgaatgtgagttgactatatgtccatgtccagcagtgtattgaaaatagaagagaacccagcagattctctggaaggagttaatcttgaaaggttcgtcttactgatgaatgtataaccacacacttagttaagagctttagtggaaaggaacatgcttctgtgagagcatttatgaaatgtgtgcatgatgtctatgtcataatcagacttgcagtttcaaaagatgactatgactagaaagtggaaactagagcagaggtcagccaggtgggtgccagagtcattcagcaggctattgcagaagtccaaacaaaagatggtagcttggtctaagggtatgtcagtggagatggagcagcagagagaactttgtagatatttagggggcaaaactgacaggactgaataatgcattgcacatgaatggtgagggagtaggggttgtcaaggacagtcacttggtttctggtatattccagtgtagagatcattgtgcaatttgctgagattaggatgctggaaaggtccatatttgaaatgaagatcataaattcagtttcagacaagttgtgcttgacatacctttacgaccttcaaatgggaatgtccccaagggccgtggaaataggaatctggagctcaaaggagaggattgggacagagatatgtatcaggaatgtgtcagcatgtggatgctcgctacagctagagaaggttaagatggcccatcccaagaaaacagaatgataaaagaatccagaactcagtcacatttatcatgtggatagacgctgaaactaaacaaaataagaatttgaaatcaaaatctgtttcaccccaactcccaagatatagctcattatttgcagttacagtagccatttgttacgtaactagtctcaagtgtgtattagatgttgaagcagagattacaggaaagcacatttttaaaaagctcattcctagatttatcctttttaacaattcaataaaaaacaatttttaaccaaaacttagtggaaatacctctaaccaagagaggtaaacaaaaaagagacatttccagtcttcattatgcttttatctggcagtgaaacatcttgaaacctttctctctaagatagcattgatttccaaacctatggttttagggtaataaggaatgtgacatttgggtggttatcactctgctatcactttgagtcctatttcattaaacaccatgtttcagttttgaaatcttttaattgttataacattctggcattcactaaagaaataatgaatgaaagtagaagagataaaaaggagatgctaaaaatctttccactaagaataacgtaactccttctctacaaaggaaggttaatgtaactcttcctccctgaagcaactaattaggtgtttgacccctcaaggcagcatttgttgctcaactcacaagttgtaactaaatgttaacactctgaggcacttaggcaagatgatatgtatttactaaaaatgcatgttagagacttgctacaaataatccactaagaagcagaatcatgtttaatctctaaactctacttctgaaatgtaaaaatagaagtgctgaattcagctaacacaaacacttgtagatacaggagattttctattttttattcctaatgaagagtattagagtagtgaggtttctttaagtagatcccactctccattacggataatgaaatcaagacccaggaaggtgaagtgacatgccaaagatgaccgaaataaatggggatggaacaaggaatagaatccaattttctaggcatttctaaggtcacattatgtggagattttatgtaattattctcttttaatttcacatttatttatgcatttatttaaaaaattatgagccccagcaatgtagccatttttttatgctcagtgaatctatatgctaagtgtgaataaaatataaatggaatatggcttctctttttaaataatttacagtgaagtcaaagaaacatgcatgtccattaatacaaagtgatacataatacactagatgtataaacagaaagcaatgaaaacacaaaagagagcatttaatggtactgggtttgaagacatgagggtacgaagtttcagctaaacatttcctttgaattggattccaattgggtttcatttgaaacaagcttttgccaaacagagtcagaagtgtgagtcaggagaaggtaactccaggctcatcatcactggtcattgagaaatgcaaatcaaatcaaaaccaaaataagataccatctcatgccagttagaatggcgattattaaaaagtcaggaaacaacagatattggagaggatatggagaaataagaatacttttacactgttggtgggagtgtaaattagttcagccattgtggaagacggtgtagcgattcctcaaggatctacaaccagaaataccatttgacccagcaatcccattactgggtatatacccaaaggattataaatcattctactataaagacacatgcacacgtgtgtttattgcggcactgttcacaatagcaaagacttggaaccaacccaaatgcccatcagtgatagactggaaaaagaaaatgtggcacatatacaccatggaaaaccatgcagccataaaaaagggatgagttcatgtcctttgcagggacatggatgaagctggaaaccatcattctcagcaaactaatacaagaacagaagaccaaacaccacatgttcttacttacaactgggagttgaacaatgagagcacatggacacagggaggggaacatcacacactggggtctgtctgggggcgggcgggggggctaggggagggatagtattaggagaaatacctaatgtagatgacaggttgatgggtgcagcaaaccaccatggcacatgtatacctatgtaacaaacctacacgttctgcacatgtatcccagaacttaaagtgtaataaaaagaaatgaaaggaaaaggaaaagcaaaataagaaaagacagagaagctgacatgaacataggggtcctggggcaggacggctcattgcagatgactgtgcaaagctttgggccacatcgtgaaggtctttgaaccttgttccatggaggtgagatctcattaatctagaatggcagctagcacaaggttgtgggcatggagttgacaggttatgtgtgttaaaagggtatctttgtcaatagatgatagcaaaaattgagaagactaatggcaaaatgctagaaaaagctattattataatgcaatacatttaagtaccaactaaatcagggaccagttctaggcacaggagaatatactctaccagaattagatctcaatgtaaattgcacaatggtgcatcgcatgttgccatgcttgacttcatgcttcaaaagatgtcagtgcttaagagttacagggactgatctcagtaaagcaggaacattatggttagtgggtcaaactgcatgcttttagagtagaaacatttattttccaagacactttaatcaagtaactcaaagttcttaaaactagcattcacaaaaaattaacgcttcttattaactaactcttcttatagcctccttgtaaaagtccaagtggacaagttgtctacagactttttagcatgaggaatcagacttcgtatatttgatgctctatgtgaattttcattgagtaaatttgctgtgaatggattcaggcaggcacaagtggcttgattcctttacttcaatcgacttatcctgaatttggcttaactccaccacactgccaacttagagttagggggaaaggaatgaagtggagaagatttgtctgacaatccatctggtgttacagatcatgactctgagttctgcatatttgaagggtaattatgtcttcagattcacaggagagaacatcactgagagggaggaggcttggggtccctgccgcttccacaggagttgttaacgcagtgagaggccgaacaatacaagtttacccaaaaattgggtaaacttctcattattcactgttctcttttcttcagaacccagtgtgcttatctgcccatttacagaggggtatggactacagtgagcagagaggaaatccttaattactgcttcatggaaaatttactttaggtggctagtgttggcctatagtggaaccagagaaatcccacataataaactgcccttccaaactcagatgttacttagttgttgggaaatggtttgctatattttgtttacagctattaaagcctggaaagggtgattaaaaactcgtgggaatccttggggctagaactgaacaaatctgtgaaggataacatggcaggaaataccattttctcaatatgcttttgtataatgttagcaattagatgtcaccccattaaaacacagggaagccacgcagcagtttggcagcagacactcatccaccagtggggacatcagataccataagactatcaagctgtactgtggaactcagggaactcctatttcttctcagtgtccctcagagagcagtttccagccctttaaaaatgaatattttcattattggaacttgttcaatgtgtgtagttatgctcactctttttgttttgatttatctttgcaaagaaaattaatatgatagaaaatatcaataaagattttttttggagtgggggcaagccccaatgtcagggaaacctatctatgtagcttttttctatgtgattatatctctcattaagttatgtcctcagattcctggttttaaatactttgtggaaaagtccccttcttggacgcaatagatttatttcttatgaagttgtggtggtattttgttattataaaataatagcagtgactgccattatggcagaatccatattaagtatcaggtgccatgtatttttctttagatattttacctacagcatttcatttaattctttcagacattgtgatacaaaatttttatagcacatatgttgtacttgagaaatctggggctcagaaagtttaatgtgaaggccagaaacagcccccctgacttacctcagtcctgaactacttactccacagtctacataggcttttgaggtttgttttttgttgttgttgtttgtttgtttatttaaaacaaggtcttactctgtcacccaagctggagtgtaatggcatgatctcagctcatggcaacttctgcctccaggctcaagtgattctcgtgcctcagccactagagtagctagaattacaggctcatgccaccatgcccggctaatttttgtatttttactagagagagggtttcaccagattggccaggctggtctcgaactcctgacctcaagtgatctgcctgcctcggcctcccaaagtgctgggattacaggtgtgagccactgtgcctggcctacatagtgtttagatgcaaactccctttgatatgataagcagatttctggaaagtggcacataaaattgaaatggttagattaaaccatggtttaaaaccactacgagcccacattgtggaaaccagtgatcaacccagggcagaaccagcaggtgatcagaggttgaaccatagagttgtcttggaggtgtatttacatagcaagcacaatgcatttgcctgggttctattttacagatcaaaatcatggaaacattttcaaaagatgctttatttatactttatgtaagactgagaaagtatgaattgtccatatcaatgaatatgtttatacataaattttttatgaattattaattttggataatttttggaggctaatgaagattattaaatcttccccattatgaaatccaacatcctcttgtatatgtaagtgatattttcatttcatgatcttggacatttttacctggacatgtccagattttcttgcgtccctttcctttaaagtatacctgttcagcaaaagacataaacagatacttctcaaaagaacacatacaaacagcaaacatatgaaaaaactgctcaacatcactaatcgtcagaaatgcaaatcaaaaccaaaatgaaataccattccacatcagtcagaatggctattactaaaaaaaaaaaaataataaacaatagatgctggtgaggctgcagagaaaagggaatgcttatacattgttggcagaaatgtaaatttattattttaggcactatggaaagcaattaggagattcctgaaagaacttaaaacagatccacaatttagcccagcaatcctattaactggtatatatccaaaataaattaaataattctaacaaaaacatccatgcactcatatattctggataaagaaaatatggtgcatatacaccatggaatactatgcagccttaacaaggaatgaaatcactccctttgcagcaacacggatgtagttggaggccataatcctaaataaattaatgcaggaacagaaaaccaaatactacatgttctcacttataagtaagagcttaacactgagtactcagggacatatagatggcaacagtagacatgggactgtcacataggaggaaggcaggagggcaagggttgaaaaactgttgcgtactatacttactacctggtcatgacaagatcaatcatacctcaaaccacagcatcacacaatatacccgtgtaacacattttcacatgtaccccagaatctaaaataatgaaattatttaaaaaataaaatacagaataatacctgttcaaagggttatggccagcgtgacttggaacacagttatttcatccagtttatttagtatttgtaagaataaagtcaattatgaaagctgtccttccttatacatacccaaggtgtttgataggcaaatatggcctttgataacaatgttgcttgaaggtctagaaaagatgctttgaaatgattcacagcagatgatagacaaattgatcctctcagcagtctctgagtgctcattgtcccctttttccctataggacctcatgtcttttacccaaagttcccatgatccaaagaagttccttatttttccactattgttgaatgatatcaatactagatttagaggaggaagttccagatttcattcttaagtgtgatacccactaactgtgaagcctttgaataaatcatgttgcttttctaaatctcactttctatatgtaaaataatgataacaaaaccaccctatctatatcagtaaggtacctgaggcactgggtataaaaattcttctgctaaaacaaaaataagcaaaaatccccatctccatgtgctcaatctctttgagctatatacaacaaggcatacaattctattatgagggtttgcttttaaaaagcaatttgctgacctaaatgatcttagtttggtagaatatagcagtgtggtatgtggcaaatgggagcattgttccatatttcttagccttacctactttagattactattgaatctcatccagacccctactctcctagaagtcggaattcagccttccagaaacttcatactgcacttctaaaagaatgcctaaacctcaggctatatccagattcatacagggtgctttttctctattgtggtaaaacatatctttcattttacaattttaactatttttgagtgtacagttctatggtattagcacatgtaccttgttgtgctaccatcaccaccatctgtccacagaatttttcattgtctccagttaaaattaaaaaaggcaggggttgcaatcctactctctgataaaacagactttaaaccaacaaagatcaaaagagacaaagaaggtcattacataatggtaaaggcatcaattcaacaagaagagctaactatcctaaatatatatgcacccaatacaggagcaccaagattcataaagcaagtcctgagtgacctacaaacagacttagactcccacacattaataatgggagactttaacaccccactgtcaacattagacagatcaacgagacagaaagtcaacaaggatacccaggaattgaactcagctctgcaccaagcagacctaatagacatctacagaactctccaccccaaatcaacagaatatacatttttttcagcaccacaccacacctattccaaaattgaccacatacttggaagtaaagctctcctcagcaaatgtaaaagaacagaaattataacaaactatctctcagaccacagtgcaatcaaactagaactcaggattaagaatctcactcaaaaccgctcaactacatggaaactgaacaacctgctcctgaatgactactgggtacataacgaaatgaaggcagaaataaagatgttctttgaaaccaacgagaacaaggacacaacataccagaatctctgggacgcattcaaagcagtgtgtagagggaaatttacagcactaaatgcccacaagagaaagcaggaaagatccaaaattgacaccctaacatcacaattaaaagaactagaaaagcaagagcaaacacattcaaaagctagcagaaggcaagaaataactaaaatcagagcagaattgaaggaaatagagacacaaaaaacccttcaaaaaattaatccaggagctggttttttgaaaggatcaaccaaactgatagaccgctagcaagactaataaagaaaaaaagagagaagaatcaaatagacacaataaaaaatgataaaggggatatcaccaccgatcccacagaaatacaaactaccatcagagaatactacaaacacctctacacaaataaactagaaaatctagaagaaatggataaattccttgacacatacactctcccaagactaaaccaggaagaagttgaatctctgaatagaccaataacaggatctgaaattgtggcaataatcaatagcttaccaaccaaaaagagtccaggaccagatggattcacagccgaattctaccagaggtacaaggaggaactagtaccattccttctgaaactattccaatcaatagaaaaagagggaatcctccctaactctttttacgaggccagcatcattctgataccaaagccaggcagagacacaacaaaaaaagagaattttagaccaatatccttgatgaacattgatgcaaaaatcctcagtaaaatactggcaaaacgaatccatcagcacatcaaaaagcttattcaccatgatcaagtgggcttcatccctgggatgcaaggctggttcaatatacgcaaatcaataaatgtaatccagcatataaacagagccaaagacaaaaaccacatgattatctcaatagatgcagaaaaagcctttgacaaaattcaagaacccttcatgctaaaaactctcaataaattaggtattgatgggacatatttccaaataataagagctatctatgacaaacccacagccaatatcatactgaatgggcaaaaactggaaacattccctttgaaaactggcacaagacagggatgccctctctcaccactcctattcaacatagtgttggaagttctggccagggcaattaggcaggagaaggaaataaaaggtattcagttaggaaaagaggaagtcaaattgtccctgtttgcagacgacatgattgtatatctagaaaaccccatcgtctcaacccaaaatctccttaagctgataagcaacttcagcaaagtctcagcatacaaaatcaatgtacaaaaatcacaagcattcttatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaatgaaatcaaagaggatacaaacaaatggaagaacattccatgctcatgggtaggaggaatcaatatcgtgaaaatggccatactgcccaaggtaatttacagattcaatgccatccccatcaagctaccaatgcctttcttcacagaattggaaaaaactactttaaagttcatatggaaccaaaaaagagcctgcattgccaagtgaatcctaagccaaaagaacaaagctggaggtatcacactacctgacttcaaactataccacaaggctacagtaaccaaaacagcatggtactggtaccaaaacagagatatagatcaatggaacagaacagagccctcagaaataacgtcgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagacttaaatgttagacctaaaaccataaaaaccctagaagaaaacctaggcattaccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacaaaatgggagaaaattttcacaacctactcatctgacaaagggctaatatccagtatctacaatgaactcaaacaaatttacaagaaaaaaacaaacaaccccatcaaaaagtgggcaaaggacatgaacagacacttctcaaaagaagacatttatgcagccaaaaaacacatgaaaaaatgctcatcatcactggtcatcagggaaatgcaaatcaaaaccacaatgagataccatctcacaccagttagaatggcaatcactaaaaagtcaggaaacaacaggtgctggagaggatgtggagaaataggaacacttttacactgttgctgggactgtaaactagttcaaccattgtggaagtcagtgtggcgattcctcagggatctagaactggaaataccatttgacccagccatcccattactgggtatatacccaaaggactataaatcattctgctataaagacacatgcacacgtatgtttattgcggcattattcacaatagcaaagacttggaaccaacccaaatgtccaacaatgatagactggattaagaaaatgtggcacatatacaccatggaatactatgcggccataaaaaatgatgagttcatgtcctttgtagggacatggatgaaattggcaatcatcattctcagtaaactatcgcaagaacaaaaaaccaaacaccgcatattctcactcataggtgggaattgaacaatgagatcacatggacacaggaaggggaatatcacactctggggactgttgtggggtggggggagcgggggagggatagcactgggagatatacctaatgctagatgacgagttagtgggtgcagtgcaccagcatggcacatgtatacatatgtaactaacctgcacaatgtgcacatgtaccctaaaacttaaagtataataaaaaaaaagaaaaaaattatttacttattaaacactaacgtcccattctcccatcacttagctcctggcagccactcagggtgcatattttaaatactagcagtgctagttaaaatgatggtaacccgtataacaaataagccctaaaatatataatggctcagaactatttctgactctataaggtatggaagggatgttactgattgtcagttcttttcccagctcttctctagaattattacaaatgttgattgttccatcatcacccatatggcttctaaggtcatcatgcttccctacctcaagacaacaggtggaagaagagaacatggtgaattacccatgtgcagtttattttaggccaggcctggaatcagcacacatcacatcacatacactcaacctcttgatgagactcagtcacaaggcctcaactagacttcagggaagccggaaaatacggtctagtacatgaagcagaaatttcgggtttgaggataagcgagccagtctctgccatcagtcatattaagagtgtagatatgcccaggaatcatcatcattcatgcacttagaacttttactttttgaaaatctaattttccctggcagaaaaagatattttattttaaatatgtccaaaaccaaaacatatctgaatggcaaaattaaagtgtacgtataattccactgagaagcaagagatattatctagatatagaaaccttgagaaacaattgagaatcttagaggaagtgccttcttcactcagttcaatcagctatatgttaagttccaatgaggatatctagaatgttcagaaggtgtagaattatgtgtgtccttaaagaatatttcaatagttaccatttctaaaatgtcagcatccatatccaaacggtttgtcatctcttaatacgcactataaatgcaaccatgatcagtagattaattcattagtttgcaacactgaggaagtttttagtttataaatgtattgatattgaacacatagagatgtggcttgaagagcaagacaaacaggcatatgttacagtttctcttcacgcaggaaggaatctacttcctttcactaattgcacttaaagtaaccacagggactcaggctccatacatagaacactaagcatctgcgttttcctttcatacaatgagagaaaatgcataaatgcatttgttggcaatactgacaaagaccgatttgtggaataattgaaaccttgatttctgtcattagccggatgtttacaaaactcgtcttcctgtctacattccagatgtttctccttattttaatagctccttgtttttcatgggttttgaattccaaattgtaaagtgtcgaggaaaaagactttcgtttgcaagtttcatggaaaatgacataatcttaaactccccagaatccttgcaacatttatttgtaggtccttccaattagtttattttctatagaaagtctgaggtcttgaattatgtcccagagtcaacattagatgagtgagcaaccttttggttcacctcactactcttgcacatcaaatacagattttggctgaaggtattctttttggaataatctttctctgcaactttgatttctcagggaacgagcattgaatacaacacagcctgggtcccttcagctcactgtgggaaacctgaagccagaagccatgtacacctttcgagttgtggcttacaatgaatggggaccgggagagagttctcaacccatcaaggtggccacacagcctgagtgtgagtatgaaaaggaacgggccacatttaaaaagtatttattttcctctgcaatatccttgaattctttcacagaacctttgcgaagtgacaaaagcgaagaagagttttttttcttctaagtaaacttatataactcgaggacttttaaaagataacttgtaaatagaatggcctcttcacttaggccacataccgtaatggcaaattaacctctataaaggcctaatctatctatgcagtctacttattcatttcctaagaaagtgatttactcttcctgacagtattttatcctcatcattgagtttcagcctcctctgttgaattttcagattttttgagtttgtaaagagtgtaacatcaaaggtaaaagaacaataacatacaatttctaaatccagggactaatttaaaagcttgaacacgcaccgcatgcactgaaaaacctactaaaagcaaattgagatttgaggaatatgagagataacctctattggataatctcactccctctaccttgaatcactagattcagctatgtttttttttcacaaagtagagcagctgaatgttctttgaccaatgtataattcaatgatttcaactttgataaaggaagagctccagaattacatatcgaaaactatttctgtacttgacaaaattttgttttttcttgtgcatttctaatgttttttgaaaagattagttgctgatgagtcattcgccaaatttgttttgtttcgcattaaaaaacgattggaatttaaaatcaaaatgaaatgcatggctacttgttaacaagctgccttatgttaaacacctaactgtacctgtttcctttttatataacaaaatttgtaatgatattttgatttcctgttcattttacgtgaaactgtaaagaggtatatcaaaatcacctcttgtattttgggaataaggtgaagtagagattggaaatattttaactggtaattgtgagagagtaacctttgtattctatcacttcttgggtggtttaaatcagcaagtcgaagaagagagagcaggagatacagtctgagtgcactttccacagaatctccatcctttctttcatttggccagggctacagagacaagatgataacaaattggaataaagtattaattgaagggacggaagagggctaagttgtgcaagtactacaaatatttgcctcacagaaataaaaacctcaacaacttcaaaagcatagtcatgttgaggttccagacaattatttggaaatgcaggcccccaggcataataataatttgtaggacccaaataatttctgtttgcaaaataaaaacacaggggcacattgttaaaaattattaagattatgggatggctacagcagaacgtgagtccttgcacaacttcaccctttgctgcctatgagctggtcctgctcccaggtttctgttctgggcaatgttttgttgctgtactgatttaaatcactaaacaatgccaatttcctcttcataatgtctatattaacataacatttcaatcttctttttttatttttgggacggagtctcactctcttgcccagactggagtgcagtggcacaatcgcggctcattgcaacctccgcctccaaggttcaagcgattcccagctaatttttgtatttttagtagagacgagctttcaccattttggccaggctggtctcgaactcctgacctcaagtgatccccctgcctcggcctcccaatgtgctaggattacaggcaggagccatcgcgcccagcccaacatttgagtctcaattgctttattgactttctcttcatagatcatctatgtaaaatcaataacttttatgactattttatatttttgattaaaagcaaattaggttttacatatatataatacacacacactatatatggtatatctcatgtgatagataggtcaacaatttaaaaactcttgaaaaattccttaaagaaatccttgataaattttccagtattggaactagctttaaaagcatgctcattttcaaaagatcaaatctccatggattatctgaatttttcatctcctagttctaaaattatcgtaaaattgttatactgtacttttcagagctgactagtcatgattacattgcatttctgataaaaatcctggttggttagccttgctttgtaagaatgagcattttttttccccttgatcaatactattgtttctaagcattcaacttaagaaagcaattttcagtgttttaaaattttacttcttttttttttttttttaacaccaacgttcccaagccaagggacagtaaagtattttcgtttttgacactggctaagaacactcattccataaaaattaaaaaaaataaaaactatgataaaatgatacaatatattctgctattttaatataattaagttaaaaagaataatgatttttttgtatcacacatatggccttaactttgtaaaacacaaacaatgacataattcataagtatgtttaataaacatttattatgttcctaacactgttccaggctgcatgaggcatgttagaaaagcatatgtgagtaataaagcagcagtatttatggatctcagcagatttggggggaagcaggtattttaaatatgtaacaataacaaaacaactcgagtaggggaacttataagaagttggtaaatggaatacaaacaatctgagtcacagatttgctcgtgggcccatgacctgtgatggctgcagcatattacctagttaatttcttatgcccagatcatactgcatccacctcctcaaatcagtcttgtaatccagttacaatgacagccatgtctatgctttatatatcacacattccttcccattcagaaagcagtgtgaaaaatttgtgcagagcacctcactggacccaagtctctataagcatttactttgcttaacaattagcgtaaatgataaggcataaaataacaaaagcctaactgaataaaacatgctgattgttggtattgttgtcacatataaattctattctctaagaaatgaaaatgaagaatctctctgctttagaaacatgatgcagccatgaatctttttcattaatggcagcaataacagccttagaatgctaaccatattttggcctttagtaacagcattgttctattaaattacccattttcttaccagtatatggaataaggatacctttgcagatcattgtttatttgcactatgatttgattctgtttcactgaacattgccactggataattcctcccttactgagtagataagtagttaggaataaagtagcctgcataaacaagacattcagaatatcctttacatgtgcaagagagttagccaattgcttcaattcatgtatattgagtactactaaactcacttgccgtctttcttacggacattagaataaataaattatattatcatgagtgataggcattgcatgtgtattttatcttctgttggtaacataaaatgccattttggcaatttgaaagtatttctaggataaggagcacttacttcatcttctccaagcctgctcaataagacacccaattactgaagaagatggaatataccagagatcctatggttcctttcctttcctttcccattccttcctcccttcctccttcccgccatccttccctctttgttataagcccatctttctgtccttaagagaaaatgcgagggctggttttatgacttcgctagactatcagaatttagtggcaagatcaggttaaagaaaacgttttcatcaatatttcttttctgacaaaatgatcttatcttttgaaaatgggtctcagctgagtatgcatttggttgctgcttttatcaatgttttccaaatgtgatgtagtaattgtacactaaaattacatagcttgtatacaaattgaatttcaagtttttcatattatttgaaaatatcaactctattatacaaaccatatttgcaaagaataaaactgatggaaaatatgtctgaaatataaatcagccagcaactgtttctaaaagtgcatacattttgtagtaatcatttaaagagatcgacagcccaagatccagtttatgaaataattgctcgaaatagaaaggcttgatttatatgaaggtttgtgtcctctgatggtatcttcctttgctaaacccttgcccattctcccctgcctttatggtatgtaatttctctaccatattatcagccaggatttaagtccctgtctgcttaagacttgtctaatcttttcataccacatgtggagattttttgaattattatttgcagtcctttaagatcctgttaaggcggtttaatcataaaggatgttaaaatggaccacatactggcttgagggcttgagttagaatgggaagcctatttgcaagaccacaactcaattacctacaaaactcttttagatttaagagttgtaagtaatattcttagtctattatattctttacactaaaaagatgagtgaaagcaacccaccaatttgagtgactttagaatatattatctagaggaatagccatatttgcttctttcctccttcatgagattttaaaaattctaatatggctctacttgtatggttgttaggaaaagaacagagaagttcaaataatgtctctgaacattactacctgtatcctagagcaagtttgtcaatcatcgagacctcagtttcctgaactataaacgggagtatcatttattcctcttcttcctaagttgcaaaaatgaaatatgataacacgtgggcagccactgggtcttgcctggcatctcatttaaaaaaaaaaaaaaaaaaaactccctgatccaacgggatcaaataagaacataatttcaactgctctacatttacaaacaaagtgggatactcatcagggtaatcacttgggtaaataaggctaatataatacctcatttatagtttagaactagcttgatcactatacagtcagcacatttacatactctgctactttctccctaattaacctctccttagcatttggcaggctgttatagattgccttgtctaaattttgaagtcttatgaacagaaagtgctacattatcccgtaagatgtatcacagcattgccattttataaataaagccatgtgtcacttaaggaaggaaatacattccaagaaatgcatcattaattgtttcatttttctgagaacataatagtgtcttacacacctagaaggtagagcctactacacacctaggctctatggtatagtctactacacacctaggctatatggtatagtctactatacacctaggctatatggtatagcctattgctcctaggctgcaaacctgtatagcatgtgacggtactgaatactgcaggcaattataacacagtggtatatgtttgtacatctgagcatgtctaaacatagaaaaggtaatgcattgcattagaatgatatgatagcaagatgtcactaggcgatagaaatttttcaacttcattatattcttatgggaccaccttggtatatctgggctgttgctgatcaaaacattgttatgtgacacttggctgtcattggttggttgatgctggtagaatatggtttgggaaagatacaaaatatcagttatatttattaaagtatggttacataaattaagcaaactaagttgatcacagctctgtctagctcattacttttgtcacttgatttacaatgattaactgcactgcactgagatttgaataaatatttggggtgaccactatggcaaacctgtccactcgacaacaattcagttgtctgatcccgtacatggccagacataaataatggaaagaagtaaagataagcactggcattacatcttttttggtagcatacaaatacattattttaaaagtctctggatgtaaaaaaatgttttcaggtgttataaataagagatggggaacgttaaaaatttatggtttagtatcctctgtgaccaaaggcttaaggaattcatttagatttaatggtcaattaggctaggtatgatgtctttgataatgacatatattagtggaaggattacaggtgggcttgagatgatgggttgtttaatcacctctagaagacttcaaagcaaatgtgagtcactgtgttctttcttcattcatttaaaaatatttattttgtgctaagttctagaactacagtttccagtacagtaaccacaagccacattggtctatttaaatttaaaagtattgaaataaaataaaatttaaaattcagtttgtcagtcacaatagccctattccaacttcttagtagcacttaaaatttaaataaaattaaaaaccaaaaattcaacttatctctcttgtgagccacatctcacgaattcatatatgattactggctactgtattggagatcacagagaacatttccattatttcagaaagttctctcagacagtggcagtctaggcactatgctggtaaacgaggatacaaatgcaagtcagaaatggtcctaactttcaaggaactggtagtctagtggaaacaactttaaatagaattcactaaaaacagctttcacagatttcatctccctgaacaaaattgttcagttttgttcaaaacaaaaaagttaattatgtgctaaaataatagacatgattttttaaaggccacagaatctagacctgaagatatgctgtttatttacttaagttagttaatcacattaaaaatccattacctggaaaaatacataagcatcttccgaagttcaactgaaagtgaaggacatagcttactagttgcttgggttgaacagtggtatatcgtaagtgtaatttccctaagaagcttctgctggctctcttattttctcttttcttttgagcacacagtacgattcaggcttcttcagttggtataaccaaacatctagaaaatttatctgcttcatgagaaattgcatagaaagaaagctaacttctcatagatagacataagggagtgtaggaaaggggataagaaagtgtcataataattattggttttcaggcagcacggtcaactagtctaggagaaagaggttccctaagtagatctgatttgggtttaatcgcctagtttggttatatgccctactaaacgtgaaagcggttggtttgctaagctgaattagagcaaaagccagcatgaacatcttcggggatattgtcgtcatgctggtgcagctgaatgaaactctactccaaggacatgagctgagctgctttaggcaaccgctttgatggagagctgatgaacaccactgagaaagggtaaagatagaaaggaataaggcattttaatcacatgtgtattgaagcactccctcatctttagagcatatttttctatgcagttcataagtatttactgagcaccaactatgtatccagccttttataacatgcttgggatagaaaataaaataagggcagaagtttctttctttgtctgtttctgctgttataacaaaacacctgacactgtaatttataaaggatagaaatgtattgctcatggttctggagactgagaagtctgagattaagcaggtgtggtgtctagtgagggctggtctctgcttccaagatgaggctttgttgctgcatcttccagagggtatgaacggtgtgtcctcacatggtggaagaagtggtaggacaaaaaagaggagctagctgttccctctagccctcttataaggactaatctcttcatgagggtagagccctcatggcctaatcatcttttaaaagattattataatatttgcattggggtttaaatttcaacatgaaattttggaggggacacaaacattcaaagaagtggaatcaaatttactttctctcttttttttttctttttttttttgagatggaatcttgcactcttgcccaggttggagtgcagtggtgtgatctcagctcactgcaacctccacgtcctgagttcgtgtgattctcctgcctcaacgtcccaagtggctgggattacaggctcacaccaccacacctggcaaagtttttgtatttttagtagagacggggtttcactatgttggccagactggtcttgaactcctgacctcattatctgtctgcctcggccccccaaagtgctgggattacaggagtgaaccaccgtgcctggctctatttcctttttttaacctaaagttagtgttacaaagtttcattgtgtaattaatgcataatctaacgcagatataatttgatgcacaaaccatattgccttttagtataaaatattttagtatattttagaaattatctgatctaacactccaccaaaattaagtaaaactcccttttaaattactgtactattttatggattcttttaactgcaggttatattctgcctgctgtaatatatggtgaattttacatgttacataaaaagtcaataatatgactttagctatttttctttaactccaatgttcttacattatgttactttaattgcccaatctttcctccttggggaacccaagatcccatgcaatgaggagttgagttgggacagaatttctgattacaggctattctgcagggagcggagattaccatgagttaaaatagaaagattttaagcctatgacaagcaattactgcttctaattgtagctgttaaagtcaaagctgagatggtgtcactcatttctggaaggaaatgaccacagatttgtatcaattgaaagtcaagcaatggaactctaagcccatggtcagtgctagtaacttgtacattgtcctcttatttaaacctataattggtgttataaattataactctgggtacccagagtctgacacatttcccggtgccctgaaacataattttaaatccatcaacactttaagatagtagattccaaccattgaaatgtgcaaccaataaacctggggaccagagcttttaaggctagccatagaatacgtcagtgcattagtgagagcccaaggcctatgtctagattcctaagtacaggcatgcttatcctaaacaatgggcttacaataatggcagtttctcttcctgaaatggaaatatcactttaaaaaataagcaaaagatctgtgttctagactgagatttatctgtattctgctgtttgtttttggggaagtcagttacctggtctgattctcaaatttttataaaataaggatcatactgcttgttttgggataatatgaaggggcactagaaaagcctcattaaggaacactgctaactgatcttacacaatttacctcaatttcattgatttttcaaatgtctcccttagaaataagtaagtgaacttgttaacccatttgggtgttgcattatttatctagggctaccttaacaaagtgccacaaacttggtgtctccaaacaacaaaatgtattttctgacctttctggagcctagaagtccgaaatcgaggtgtcagtagggctatatttcctctgaaaatgcttcagaaaaatccttccttgcctcttcctagcttctggtggcttctggcaatccttggcattccttggctggtagctgcataatttcagtctctgcctgcatctccacatggccttctcctctctgtgtctctgtgagtcctcttctcttcttataatatacttggaatgcaccaaaatccagtataaccttgtcttaactaattatatctgcaaagatatgtcatcaaataaggtcacattctgaggttctgggtgtacatgaatttttggagtactattcaacccgatatactgccctgtgaatcttagtaagaattcttacagattcttagtacgattcaatgtcatctgttggaggactgagcaaactatgaagtatatattatgtttgtatgtatttatgtgcatgtatatatatgtgtgtgtgtatatatgtgtatatgtgtagatatgtgtatatgtatatatgtgtgtgtatatatattcaggtcatagctgttaaaatcagagtccagatattggcattagtgtctggaagaaaaacattttagggattttatcaattgaaggtcaaacagtagaaatccaaacctgtggtcaatgttagtaagttttcacaggcagcttaaaacatagcaatgccaacacaattttatatatatataaacttttccatatatagtgtatatatatataattgtatatgtacatatagcatatatgtatacatatagaaaattaaagtgtatgtctatacaggtatatacatacattaattagcaagctatatttttcattttaaaaaccatttcagtcactgcctctcaagcaaagtagaaatgttggtattaacagacatccctagtgtccttaaaatcatatttgctatgctcttaccttcttcatctcttcagaattctaaccctgccttgtaagttgtaggacatagcactttctgaatattaaggactgcaaactgcttaggtggcctgaaggaaactaataagtgaatgaagttagccaaataacagattttgctgaaggtgcctgtgagatctgttacagacattgaccacatgcttggatttctactgtttgaccttcagttgataaaaacccctggttttcttccagacactgatgccaacaacaggactctgatttttattttattttattttgagacggagtttcactcttgttgaccaggctggagtgcaatggcacgatcctggcttactgtaacctccacctcccaggttcaagtgattctcctgcctcagcctcccgagtagctgggattacaggcatgcgccaccacgcccggctaattttgtatatttagcagacaccaggtttctccatgttggtcaggcaggtcttgaactcccgtcctcaggtgatccacccacctcagcctctcaaagtgctgggattacaggcatgagccgacatgtctggccaggactctgatttttaacacctgtggcctgaaacagtaattgtgtgccatcaccttaaaatctttcaacttcagaagaatagcaatactttgacctgtaaaatatcctgtaagcaagaattctggcccaacccaactcctacattagatatgacaaaattaaatgcaaaaaaactaatagtgtcagagccagagtttgaacctagcataatattcctactacactgctaactctgtgtgtgtgtgtgtgtgtgtgtgtgtgtgtgtgtgtgtgtgtgtacacaaactaagattagccatgatcgtttcaggaaaaatgatcaaacattaattaccttttgataacagttctttaatgagttaaaattcttattaattcaccattgataaaaattagttcagaaaacatagcagtgacaacataatatttttaaaatctcagcagggcgtagtggttcacgcctgtaatcccagcactttgggaggctgaggcgggtggatcacgaggtcaggagatggagactatcctggctaacacggtgaaaccccttctctactaaaaatacaaaaaactagcctagcatggtggcgggcgcctgtagtcccggctactggggaggccaaggcaggagaatggcgtgaacctgggaggcggagcttgcagtgagccgagatcgcgtcactgcactcttgcctgggagacagagcggactccgtcttaagaaacaaacaaacaaacaaacaaaaaatctcagctttggtgagattaagccagcctggatgaattatactaaccgtcatgccaacgaccatgctaggcacataatttctactatctgctataaatcacctatttgattttaactctcagttgaatttcttgattcaaagccctctcctatggccttgcagtgaaataaaaaataatgattactacttctattcttcagaggggttaattggcttgtagttcagtataagctcttcacaaaaatgttgaggactcccagaaatgagtagatgttaattttgatggtatggttcattatctaacatattatttaagagcaaaaacaatataataataaatttaacatatcacttacatttttatttatgccacagagtgtttaaattaaacagcttgattaatttttatcactttggatataatatgttttgtattttctttataacctcatatttttatagtatttttgccaatcttcttaaaaatatttaattttgtagtattacaactaatttcacttatttttactttcaatgtgcctactagaaaatttaaattacatgtatttgtagcttatattcatattggacagtgattgcttatatgtatattgcttgtgtcttatgtccagtcaaaaggaagtcaagaaggttgacaatctgaaattaaattgagttttcgagttaccaaaatacagtggttaaatttaactcttctcaaataactgtttctaaaagttatctaaataacattcatagttaactgttttccttattttactcagtgtttactcagcatgataacagctcttgagcatgagtcagtcattttttttttcctgttgatctggcactttgtgtcaccaatagaaataaaagcaaaagtggggttggctagagaaaggggaattgttgatccagagcagcacaccagggttcccgtattcagttttacctaaagtcattctccagcttctgtgagacgatttactgctgaagtctatttgtcttcctgctgctatctctgaacaagcccaaaccttccatgtggttaataaacttcttatcttttgaatactgaaaataaaataaacttaatcctcagggtggttcagtcagccgaccagaagcctttgagatgcttcttagagatacaggaaaactaggttttctgccctgtgtgattatcaatctttccattgcatgcatgtatgtggaagggcgttaaaggtgcttctcagtgataaatgtcagcgaaatcgcaaagtgaatattaatttcagtattgtcaaggtcagatgtgtacctgggttcattgttactggaatttttattgttgctgctattgggaaagatattttatcttgggctcattttttcaagtatggagaaagagtgagaaaaattcctcaatgtacatatacattgctcagaaaaaaagtactgtagcacagtctggtctgttaattagggaaattattttgagtccctaaaaaaagatcaaggtgtaagtttggaggagttaagctaggtgggaaacagagcaaacagatgatcacgagatctggagactagctggtcttcctgaaaagcagctgactatcaatcaatagaaaaagcagaaaattgaagaagaaataaagaagaaaatagtttgtgatgtgcccattaatagaagtagggtgtgaaattatctaactgggagcttataaattaaaagaagagaagataggggaagatgttaggttatgagtgttcatacaggaatgaataaccagctggacatctctgtatacagtgaactgcctcaaagccagtgtggtggcaaacctgtgaattcactcacccacacgtctccacctacacgcatgcccagtttagtctattccagtgtttcctttctcagtgaacaacaccagaatcacctagctatgcaaatctgtattgcaggagtcattcctgatgcttccatcaacttcactctcttaccaccaatccaagtcctgttgattttaccgtccctatagctcttaaatccctgcccttcttttcatctccatggccagccattattctaattcaagctgttttcctctctcttctggactatggaatattctaccaattgatatctcaacactcatctgtgccccttcaattcactgtctgtgtacagtagacaaagtgaaaaatgcttaaaatgggaatttctttctgatttttagaataaaagatccacatcctcccaaggcttttaaggcctggcatggacctgcccccgagaatttttctcacctcatttggactcctctcctccctgcaccttagggtcctgccatattagactgtgagttctatggaagtgttcactctttcccctcaaatccccgcagtgcctggaacactgtaaaaatagttaacattcattgagcatttcctttttgccagatataattcatatattatttattattaatcttcacaacaaacttatctggtaagcactgcccatttttttttaaataaggaaatttaaacacaaagacattaaatagcttgatcctagccacatagcttgagtgagtcttctggatttgaaccctaaatctctgattctggagggtataccctttactgctggtctctgttacccaagatgtaatagatgggatttgctggcatcttgggcatcaaagcatcccggaactctgacttccgtgaaacctacgtgttaggagaatagagtgctaaatttcttctttaatttatattccctcccaaaagagccagtttactcaaggcagttccttatcttttaaagccttgaaatagataaacaataaattgattccccgaagagatggtatcttttaaggtaggatctttttttcattatgtagaaaaatctgctcacttgactgtctgaaaaaagattacttgcttccttttcctctaataaatgacagcagggcttttttataaaagcaatctatacctgtcatttattgctctattaaaactacaaacatcagatattgattgttcccatattgaccataatacaagccaattttgagaaaggttgctgggtttagtcacattatcaccatgggaaacactctgagttgtgcataagctgaagacacctgcctctggtgcatatctatttatagagaactgagatttttgcatgcagaaatacaatcttgagatatatacaggctcaaatcaatgtgaagtaagcaagaagccagtgaatgccctttctgaaggtttctgcttgggagtcttctaaagaattaaacatcaatttatggtttgtagagtatggagatataacaacaaatgaaactcgatgtggattatttatgaggaggttaaaaggctccatttatatcggtgatgtcacatgtctggatcatcctggcttttctatcagggactctgttggccaggtttggtggtggtggttttttgttgttgttgtttttgttgttgtttgttttttttttagatggagtcttgctctgttgcccaggctggagtgtgcaatggcacaatcttggctcactgcaaccttcgcctcctgggctcaagcgattctcctgcctcagcctcccaagtagctgagattacaggcacgtgccactgcacccagctaatttttgtatttttagtagagacagggtttcaccctgttgcccaggctggtcttgaattcctgacctcaggtgatccactcaccttggcctcccaaagtgctgggattacaggtgtgagccaccacgcccggcccaggtttggtttttaagcataatcttggtcagaacttgggccacatccttttaggcatctatggaatgctatgttttccatctaccctttgcatacataatctcttcatgttcttctaacaatactgacagttaagaagattaaatacttcttcctccaattgtctaatgaggtaaccaatatttgaaaaagcttcagggtcttgatttcaggtaacaatattaactaacatattatattgaacacttgctttttcatataatctcatataatccttatgctagctctgcgatacagaaataatgaatacctgagaaaatgatgctctgagtatttaatacttggcccaaggatacactaatatcaagtaggagaaggggttttttgactcaggaatcaaaactaagatgtttcaatcctacctgaaatgttttttaaaaaagcactagttatcttagagatagtttctgacttttctatgtgattttgtcaaaaggccttgacaattcatttgaaaattagagttctgtgaatacttgtacctaaactgaattttctgagacaagcatcttgagaaaaatggatgattttttaactttctttgagtctcatgaaagagactacatttttctgagattggcaaaacattatttgatttgttgatggtggttattaggaaaacaacttaatggtaattccatgctttggggaaaaatgtggtttcctcaatacgagatgaaatgtgcgatcattaatttagttcatcttggaattattctcattgtttttacttgaaaacctcatatctgaagccttccacgaggtatagggtcgtttttgtctccatttcccaacttgtaagttctgttctggaaaggctcatgtcaagtatgttacccattcaacccattcctcctgatgtgtcctgtctcgtcggattcatccttcattcatccatctatgcaattcttaattgttcttcaagaaatgttcttaactaagccctccgttatcatcccagattcctatgtatctcatcaatagatctatttctggaattcctatatgtttggttgtccagataatttttagccttgattatatatgatatattgttcatttctaggtgttttctgtgcattttgtccttcctaagttccttgaaaatttctaataaaagttcatagttctagagaaagcactgtatgctgaacacatagaaattattattagactttaaaatcacgtggtacttttatctaaacatttcaatcacaatggggagtaatgagacccaggctaccgtggaattatttttaagtcagtgtgattaggtgtatatgacatcaagctgtcagtaatgtgtacatgtaacatttaatatgtaaacctaagcacatttgggtgaaactttaagtttttatcttccgtttggtgtgtgtaggtagtttttgtagatcacaaaaacagttgcatttgacattacttagaaatcagcacttgaaacaatttgagacttccaccatgcagtccagaatcttcgttgttcactacaatttgcattactaagcattgcttatgttttccaaagtaaaattcaaaaagctctacattaaaaacatattctacatacttcacaaggttattactacttggttgtgttagtgaaaaatctgagctgtcttcctgaaagaccttatctggaggtcaattcttgtaatccctttattatccaactgtttccagttctaggttgaattacaagaaatctgctttgaagattattttcttcacagggagtcactgaagtttttttctattaagctgtcaaaaatattcattaatatctaagcatatacatatgtgtgtacaaaggtaatatatagattacatccatcatctatatcacacattatatatgtgtgtgtttatccatatctgcatccgttctatatatatttatacacacatacgtaatggcgcagtttagaatattgtgtgttagcagatagaaaatattaaaactaaaggtaaaatgagcaggtaataactgcttcctccaaccaaatgttgccagactcctgtggttttgtaatagaaatctaccctatagtttgtgcttcttcctagccaaattactgtcttatctcctaactatgtacagttcagtcaaggagaggtttcattatgttaataattacattgcctgcaggctttttgatgttgcattccccatacagaatagaaacagatttcatagaaatatcattaaagctgttaactacaggagaaaaaaaatcaaagaggcaatcaaagcatatactttattatcaataaatgtaagtagtttcagaaatggcttgcatttgaaacacgttcactaagcagatcatcagcaatggaagctgctgcttaaagggagagagctttgtggtctaaatccatttggatcactacagatgattacttaggtcctttgctattcatttttaaatataggctcaagaatcatttttaaattagcaaactaataaagggatagaatcagccacagaattctgacctgaattcaggctatgtgaattatatataggtcattactgcaatgacaacacgtgacagtttttcttcaaatccacttttattttagtttttttttttttttttttttaacagtggctgttaaattgatgattttggaacagtagaactcattgtactacacagtcatttaaaaaagactttaaatattcaaatgttcaactacatattccctgacactaacatttatcttcattttggacttccagctgagaaacatcagtataatggctcggagacatcagcctcgttcagtattaggaagatagtggcatgccttgatccttctaaagctttttctttgaaaacctcatattcagattcttttttgaaaaggattaattaagttcccaagatttttaaagaaacatatatgaaaaatcataatttaggttttgttctgattattgcaaatatcaaatttcttacagtaaagggaagacaggaaggcagatgtttagatagttgaatgaaaacagagtaagagaaagaaaagataaaaagtgtattaattcatatatgctatgtgacttcttgattatcaggagccccaacatcctataaaacctaaaatatttggtgaattaaagcagatgaattcaaatgtctttgaaataccgatgatttggaaaataaaatagaagtctatttcacaaacacattttagctttgaaacagtagcatttgattaaaagttgaagatagctctttaaagtgaaattatgttttcctgttataaagtaattaacaatcactatgaatgatttgatgataaagaatcactgattttcacaaccaaaagaaaccagagatagctaatccattggcagctaaaatttgggggatagaaatggtagaagctcagatacaatgatagaagctaagaaccctactcctcaaaaaatatacatattacaacttttaatgtgcagataatttcaggggcttgttcatggaatctttgatgctaatgacaggtttctatcataggtagagtagggataaaaaaccacacatcctgtcatctataattaatcaattataaatcattaaactgagcagctctctctctctctctctctctcacacacacacacatacagacacacacatgcacaccctgtcttcaatatgattatatgtaatcaatcatgctttgttaaagattcggctaacttttatatgccgtttattgggtttaatatccaataagatctcattataaagtgctctgttatactataaatttttatatatagtcagaaattactgttcccagtgcaaatagtgacatgtaatacatctcatttactccaacataagtacttaatttgttctgagatacaggtgttataatgaatttccactgtaatgaaatattgaaatttaaaaaaggtagttggataggctgacattgattgatgagttacttgcatagattatgcatctattctgaaatctttccattctttgaagaaataggtaacttgaatggagatggggagaaattagaagcagtttgccacaaaattattgtccaactgaggggatcagtgaggaatattaaagacatcttcgaaatgatgagcagttaagcccattaagttccttgactgacatactaaaatgtaatgaaatggaaggctgaagctgttaacggtattgatttcacatctaattcccattgttaaaaattttttttctttttcttttttttttttttgagatggagtctagctttgtcacccaggctggagtgcagcggcacaatcttgcctcaatataacctctgcctctggggttcaagggatcagggatcaagggattatcctgcctttgcctcctgagtagctgggattacaggtgcccaccaccacgcctggctaatttttgtattcttagtagagatggagtatcatcttgttggccaggctggtcttgaactcctggcctcaaatgatcctcccacctcggcctcccaaagtgctgggattacaggcataagccactgcatccagcctcattgttgaacatttttgagtctccctttatttcattttctcttgcagctcatgtgcatgtaatgtatcacatatgtaaaagtatgtaaattatactaaaatatactttatggatatggagctgaataaatgtataagtatatatatgtacatgcatacctatacatatcttcataattaatgtaaataatatattcttcatatatatgtaagaacatatatatatatatatgacctataaatcaaagggaaaatattagggaaataatgaatttgaatttctggcatttttgtgaagatgagtaagcatttaatagctcaagtgaaacacagagcctcgacactagccaggaatgcagtaaacacatatctaacaagcaagcactattttggtctatttcagagcactgatattttatatatgaaatatatgtatattttgatattcatatttattcaaatcatacaattatgaaatttttattttaacatatgagaataatttgaaaatcagatcataaaataaattttacaacgaaagagttgaagtagaaaacaatttagtaccaaagggcagtcatttctcaggaaacaaaaaggcagttggaaactttacaccaacaaatcgaatgttctcatttggctggcaattgataaaaacgcatcctgttgttgtgaatacttaaagtaaatgatccagaagagtgcagttgatgcccagggtattgggattggcagtaccagtgtaaactgagtgcaaattatggtacttactgcctgatatttccccgccaatagtaattaagctacgtagatataaagaaattatcagatggggaaaagtgcccacaggctcacatgcacaccaaacacatagacacatgtaccgattttagttcataccagatgtgtgaagaaaacactcttttctgatcccttttagtaacaatgatgaatcaacaaaatcaaatgggttagactacataaagtgccttaggcctgtgatttatggtaacatttgtaactgtatataaaatcactcatttggctgacatttaatgagtcccttctatgtagcaacattgtgcatatccttgtggaaaagacagttgctgcaattacttgcacaactcaatggagtgtgtactggccgttctcctgggacaaagaaccaggacactgagcagccctggctaggcttagcaggagaggagtgtggcctcatgtttgttcttatggggatactgctttgagctgcagatattcctatagtctattttcccccatgatgcctgacggaagtgtgtgtgtggttgtcatatctgtttcccagaagtttccaagcctcaatgattctcagagtcatggtcaggtaaggctgtgcatgacctcccgctccagaccatacacagcccctacattgctaagtagctctctcagattgctcttccatattctcataggtttcactctggatgaacagttcatttgcagcttctcttccgtgccacacttggaacctcagaaaactctgagtgatatgggcacacctcacactccttccttctcagcaaatttgccacctactatgcatgtggtggatcagataaggtgcattttcttctcctttgccccttgaaacttggagtccatttgaattgtgtcacatcaccccattgtgctctagtgggagagatgagcagaaacttcccacacactgcctccctttcccttcccccagatacccactcatctcccagtcctcctggagtggttctgtttgggaaactagggctcagctctcacctgctttgaatgtgttacaagtcacaggaggagtgatgcccttggagttgggtcattttaaaatccaaatctctgctcccagattgagccatgttcacaacaaagaacaccctttccatgtggccacaagagagcaagaaggaacacattcaatgagtactttacttatcaactgggccacatgtttatgcactgtctgcaccatatcacaattctggatccctcacatacggcatatatcttaacaggtcattcagtctcaatgttctcgttcctttctctgccttctgtagaggaataataggttcagaatcagaaatgtcccctcttgaaatatgtgcgttgtctttgtgaatatatcaataatagtataagcatacaaattatttatgtttttttctttaaaatacagtactgtgaccatccacttgaacaatattagtggacacatttttggtttgctttgtttcatttttttcccattaaggaaatgtctgctttgttataacacaatactaatgcatcactgtacactttaagactcctcgttgttcaactttttctcttaaagtctcctttttggaacatagagctttttcatagaaaaagtatttcttcctggaagaatattgaagtggagacactcataaagtgtctgtgaaaatacaactctctaggagtaagggttctttctgtgaaataacacatcaaagaggaatgaggagagcaagacaaaacccagtagagatggattggaatgggatgcattactttggagtcatgaaacatatgtactgtctgtgtatatgtatataaacatttgtgtaaatatatgtgtgtgcgtatgtatgcatgcacacatgtttcttagctctgttcaccaaaaagacctagaagcaaatgcactcaagtagcaacttatacacctaggattcaaatatttgtctttataccattccccactaaaagaaccagaaaaccttgaaggaatgtctttttctagagctgaggcaagatcaagatgagcctggaacatattatgccaaaaagaaaagaggtactccaataaacaatggggcatgtcacagggacagagaaaaacgattaaaaagagcttccctagttgaatctgggtaaatttgaacaccagtataattaaggacaataatgaattatagattataaaaaggaatccatgtgcccattgaaataaaagattcacaaaagagaaaaatatggacttttgcttatagtcaaatgctaagtgtcaacaagtaaatgtagagaaaggaatgctggaataggaaaaaaaatcattattttgtaaccaccatgctagaaatggactccatcaagaaccattagtagatgctaaatctatgggaaatgttgataacaagcatatttatatggtcctaatgttatctccccatgggttgcttattagttgtaagtggtagagtagagggctgggaaggcgtaggggaccttcaaattctgcttggccaagtactcagttctggaatcataaatgaggccagagagagagcttgtgcctctggatgtgatgccctgagaacagatcatttacatttcatttgtctgaatgcataacctaagtctaacatgagacagagacacattcaaaatgatgaacattttatttataaaaaggggctagattctttaaaaatatcagttgcctgaaagtcaatgtatttagtactgttccaactcacagcagcctggaaagacatggcaacaaaacctgaccctaaactggatcctaaattggtgaggggagtgctacacaaatgacattattggtcagttgccaaaatgcagatgaagattagataaaagtattgtgttaatattaaattcactgaagttgagaactatactattcatatacacatttatttttaagaaatatgtaccaaagtatttaggattaaggagaaatgatttgggtagcttattctgatgatatatagattctcttgtgtgtgtgtgtgtgtgtgtgtgtgtgtgtgtgcgtgtgtgtgtgtatgtaattatacagaaaggaatattttggtatatatatttcaaagtgttgacaataggtaagtctggataaaggaaacatggctgttctatgcactatcctcattcttaaaatttcctttggttttaaattatttaatacctttttaatggcaagaaggaaaaaaaacacagtaatttgtaaagataaaaaaatacagtgttaagaacaaggaatctcaaggttccaggactgatgggaaatatgtgaaggtgacattaatacatgttctgccatgaatagaaatatttttccaaatgaatgtatgagcagtgataccataaggggcctgggttccatggaataaatcttgaaaaatgatgcagagttacgctgttaggttccacgctgatctaagaagtgtatcaacagattcatgccagtcagtttttcctatgccatttttgctatggaagttcaaactctcagaactgtattacaggcctacaatgtatatctgtccaaagctaggtgttatccaagcctggggaaaatacacagacaacattattaagtaaggctgtagttaaacctggaatggtggtatcatttgttgattttaggtaaccatagtgtggccattgcatttaccatttacaagctatatacaggtccatatgcaggaatacaaaattatgaaaaaatacaaaatttgcagagaatcaaaatggaagctttttcttaacacattctgtatctgaacctgacctgacctcatgctaggctattcatagtctctaatgagcccatttggcatgaatatcatatgctttactgcaaatatatagttacatttgattaacaatgtaaacaatttgatatgagtatcatatgctttactgcaaatatatagttacatttgattaacagggtgctactacagaccccattagggaaaaaagaaaaaaaaaccctgcacagatactatgttacttttctaaaatctgaaagtttcaaaatcttaagatacctgggctgggtgtggtgtctcacacctgtaatcccagcacttcgggatgccaaggcaggaggatcgcttgccaggagttcaagactgtcctgggcaacaacatagtgagacccagtatctacaaaaaataaaaataaaaaaataactggtcatgatggtgcatgcttgtagtcctacctattcaggaagctgagacaggaggattgcttgaccccaggagttcaaggttgcagtgagatgtgatcatgccactgcactccagcctgagaaacagagcaagactctgtttctggaaaaaaaaaaaaaaagtgttttaggtaaacgattgtggatctgtgctgtctaatttcattagcagacaagttatttatccttcttaagtaacaataataagagaaaatgtaatactaaaaagtggaattgaaaatggaacactaaaattcatttaatgaacccagaatcaggcaagattttaaaactctgacttaaagaaagacaatgtggtaaattatccatagctgtgcgacctattttaattataagtagaaccataatatacaagtactccaaatgtactttctcttttccttctgcagttattagccatgtgcaggcaaagacatagtggcatagtggcaaatttttcagactaagaatttagattcacaatcccactctttgctgccattatcttagtcacttgtactcctttaccagtttctctaaatgtaaaataaaataggcaattttggttaatgtaagctttcttatgaattttaaaatgaagcgattctaaagcttccagagtttatatttttatattcttattccatattattctaaaatacatactcctagaattttattgaactgtaaaaatgtaattttgtttgttttgagaacaaaaacccacttatcctaatcacttttctttctttctttattatttttttatacagtgcaagttccagggccagtagaaaacctgcaagctgtatctacctcacctacctcaattcttattacctgggaaccccctgcctatgcaaacggtccagtccaaggttacagattgttctgcactgaggtgtccacaggaaaagaacaggtaggtgaaggaatggaccacactgcttccatctgttggatgtttccatccattggatagctctagggctggagaaataggaaaagactcgcaaactcttgaaacagcccagtgttaacacattcattgaaaagctgattagttttaaagcacttgttattggaaactttacacaatttaattaaattctggtggtaagaggtaaatgggcaataaagtgaagtcaatagaaaggataccaattttttggttgagtctgcagtggcctggcgtgtgtgggcaaccagatttgtattaactcacctggtcgtggaaggcatttgcagttttattccttagactaaggggtgattgccctcctagtcaatggcgtttgccaaactgcttttttcattctaagacatttatatctaactcccttccatcatcaggatgtgtcctaccattttttaatgttttcagaagaacttactctgagaagcctagtctccttctccttacattttgctcctacccaatggttagcatagacacctgaaaagaagcaaattaactgttcaggtaaactaaaagtaaaaaggtctttagggagacacatgaaactgaaaaattctatttggtgatacatgcacacacatatgttaaaaatagaaattgagtttcatatatatgtgtatatataatatgtatacctatataatacatatatattacatatatacgtatatgtattatacatgtataatacatatataagcataatacatatacatatattatatattatataatacatatatacatatacatatataatacatatacgtatacatatataatacatatacatgtgtatatatacatatatgtgttatacataatacatatataccacatatatgtattataacacatatataccacatatatgtattgtaacacatatatacatatatgtattgtaacacatatatgtatatatgtatatatacatatatgtattgtaacacatatatgtatatatgtatatatacatatatgtattgtaacacatatatgtatatatgtatatatacatatatgtgtatatgtatgtgttatatatagtatatataatatataatgtatatgtattacatatctatgtatatacatgtattatatataatacatatctatgtatatatacatgtatgtattatataatacatatctatacatctatatgtatataatacatatctatgtataatatataatacatatatgtatacatatatataatatatgtatacatatttataatgcatatatatatgtatgactgttgaggtatttacttccagattctcaacttcatgtaggaaaatatatacagacatgtatatattcaatagttaaatcaaaaattggccccaggatatgggagttcttattatttgttgtgaagcttgtcaagcatagaaaggccttcctgctttcacataaactgcatgatcagaatttttacttaaaaataagaaatattttatattcaaaaatagctcaagcccagtcccaaattatattataagataagcattacaagagctcctcctatgtaatcatgggttgtatttttttcttgctatcttcaagctattttttgctcttgttttttcaactttctgttttatctgcctttctatatattttagctcttcaacgcattttgccaaccaatttaaataaattcaaaaccatcatcatccaagatagatgtgagtgtgaagatctgattcctcagtaaccttcacctccagtatctcatttactgcagccatgagaggctcaaataatttcaaccaatctaacagcattttgggagataaaaattgtggcaaagtgtctgacagtttcaagagctgtgggtatatttcagcaagagaagcacaaaatctattatttcttggtgaattattccattttgggtacaggagaaaatctctgttcccatggcgttataagctgccttctgcctgtgagggtttaggtgtgggtagaataacccaaaccattcagtacattgagtagtgttaaacaaattggaacttaatgactgtaaaaatagcatgtgctgttttaacaaggagtctacagattagttggtttttagtgggggagtctgtgtcacaaggtaggttttatagctcattagaaggctggagtgtagtttgtaagagtctaatgtccaattcactgattgcacagaatgagtgccatttctactttaatgtgcttccttgataacagttttggtgttttatgtctccagaatatagaggttgatggactatcttataaactggaaggcctgaaaaaattcaccgaatatagtcttcgattcttagcttataatcgctatggtccgggcgtctctactgatgatataacagtggttacactttctgacggtaagttaaaaacagtgaaactccttttacatatttgacataatattgacaataatgacatgatattgcacatatatcatatattccattttcaaggcttcctgactaaaattttatggactattacagttaaatgtaaactttctatcaagatacatactcccagctggatgtggtagttcacacaggtaatcctagcactttaagagactgaggcaggaggatgagttaagcctaggagttcaagacccacctgaacaacatagtgagaccctatctctgtaaatgttttttttttttttttttaattaactggatatggtggcatgcacctgcgatcccagctacttgggaggctcattctggaggatcacttgagcctgggagttcaagactgcagtaagctgtgatcgttctactgcactccagcctgggcaacagagtaagaccctttctccaaattaaataaatatatatgtatatatgtatatacatatgtatatactcttgagtcagtatatactaataggtaatcctcaaaatgtgactattgactaagagctaaaactttgtgtattttttatttctttacattttctaatacacatttgtgcatgtgtggattaattttgattggcatgttttattcccccatctaaaagtgtgcagatgattaaaggtgtaaatgatagacaatccccctatatttacctcttaattagaaaatatatcaaaaggaattaggccaaataagctgatattaaaatttaaagtattaaaattgagcatgaaaaatgtgtatgttgcctactaaatggaagaatagacacaaacacacacatttgagacaagaagtgcagtgactcaattgtgcttcactacaccctttattcctgggctcaagggcttttcttttcttttccttttttggaaacggagtctcgctctgtcacccaggttggcatgcagtggtgcagtctcagctcactgcaacctccacctctcgggtttaagtgattctcctgcccccagcctcctgagtacctgggattacaggtgcatgccaccacccctggctagtttttgtatttttagtagagacagagtttcaccatgctgagcaggctggtctggaactcctgacctcaagtgatccacccgccttggcctcacatagtgctgggattacaagcgtgagccactgcacccagcctcaagggattttcctgccgaagcctcccgagtagctggaactacaggcataggccacagcacccagctaatatttttattttttgcagaggcagggtctcactttgttgcccaggctagacctgtttttgaatgccataaaagagaggaacaaatcttaataaagagaataaatttgacaaaataatggccaggggaaactagaaacctaactgctagatgatcatgaaaggttgggaaattttataaaaagtgaaaataaaatacatcaaagtatatgatgtggggccaacgaaaactcaggcaggtgcagaaatgtagcgataggcccttgtgaatattaaaaaaggccacaagctagctcttttcagcaacaatttccatttggtgtgtttaattctataaattatttatctttttaattaaaaaatgactttagcttgtgatttcttgacagatctatcattgtttattctgggaaagtacctgggtgtacatttcacacaatatcagtgaaatgaggaagggcatgcatattattaaggacagtacaaagagaacacaggaataatgctcatttgcaaattcaactttaaaatgtattttatacgtaataccactttggtatcatttttaatgtaattcttaggcccatccatccaattctgttattgaagacagaacagaatatttattggtagaataaattacttcacaacttataattataaaaataaaagaaaaacaaatgaaagtgaatgttttacataatttatgtagatttcattcactctgaactgtaatactgtggcctgattctccactttggttttaaatgtcataagtgagaaagatagattattattcattagtccaagaattatcttctggaaatgttacaatgtttaggacttagacagtgtctgtcagtataaaaaaagtatttcgtgaccctaaccccaataaacatcactgtgcaaaggacaccaaattctctctctcaaatgcactgaaaggagatagcaaggactttataagcttcttagagtggacaccgtgacctcgtttgcattcatttttacaatcaacccatctcttttaatgtccaacacaaatgtgtggctcttggctttcatttccttattatccagttcctttctgtctacttcaatctcatgtctcctcctctgtcctgaagctgttcatgctgaggtcatatatcacattgagttgtatttaatcacatttaatagtcacctgcttcccagtcttcagtcatggagcactcttcttcgttaactttatgtatgttgtaacaggtggatgttgtgaaaattaaatgggctgatctgtgtaaacatctaacaaagtgtatgacatttaagtgtttaataaacattatctctaccaaagtgcacttcactttttctcattatattaatattaaatacccctaaatatgaaggatgctgttatattcacctctgttttcttcctgagtaaatatttatcgaattaattagacagctcagtcaaaactgtgcaaatttctgtatgcaaaggcttatctttaggatttcccatttgtggaactaatttgatatattaatttaatatatgactgtgtctaaatgcatctgtattatagtgaacataataattcttttcatatcaggagtcttaccataaaaaatatattgagacatagaaaaatttttaaaaaagcaaaagttaagtgtaaatacatttcttccaatttcattactttatgtttttttttccctgttctactgggatgcttgtaaagatctttgtccagatgagctgtcatctctaatttagctcggctttattttctgagtagaaaccttattttttattcaaattcctccacctagaaaaccactggtttacaatgagccatttttttttcacaccactgagattatacagcatatgatcatctaaataattttgccaatttgttccaaaatactgtctcttgcactagttggtaagtcactaagagcttttatgaacgaatgaaccattgaaagtttccatgccagcttgtcctgtgtccaaatgcagaaggacctgatttcataggcaacataagaatgtgcttattatttttatgaatgttattaatatttcttgaatacttactaatggaaggccctgatccaagtactttgcctttacctttcatcctcacgatactactaaaattttccctactttacagatgacaaaactaagtcagaaagagttcacaacaggtagtaagcagcagagccagaccacataagctagtaaattcagaggcaagattcattgtggaaacatgtttcttttattctatgataagtgcctttaaaggaaaatgcttataattaaatatgaattactggccaggcatggtggctcactcttgtaatcccagcactgtgggaggcccaggcgggcagatcacaaggtcaggagatctaaagcatcctggctaacatggtgaaacccactctctactaaaaataccaaagaattagctgggcgtggtggcgggcgcctgtagtcccagctactcgggaggctgaggcaggagaatggcgtgaacccaggaggtggagcttgcagtgagccgagatcgtgcctctgcactgcagcctgggtgacagagcgagactctgtctcaaaaataaaataaaataaaataaatataaaataaatatgaattactgctgggcagtaattacacttgtaatcccagaactttgggaagctgaggtgggtagatcacttgaggccagaagttcgagaacagtctggccaacatagtgaaattctgtctccaataaaaatttaaaagttagccaggtatggtggtgcacacctgttaccccagctactcggaaggctgaggcaggagaatcacttgtacctgggaggcggaggttgcagtgagcctagatcacaccactgcattccagcctgggcaacagagagaaattctgtctcaaaataaattagaattattttggtctataaattctgtgtacatggcagcatacatttgctgaggggaggaattcaagtgcctgtgccttgggagactcatttacaattatggggacttgatctgtcctacaaaatacctcatctccatgagtttcaagccaacatccttctccatattgagggaagtttccagccccacctctcattggcttgaatggacctatttattataaataataaattatttgacattttgaagagaaaagtgttctttcacttctgcctcatgaaacaagaagcgtcttgggaagacaaatatagaaaagaacaatcgatatggattctcttcactttcacctagccctagcatctattgtatctatctatctccaaataatatggaaattgatagtgagaaggagggagtaggaactgatcactaaaaatactgtagaaaaaattctctactctcctccctgacatgacaacaatagccagtgtgctatcagtggaaagttagagaagaaatgtgcactgtaaaaaaatacagaaaaactacttcaataccattacaaaaggacttttagcagaattgtattttattgcctttcaattcttgttttttttttttctttttttttgagacagagtctcactgtcttgcccagggtggagtgcagtggcacaatctcagctcactgcagcctccacctcccaggttcaagtgattctcctgcctcaacctctggagtagctgggactacatgagtgtacccacacgccaggctaattttttgtatttttaatagagatagattttcaccttatttgccaagctggtctcgaactcctgacctcaagtgagccacctccctcgggctcccaaagtgctgggattacaggtgtgagccaccatgcccagcctgcctttcaattcttaatacagaaaacagccctgatgcttataaaattgtggtagctacagaaaaaagaacacatatatatctatcctcttaaagttttcttggctttctagaaataaggagttaaatgccacttgtaaactcaaatgaaagtgacatttaagggttgcatatcagctagaacagtacctacaacaaaacacatgataaatgttaccttctctttcttccaaaattcaattatctatcaaaaattcagttagtaattgatattatgtttggatactaattgatcaaaaagttagtgtaatattattagaaacatatagcatgacatgtcagtattacaacattaaatataaactagaaatattctttcatgtttaagaagtgactcggccgggcgtagtggctcactcctgtaatcccagcactttgggaggccgaggcgggtggatcacgaggtcaggagtttgagaccagcctgaccaacatggtgaaaccccgtctctactaaaagtgcaaaagttaactgggcgtggtggtgggcacctgtagtcccagctacttgggaggctgaggcaggagaatggtgtgaacccgggagacgaaggttgcagtgagctgagatcgtgccactgcactccagcctgggtgacagagcgagactccgtctcaaaaaaaaaaaaaaaaaaaaaaaaaaagaagtgactcaatatcacttaatattaagacattatttccaaactttgcttttaaaggataacatttttggaagtttgtgaaattatatgatatagagcatgttattttattctacaaatagtacttcaatttaaaaaactaaattgtaatttttatgtcaataattataacgtttagaatagattaaataataatacaagtacaatttatactttaacttaaaaatttacaaaacaaaacttgggaccaaaccctgaatatggaaccatttttattataatttataaactttttattaatatatttattcagcaactatttactgagtgtacaccatgtgccttcaactcttcctgatactggtgatacaacatcaaaatgaataaatatctttttccttattggggttacattctgtatttaattttaaaatcagaataagaatctcaaaaaattaaataacattttataaattgtggaatatttttgaaagaatacttgctgagttaattcatgaaaaacaagcagatgagcattttgtcagaaactacactggctgcaaccttcatcaggcactaagatcagaagttcaaaatcaaaataaaaaaaaaagatttcattttctgttattcccagaaaggtctagaactatataagtaagtactcatttgctcattcaatcattaattcagtaaatattaattgaatgtcagtttggaagataaaagattaatcggtggcacatcatgtcttcatgataattactatttagaagataaattcagagtatggcataaataaattcatggtcagatgtaagtactctatagaaaaacatagatttttttccaaattctagtaaaagaaggggaaagatgtcaaaaatggcccttagattcttgaaaatgcctgagaacttttctattaaactcatctatttgtgaggaacaaggatagggactactcactttatagattaatatgtgttaacaatttattgaatgctacttctattcctattatggggcaaaaagctttatttcatttatttttcatcccagacatctagagtagttcctgacacataaaagccattcaataagtggttgtttttaaattactcacatgatagaatattcacttttttggtagagtaaatatttattataagtattaaaagagagctgtatatgttcttccttctataaaggagtagttaaataaaaatgtaggcaagaaaaacaaaataccgtacctagaaactctacaaagaaaaatatactgctgctttgctaatagaattgactcatcaagtgctatttgcaacctgcttgtatttatcacataaggtttaattttacacagctaaaagaactgagaagtatttcttcttttcactttttaagagctaataaagtttgcattacagggattaagaaacctggctgaccattagaatgacaaattttatcataaaattatgcagattctgaaatgcgcaatatcttaagcctttaaaactactgtaagaaatctcctgtgtgtttttattggtttctctgggaaagttatcacaagagggctgtaattaaatggtggtgtttggtatcactgcccgcgttctcttgcgtaacagttttaggggctccctacataggtaagttaactggctagcgaaatgagaaaaaaaaaatagacaaatacagttatttttcatctctccaaaaatttttgaagtactacctgggttaacctacctaattatcattataaactatataaacaaaaccacactctctttttactagacaggtggtatttttctttcaagattttggcagtaactgtgacaatttgtttgattccttttagtgccaagtgccccgcctcagaacgtctccctggaagtggtcaattcaagagtaagttggctaaatgttcactactccattacctatcaagattacctatcatgtataaccttcactcacccaactgctgtcttgagtacaggatagtggcttccatgtgcagaaatgttctggaacaacacagcaagtgacattgatcccacatcctcttccatcagacttaagtaaattaaatgaaatatttgtctacttctaaacaaatattttgatttacaaatattaaacaaacattgattttgtgaatgttttagtggccaaaggctattccataaggaaacaaagacatctgcttcgtctatattcaccagtctatcatatagcaatgatgatgtgctagatgaggaaattgaaataattaggagaaagaaagactgtttcctaacacattacttagaattgaatatttcgtcatcatccccattcttcctttataaatgtagtcattgaaggccattcttgaacttcaatacagttatatttatgtagcgatgttacctagttgttagaactttcctggcctggaatgttgctatgacttccaaaggagctcaacttaggctagtattgctgaagtagcctaatgccagaggtcagttttctagaaacatgtcattatttcaagtgactcagggttggaaataagccaaggccacctagtagagtataacaaatgaggattcacctggtttgaccctgtcaccacctggccactatgcttggacctccagttaggtacttctcatgtgaggaaattggcctaaatgatttctaagctctgggagacagcagagaaatgatacaggtcttagaaaaagtcatactctgggttttaaatctagctttctcttttcataactatttggtcttagcaaagttttcaaccttagcaaacctctttctatgtttaagtatcctaagaattactatcttccttattgacttatcatgagaaagtaatagtaaaatgtatgcgatgaatctgacttgatagtgattccttcattccatgtgcaaatgccttgtcatattttgtaaaaaatctatgaggaagccatatcttgtgatgttaattggatttgtctcagtcaaatgaatttatcttttgaagcaagtgaatgcattattctcttatacttttaggcaatatgttggataagaactattaaagcaaacataaaattagaagaaaataactaaacttagtggaaaaaatgagctaaaggaaaataatcaaaaattaacataaccctacaaatgacatttttatctgcaacaacactgctttagagatgtgccacttaaattaagagattgccaagtcaaagtcaagtagatttttacaattattgtatgttgttaatgaatgaaatttggaaaacatattgtaatgtctcttgtttaacaattcatcattgttagaatcctcactcactttatgtttttcctccaggacagaatatagaaattgatatacaagctattttgtgtttgtgtgttcataccctttaagagtgtactccaggaaaagatgaatgttttcacttgaaacgtgtatagggcattactgaatgaccctggatgctaactgtatttgaatatggatgtactttactgaagacggaattcctggattgcaaaattgactatatatattatacacacacacacacacacacacacacacacacacacacatatgtatatacacacacacacacacacacacacaaatatcacagcttctactcttctctaatttgcttgcttgcagcaagcaaatacaaacacttctacttctatcctcttgtagttgatatctggaacattgcactgctagaaagtttaaattgttcattcgcttttcagaatgaaaatactatgcccaggcactggaaagtcacactccctctctcctttttctctctctgatcttatttcatagcttctaagaaattatgaattataaatttttatatcagactgttttcaagagaaaagaaactggatgatcaaaacaccactttttgcattctcagtgtattgattcagacaaaggcaaatgtaatattctattttgatatttgtgttttatttgaaatagatgaaaagttttaaaatatattaatatttacccctgactgtgaccatttcaaggggcaaactgtatttaaaaagaaacattatagttgaataaataatgtgttcttttttaatactaacagaattccagggtgtttttattttttttattctttagagacaaggtctttctttgttgcccaggttggagtgcagtgacacaaccatgacttactgcaatcttggactcttaggctcaagtgatcctcttgactcagactctagcatagctggtactacaggcatgcaaccaccatgactgactaatttatttttgtgttttttgaaagacagggtctcattatgttccctaggctggtatcaaagtcctgacctcaagctatcctcccaccttggtctcacaaagtgctgagattacaggcatgagtgaccatgctcaattcatgaattttttacgtaatttattttacttgggattttaagatggaagagaacacactttgaaaacgtattctatatcatatttgtaaatatagagcacaattgatttttttattgatagtaaatgaaataacttggtgcaactaacatttttgcagaaagattattaggatctctgtacataaaactgaggggttgttataagacatatgatcacaatctaggtactcgttaaggttttggtcacccgtaagccagttggacccagaaatcatgttccataataattaagcagagaagtctttacacatctagataatgaaactaagaacaaaattctcttactgtatcattcttgaaaacccagtatggtagaatatttttacaaagctgtaatagcagaacagattagattccttttctacaagctaactatgaacacaagttttttgttgtactaatggcttgacttacacatgttacatgtcaggtgaaactgggtcatagtgaggtggttatttctcatactaaaattttgttacaagaaatagtatcttttccagaaaaagataatggtttatgaaatggactttaaaatgttacgttttattaggaaaactttttataagaataatttccttaagaatttaatttgaaattcaattattattcaattattattgattcagttattatatatttcaaatacatactacaacttaattagttggctggaacataaaggatacatttacagaatgcagagagctaatgttggggcacaaatattaatacttccctatgtttcaatctaaaagttctgatgagtaataatgtttagaggatgatagaattcaagttgcttgggtccttttattaactctttgaacctgtgaaaagtcacgtgtctcagttttatttattcaacacttactctgtacctgttttaatgtcatacataataaggaatgtgatctagaatttgccttcatgcagctcacagttgggtaggaaaacgtgaaagaacattcactgttcctctagccactttaatctgttgaacctttcaaagttgacattattttctcattttaaaatgagagagctggatagagaatctctaaaatctcctgtggcttcaaacatctgtgcctgtgtttctaaccattataccttttctcaaccattttactgttaaagaattagcgaaaacacaaatcaatttcagtataccagtcaactcactagttcagatatatattgactgagcactacagagtgattgcaaggaatgaagtattaactcccctttccccccaaaaccccagtatattatgaggcatagatcattgttcagatttaaatttttaaatgcaaattgatggattcctctcattatatcacctcacacctctctgctgttgaaatccttattcttgaacaccagatgcatctatgtgaatgtctttttgttgcattcctaaaagctggtactcagtcactcacaatctgatattgtacatggtgccttcaaagcaaccgaagaaaaagtttctagtgccttcctacgtcttaaagtgtctcactctcccttgtttcagcacaacttggcatgcttaaataactcaagcctgagttcagcaatcatatgatttcctttatgcaaaaactatacagtaggagaacagcaagtttctactctgcaaagcaaactgatcatttttaacagatattttaacattctttgtgtgtgtttgtgtgtaacaagacagaggaaatctaagtgtattatgggataactgcagaaggacatgcttttgaggatgtggtgcaacttgttggattttgatggaagtctctataccctgtcattgggctggtgttgcttctcttattagccaagtccatagccaagtgggtggctgagtgagtcatttgcatatgactcctagtgggaagggaggagatggggaaaagctggaggcaaggaaaaaatgtgagttatgatattaaattgcagatcctctgtgtctggggtatgtgtatgtgtgtattcagttttgttttgtttttttctgaaattggggttatcttctcttggttattcagaaggggtttcagttcacacacctccctgctgcgtgacaatctctctgaaaacatacttttagaaaaggggtctggacccacttctctgctttcaccattcttctagtcaacgttcatttctctcctgtatgttgtatggagtcataggcctcaggcagcccatggaaaaacatgcttcttcatgtctccctaagtcctttataaaatacactttggctgctgagttcctggacccagagctctgagccctctcctcacaaatgtagtaggtttaaaaaatggatttagtgaagagaaagaggatatatatgagactgcagatgattgtatttatttaaagataaactagaaccagcatttgcttattaatgaacaatttaaatacaacaatgttgactctcacaagcttaacaatgacacttgtcctcaatcataacacagagcatttctgcctgagcatagtatttgccctagttatccatccatttaattcaagtaggtgtagatctcttatatttattttagttattgattccttcatctattcattacatggtgatttttaagcatagataatgtccaggggcctatgattgaaagttttaggaagggtggggagtaggagcataattgtaaggaaggcaatatttcctgggggctcttacagtctagtctttctgtttggaatttgtaggaaagactagactggatataaatgattatattacataagaatcagataatttgtaagaatctgtgagactcccttaaggataagattgtgtttggtctataatttgggtagaactcatcttcagatctcttccatcctgtctttttacttaatagatccttttttattgtggtgaaacaactttatataaaatttaccattttttaatttaatttaattttttaaattaaatacaaatttaagcatttgtaaatgtgcagtttaaatgtggtaagtacattcacattgttgtacatctatcaccagcttccatctctagaatattttccatcttcccaaactaaaacttagtatctattcaccagtaagtccccatttccccacacagtcatagatgtttgaagccacgagattttagacattctctatccagccgtctcattttatcaatgagaaaataatgtcaactttgaaaggctgcaacagattaagtgtggctagatgaaaagtgaacgttctttcacatgttttcttacccaactgtgagctccatgaaggcaaattctggatcacattccttatgtgggaatgtgagagaaaatggggagttattggtgaatagatactaagttttagtttgggaagatgagttctacccaattacagaatccctggcaacgactattttactttttgtatcccaacttactttataaatgagcaaagaaaccaattcataaaaaaattaatttcccttttgcttcatttaattgagaaataaaacagttttccatttttagatcccctttcttatagagaaatgaaaaacttaatgaatcagtggtcaagaatacagacagatgctttaattggctaggaagagatgcctcacttcccattattgtcagtgctttcagaatacttctgttccaaaattccacatttataaattgtttttagaaaatctgctgaaaaagccaactgtcatatttaataagaggaaaccagaaacataaacataggattgttccaaagaaactgtaaaagacataattttgtctcatattccatcagaatttagaccagagctcctgaccagttgctaaattgattcttagactttttttgaagttccaaaaactcaacagtttacgtcttttttcagtgaaattacagtcaatgaataaagatcaaccatgaattagaggaataataaaatagtaaattattggataactagtttttaaacaacataaatgcatcattccaacttaactgctttctgtaattaagttgaataaaagaatactctgcaaatttgcaaattcaaagcatatctttgtattacactatcactcattttctcagagcagcccttcctaaagtctatttgagagaatacttacctttttcttttttctttttcttttttctttttttttttttttttttgaaatggagtcttgctctgtcacccaggctgcagtgcagtggtgtgatctcagctcactgcaacctctgccttctgggttcaagcaattcttctgtctcagcctcctgagtagctgggactacaggcgtgtgccaccatgcctggctaattttttacttttttttagtagagacggggtttcaccatattgtccaggctggtcttgaattcctgacctcgtgatctgcccgcctcggcctcccaaaatgctaagattacaggcgtgaaccaccacgcccggcctatggtactttcccaagaaacaaggttgctatggcttaaaaaattgtgagaaatatgtgaggtttcctattggagatattaaaggctatgagaagtatttgtttaactcagcttttttaccaattgttttttctacaaaaacattttagatgaaatacagcctttaaaactctgtcaaagttacttaatgtcattgtaacattacaaatgagaacaatgtactccataaattgaagaacctcatcttcctccaaaaataccttcttatctcaattaatttaaaataataatatatattaagtgaaaaaataaatttatggaaagcagaagtgaatcaaggaatagttataaaggacatttatgcataactagaataggatattgagaaccttctgtgacatctgttagaagatttgaataagttagagacatgattaaatctccatgtcaatatgaatttttattaatgtaaataggacttaggaaaacattttctagacttttctcatctttcatatttcatatacataaaatacatcatttttctgttgtgttttgagaatgttatatttttgtcttttccaatttattgcagtcactgccattgagtatacttgcacaaaggattttgacaaaaagagattaaaatatatgatagaataccattctcttttgagttctagcctcactttaatattaccttataatttatacttcatcacacacatttctaatggctccatttctgcttggctctgaaggcaaagctcactttagcctttccatgaagtttaatgagatttccctcaagtcatacatttttgaaaagtgggaggtttaataatgggcttaaattaaatgaacctaggtctagtgataaggtctctgattttaatttagttcatggaagttgcccttatagttggaatggttgattagttagaagacatgaataagttcagccctaccagtaggtaaaagcagttgctaactatgtgatttgattttaaagatgttgaaccattcacccatgtgcaaaaactttattcagtagtatagttttgaatgttatttatattataaaacaacttttaaaatgcaagcactttattgaaagatttaacacattaacacgagctattttagtcaatattctagacacacattcaatgaatacctaattataactgtaataatggcagtaacctttcccaaaggtattttgtgcctggcaatgtgctaagcaatgaaagcagaatttcatttattgcttttaataatcctataagatattataaaactaattctgaaataccaattttgaactgtgcttgttgctggaaaggctataacaaaagcaatcaaatgccttcttttctagagcttacttatattctaatacatggaaatagactaataaacaaattaacaattgacacaagggagtggtaagttctgtgaagaaaatcaagaacagtcatgcgatagaatttgaggacctcatttaaatcagattgtcagggaaggaactcttaaggagatgagctgaggcgtgaatagaaaaggatcagctttgtgcacactcagagtaacatatttcaagtgatgccaacaactagggcaaaagcagtaaggagggaactatctttgcatgactgtgaagctgaaatgagaatagaatagaagacggattgctgggttccggccagatctggcggggctttgtagggtgtgataaaagttgggatttcattctatggacaatgaaaagcatattgaaaggagagtaatcagattcaccttttttaagaattacactgactactgtgggaaaattatcagggggtggaacgtagaggaagcaggaagaccagttcagagacaaccaagtgctccatgtgagatcatgtagcaggaacctaggagtcataggaggtgatggagagggaagtagaaacaatcagggtctgtgctggatctagagccaacaaaattggttattggattatagggcagaaggcagagcaagatcaaggatatagagtagatttttggctataaaatgtaagcagattgtggagctacttaatgagataagatttggtttaggggacaatcacttttggacattttgaattcgagatagctattaaatatacaattaggaatgtcaatcatgtagacaagttggtatatgataatagttctgatgacaggtcatgccaggagatataaatttaggagtcactgtcatattgataacacttagggagagactacagttagaaaaaatatggcagaaatttggaatacttaacatttagagattgggcagatgaggaggaatatgacagggataaaaagaggaagggtgatttcacagatgtcatggtggggaagaatgtttccaaagggtgggagctgttaactatgtcatatactaatgagagatacagtaaatcatgtcagtaaggtgaccactgtgggagggagatatgacattcgagagagagtatgaagggattaagtagagtgactatagattatatttgtgaggagttttgctctgaagtggagtgaagagatggatagtgcctttaggaggtggtaggcttgagggaggtgttattgtttgtttcatttatttttgttgtttcatttttgaacatgagagataaccacaacttttagaaataaagcagtaaaagagacacagcaatgatgcagaagagagaatagaaaattgcaggaatgcaatcctttgaggaggcaagaacacacaggatccagtatacaaatgaatgggcacagacaattgaatcttggtaagttgagcaaaggcagagagaacaggtctggatgctgatatattagtcaatttgagctgcagagacgataagtgtaagtaaaggtcatcagagtatgaaggcttggaggaacaagtattgaggatttcaaaacagggaaaaaggtggaaaatggttatctcagattgtagaaaagaagtcataatatacatgacattatgattgctgagtactgtggactgaccatttgagactggttgtcatgaatttaaagtgaaactaaccaacacaatcatgtttgtttttctccccatggttgattgctcagttgctggcttggggtaggcagatagctgggttttattcagtttgatgtttttccagggaagaacgggtcagggggattaatagtttttgcaaaggagtgattaaaaagaaaacccatggatctaagctacctatggaagaaaaaaatgggcatggggcagagtggtgatggataacagaaaaatagtaaggccagtgggctgcattattatcccaattttacagagagaacactgaggcttagagagatgagataatatgccccagtgtcacacagagaagggctgagtagcagcacagggacttgagccccagccagggctgttggtcatttggacacaatgtttcggatagggcccaatgctaagggaagggatgcaaatcagaatacaaaaataagccttgcattcaagtggcttaggttctcagtgggaatttttcccagacaaaggtaaggtctagatcagcagctaggagacatcagaactgttggtggaaactgaaagttttggttctaaaatgtgctgagaaaggagagctagaagaggaaccaaaataacacatttccctgacttttcggtttttttcctgtagtgaacctacatggaagattctgtacctcaagctatgtatttctccccatgggacttaaaaagcacatcagcgggacagcaggtttttaagagagcacaactgatacctcaataaacttcagtagacaaccttaaaaacttagggtatttttgaatgtaattctgacttttcttcaattccaagttatataatatatttgttattaaaagttttaaatgggaaaattgagatccactgaaaagggccttacctcatccctcaagggttgttggccaaaaaaacaaacaaacaaaacaaaaaacaaacaaaaaagccgacctctgattatttagcaacagagttctgcaaccattaggaaatttgtattaaattcagagaaaatgcaagtcataaaactgagcatacattttataatcagtcattattaacttaaatagtaaataaaactaaaccaaatatatattagttaagtatagaatagatgtcagataatagtgtaactgtgtgtgtgtgtgtgtgtgtatatatatatatatttttttttttttttttttgaggcagagtctcgctctgtcacccagggtggagtgcagtggtgtgatcttgactcagtgcaacctctgcctcctgggttcaagtgattctcctgccttagcctcccgagtagctggaatacaggtgagtgccaccaccctagctaattttttgtatttttaatagagatgggttttcaccatgttagctaggaaggtctcaatctactgacctcgtgatctgccacctcggcctcccatagtgctgggattacaggtgtgagccaccatgtctggccaatctgagtatattttaagatataacttctttagatactaaactgaatctgatatatttttatctggaagttattttagtttaatctcatcaaatgtccaccagcatcatacaatcttaatatatgtactcaataacactcaacaatgaaacccacttatttcatttattatgttgttctttcacatagaaaatgatagcctccattagttttccaaagctgttcaaaacattacccagtctactggaaaactctatgtaaaactgacagaatctaagagcatcatcttcacgtttccctagcattttgtataaagtgtatgttgcatacaaatggatttgtcagatacattgagaagtatgttaatagtaggaaaaagaaagtattaaggaacaattctgtatcttcagaaaattaacttaagaacatattatgtatctaatcttaatgcaactggtggaaattaccgtgtcttctacaaataactttgttccagggtaaacagtaagaaatttcactttcttttttttgtagtaatgcaaggtcctcttatctaaacatttctcatctttcagaggagtctacttgacagaccattttgtgttttagctgagaggcagtagctattaactagattgctgtctattttatttttatgtggataaagttgaagagactcacacaaaagggatttatatgtcaagaaatgccttatactaactttaaacaaaattgatatctttttaaaatatgaagctgactgtagatttttatcttttatgcatagataagtctaaatgttgcaaagaatatatatttccatgtccatgactacagtatcaacatgtatttctctagagatgcctatatttcaatatttccaagttgggttttgttttcttatacttcaaagaaaggaaaatacatttgtgtttcttttcaatgccaatacagataattcccttgatgaaatcaaatataatggcatttaaagaaaacgttgttagtaaaaaaataaaaataaaaaataaaaaatccagatgctctcttaatttggaaggtttatcagagaaaagtcaatgaagaatttaaaggttatttccgttacaatcttggattatttctttcattaattagtttgtttgtttaatgataaatattcattgaatatatgctgtgtaggagtcactttctaaacacttcagctccgtaagagtcttccaaattatttgtcagccaaaaaacctcagcacttctatgaatgtcagcaatcagtgagcaactggcatatgataacacctgggcttgcgtagagtttctgctcttccatggggaattaacttctctacctatgataaaggtagcagacactttccccttgtctgtcatttagagaaggttgggcattttctgactatacttaactttgataatagtcaaggatttcggggtttatgagataagaggtctatgaagctgaaccttggagaaaggaaaagttgaggggccccaattaaagttctcaaactttaaggaacataacaataccttaaaccagttacttgtttaaaatgccaaagatttttccctattcccctaacacacactcttctagtgcattattagttgcagtgttatctgacatttcttctatacttaactaatttatgttcaattgttttatatttctttattatttaaattaataatgcttggttgaaaatgtatgtccagcattatgacttgtattttctctgagtataatatacatttcctaatggttccagaccactgttgctacttctgattcagtaggtctttaagccagaaacttagtgttttcaaattgtagtccaaatagtataaagggagatgatctacagatcccactataataaagtctaattaaataaaaggtttccacacttttgtaatggaataaaatcttttaaaaacaaagatttatgtgacatcctggtataatatgcaaaggcaaagttatgcaaaaacacagattggtctccttgggatgagggtaatggggtactggagccaggttgtactgtcttgcaagaatcaattgttaatgttttaagaattttgtgagccctatgttaaacacagcaattattaaaaattcagttacatagccttataattaaacaaattatattaaaggcaaatgtatcaaatatgttacatgtaacagttcctcattcttttactacattttactattatctatgccctttaggttattcatatcgtatctgtggggtgaaaatacacatctcctcccagctctgttttcagtgacattatgctggcagcttgaaattggccttcttcggtgtatttgcaccacagaactcagcaaatgctacaaattaaagattttttcacctacagagccagattttgaacatttaatagcttacttctagagaagggcggatgctaggattgccagtttctaagcatctctctcaattccctctgtaggctctaggacaccacaggaaaaaaaaatgtagtttaaagaaaggaaaaaagctgacttaattatattgtggctgtgaacatgcaaaggtaaaaagaagaaatcaaaagaaaggtcaaattctttagcatgaacacatacatcttacaaatttggttatgagactataagcctttattttcttccaattccttggaaaaataacaatagactagatccaaataattattctacctggctatcttgttttgcaagctcctttacatgaagatgattacaaagatgaggctgtataatctgtgtataagtatctccagattacatctttattgtttagctcagaaaatggttcctccatcttcattgttattgatgaatgagagacacctctgcaccttctgtgaaatacaagtgatcatcttgcacaacagtaccacatttagcatttactttggcaaatttaattatagacatttatcctgcttactgtctataaactatgcttttatctgtaacactaacatataatttgatatacccccaaagtagaagaattgcacagtgcctttaataatatctttgcaatgaatataaataatttcattagtgatggattatttcagcctttcaaaaatgaaatgatcagaattttttaatgtttgttagaaaacaaagttctctttccttaagggactccagcgtatcattttaaataataatgtgtatagtcttgtgtctgtcattcagctatttattcatgaatttaattttcttgattcatttagtcaacagctattatgtaactattgtttaaaaattagatactgatattccttaagaagccttatttttaaataatctgaaatttaaatcatcaaagtaaggtgtctaaattgtagtataataggctaattagaccagttagtaattttttcccttactttgaattatatgtaaagggagcaaatgctggccttaagaattttcacttcaaagttataaagtatttacaaattccatagatggagattcaatttagaatactagatgaaaactgtgtttcaatcattcacctgtatgattgatttttctctatagttgatagtaaattcagtgattttttggaaatatgtatgtgaaggaaggatgtaagtctgtgacatcatgcagtttgaagtctacttttccttggggtattatgcagatatgtagatttgcctattattttctttaataaaattggtgtttttttttctgagactattttccaggaatgtagttttgatcttagaattgattttttcctccagactgaggaggacgcagatgtcaagaagtttcctatgggatatggcttgacagagggacacacaacaggagtcggaggttacaataagaaaatatacttactctatgacatgtgggtcttgtaaggaactgacattgatgggaagtgatgctttttagccaaaggaagaagtatctatcatgctgtcacatcagattcggttcaaactaagcaaacatttgtgttatggtactattcttgggaaatatatttctgaatgtgctcttggctctttagatgaaaagtcataaatgatcataaaatacataaaatggtacctgtcataataagcaaatgataaaataaatttatgcttattataactatcaacatctgtatgtgtaaaatagataataaagcaagtgtctgaacaatgcagcacatactagcttcacctaatgcaagcaatcagctattctttgcctgtctttgcagaagattgtgaccaatgatataatgagtttgaggaggctgtttttatgattaattcataaataagttaatctagacttatttcaggtctgggttttacatttgatgactcattttcagagcccagaaaataatatttaagggagtattaattggattgaaacttttaactgtgtgggtgttacacaaattctatttaatcctcagtgtgttagattaattttccagtattaacaattttaattcattctacctttatcagtcttcagcctcttcttatcgcatgcacaacagaaaaacagaatcaccaaaaatgtatctttagactgtaattcttattttgctgactcaaaatatgtgccaaaagactgataaaagtctgattttccaatagttcatttgacgtttgagtccttttacgtcatcttcaagctcatgcttgaacttttctaatgacagggatatttttgtctttaagcaaccatttttgtcatatgtaggtctaactttcagaaatgtatattcaaagttctgtccctctataacgtctgctcatttgtcataattgtttcccctgggactataaatacatctcatgagtttagtgactttctcttgcggcatgacttttaatatttggggatgtctgtcaagggcccccctcccccttctctccaccaatgcttctcttctccaagtaaaatattcttagtttctacaaatatttctctttgcttgtcagctccctacttgacttgtcatcctcctctgcatagttgcaaatgtcatgtgactattagacatcccttaagagtacctctctcatcttaagcacagcattattattcagatgtgctacaatcacattgatgttgtgggtggtcacattatcttatggacttattatggatctgattttccatgaaaacctataagtatttcatgaatgatgctgacaaactgcatgtctttcattctcttcatgccaggctctgtctgactcacatgcaagacctcttcatgtatctttgttacattttatcttacattaaccccactgctacaacctctcagggtaccttgtgtcttcatgcacttattcaacatcaataaatgaaggttagttgtacacctggaatgtgtccggctaaatcgaaaatgctaattctgtggctcaattatttgacacaccattccagcaatcttctctaccactttatttcatccaccatacccaggccatattttaatcttgttttcttctcctcgaagcgactttcactaaaaaccttaaacttcaaaaccatcctatatgacagcccctgtgttcatctgaatctctaatgtctccgctctcaataaactgattagctgataagcctcataaacactttcaacttgctcctttcttttttttttttccccaggtattattattcttattttctcactctccttttaaaactggaccttgtggttgatcaagtgactaaccatattctgcaccctcaagatttattttatttttgcctttatactatcatcatttatctcatatagtcctgatgaactaccttgcctgttcttaaggtcaagctaatcagtgctatgggagaaaatcctataatggctgaaaagcatagatatgaatgaccctaaaaaagccactaaacctttctacatgttgacgttctcccgttctttacatgtgtcatcataccagttattaatccaattcacctgtagtgtcctccctatttcttcatgtaattcacaaaaataattcaaatattctgctttaccccaaaatacacatttttttgcctatatccaaaaggtcaagtaatatgcagggatagatctagctcattttcattcaaactaaaatcatatcaagaaacagttttcagtctttctatacactttttccctagaatatttgaagccgatttttttaggtaattattccaggtttccttttcatcttatttcctgcggtttcaaggtcaacatatttatcatattttcattcaaagccataacaaaaatgagtgataaacagaaaaatgattttcctgcttgacttcctgtttattctgctaaactataatctgattttacttaaaactcttccgagttacctttgtgaataattcaccaagcatgtgaaccactgcttatataacttcatgattgttataaacaccttttttatgtggcatagttcaaggctcgaaccaaaagtgagatacaggaatgaagcaaatatgtttgtcactctttctcatctcaaaatgtattggccaggccaggtacagtggctcaagcctgtaatcccagcactttgggaggccgagttgggtggatcacctgcggtcaggagttttatatcagcctggccaacatggtgaaaccttgtcactactaaaaatacaaaaattaggaccaggcgcagtggctcatgcctgtagtcccagcactttgggaggccgaggagggcagatcacctgaggttgggagttcgagaccagcctgaccaacatggagaaacaccatctctactaaaaatacaaaattatctgggcatggtgaggcatgcctgtaatcccagctactctggaggctgaggcaggagaatcgcttgaacctgggaggcggaggttgcagtgaactgaaatcgcaccatcgcactccagcctaggcaacaagagtgaaactccatctcaaaataaaatgaaataaaaaatacaaaaattagccgggcgtggtgttggtcacctgtagttccagctactcgggaggctgagccaggagaatcgcttgaacccaggaggcagaggttgcagtgcgtaagatcacaccactgcactccagcctgggcgatagagtaagaccctgtctcaaattaaaaaaataaataaataaataaataaaatattggccagtcaggtttttttctgcttcaagaccccagatatcactcaacccctggcccagtgtctcacacaagtcataagtaggccctgtgaaaaccctcactctcttaaacagtgacttagggtcacgtgtttaaaagaaaattagttataaaatcacccaagcccctcattttcaagactgtgtaaaatataggcacatccaaatcccttggcaatttagtgacaaacctgaaatctgactccagttttttacctaaaccagtgcttactctggattatatcaaaagaaaacactgaggaacacacatgtggattctcagtgaagtgataatgccttttaatagctagatctcttgaagaagtaacaatttgttctgtaattattgatttaaagctgaagcttttgatgactagatggtttgttcctttcttcttctcttcctccttgtaaatatattcattttatcacttacacaagacaaatatgtgtcacaaacggacagtcatataatttttgtttgaaaaacctcatgaggatgggtgccctctagatagccaatttccattcttttcattctaatgttaatgatgttatttaaagttattggatacacagcatcaaatgtcattatttcaaatgacttcatgacacagggttcattgtgtaaggaatatcaagtagaggttctcaggtgttgtccctttaaaatgcaaggggagaaatgcaattgctattttttatttagttacctaatgcctgcccatcatgtctttttgaatttggcccaataacttataattaaaagactcattatccctgctggatgtgggcacaaattcacattatttccatggaagcctgtctgctgtctcactttaatgaaaatttaaaccctttagaatgacatgtgatgcttggaattatttatcttttgtctgagtagagttacaagaagaaagaactcctagaaaaataagtcactatttctttctgcagattcttgtcttccaagtaagcattcttttttgtttgtttctggaaagattgacagagaaaactatgaaagtatcagttagagcagaaaaaaattatggactctcccacctgtgcacttttgacctggtatttggctatcttttgtacatgtagtaaaatatacataacacaacatttaccatttcaactgtttttaagtgtacaattcattgacgttaagtatattcatagttttgtaaccatcaacatcatccatctccagaactttttcatcatctcaaacagaaactctacacctctttaacaatacatcgccgttcccctcttccctaagaaactggtaaccactattctactttctgtctctgaatttgcctattccaagcacttcaaacaaatggaattacacaatatttgtcctttggtgtctggcttattttgacatgtttctgagatccatgcatggtatttaatattatggtaaattttttgttaagtataattccattgaatggatacaccaaagcatctttgatgaatattggattgtttccatttcaaggatattacagataaaactgctgccacactgttggaaaaggctttactggacataaactttgtctcgtgtagatatttagaagtaaaactactgaatcagaatttagatgtatgtcttacttaattagaaataattttcctaaatgattataacattttgtattcgcaacagaggtatatggaaattccagttgtccaatcccaaccaacacatggaatttgttgacatcttaattttagcaaatctaataggtatacagttacatcaccttgtggctttaatttgtatttctctaataactaaaagtgttgaatattttttcatatatttgaccatttgaagattcttttttgcacattactttaggttgaattgttaatcttctaaattatcaatgtgtagaaattctttacacattttaggaaaacattttaattatattttggtattgttaacattttctacaaattggaggcttacctctgtaagttggaggctttggtattgttagtattttatacaaattggcggcttacctttttacttttttaatgctgtcttttgatgagcagatgctgtttttattttgttaaagtcagagttattgattttgaccttttatgatctacttaagaaagttttgtttaccccaaggtataaagatattcttctatgttttactagcttttacatttaggtctgtgatacaccttgaattaatttttgtgtatagattaaggaaggggccaaggttatttatataggtatccagttttgtcggcaccatttattaaaagagttctctttcctcattgaattatttagtgcctttcttgaaaacagttgaccatatatgtatgcacatttgtgtctatttctggatcttattctgttccattgatctatttgtttatccctatggtagtaccatgtggtcttatttgctatatctttatagctcatcttgaaatcaagcagtattaagtactctaatatggttcttttttttccaaaatggaatgtaactatttatatatgtttaaaaccgttactctccacaaatatatatatattatatattctactgagagtacagatctttatatatatgatcattatatgtatgatgagatcattatatgtatgatctggacacccagtagaatctagctcattagattgtccttcacagttaaacaatgcaaagcctatagaagaacattatgctaaatatgtgggtgtgtgggtgactgagataaaatagaaaaaaaggctaaatgtttttggggtacctgctatctgccagtattctgcaaagtgttttatatatcttggcatatttgaatttaattttcacaaaaattctgtgaagtagttattgtctccattagtggatgaacaaagtaagggttagagaagtaatttgttcaaaatatttaactcgaattcctttcatctttgatggtcacagccaatcagtagtcatattgagtgctcatgcagggtgcctgctttgtggttgacagctggattttcagctagtgacaggtttgctatattaacctagtcagttgtcacactgactaaacatacaatttagagcgtagttttaataattctgtgacaactcagtataccttccataaaaaaatgcatctaaaagtacattatttataagtgagttcttgtgaaagaaatcaaattataattcccattgttttacaaaatcattattgagtatacaaagttaaataaaaataacatttatttcatcaaaaaatgtctgacaaaccgagctgctggcattaagcattactagttgtgaaattatgtgttagtcacaaaatcaatttaaataaacaactagattatcatcttgccacccctgaaaacaaagaccttagcacagaatcagatttaatcttcaaatctattacttaccaagaaaacctaagaacacaatttgtttgaaacctttaaacctattactttctaaaagaatctcatggagcactgtgcttgaccttcacaggataaactttgtagatgtcaggggttcaaagcaatttgtttcttatattccttgaatttatctactatatgttgctgattatttccttcatgacagctgtttttacttatgacacacagaaatgcattacattttggagaattgcacttgattctactcttccaatagatattctaatttattatctgatacgtagtgttgggttctaggtgaatcatgactcctagaattattcaatgtgaacactttattgatgatagatgttacattaacatatggtagttgtgttccataagactgtaactattttagaaatatgttcacaatgagacattaatcttttagttatgcatattaatccttataaagttttatgatatacacagaattgaaatatttccattttcatttaagatgaagaaacaaagaatcagagatattgatatttgtccaagcactcacacatttcaggggtccctttttcttataagctttttgtgtccaagctcttataagccttatgtgtccaagctctcacacatttcaggggtccctttacttagaagccttataatactagtaaacactgaaaatgtaaagatatatgagaagtatgagaagtatcattgcaactaaggaactcagagcctagaggactgagacaagcagccaaacatgtaaaagtgaaattgaaaaatgctgtcatacaggtatactaagaggagaggagaacctcattgtatgggtaaattttcctacataaagtgaacccagagcaatcagacagctaatatttattgaaaggaacaatgtctgttatgtgtcatgtaaattagccatacctagtattatttaaccttcacaaaactccagcaaactatcgcaaggacaaaaaaccaaacatcgcatgttctcactcataggtgggaattgagcaatgagaacacctggacacaggaagggggacatcacacaccggggcctgttgtggagtggggggaggggggagggatagcattaggagatatacctaatgtaagtgacgaattaatgggtgcagcacaccaacatggcacgtgtatacatatgtaactaacctgcacgttgtgcacatgtaccctagaacttaaaatataataataataaaaataaataaataaaaaataaaaatgaaaaaaaaaaaactccagcaaagtccattactgttctccattttatagttacagaaactggagggaagaaaaacctaaagaatagaaaagatgaaataaccctttatggttcctcccaggtagatcattttggggtttttcaaaccacagagtcactgcaccatgagttacttcagttttcttccttgtttccagttaatcatattctctgctctaagctctttagtgatagctcatgtcacaaaaggccaggatgagagatgatggttgtgctgataggtgagtgaattcacggagcagagacagaaatgagggagaacgcacccagagaaaggtgcacaggggcttacatcactgggccctttgattggtgtttttgacatgaacacaaagaaaaatatttgaaaatgtcaaacaaaacctcactgattttctaccttgagtagaagaattcaaatgttttgaatgcttaatatttgatcccaggaatcagagaattgtgggaaaagacctccaatttttcttggtttcaattcaagggtgttcaaaatgatatacagtattttacatggcctattcaaaaaattattttattttgaataaccaagggctgataatataattcatgccttttatcttagcatgtaaaagtgctacataagtagaatggtagcataatacacattttaatcagaacaagggcagagcaacgaaggcaatgctttttatttttgttagaggagaatggtgagaaaatataaaaaaacatttagacattcaaaattctagttctagagttaaaaaaaaaaaaaaaaaaaaaaaacaacaaaacactttttccccaatgtgtaatatgcaatcaaaagcactcatgcctctactgttttccagaagaataaatatgaaagttataattactatgaaagttataattacttttatattagactagatttttttctggagatgtttttaaaaggggaagaaaaatcagataaacttatagacatgctcatatttaaaaataaatgaaaaagccacaaaaacagtcaatagcaagcttccatctttactccttacactgaatattttcccatttctgaggctgcctcaattcatcttatgtcttatcaagaattgtgggatcaacaatcatctctgtgattgtcatagttacaataaattttatatatgaaaagcagaggaataaaagctaccaatcctgggtttaccactggaaggatcagaaggagctgtcccctgttatccaggtaggaatatttgtagacaatgtattaaaaagtgatcttcaaggcataaaaggtcttggtgtcagactcaatattaagtccctcttttcatttgcttgactttttatagctaattaacaatctagccattgtttcccttatctgtaaaatgagactaatactaggttccaactctcatgagattgtcgttgggactaaataagataatgcctctaaatgcacagcacctagaagaggttgtcattatcatttttatcatttaatatttccatttttctctgaggctatggctacactcacaaactggcttgtcagattctatttttaaaaagattgcatttagttgatccatttttcagatatttgtaatagttacagataacattttcacttttagagagtcttgttgtactgtttgcatattgtttaaatgcatagaagtattgttagggcactagcctatgctcttggtgcagaagagccactgaaatgtgctggggagttggaaagtcctcagcaatattacttaccttcttggtaaccgagatctttgagcttctgaaaggaccttagttcccataaacaatttgaccctgaggctgggaagtaatgttattccaggagaatggatgagagtgatcaaaggcagagagatgaggaggtgtaaggtgaagtctaaaggtggggcttgagaaggtggcttggtatcttaaatttgtgactgtcaagggctaggctaagctggagaaatctgatctgcttcaggtcagagtagccattagctgatcaagaaaacaagccgagatgaaagtgacagtcaagcctttaatcactgaactgcaattgtacaaggaagaggttaaccagagaacacacccattctccccagtcctgctttcccccacggagcagcacctgtggagggtcaagtggaccaacatagacaaggggttgtctccctgatgagggagctctgaaccaaagcttcccgcagtttcatggtccctggggctggagaggtggagaggaaagagctaagaatgggaaattactgcacactgagagtggagaaaagtgtcttcaaggttttcttctgcttccgccataaagagaaccaggcagaggtacctctgcttgaaggcccagacaaagaacctctgaatgatggtgcctgggctggaaatacagatgtgcataagagcatggccagccagggcgaatgagtccttgcctgcaacttcctttggaggttgcagtggctgcgcactaagtctggtatggggaaggcaggttccctctgtgtgatctgccaggcaaagcctttttgactgaccatggccaggtctggaaaatcacacatggagttttagctagaagccagactcctcaatagaaggtagtcctatagatctccagtaatagtattcaatcaggcaaagaggaagtcaaattgtccctgtttgcagatgacatgattttatatttagaaaaccccatagtctcagctcaaaatctccttaagaagaggacttcttaaagcatgcgcagtctttttaaaaagttttcctgcttctctttagttgcaacaaaatttttcaaacagggaagaaatggtgggcttgtagtaaagaacaaacaggaagactgagtcttaatcaatcactggtaacaaagggaaactacagcagctgcaaatttcaagggaagacaagtgtgttaaaacatttgatttagaaagtaaaggagagctaattggctagtgtagacctgtaaacaacctacaaaaagacctatatgcttaatgatataagtttccaatgggacagccaggaagatattactttgtagttgttctaatttgcatttaggactaaatgaattggcatacataaaacacctaacacattatctgaaacatagtatttgttcaatcgatatctgctccattttcccaagtaagttgaagagggggtaaatatacaaaatgacctactcagtgactatatattagatacctactactgtaagctttcttcatgataaggtaaggccattgcctgtaaagagtatttattcttattggggacatagaaaatgaaatttaaccctatcatgatagtatctaagaaccaaataaatgcaagaaagtaataggataccactgtcaatgacaacctgttgttggcattaagagtttacacatctctacaaaatatgctggacaggcctgatacacaccatgggtcagttttccaaaaaaaatgtgccagtatcacattatccaatctttcacatactttttataggcactgaataaaagtatccttatcctccctaggggataaaggtgtccagacctatgatgacaagtaggtgtgtgtgtgtgtgtgtgtgtgtgtgtgtgtttgtgcatctggccagtgaacttgcagggtgcaagctctcacttgtcagtgctcattttgagatatggcagtaccataagtggtaggtgagaggaccccaaagctataaaagttgtctgattatgattcaagaaggaacatttttaacatgttgaactgatgtgactcaaagctgtgagcatttctggattgaaaagaaaagcagaatgatgagaaaacagtcctattttggtttatgtggcatagatgctggcaaggaaggaaatgtcgcttgagctatcaaggagtcgggtcctcattaggagtgtgaagacaacatctgactgtattgtggattttctgggggaagaaagtaaacacctctttcttaaagaagaagaatcatgtagcacagctgggaagacacttcaaaagtgaccattgagaaacatatcaatccaaaccctgagagttcaggaaggaattggtgcttggctgctgtctttagcaatcacgttttaaggatctccttgtgccagacattgaaaatcatttcaaaggcttaccaaggagacaagtattattctctaacccaccagaggctaacaaatgagatgaggcagggactagttgcctctttgtttctgaactgttcacagtagcttccatattagtttaatcaaaggatgtaaacttggcaaactcagagtgctctctgggaagaagaataatttgctggcagattatgtggtttaagaagctgcaaggaaacttaatgctgctgaacgcttggaaactatcatcaggattcaggctctacctctgagattatcatggagtattaacgacataatgtttgtatacaaaacagggtcactcaactgaagtgaagggttaagaacaacagatctgactccccgattcagctgattcctctgaagaaatggaaacataaaagtcttctctttctttttattaaatattttataaactcaacacacaaatcttctcgttagccaaaaaagcaagcttatgaactgtcctcagaatttaacttgacaaatgcaatgccctaaaattctaagcaatcatcaaaagcagcagataggttcccagatgattatgaaaaatatgagtttgcttctgcataatatacacagttttgtatcattagatatcaggctattatactgcagcagatgtaaccagatgtgacggatttttcaattcactttctcttgtcacactgagtttttttctttccaccatggaaaactgaatgttcttcactggaagtttgatactttattatcttaatttcattttataaatctgaaaaatatttccctttaaaatagggatcacctacagaagggatgatgctctacttccagtatgttattgcatggacttacagttaaaaaccagtgatggggttccttttaccaagtagctccatgcaatcctcaggataattttataggatttgaaccaagtgtcctagtacagatatgttttggtgatctattgttatggaacataccaccttaaaacttagtggcttaaaacaataacttattatcacttgtgattttgtgtgttgactgggttcagctgtgtggttcttctgctttatgtgacataagcaaagtctatatctagggatttgacttgactgaagaatacaagatgacttacttgcattgttggcagctgatgttggctttgtcgggaactcatttgggactgttcacttatgtgcctcttatctccacgtggcctctccttgaggcttggacttctcacaatatggcagctggatttcaagagggagtgcaccaagtggaatgggattacacaaagctatggttcattggggtccctttgtagaggctagaagtcacaatttggaatctggtttacatattcctaatttatctttaccccagaatcacagtgtgtgatactgtctatgagatacccaaatttagattgcctatactatattaagtcattcatcctgcctttaggggataaaagcaatatatcctatcattttaaatgattaaacattttaatattctcaatctaaatgtgaattagcatcagtggtggcttagttacttgtgatctttaaattttctcacttctgtctgaacctcagtttcatgagaaaatgtaattagagtcatatatttggatgccagaaataccatcttactatagtccatgctagaagaaatctaagaattcacctaattcaccccctatatttttgcagaaaagaagctgaaacctgtgaagttatgatttgttcaaatcttccttccccatttcaatcagagctgcttctctgtcatctgctttatatattgtgactcaggtataattttatttggaatctaagtccgataaaataaagtttgagaaagaagcagcatagttagtggttaaaagcacagactatgaagacagactaccttaggctgtgttctgtatgctctgtgcctcagtttactcatttgttatgtgtggaaaagtaacatcacctgccctacagagtttttatgtgtatccatgagcttatgttggtaatgtacttggaactgtttctagcatatgaatagaattatgtaagcactggtgaaataaatacatttccttgaagtaatgagagatgcagaaaaacatcagatatgtcggtttacagttcaaattcaggccctaggagtataatgtttctcctttcgatggtatatttttaggcatggagtcagtctccttaagcaagtctaatacagatatctaatatagatttaatagcaaaagatttaacagtaatccttgtgtatcagttagaataccttagactggaaagaacaaaaatctcaacagtcttaagcaataaggagtatcttattttctatctctatgcaaacgtcaaggtcacagtcataccttgagttttacttgtcaggctttcgtagtttagtttatattttcttcatcctgactccctggctacctcaggttgtaagcctctcagagtgactccaggagttggctgagcattttggataccttcacaggtctgcctgggtgtcagctgtcatgctttctcaggttcctacctaacaccatgtctgctactcagagcacacttacggtattgaatagttctccctgagacttgcaatcatcatgacgtttacccagggatgaaagcataggtcccctcatttctcagatttctccttaaccttttggatttctgttactggccactactgttcttagaatcagtcaggaggccaggctttagcacccttctttgagattcattaaaatctaatctatttatatttcagctgaggcaaattttattctcaagcaggggtttcctggctatttactcactttctttcaaatgtaatatttatagccctaactattaactggcttcctaggatttcatcttttacatattaaaatattcagctatcttgtgtgtatgtgggaggaggttgtcagaacatcactacttggatctgagaaagggtcaggcaacaaggaaatgcaatgataaatatctcagctcatatttctttattttatctggactaatgcagtcacttagtgaagaaaaaaaaaacaggtgaattaaaagtaaaaatatatatatttaaataaaccagtacaacaccatagacaatgttgcctcatgggcatttattattaactcaaatatttatgcagaactgctatgagaattcagaatgtatttcaaggccaagttggtcaagaacagtttcccaaagcaggatttttatataggtcatgaataatgactataagttgcatgggaatggagagtagaattgcatggtatgtttttagtagtagaatagccgaattagttacataaagcctgagtattataaagtgcgtttgaacagtagcagatggaacagttgcctggagttgggaattcatggaaataagtccaagctagggctctaaatgcagttagaaaagaagatgaactttagtatagcctataaatgatggttgggtttcatataaggtggtgggaaccaaggaacttgagtgttctaagtaaaggaaacattggagatctagtcaaagaaatgggagcatctgggaagactcagagaatagagcattacacttctactgaagtaaaggctacatggcagagtatcatgagccatgaaactatacacacagtttggacttggaagaggacaaccttagattacttaaaaattggacattgtcatatgttatttttaagaatgaaacctagaagtggctttttcttctgcccacattcaattggccaaaatacggtgagattcttcttgatcctaagtctaaggaagctgagaaatatgacccccttgagtgtccagaaagaagacaccgtgtggtgagtaatattgtttagacatcccataaaatgttgtatttaaaatttggtgcaaaggtggctatttccaggaaaattatatgtgcttataaatagtgaagattatttttacaaaccgacattaaactcctctactttcatagcttactcttacgaataggaaagagcataggagagtctctagcacaatacaggctttgacaattaaagagaaaaataatgtcatggttgctaatactttgtttatttgtttagagtgtagcaggagtcacataaagatgtagattgatttaatgtagctattaaacgtattaaatacatttttatagatgttaatttttaaaattcttactgtttgaagttaaccatttgccaaatgatttaatgcacactcttgagtgtgggcttttgagaccactcttgcttggaaactagtctatttggtttggttacccttagaagttgaagcttcctttaaagtctattgaacttcagaaaattctttttattttcaacagagccacagaattcttttcctgtctttagccctaagtctaagtgctttaatatccgtgtggacatcccatccaatactctagtttcataatttcttgactttctcaagtcccatgacctttcagccatacatgtcaacccattaactgctccatgtctgatctctttgaatcccttggtttagcagaatgtcaggaatgttcaggaatagatgctcaataaatgtttactggattaataaatgggttaatgttgggtgttccataaatacagaataaatatatatgaactgtttgttgactaacagccatcctgctcttgtctttcctaacagcagctctattttgatcatttatctatctcttcccccatctctttatgtatatgttggaagatggtgacccgacctgaacattcagagatgggcccagattaatttatgacaattctggaaatcctaaacctttgtcagtgattacccccagaatggtcctgtgggcatactgtggccaatgagacttaaggaaaggattactagagggtcctaggaaagttcttccccatttttagagggtagcaatggaaaaccactttcactctctcccactggaagtgatcaagaacacatcttgtccttcttcccaactggtagtagctaatttgtgatcatgaagaaggccagattgaggacaatccttctccataggagataaccaagcctggaaaatagcgaagaacgaaagccagagctggctcctgtcatgtgtgacattcccctgccacacctctgcaattccagttcattcagccaattaaacactttgttttttaatgccagtttcaataaagttgctaatatgtaatatcaaaagcaccatcctgatacaaaatctctagccagagaaattggatgatggctttaaaataagaaagtaaaatcatctattcccttattatcccccaaggattgacaatattctttctcgtcagtacataaacacaaaaattgttttaaatgcaaatatctaaataattcaattacattggcaactatgtattttagggggaatttttgtttggcatttaagaacaaataatatatttgcctgaaagttccaattttaccttatgtggatggaaaatcaggatgactgctctggttctgtttggcaccttctagagttagtctgtattcctttcacatgaaaaatgtcagcatagaaattttactgctttcctgctgagtttaacttgctttaggacagctggatcaggctaggcatgaacgtgtaatgtggattcccatagtttttaatgagctttaggaatttacacagtttgcagagttggttcactacattgtcaattttgttacatcatttagtaaaagtatgtgttttttttatttgaacaaacaaatattatagctatcttctagcaaacaaaaataaattgccaatgtatgtgttgtaccccaaagtgacctaggtgggtaccattctaagagaagtctcaggctaaatattgatggaagaggttccatctagtcacgtgtttttgacatttttacaattagggttttatgacagatcaagggctatgtctacgacctcggggtagtagaagtctatttcatgaaaaaaatagggattaaaacatatgtgtaaaattgatgaagataaagtagatattattgccctggaaatgtggggtagaattaattactcatttgttgtaccaaatttgattctgaactgcctaccatctaagacaaaaataaacagtgaattacatacttttccttgtctatggaataataggaggcgtaacagtagaaagaaatgtgttccctaagaaccacattttaaaaaacaatattatattgttagatttctttcttggaaaattttagccaaaatgcaaccatgtggttgtatatagtcagcacttatttcaaccttcaataaaagttaatggcatcatgattaattgtaaatctctgaagacatttataaggaagctaatgtaatgccttccaggtatgttgctctcttataatcagatttttacagtcataaaatcaagttggatttttaatcacagaatactctgctcaaatttaattggattttggataggagtgaagacagaatttgaaaataaggctcttcgtgaagatctgaagttcagatactctatgatgttgaaaagacattaatacatcttaaaaatcagactcttgatgcaattctgcccttaagagagaactgttccgtttttttaaaatggggtggagttgaatttccctcaagaagtagctttaagacatactgatgatcaggttaagtggcttctattactataatttcttaaaggtgaaatattcactatatagattctgtactccacacgggaaattataaagttttaccatgaaagcttccatttcagattaaaaactaatttaaaaaaatgagagattttagtttatttcagttttcttttttaatcaagataaatgactgcaccctgaattgtgcttggggttgcagctctactgtagtttcactctaggacaagtgacttggcaatcagctgtctctaaggaatctgactttctttactatacctagggtccctctgccttgtttcactctgatctggtgtctgcccagctcccagacctacaggcaatatctgcccctagtctcctcccctttcttccacaggcttctggaagatacatccttcctagtgtccttcctctcctgtgttccatctcctacagatttctcaggggtctcactctgattgtctttcctctcttatatctttaactgcccactcagtggcttttttctcattttcactggactgtaatcaactgtctaccatattaacaaaaagttgctttaactgcttactctctgttctttccttcatagcaatatttttgaaaatgttacccatgttcaggatctccacttccgttatctcccttgattcctgaaaccctactatctggcttctgctgcatcattttcctaaacctgttctcatcgaggtcatccgtgacctctatgctgttctttccgaacagatgagccttgttgtgcatggtttaccattcccttttcctggaatgagtttctatatttggcttcttgtccttctctccatctgtcttgcatcacctttgtggcctccctttctcttatagttcccttaaatggagactccttcgtctcttacaccatcatctctagtcttattccctgatctgattattagaatctatcatcggctccccccaacccctgctttctgacagatgttgttaaagcacctctgtgattctgtctgttcaccgcttaaaaattcaccatgatttcctaatgcttacaaacagcctcatcttatcctggcaaggtaacattttccataatcttgttttcctactgtacaatatctgtcttttgttttgaacgtaccttcttacctattccacattggactccgctcacttttgtatttctttatctttaaattagaattaagccatttaaatggaaatgagcattgtgttatgtcctatggatataactaacaataacacaaatatgatttgtgcatttatatgctaaataatcaagaacttgtcaaatcatacctgtaactcaaacctcagctcaaatggagtcttcttacatttatctaattctaatcttttcatttagaataagtatggattctctttgaaatcacatactcttttttgggttttttaaaaagttacatacagcactatcaaattgcgtgtgtgagtgtgtgtgtgcatgcaagtagacactgtaccacataggtataggaatggccaataataagaagaatagatgctgaatatcattagtggttagagaaatgtgctcattgatgaagcaccatatcccaccatcattcatgacttgtcatcttcagtatattgaattaggtgaataaatgcatcctcccatgttttcacttccgtatattgtccttacccctggatatcacaaaacactgactatttccagggtgttgccactacctttttctgctgaggtctcttcatttcaccccactgggctggatctagaataatcccaggaagatgttctctggcatggtctgatcctccacaatatgtatgtatccatgtatgtttcctatatttttaacataaaatcaatcaagataggatctaagaaaattttgtcagatttaagtcaaatgattttgtctaataaaaacatcaattacgctgcttcacactcttatactctgtatttgaccttcatttgttgcaagaaaccccttgaaatactatgtcatttaggtgtttatgtattttgcatgtgctcatttacatactgcataggattttagacgatctacaatacagagacagaataaaatagaaataaagtattacaccacaataaaaatagagttaagaaaaagaatgaccccaaagaaagactgagacttaatcactctgggggtttaggtggttcatgtgacagtatgttgacagaaaaatagttgtcaaattgggtttcataaaaatatcttaaatttaatacttattaccaaaacaacacatttattttcaaaccccaaaaggcaatttaagaatttctagttagtgcaatctaaagaagattcaaacattccatgagaaataatgaaattgtgctagaccaagcaatagcaacaatgaggtgtgaaccatcaccaagcatctttcttgttactactctatgctcagaactaggagaagggctgttcaagattaagggagaagtggaaggcactgagttcaagatgttgacttgtctatctggagagcggagcacataaaagacccaattattgatcaaaacagaacagactaaagccctaagttgggttaaatgagcaatttggaaaaaaatgtttattttcaaaacaatttatggagatagtttgcatttgtataatatattttgactgcatccaatgctgtaattttgctttaacaaaataagtttagaaaactaaaggatagaattataacatgcttctccaaagtcacatagctaatgatataataggattagcacttatatttcctgactcctgataaattactcattttattcatgtaccattttcgtattaatcaaaaatatcattgtatgtcagaatataacatatagatacataaataaatatgaaaaaaatgagcttaattcaaccacagatgtaaatgatccaaaccgagacagtcagtaggatccggaatattttgaaaatctaacaacacagcactctttcttttatatatttctttgtgttgttgaagtttccgtccaccccctcttcctatactaatggtgaatatttattaaaagcttattttatgccaaccatgattttaagcatttcataagtattattttacttaatactgaaaaatccctatggggtagaagttgttattatctccattttgcagatgaggaacaggataggacatgattaaataacttgtccaaggccactcaagtattaaatattagaatcacagcttcaattaaaggtgattctgaatgtcctcttaggttgaaaatgtctaactctaaaacaagtggcgtaccgcctcaaataatgtatagaccagtttggtctcattataacaatactctttattaatattgcccttctctaagcagttgaaaatactctgaaaaaaaatcactaattaactattctgtcaattatgtcatattgtttctatttttaaatggaaaacaacatgagctttctcaaagccagcttggtagcagtttcaggaagaaaatgtggatcaaatttcttagactaagacacctctcatacagacttaaggagttagattgaaactaattataaatccatgacatttttatttaccttagtataagaaatcatcccttcctccactcccagccatgcatgctattctacatgactaatgagttaatttgagaactgatgcttcatctggaacaggtgatgaagggtatataggaatcagtgttagatggcaggtgtctaaacaatgcctgattaaatgaagtgtgttttccctccaatgtattagcataaagtgtcatatagcctcagaagtcaaaaacatcaggagagttgtaaaagctaatgagccaagggatgtttccagggttctgccattgtaaaaaagaatgattatttaatgtgtgtggggacaaccatatttatttttgtatcaagcaaatatcctcactcttagcgtaaataaaaagtcatctgagcaacagggctccaagctgccatggttctttgctctgaaatgataactttttcctggaaaggtagggaatccactcagcacacttgaaagaagataatgggtttcagattcgcctattactaaagtggtcatgaatacctgggtggggtctgcctctgggatggtatcaaccccaatttgtactggacttctttagctagttttcttcagaaaggtagatcccagagctatcagcacccagagctatcagcacctgaatcaccattaaaatgcaaattcagggcccacttcagtcccattgaatccctctttcaaagtataaagatgaaatctacattcctgggaatacttgtccttcttccctattcctaactggttcttaatcaggggtgtgacactctataaaaatatacatgccaagcccatcacacccagttctattcccatgcaggatcctagggaaagtttattagcaggtgcatttaaaataattctctagtgattattctgaatgtcccctttcgttcagaattgtcctggatcttattaaacaagtggtcttaaacctcactcagggtgagatggaatcatgcgtaggtataagcattatttgtgagattattaatgctgtgcatccatcagcaatatttctatgaaacatagtaatattgttgcaataagagaaagcatataacatatcctaatttaacacaccttagggactacatataggacaggcatttccccctaaattggaagactttagagccctgccctattctagtctagcccagttgttcaggtaactgcaggttgacccactcctctattggaaacaatgagtcagctattatgtccacgtctgaaagtgctttcctgttgacacccaagatattcccagggatcagctgggaagcattcacttctagcttcctgggtattcctatcagaatcccaggcctttcgggcccttctgtccacttgtcttggatatgtggggaggttttttgtttttttttctattattattatactttaagttttagggtacatgtgcacaacatgcaggtttgttacatatgtatacatgtaccatgttggtgtgctgcacccattaactcttcatttaacattaggtatatctcctaatgctatccctcccccctccccccaccccacaacaggccatggtgtgtgatgttccccttcctgtgtccatgtgtcctcattgttcacttcccacctatcagtgagaacatgtggtgtttggttttttgtcttgcgatagtttgcttagaatgatggtttccagcttcatccatgtccctacaaaggacatgaactcatccttttttatggctacatagtattccatggtgtatatgtgccacattttcttaatccagtctatcatggttggacatttggattggttccaagtctttgctattgggaatagtgccgcagtaaacatacatgtgcatgtctttatagcagcatgttttatattcctttgggtatatacccagtaacgggatggctgagtcaaatggtatttctagttctagatccctgaggaatcgccacaccaacttccaaaatggttgaactagtttacagttccaccaacagtgtaaaactgttcctatttctccacatcctctccagcacctgttgtttcctgactttttaatgatcaccattctaactggtgtgagatggtatctcattgtggttttgatttgcatttgcctgatagccagtgatgatgagcattttttcatgtgtcttttggctgaataaatgtcttcttttgagaagtgtctgttcatgtccttcacccactttttgatggggttgtttgtttttttcttgtaaatttgtttgagttcattgtagattctggatattagccctttgtcagatgagtagattgcaaaaattttcttccattctgtaggttgcctgttcactctgatggtagtttcttttgctgtgcagaagctctttagtttaattagatcccatttgtcaattttggcttttgttgccattgcttttggtgttttagacatgaagtccttgcccgtgcctatgccccgaatggcattgcctaggttttcttcagggtttttatggttttaggtctaacatgtaggtctttaatccatcttgaattaatttttgtataaggtgtaaggaagggatccagtttcagctttctacatatggccagccagttttcccagcaccatttattaaatagggaatcctttcctgatttcttgtttttgtcaggtttgtcaaagatcagatggttgtaatatgcggcattatttctgagggctctgttctgttccattggtctatatctctgttttggtaccagtaccatgctgttttggttactgtagccttgtagtatagtttgaagtcaggtagcatgatgcctccagctttgttcttttggcttaggattgacttggcaatgcggactcttttttggttccatactaactttaaagtaggttttcccaattctgtgaagaaagtcattggtagcttgatggagatggcattgaatctataaattaccttgggcagtatggccatttttacaatattgattcttcctacccatgagcatggaatgttcttccatttgtttgtatcctctttgatttcattgagcagtgttttgtagttctccttgaagaggtccttcacatcccttgtaagttgtattcctaggtattttattctctttgaagcaattgtgaatgggaattcactcatgatttggctctctgtttgtctgttattggtgtataagaatgcttgtgattttttcacattgattttgtatcctgagactttgctgaagttgcctattagcttaaggagattttgggctgagacaatggggttttctagatgtacaatcatgtcatctgcaaacagggacaattggacttcctcttttcctaattgaataccttttatttccttctcctgcctgattgccctggccagaacttccaacactatgttgaataggagtggtgagagagggcatccgtgtcttgtgccagttttcaaagggaatgcttccagtttttgcccattcagtatgatattggctgtgggtttgtcatagatagctctgattattttgagatacatcccatcaataactaatttattgagaatttttagcatgaaagttgttgaattttgtcaaaggccttttctgcatctattgagataatcatatggtttttgtcattggttctgattatatgctggattatgtttattgatttgcgtgtgttgaaccagccttgcatcccagggatgaagcccacttgatcatagtggataagctttttgatgtgctgctggatttggtttgccagtattttattgaggatttttgcagatgttcatcagggatattggtctagaattctcttttttttgttgtgtctctgccaggctttggtatcaggatgatgctggcctcataaaatgagttagggaggattccctctttttctattgattggaataatttcagaaggaatggtaccagctcctccttgtacctctggtagaatttggctgtgaatccatctggtcctggactttttttggttggtaagctattaattgttgcctcaatttcagagcctgttattggtcttttcagagattcaacttcttcctggtttagtcttgggagggcgtatgtgtggaggcatttatccatttcttctagattttctagtttatttgtgtagaggtctttatagtattctctgatggtagcttgtatttctgtgggatcggtggtgatatcccttttatcattttttcttgcatgtatttgattcttctctgttttcttctttattagtcttgttagcggtctgtcaattttgtagatcttttcaaaaaaccagctcctggaatcattgattttttgaagggttttttgtgtctctatttccttcagttctgctctgatcttagttatttcttgccttctgctagcttttgaatgtgtttgctcttgcttttctagttcttttaattgtgatgttagggtgtcaattttagatattttctgctttctctggtgggcatttagtgctacaaatttccctctacacactgcttttaatgtgtccctgagattctgatatgttgtatctttgttctcgttggtttcaaagaacatctttatttctgccttcatttcgttatgtacccagtagtcattcaggagcaggttgttcagtttccatgtagttgagcggttttgagtgagtttcttaatcctgagttctagtttgattgcactgtggtctgagagacagtttgttataatttctgttcttttacatttgctgaggagttctttacttccaactatgtggtcagttttggaataggtgtggtgttgtgctgaaaagaatgtatattctgttgatttggggtacggagttctgtagatgtctattaggtccacttggtgcagagctgagtttagttcctggatatcctttttaactttctgtctctttgatctatctaatgttgacagtggggtgttaaagtctcccattattgtatgggagtctaagtctctttgtaggtcactgaggacttgctttatgaatctgggtgctcctgtattgggtgcatatatgtttaggttagttagctcttcttgttgaattgatccctttaccattatgtaatggccttctgtgtctcttttgatctttgttggtttaaagtctgttttatcagagactaggattgcaacccctgccttttttttgttttccatttgcttggtagatcttcctccatccctttattttgagcctgtgtgtgtctctgcacatgagatgggtttcctgaatacagcatactgatgggtcttgactctttatccaatttgccagtctgtgtcttttaattggagcatttagcccatttacatttaaggttaatattgttatgtgtgaatttgatcctgtcattatgatgttagctggttattttgctcattagttgatgccgtttcttcctaaccttgatggtctttacaatttgggatgtttttgcagtgtctggtaccagttgttcctttccatgtttagtgcttccttcaggagctcttttagggcaggcctggtagtgacaaaatctctcagcatttgcttgtctgtaaagtattttatttctccttcacttctgaagcttagtttggctggatatgaaattctgggttgaaaattcttttctttaagaatgttgaatattggcccccactctcttctggcttgtagagtttctgccaagagatctgctgttagtctaatgggcttccctttgtgggtaacctgacctttctctgtggctgcccttaacattttttccttcatttcaactttggtgaatctgacaattaagtgtcttggagttgctcctctggaggagtatctttgtggtgttctctgtatttcatgaatttgaatattggcctgccttggtagattggggaagttctcctggataatatcctgcagtatgttttccaacttggttccattctccctgtcactttcaggtacaccaatcagaagtagatttggtcttttcacatagtcccatatttcttggaggctttgttctttttcttttttctctaaacttctcttctcacttcatttcattcatttgatcttccatcactgataccctttcttccagttgagcaaattggctactgaggcttttgcattcgtcatgtatttctcgtgccatggttttcagctccatcaggtcctttaaggacttccctgcattggttattctagttatccatttgtctaattttttttcaaggtttttaacttctttgccatgggttcgaacttcctcctttagcttggagtagtttgatcgtctgaagccttcttctctcaacttgtcaaagtcattctccgtccagctttgtttggttgctggtgaggagctgcattcctttagaggaggagaggcgttctgatttttagagtttccagtttttctgctctgttttttccctgtctttgtggttttatctacctttggtctttgatgatggtgacgtacagatggggttttggtgtggatgtcctttctgtttgttaattttccttctaacagtcaggaccctcagctgcaggtctgttggagtttgctggaggtccactccagacactttttgcctgggtatcagcaggagaggctgcaaaatagcgaatattggtgaacagcaaatgttgctgcctgatcgttcctctggaagttttgtctcggaggagtacctggctgtgtgaggtgtcagtctgcccctactggggggtgcctcccagttaggctactcgggggtcagggacccacttgaggaggcagcctgtccattgtcagatctccagccatgtgctgggagaaccactactctcttcaaagctgtcagacagggacatttaagtctgcagagttttctgctgccttttgtttgtctatgccctgccctcagaggtggagtctacagaggcaggcaggcctccttgaactgtggtgggctccaccctgttcgagcttcagggccgctttgtttacctactcaagcctcagcaatcgtaggcacccctcccccagcctcgctgccaccttgcagtttgatatcagactgctgtgctagcaatgagcaaggttccgtgggccttggaccctccacgccaggcactggatataatctcctggtgtgccatttgctaagaccgttggaaaagtgcagtattagggtgggagtgacccgattttccaggtgccatctctcacccctttctttgactaggaaagggaattgcctgaccccttgcacttcccgggtgaggtgatgcctcgccctgctttggctcacattcagtgtgctgcacccactgtcctgcacccactgcctgacactccccagtgagatgaacccggtacctcagttggaaatgcagaaatcacccatctcctgcattgctcacactgggagctgtagactggagctgttcctattcagccatcttggctccacaccctcgtgaggacgttttgtgtcctcttctcctgcactagcatcaggggagagaaatgctgtcagtgactcagctatttggccagggctcagtttcaataaggagctgggtcatacttatgtctttcctctcctctgtcagtcagatcaccacaacttaatctgataggctcactgttcctgcttgttttgaggtgggcaggcctatgcatacctgtctccaaagtctgtgaaagctgagaagccaaagagagtggctatcacgccattctcctgcctcagcctctccgagtagctgggactacaggtgcctgccatcatacccggctaattttttgtatttttagtagagatggggtttcaccatggtcttgatctcctgaccttgtgatccacctgccttggcctcccaaagtgctgggattacaagcgtgagccactgcgaccggccatttatgaataccttcgtggggtctgcctctgggatggtatcacccccaattagtactggacttctttagctagtcttcttcagaaaggtagatcccagagctatcagcacctgggaacgtttctcagaagaaatgtttaatagggacttaccaataaaagccatgtctgtgtctcaggctgtgtgagagaagatggtggatttccatcagaaaagaggggaacaattgaagcacaataacagaaaagttgttttatctaagagcaagatctatagtaagtttctgttcttacacaaagaacagcagataaactggaaatcttagaggctttcctggagcagaggctaatcagaagccaacatggcagattagcttccaagacagagttgctttagcctacacactactctatccttctgaggctatatccccaccccattctaaacttatgtgaatgtattatacccatttttcctcgtagcctaaaatcaactctatatacagaccaaatgctattttctgcaaattctaatatttgagagtccattctgtggtggtctaactcatgactttctggcataacttttttctttcaacatttggtgtagataaaatgagttttatataattcattgtccctggatcctcctggccagacatttaaagctaaactcccatctgattctgaagagcttataatactttcagaagagataatgtttgctaaattttcatgcacatatttaaaacatgcagtgagcatagttcctcagaaaggtgatccaactcaaaggttatataatttcatatgtgttctccttctgtttatataatgaaaaacactgttaaattctgaaggataaatagaaacccttttctgcatagacattctcccttagtctttcatcagaggttatttagtttttctgaattttgaaggaagattaaggaattttaatggagggttgaaaatggcaaataatcacaagcatcttcaaaaggccaataaattcatttatctgccagctaataaaatatttaactccatttatggctagaattaatttcatgatattttcaggaaatgagaagagttgttcatttggaatgaaacattaaaaatattagtgattttgtaaacaactttaagaatacaataagcatatctgtagatttattggtctttcattggtaagcattggcaatgaaagttccaataagaactggatttgggggtatggggaacaaatatggccatctagcaaaagcaacatgaacatatgtaaatgttaaaaaatcatctcttttattctgaatgaattcaacaatatgcagagtgaataattttgttttgttttattttattttttgagacagagtcttcccctgtcatctgagctggagtgcagtggtgtgatctcagctcactgcagcctccgcctctggggttcaagcgattctcctgcctcagcctccggagtagccgggattacaggtgcctgccaccatgtctggctaatttttatatttttagtagagacagggttttgctacattggccaggctggtctcaaactcctgacctcaagtaatcctcctgcctcagcctcccaaagtgctgggattacaggcatgagccaccacacccagcctgaagtgtgtaattttaaaatgtatttctatatcctaataatttaatgttttatgcattatttttagaaaaataaaattttattaagttgattttatgaacagaagtagttattataatggaaagactgggaaacattattaatggtgcatctaaaataaggatgcttgaaaacacacaatgttttctccaaacttttttagacataaatattacggaagttctgtactaaagttgtgcaatatagttttggttttgcattataatatttaaaatacatgtcaatcatatacttactggaattagataccctgttagtagctctaaatattacttttatatttttaaatgattttatgatatttataatattaatataattttgtaacaaactctgaccctactgatattatatccttctcaatttgcagttgtttcatcttggaacctttttattttttaaaggaataattacaatcaataatgttttaaaattcctataaggcatagtttctgatttatgtgtaatataatgattcacaaagcatattttcaaagaagggttaaatatattaggaaaattctttgttctgtattttgctcttacaacccacaaatcccatcagcataggaaacattctgagtctaatggtaatacagcctcttacattgttggtccttacatttcataaagtcctgtcaacatgaaattattttacagggaattttgggaagcagtatttaaaagaaacacagggctaggcgcggtggctcatgcctgtaatcccagcactttgggaggccgaggcaggcagatcatgaggtcaggagttcaagaccagcctggctaacatcgtaaaaccccatttccattaaaaatgcaaaaattagccagacgtggtggcggctgcgtgtaattccagctactctggaggccgaggcttgaaaccagaaggtggaggttgcagtgagctgagattgcgccactgcactccaccctgggcgaaacgagcaaaactccgtctcaaaaaaaaaaaaaaaaaaaagaagaagaagaagaaagaaacacagtggtacctcctaggcaatccccatgcaatgctcttggcttagagtttaactgtgattaacggtcctcttccacaaggtcagagatggagtcagtggcccctctggttcctttctaaatttggaaaaggtggtatcagtctttcaggttcagtggaagacagacctgctgctcagcgtttagatcattgaaaagtagttgttaggtgattctccctttaactcaataattatcatcattttttttgctgaaaagaataaggatggaaaaaatcagaatggacagaacaatatgccataaagtcaagcagtgcggtagaagcatcttcacatcctgaaaacaaatgtagctactttcaaaaaagattcttgagaaacactgtgtaatatttgaagaaaaaagaatcttgctcacaatttttgcttttggacttcttgttgaaacagactatatttttattcagtgtttgctgagtgttttcctgttcacataatgcccagtatgtgcccagaagtgagctgtgaaagcaaccgtacacttttgctagtaggaaagtagctccatctcagctaagcatactccatgtcagaagcaaccggatgacattaaggatgcagtctatgggaaataatgtgttcttttcttcccaaatgctagctaatgagaaccaggtccttggcctcatcagcactaagctctcttagctgtaacctggttcagtattacagcactaagctttcttagctataacctggctcaatattactaatagaggtgacagcctctaagacattagaggagaaaaggtaaacttttttgcatgtcataaataatttctaggtgatgagtttctatcataaaagtgtactatgcattggagaaacactccatgtataaagaaaacctacaaaatgtggactgatcattatcaagccttaaacaaatgtgatgattgacagcaaaagaggttttctctgctatagagaataatgtcttgagaatttggagaccatttttattttccgtttccctgttagttttctgaatcttaccctaatcaagtttgacctgtttccttgacctttcaatattattggggaatgaaaaatgtaaagatgcttacatggcatatagttccagaaatcaacttatcatggaaaaatgccaatgcaggataggatatgcagatgatgcaacagacattctcagctccgatctgttatctagggctttcagaagcttacagggtctccttgccatcttatcagaaccagaatttcaaacttggaactcatgatctttctcataaaattagctactatcccctgaagtttactttctgttggtgatacctctgttcttcaaggttcccgttttaaatggattgatgcatcttccaaggatctctttggtttacccccagcttttcaatccttgtttcctggcattctctcttgagctctactttaagccaccctgcctgtggacatatcatgaaagtttctccctctgggccttgtttatgccctttcctgctctggggtcttcctcacttcttccaagccatccaaatcctaaccaagcaccaggtcagtgacctcatgaatccagaattcctattatgttttacttcttttgtcaacatcactacacatttcatacctgatttctcattatcttgtttcttttctgtgtacctctacagctcaacactgttatcttgctgtgctgtcctagggacactgctatttcaatcctcatacattgtatgggccatgtaatagatgctctataaatatttaaaaagacagcagttggaacaacttggaggagatcatctcacttaatacatttttttattattgttgttttatgatttttgttatttgattttgcttttttcaatgcctggggtaaaatgagagttcaaggtgaagtaatttatttacaaacactcaaagttgagactcaacccaatgcctttgatcccttccctgtgctctttctttcttttttaaaacagcgttgttgaagtgtaattcacatgccataaaattcactcttttaatgtgtgcagttcatggcttttagtatactcatagaattgtgcaaccatcaccacaatctgattgtagatttttattatgaatctcttagcagtgccctcctcacacttcagccataggtaaccactagtctgatttctgtctctatgtatttgtgtattctgaacatttcatataaatgaaatcatactagatgtggtctgttgtgattggcttctttcatttactgaaatgttttaaggttcatccatttggagcacgtgccaatattttattccttttgattgctgcataatattctattgtatagacataacatttcatttatccatccttcagatcacagatgtttgggctgtttttacatttttactattatgaagaatgctgctatgaatatttatgtacaagtttttgtgtaaatgcgtgtttttgtttctttttggtagacaactagattaattgctgagtcatgcaataacactatgtttaacctttatatacacacacacacactctctctctcacacacacacacacacacacacatatatatatatatatagagagagagagagagacagagacagagagacagagacagagacagacatagacacagacacagtcttgctctgtcacccaggctggagtgcagtggtacaatctcagcttaccgcaacctctacctcctaggttcaagcaattctcctgcctcagcctcttgagtagctgggattataggtatctgccaccatgcctaactaacttttgtatttttagcagagacgaggtttcatcatgttggccagcctggtctcgaactcctgacctcaggtgaccctcctgcctcatcctcccaaagtgctgagattacaggcatgagccactgtgcccggccaatattcttttgagacagggtctttctctgtcacccagggtagaatgcagtggtgcaaacactgcttactgcagcctcaacctcctgggctcaattgatcctcctagaaccacaggcatgaataatcatgcccaactaattttttttagttttattttttgtacagacggggtcacaccatcatgcccaggctagcctcgaacttctgggctcaagcaatcctcctgacttggtctccccaaatgctaggattaaaggtgtaagccaatgtgcccggccacatattcgttattgttaatgagaaatggtcagtactttatgtttgggacttgtcaagttgagtagacataaatacttttaggtttgtgaatagcaggtttccaaggtttaatatttaataaaattcaaacctggtacagattgattacttctaaaggagatccttttgtattataactacaggtataattattttgcagtcataaaaagtaagcacttcaaagcactaaaaaattcccccgtgtgagcaccttattgcaaacttattactttggggggtagctgagagcttccattgtatctgaaatatttgatttccacttgaacacaggcagcaaaaatgagtttatagaatgtctctgaggtaaatttagccaaaaacaagattaatattaagtgttgtctctggctttctttcaaaggaattttttctcagtgggaggtcatttcttctgtaacctaaagcatcatgatttttacagatttgtcaaaaaatgttagcaattcaaactaggcaatctgatttacacatacttatgtaaatagaacatgtaacagatatgttgagtttaaactagcctcacatagatttggggaggaaggaaattatgctttttcacaattaataaaatttaaaatcacaagaattatcactttatttggcttatagaattaaaattaagaaatattttttcttcctttcacccagagaaatgttaagatgaaatgccttcttacatattcaataagcttctctcaagaatgtgtctaatcaggacttctcagccttcaattttctcatttgcaatgctattctcattcccctttattccctttgttatttggccttgaaaaaaaatggcgagattcatatctctgtccaactgctgaaatctcacaagtttaaaatggcaatgtttttatggaggaatcgtggtgctgtcacggtgatttcagaaagccttacttctgttttgctctctctcagtctttattatgaccacctgaacaggatgaggggccaaagacactgccactgtgtgtcagctaaagagcagaggactgggcttggcctgcagtgaggaactgtagggaatgaggatggatgagtggacaaggaactagggctgcaaagaccacctttgggatagaaggcaattgctttttatagagtgtagtctccaggtcatttacactagaaatgtgtttttagaggaaagaatattgtccattagtgaacagatggtctcagcaggaaaggcatctcaggggcaagttttactcaagtttagagttcacaacaattatcctgatagatgtgtgtgcgtgtgtgtgtgtgtgtgtgcatgcacgcgcatgcctgtgggtatatgtgcacttgtgcctgtgcatatgggatttttcttttagcttgcttgactggaatgataaaataactagcgtattctttatttatttgctataaaatgataaaatgtggttttaacaaaaaatgttttaaaatattgttcattgaactttaacaacacacatacacgaatttttcttgcatttgccaaatcaaaacaggtttcatcctggtgttcttagtttaacaacaatggtctattttacattaaagcctattagtcaaccctgagcacaaaactccatccaaggtggtgactccaactatgacaccccctctccaccatatcaacctagatcttaagtgaaaaagtacaggggaaaattattctcctgcatgcaaagaataggaaaagagaaaggcatagaatgttaagaataatagtcgtaatattaatggcaattacattaatcattgtctttcaagtacctgttttgcgccaggcacaatgctaagtcgtctatgtatattgtattgttgtttctcctgatagctccatgtggtcaagactattattgaacccttttggtagacaaggaaactgaggcaaagaaatgttaaggaacagtcccaaagtgcacagctagatgaaaatctagaaattgcactctagagtctggttgctctagagtcagtttactcaagtataatttctggattatatgatatctctccgataagatgagtgtttcctagaggtgagccccctagagtttgggctggagaatggatggcaataggatagattaaggcttggaatgttgacggagaaagagccttctagaagagaaatatactatactttaaggcagggtttagaaaatgcatgtggtgcattcatgggataatgaagaatccaggctgctccattgggctgtttatgctggaaacactagttggagggacaggtagttatgcaatttgtagtagacaacctctccctagcaaggtagaaaagcaagagaggtaggaacaaaattctgagtttttatttttccatccatattttaagacagatgcacaatatctgcagtttgaccacttacctcaaaagagtgctacccataagctcctggctccaagaatgcttttgttcaaacataggaggggatttgaaagatgctttgaagatggtggtctgaatattttaactatagtaaggaattcctagtcaatttttgttattctttgtttttgggggagggggaaaagtgccaaatattttcatataggaagaatagagtattcaaaatctttctaaaaacctaattatatatgattagttgtaagattttaatcctagagtttggacagatctcaacattaaaatgacggttttggaaaattgtttaaagatacaaatgtcaatttgcttcctgggattcatatactgggaggttttaccctaatatgtttagaaggcagaatttggaaacaaagggctccctacttcttacagttttactttgtacttcatgatgctgaaaatgtaattagcccctcgataccatatggcacattggtacccattgttatctttttaaaattatgttttagggccctaacctatgtagattttaactctgcagatttatccaaagtacttcatcttatggcatgattttaaggctttattcataatttttacttattattaagagaaaactctctaggatcttttttctagtataagcagattatatttatagagtccttactatgtgccaggtactacttattaaaagtacattcaactggcttaattctcacaatactttgtgaggtaagtaatattacccattttattgttaaggcataaaattttcaataactaccacaatggagcatagctattacatagtggagctcagtgtgaaatcaaacattttggctctagagattttgctactcaccactgtgctatgctacaagggtaaggttaaacccacatatcagcctatataatactagagtgttttggttaataagtaggagcactttcttttctacaatctagaaaagtgctattgaagggaggtttcctaagtggtctctgaccatagatacagatgagatatttaaaggaggtttttaactacatcactatgtaatgagtggaggaagcaatatgtaatacttatctattattgcataaaaaattaccccaaaacttactggcttaaagcaacaaatatacatcatctgccagttcctatgagtctggaatccaggtatgattcagctgggtgcctgtggctcagaatctcccacaatgctgtctcaagttatgaataggagctgtgttttcatctgcaagtttgactggggaaggtctgcttcaaagctcatacatttggctgttggcaggccccaggtactctggctgttggacagagacatctgttccttgctccatggacctctccatagggcaggtcatagcaaggcatctgaattccctcagagcaagccagcaagacagggaaactcaagccggaagctatcttttgtgacctttttgtaaccaccactttttctgtattttgatgattaggagcaagtcagtaggtccagccatggggaggggattacacaagagtaaggggtttacacaaaagggatcactgggcaccatttttgaggctgcctaccagcgtctccccttgtcagcctaagataagttagtattgctatgaagtaataacagatcactgaatgtattgtcacctgcctatttttatagttaatagatacagcaacgtattttgtatttaaagcttctttttaggaaaaggccatttgtgtgccctccattaacttcacaccaatttcagtcagtttgctgtgttgtgataagatgtttcagttacaccctctgtgcttcagagtgactggtccttcattagagggttaagaaacttagtattttggcagaactgagtaatttgtttcacccagtggttaatttaggcaagcaactgacttgactgatctgagtccttttagtacatgtctgtttagctgagttaatcagatggagtattggtttagcattaggtcagggaattctgaaagtagaatatgtattacctagcctattttccacatctaaaataaggaaatatataggatttattaataaaatatttgagaaaacaacagaatatacattgtatttttctatgtaattttgtgtttgatgagtaatcattctcattagagaatgataccagttttgagttttgaaagacatcttttctcacagaactatcaattgccactctttgccagaagagtttttcaaagaggtatgcgtatttctgctagctatcattacaaaatgattctgagttatagtatgaattggtaatggatctacttatgacacactggttcacatctcagattgtttttatcttctaatggaagtcattcattccttcacatagtcacttatatattcagtaattatttgttgagtgtctactctggaccacacagagttgtaagcattgcaatgtaatttcgtatatttttcaaaatctcattgtaaggaaaagagtgtttagcacctctcactggattgaggtagcaatgtttacttcttaatatttttccttagaaaacaagcttcaaaaaattgtgttatcctttgattgtttcggaaaaagctgttctctttaaatagcatttaaatatcaccacaaattgatatatgattctcgaagaatgaagcttcatatgaaaataaataaacagctcaacacagataaagaaatataaattaacctagtgagaaaagaacacaattattggctggatatgaaccttgattatgagtcagtagcaaacactaaaagagggaaaatgatccattattcaatggaaataatttagcttgattattcctgcattttcaagagcagtaagatcagccacatgcagacaagtgggacagagttgttgtgaattaaatgcagttgtattgctattatatttaagacatcacaatctcatttactcccatggagcctgaagtatgtgctcttatgaataataatcttatgatttttttcataatatgaaattatacatgagcctctgaattttatttcagtcaatgaggtttgtcctctttttgttcttgccattggtgattgatataatcattcatatgtgtgtgcaaaatgacctgattcatcatgattatatatattaataatggctatattgaataactttagccaaaggaaatttgattggtaggattcacaaattatgaaatgtctaggatttaaagaacatatatcattaaaatcctttgaaaaaacaaattatccaattcatagtccttcggtcaagaaaattatttgatactcagttccactttaaaaattaaatattaaatttcatgagtgttgcctgaaagctatttgcaaataagttctgagtttgtgttattacaatgggtttccatgccattgaaaatattgttcttctacacatgacatctttttttctcataatttatctccttaggtcctatctctttctgctgctttttttttttttaccccagttatttcaatatgaatcttcttctcaactcagcaacacttcagggctcactgctcttgtcccagtgagttatctcaattgagcccgcgcatcacacatgtgaccctggcacatctgtgaggcaccagcacatgtactccacagccatgtagaagcagctcatgttccctgataatattgtgtagggagagaaatcaatagggccttaggcgagcctgaggaaaagagttaattaagcagtgtggaaaagagaagcatcattgacaagcagcaagatacatttaaaaggaatttttcaaatgtattgaaaacaaaataggtgaaggagggggcaaaacaggaggaaactatgctaccttttctcagtgacactatcacaaatttatttactttttcaataaattgcatatatatattcacacacaagtacattcgtaacttaaaccctctttatatttcagtgtagacaacatgtgagagggctgttatcgattctacagaagaatcatggcatgttatatcaatcatgtttcatgtgcaggagctactcgtagggattgtgattgttgctacatcatccagaatctcatagtcaagttgcacttttgccccatcaaattccacttttcatcctattaggaacaactttgctatgtaagcagggtttttatgtaaatattttaaattgaatcaattgcaatatgctgtcatgacatctgatttccaggtatgaagtaagtgtgcagtatattgtggacatcacacgatttgcctctctgttctttaccatgtgtctcatgatgccactgcaagttgcataggagaaaactgaacatatctactcctagaattagattggttttttagaagcaagattttcagggaaataaggaggaattcgtttgaaaatcccagttgaacacctattcgtattacagatgggtttatttcttggttttattcagaaactaggggcctggattgccacttccttttaaagcaagctgtgtaggcccttattgatcgaagtgtggtctcttggccagaagcatcaggatcacctaggatcctttagaaatacagtctcaatcttcagattagtcaaactgaatccaaatctgcatttaacaaggttccctaggtgattcttctgcatattacagtacggggaagcactgagcctcagacagttgcattttgggtagggcatatgtatttgtttcaactataactctcaaatcttgtcctctagctgtaaatcccaactacactgaaaattttaaattgtcaatcaatgcaaataaagataattaatatttggtgcctctggtgcatgcttaggatagtgaggaatgcacagagattaaaagaatgatgtcagctatgcagaagagtggaattcgttaagaatgtgattgcctcccatcttaagagataaaacatgcattgaaaaaactattagagaacaacatatacccatatttagccaactgctagattgagcttaaggctattactgctttgcaagtactaagaagataaaaatcattgtacaaaaattctctaagaatttttgccttttcttcttctctcagtcatcactgcaattatgataaaattatactgacctttggaaaactcagtcaaatatatgatctccactggccctgaattctacagtctaactaaacgtgtcacagagagagaattagatagttctctttaattggttttaaattggtagtcctttcactcaacattttttgctggcttcctttagttcactgtattacagtataacacagaaaaattggaacaaaaactttttgccaaaaactatgcattcgtagtcaagtaaacaaacatggctactctgagaaattggttataacaatatagcaagcaacaacccactaaaaaaatcaagcagcactaggaaatatctcttatgtttaatttcctgttggttttgctattcaggtaggtctggttttttgagagctaatgtggtagtctatacaaaagggtcatcgctgataatgtgtataaccaaatgttattgactataatttttttaaaataattttgttacaatttttctgcctttatattatatcagcaatacaaataaaaacactcctttagagttaaagcaggattttttaacaaacagttattttcaggccattagtaaaatataattttcaaaagttaaaaatatgactctcataaatataaaatgaacatatcaaagattttattcatttcattaattaatgacagaatgaggaaaatggcaagcctggcatttattggcactttaataaaaaattagaatatgtttgctaggatagttatgaaataggctaatatccattaacagtaataaactatcaactttgacatcttctcagctggacaggaattatttgcatttctaatagaaaatctataacatatagcttcactcaactggggttctttaatcaattgtaaacaggctgcttaacaaaatacattccctagataattaaatcatctttgtatggacctgataaatccccatggacaaatatgtcacctttcttttttccttattttcacattttacatcactacctgtatttagaaagatcacatattaattctagttctcattccattgttcttgctttctttagattggagtcaataaacataatctgtttctaaattctctggaaaataagcacaaaaccaccttactctaaatgtccttctttccttactgacctttccaggtagggcattcctaatgccatgtgacctcataaaatcatgggctagctggaatttattaatgtgacttgagagatgtttaaagctgaaccagtatgattaataatcatgcagatggaaatgaagggaagggtctgagatatatctagaaagtaaaatccaagggacctcatgccttcttgagtagaaaggagcttgggagaagaaagagccaaaattgacagtgggattacatgagaaataaataagatctttgacatttgggtttaaggtagtaaagaaacattgaatttaagatattgatgaagcaatgagaaattttactatggaacttgggtcagtgtaggaaccaggaccatagagtcacagggtacccattgatggtggtacttgaagccatgggaaataatttaaaaatagtcaccaagagagggcatcctaaaacaaaaccaacaaaatcagtattaggtaccagagaaagaagaggcaatgaagaaaagatagtcagataagagaattgaaatgtggcagtgtaagtgcatacaagttttttgaaatgtaaacaaataaatatagtactctcaacacatatacaggaatacattttaatttctctaagattaatattgtgtgcctctttccaaattactacaaacagggccaggcacgatagctcacgcctataatctcagcactttgggaggccaaggcgggaggatcacctgaggtcaggagttcaagaccaacctggccaacatggtgaaacctcatctctactaaaaatacaaaaattagtcaggcatggtggcacacgcctgtggtcccagctggagaaggaggatccttattattctgcacactcaccacatttgcttgccaaatgcaagcacaacctgaggattcctccagcactttcaatgttactactgcttcaacattccaatagttgacagtagatataattttggcaaaattagaagatcttatggaatggtttgtctcattcaatttctgacagatatgttaaagaattgttttcctgtcctttcgtctcctcccttttgcagttttgataatacagttaagcagaaaatcagtgagctagtctcccagtgaaatctcctctcttccaagggactgtgcccaagtgatcctttgatcatttggagaaataaagccctcgctgtacagaaaagctcagctccacagtgcctcagccacagagcagatcagcagccatgctgtcatatttacagccaggtgaaactctgggttctttgctctgcatatttgtaaaatcaccaactatgatgagagtccacgggatagcaatttgctgctgccgaaacatttccatgcaagattccagggaaaaagaaaatggcatattcctgggtcttggctgaaatgattttgctgttatttgataaataatagtgactgtgggcttcttttatgttaggtattctgttcacacacagataattgggattgcaacagatattttgtttttctttaaagggagttgatcttaataacaaaaaaattaaatatattcacaggcatatgactagacaagtagtgtatatatgacacaataactaaactaaaattgaacagtataaatttggcacagtgtacattaaaaaatctgaataattaacctcatggtgctttcattcacatattgggaattatatgagtctagaatgtgagaacgtgtgctgttctcattttctagaaaagactagaattttcctttatatggaaagaaatattttctttcagattggaaaaatatattcactttgtagggtaacattgacacagcaaggtttttgtgtgtggtttctagatgtgggaaatgtgaacttggcccaccataccgtctatatctattgtatgcattatcaagaattattatgaagggatctgttgtaattagttgacacaggattactattgtctctgcattaatgaggtagaggtaaaacaggatctctgtcttgtaggtcctcttttccctctgctccctctccttcctgctgttaattttcaaaagcccttcaggattttttaaaaaggaaagcctattgatgtgacttgataatttctccttaaaacaattcattttcatttctttcagttgagaattcaatttttgactcagcatttagccctaaaagcatttgaaacagggttgatcatgtgccagatgtgcataaatgctttacatccattgtctcatttgatcctcacaacaccacaaagttggtgttgttactcccattgtgtggcaagagaaggtgaggcacagagaggtaaatggcatgcaccaaagaactgacagctgttaagtgttggaattgtgacttataatcctttgggtatatacccagtaatgggatggctgggtcaaatggtatttctagttctagatccctgaggaatcaccacactgacttccacaatggttgaactagtttacagtcccaccaacagcgtaaaagtgttcctatttctccacatcctctccagcacctgttgtttcctggcttttcaatgatcgccattctaactggtgtgagatggtatctcattgtggttttgatttgcatttctctgatggccagtgatgatgaacattttttcatgtgcacatgcacacgtatgcttattgtggcactattcacaatagcaaagacttggaaccaagccaaatgtccaacaatgatagactggattaagaaaatgtggcacatatacaccatggaatactatgcagccataaaaaatgatgagttcatgtcctttgtagggacatggatgaagctggaaaccatcattctcagcaaactatcgcaaggacaaaaaaccaaataccgcatgttttcactcataggtgggaattgaacaatgagaacacatggacacaggaaggggaacatcacacactgtggcctgttgtggggtggggggaggggggagagatagcattaggagatatacctaatgttaaatgacgagttaatgggtgcagcacaccaacatggcacatgtatacatatgtaattaacctgcacattgtgcacctgtaccctaaaacttaaagtataataaaaaaaaaaaaaaaaacctgtgacttaaactaggctaaatgcccatcattggtaaactggacaaagaaaacatgatacatatacaccatggaatactacacaatcataaaaaagaatgagatcatattcttggccgcaacatggatggagctggaagccaaaatcctgagtgaactaacgcaggaacagaaaaccaaatactgtatatcctcactttgaaaggtgagaggtaaacattgagtgcacatagacacaaagactagaacaacggacactggggtctacttaagggtggaaggtaggaggagggagatagtaaaaaaaaactaccgttgagcactatgcttattacctgggtgacaaaataatctataccaagcccctatcacacaaaatttacctatataacaaaactgcaaatgtacccatgaacctaaaacaaaagttttttaaaaaaaatcctaggcttctgttgaagcctatgggctaattttttcatgatactgcctgtgcttgttaaatgaatacatgtaaagcacaaggtctagcacaagtaataaaatctagttataagcaaactgttatttttattttctactgatgtttagattcagtattgttttctttccctgtgttggagatttattttagagtaacctagtctcatttctgtttacatttcagagacatttgtaggttttattgttgatgttgatttttttggaacaatatattgaaaaaccaaaatgtcatgaagttactgaaaatagttattccacatttcaatctccaatcttgttcctaatctcaaaattttgaacgtctacctgatttaaatttctttgagaagttttttgggtaggatgaaggagcatgctctggagttactgggtgttttctttcttcctatggagccaccctgttttattcatactcttgccaagcttccagcacggaagctttctctgtgatagattttctctggtatgaaatatttttttttctctttctcaaaatcactattaatgaacgtactggaaaatggagcagcctgacaattttggttctgaatgtaaccactatgaaaattttctaaaatatctaaaatatccttgaagtttctgtttcctcacttaaaacccgaaaaggttggactagatgaggaataaaaaatattctagtagactgaactatatgaaattaccatttttgtaggtaaaaaaagttgattattggtcatttcatatgacctaacctaagagattaactatcttgtaatttcaggttaaatattaatatgtatttatatagagaaaaagtagcagtgtgcagtcttctctatgaataacttctcctcagaagagactgagataccagcaaaatgttatgaattcttttggaataagtaggggttattttggaagatgctcagaatcttgaaattgtgatttaataaaagatctgttttttaaatgtttatagcacaatgtagtatgtgagcattactgggtaattgaaaacagtatatgtgagtattaaatatagctacaaaacagtattatttgccatcaactttccattttttaaatatattttcatgatcctaatggttttgcaagtactagtaaactggagctaggtttaagatattatccaacattttctctctaactaaatttgatatgtcatgtaactcttttctgattttaacagaaattctgactatataaggtcaacacacacacgcacacaatatattgcatggctgagttttagtctttaatccataaatatttcttttgctgagaactacagaagataaaaatgctgaatcagacgtaggccttgtccccaaggaccttgcagtcaatttttaggtactgttcaatctaaacctgtcccattctgacttctggacttgtgtccttttgctagcaaactgacttcatattcctttttgataagtgctggagctggctgggactggctcatatgagcccattgttaaatacgcaggaattttgcaaggcagttgctaaactgttattagtttgcaattggcctaggtggaagtatttaccccacagaaattggcagatgctattaatgggggatttttttttttttttttttttgcctgagaggcactttgccagtataccaccagaattcaccaggctggcagttgcaatagaattctccaaaagatatacatccgattattacacaaagatagaattataaaatcttatacacagctacgctggggtaggataaagtgagagatcttggagaattgtggcttaagaaaaataacttcaaaactaagacaagcacccttagtttagatagtaagttcaatttctccttatagcctttgcaggaatactgataacttcccagggagaaacaaatggctttttttcactacctacaacgtacttcacattgataaatatcatatgtaattcacatgaggatcctgtgaggttattatttactgatagatttttcttttgttgtttttgctttctttattttttattcccactttaaaagcaaggctaaaagcacaggtgtgttccgtggttagtaaatagctgagttgggatttaaacacaggccatgctgactgcaagactgtcctgcttctaccacactgttttccaggcaagagcatctgataagtagggccagtgattttgagtgtcatctccttttttatcccttaacatcttccttccccaagattagctaactcatacagaagaggcaagaaggcttcttggagagtttctgaagtcaagatttagaaaattaatgatttgtataattcatacgcaaagaaccaatcacaactttgccttaatgtcctcatttgcaaaataactattgtaaggaaatggaattgaaaatatttaatatctggagtttattatactgaagcattataggagcatagaaccttaggattttgtcatttctgtaggctaatgtctctccatacccttcctattatctctcacttttaaggacaatttttaaaaagattcatgttttttcaagtggggaatgagctaaaataaggaatctgtttttatctctcagttataagataggcagatgacagtactcagcctcatgttattgaatatgtgcagggagtgaaaaagacttctaattaaatgaatgccattgggtaccaaattttaaaggcctgcactaaatggccctagtcattaatcctagaaaaaagaaaatcgatgtgtgcagaatgttctctggtgaattttggtcatttgcttttcccaggaatattcactgactgtatcacatagtctttatatagctcaataatgagcaaaagaataaaaggagacataaaagaaggaatcagtaagtcagcactgacctaattattacaaagtgaatgtttttacaagtaacctgcaggcaactcaggagtgagaaaatatttttgttcaagcgtttcagtatttcttatgcatcataaagcttaaagcaaaaagaatagcattcagccataattgatgaataagctgaaccctgaattttagaataaaaatgtttacctgtaagttggctttaacatgataaaatagggatagtcaagacaaaggttgccttctgtttggctataaacaagtgtattctgttctattccaggaaagaaagaaggactcattttcttcattttttcttccttcccctatttctctctctctttcttagaattttcaggctcagagtctttaattataacattaatataggaaggacacgtttactgatttgatgtatattattttaaatgtgttttcataatatttcaatgtaatttggaaagcaaagataatagataatacatagaaataaaaacctgaactagaatatcaaaagatagcctttattttatgcttattccattgctcactgaggctttcttcagaacacaacaaaggtatccaggtctgtctaacttctacgattctataaaaaggaaaattaaaacataggccaggattacaattgtatataatcaatgcatgtaagaacatgtatatatttcaaatctgcaattttccaaaaacaaagaacatgtgtcatgattatcacttgtttgtcatttactcaaattttctcatgaactctggtatgactttgtcaatgctaattataaacttaccttgcttcataaaagacagcagcaaagttcatgagtttaagttctagggagctaaaaaacaaacagatcaatggaaactttgaactgtgataaacactatgatgaaaagtacataggctatgaatacgttccatgtattatcattttattttcttgtgcttgagcaaataagcatataaattattatttttcaagacctttcataaattttatgctgagattaaccattcatttgcacgtggcattttactaacccctacctgcatctcctcaaaccctctgaaagaataccctgtacaggcttagacccatgttttgccctgtagttctgttatgtaagatcactaaaaggattgagattgaaacctccaggaatttccccatgggctgtatttgttcttttaaataacttgaggatagatatggctttgctgtgtccccatccaaatctcatcttgaattgtaactcccacaatcccacatgttgtgggaggaacctggtgggaggtgaatgaatcatgggggtggtctttcccgtgctgtttttgtgatagtgagtacgtctcatgagatcttatggttttaaaaatgggggtttccctgcacaagttctcttctcttgtctgccaccatgtgagacgtgcctttcaccttctgccatgactgtgaggtctcccagccacatgaaactgtaagtccaataaacctctttcttttgtaaattgcccagtctcaagtatgtctttatcagcagcatgaaaatggactaatacagtaaattggtagtgggagtagggcactgctgaaaagatacccaaaaatgtggaagcaactttggaactgggtaacaggcagagattggaacagcttggaaagctcagaagaagacaggaaaatgcgggaaaatttggaactccctagaaacttgttaagtggctttgaccaaaatgccgataatgacatggacaatgaaatcaggctgaggtggtctcagatggagattaggaacttcttgggaactggatcaaaggtgactcttgttatgttttagcaaagagactggcagcattttgccccttccctagagatttgtagaactttgaacttgagagagatgatttagggtatctggtggaagaaatttctaagcagcaaagcattcgagaggtaacttggctgctctcaaaggcattaaattttacatgggaaacagaagataaaagtctggaaaatttgcagcctgacaatttgatggaaaaaaaaatccgattttctgaggagaaattcaagccagctgcagaaatttgcagaagtaacaaggagctgaatgttaatccccaaagcaatagggaaaatgtctccaacgcatgccagatacctttgtggcagaccctcccattataggcccatgggtttaggaggaaaaagtggttttgtgggctgggctcagggtccctctattgtgtgcagtctagggacttggtgccctgcatcccagccactccagccgtgactaaaagaggccaaggtacagctctagctgttgctccagagggcagaagccccaaaccttggaagcttctacgtttttaagcctgcaggtacacagaagtcaagaattaaggtttgggaacctttacctagatttcagaaaatgtatggaaatgcctggatgccctggcagaagtttgctgcaggggcacgaccctcgtggagaacctctgctagggcagtgcagaaaggaaatgtggggtctgagtctccacacagagtccctgctggggcactgcctagtggagctatgagaagagcaccaccatcctccagaccccagaatggtataaccactgacagcttacaccatgcacctggagaagccacaaacgctcaatgctgccactgaaagcagccagggaggagaccgtacccttcaaagccacaggggtagagctgccaaataccatgggagcccacctcttgcatcagcatgacctgtatgtgagacatggagtcaaaggagatcattttggagctttaagatttgactgcacctctggatttcgaacttgcatggggcctgtagcccctttgttttggccaattgctcccatttggaatggctgcatttacctaatgcctgtatccctcttgtatctaggaagtaactaacttgcttttgattttacaggcttacaggtggaagggacttgccttgtctcagatgagactttggactgtggacttttgagttaatgctgacatgagttaagactttggagggctgttgggaaggcatacttggttttgaaatgtgagaacatgagatttttgaggggccgggggtgaaatggtgtggtttggctatgtcaccacccaaatctcatcttgaattttaactcccacaattcccacatgttatgggaggaacctggtgggaggtgactgaatcatgggggcaggtctttcctgtgctgtactcatgatagtgagtgggtctcaagtgacctgacggttttaaaaatgggagtttacctgcacaagctctcttctcttgttgaccatcatgagatatgtgcctttcaccttccaccatgattgtgaggccttctagtgacttggaactgtaagtccaataaacctctttcttttgtaaattgcccagtctcaagtatatctttaccagcagcatgaaaacagactaatacacaattgcattagcctctaattgtgcctggctttctagatgtcctcagaggcagcacttgatgcaatggagtaggactcattgctctgtatatactgccttcttcgccttcttctggaggtccagtgcatcgccattgctgtcttcaaatatttgtgagtaccacgcttacagggcatcatagccatgatgaaggaaaacaacagacaggatttaggttccctctggaaagtacttcccatttatggcaagactcacaaatgtaggggtgtttccaactctacaaaaatatttagaatttccttaaataaagtgtctatctggagtctttggcatatatataacaagactggcaatatactgagaatttgaaattaagtgataggcatattgggactcattatactattcttttttttttggtggtgaaattttccagttttaacatcttcacatgtggtatttaatttacacaccataccattttcccatttaaagttacacaaccatcaccacattaattttctaacattttgtcacccctaaaagaaattctctagcattcacctctcatcttccagtccctccctcaacccatcagaggcaatctctcatctactttctgtctttgtatatttgcctattatgtacattttacataaatggaattatacactatgtggtctttcatgagtggctttcagatgagataatttttcaaggttcatccatattgtagaatgtatcagtacttcattccttttgatggctaaattaatattccattgtatggatatactacattttgtttacccattcatcagatagtgggcatttggactgttttcactttttctggctattgtgtgaataatgctgctatgaacatttgtaaataagtttatatgtagatatatgttttcagttaccttaggtatatactttgggaaggaactgctgggtcatacttaattctatttttaaccttttgaggaactgctaaactatttttcaaagaggcaacatcaatttacattcccacaagccacttttacgttcccaccagccagttgtgtgaagattccatttttttcacatccttgccaatattgttattatgtgtttttaatcacaatcatcatagtggttgtacagtggtatttcttactatcctaatttggtatctgcttaaaacttttctaacaaagaacttttaaaaattataaatattaaattctctgagtttgtttaaacagtcatttgcagaaacattttattgataacaaaagagactattaaaaaagtagccactgcctcaatccatattttgaggtcactgattcttaaaacgttatattggtataggatagaactggagaggattttttttaagtttagaagatttattggttctttgagcatgtacgcaatcctaatatgctgtaagccctctcttgcaataccgtcatgtaaacacgcatcatctgcatacaggatgttttgtcactattgcctgattttaaggtatattagttaaaaattgactttctcttttagaaaaactgtgtttggagcaattatttagattcttattgtgcataaaaaagtaattcaaggtctctttttgacaatgactattgactagtctgacatattcttgattaaaggatcaacaaaccttttcatttctagaacatgaatatttattaaagcagattagaaattttatctattgttacctaggaactttttcctaataactattgttctgatggacaatggcatattctgaactacttcctggtctcccaggaaaatggcaagttagttacattagaatgatcactgggcggtttctttccatgttgcataattgagggaaaatctgttaacattgcttgaaataaaaatcttttaaaatattttattaattggctttaatctcaattttaatagagtaattattttggaatagttttattcttttccttgtaatctaatggcttttgtgcagatataattttaagtagtcagccctaatgcaatcagtaattaaaattatagccaactacaggtgctgctaattgttaatcaattagatgcagaacgattacatatctaattgaaatactgattgaagtgttgatagttacccatacttttttcaaaagtaaactacttctaactgttcttaagttggaataagttgggaatattttctcaactactctctcactcattaacttatctgaactttagtggagaatagacttgctctttctgcatgtataaataaaattggtacagtagatcagaattgacctgactggctgttgaatgagtctgtgatttttaattggtttatgtgcatattaacaggccacattctgcagatggttgtgtgggttctgagtatctggatttggcaaatactaggaccattatataggaatgttatagtcattaaacactgatagaatccttgatttgccaggaggctgcagtgggtatcactgtcaacctgctgatcagcctttacagacattaattagttcacatatttataacaatttagtggtaagaatatctgcatgacaaaaaaaaagatttgatatttattccttttgaaaaataattgttgaaattcgcaatataggctcaagtttagaaaggaacattttacctataccatcgtaactgaaaactattttgcagtttctaagcatggaatcacacgaataggagacagcaatagtaagcaaagactgggtaatattatttgtgtttcatgattgatcaaatcataatcattctaatttagaggcataaattctctacgaagccagaatttattttctcaaaaggggactatagtatggtgtgtctatttatcttagtagatttaagtaaacctgatttaccaagagcattatataatctttcactggaaagaatcaatcatgttcttcaaggaaagagtttgagttgaatatgcctgtttcagcaccatgcctggagtgtagcaagcatttgggatgtttattgaacaaattaataaagtgactaatgtaaattatagtgagattttctgcagacattaataaaaaaagatcattaacaatccaaaaagagtgtttttttattttttaaaaccagccatgtaattttgagactgctgagatctcttgattgtgcatctgacgtgatgcttcagatgtaacatctcttctgtcagctgccaaaagtcacctattaagccaagtaaaaacttccaagtatagactgggataaaggaaagaaatttaggagaaaactacttcaaaaattttcctaaaaattttctctttttcagaaaatgggaatggattttagatttgtgtgcttgaggagagggaatgaaaatctgagcaaataccattttgattcaaagcaatagaaatgaaaaacacaaggacaggtattttatcattctgtttggttgcatggtatgctatttgtgaaagcattgtatatgacactatttttaatccagcaattctattgtcacctgaacatttatggtttggatgtaaagtgtaactagtaaatcatactattggtctatcatctggcattacctgaagatcgaagagagagaacaattccatttacctcatccctggtaggaatatttgttaggatgcctgaagtcttcatttccaacaggagaaagccacaaaacacttgtggttctgaaagcagcctgctgttaacatgagttatgtgaatctgatctataatcttacctgacatttggaactcaaatattttccttatttctccaaaacaattaaaatatttagtctcacttcattttatgagacataaatagctatataagtactctgtaattactgtacattgtaacaaatgacctcataaatacattgtaatgtcccatgtaattacatggtacatcgtgtctttgagatggctgctctgagattgaaagcctgctggtttcagagattaattacttagggcctaatttgacagtttgcttgaagataggccgctgttaatagccacttctgtggtttcataaaaaaaaaactgtttcttcacaagatcttatttccttatttactatagacccagctgtacatgtttatccctgaatattggccatacctaaatttttctgtatataaaagcaaaaaagtgaaaagggcatggttctgtacaggaagaagttgatttgcaattatatttctcccatcaaacactatgacttattttatgacaataattttaaaagttctggtttattaatttaaaaaaatgttggggccaggcacaatggctcacacctgtaatcccagcactttgggaggctgaggctagcggatcacgaggtcaggagttcaagaatagcctggccaacacggtgaaacccctgtctctactaaaaatacaaaaattagccaggtgtggtggcaggctcctgtaatcccagccactcagaaggttgaggcaggagaattgcttgaacccaggaggcggacgttgcagtgagctgagatggtgccactgcattccaggctgggtgacagagcaagactgcatttcgaaaaaaaaaagaaaaaagatattggagtataagatattgtaaaaattatgtcatttttttctctgattaagcgttatacagcctataaactaatatttcattttgtaagagcccaaattcgtttgtcacaattattttatcatgagggcattattataataccttgcgatctcagtggttattcttgataaatgcatcttatcctatagttgccgtttttatatggcatgaatcgtatttaaaccttctttctctttgactcaggttgcttaaatatctggtgaaataaacttttctcaagttgtactactcaccttactgctcaaattctatctagtttccatgttccaaaacacaaaggaaataagaaataagtgaacactgtattttctgccttaaattatatactggccctattttcttgtgcctttctagggtgtaattttacatataactcccctgatgtatttctattccagctttcttaggtctagttcctacatcaaatatattatattgcttttagtagttttatttagtacaaacgaatagtctgagaaaggacctagtgatctgaaagagttaataagcccttctaaacatccagcttacttccaaggaatgatttaggcactggagaattaagtctattgatactgacaaattccaaaatgtattaatcgtaaactcactttatcataaactctagggaacaaccaaattgctttattgtaatggaattttgtcaaaacgtgaatacctcctagaaattacatttccagtttctaggacctagaagaaacaagcctggctactaggctatgcatagaaaattatcagatgtaaaaaatgctattttaaatccaggagcttaaaaaaagaagatgctaggtacacaccaaactcactgctttcttttcatgtctttttattctttgagctccacccccccccccttttttcctgtaagctgggctatactctgacatttggggatcattttcttagtcagtttaggaatattgggttggttttgcttagttagccaagaaagcccagcgggcaggaaggattaattgatttttctttatttttcttcccataatagaaaccatatatggttacatatctgagaagcaactcgaatagagctgtggtaatcagtggaaaaagtgatgtttctatgggtcattcatctgaatatgggaaaatttactatttaaaaaaaaccacctcagccaggcatggtggcttacacctgtaatcccagcactttgggaggccaaggcgggcagatcacctgaggtcagaagttcaagaccagcctgcccaaaatggcaaaaccctgtctccactaaacatacaaaaaattatccaggcatgggtggtgggcatctgtaatcccagctactaaagaggctgaggcaggagaatcacttgaacccgggaggtggagcttgcagtgagccgagatcgtgccactgcactccagcctgggtgacaagagcgaaactccgtctcaaaacaaaaacaaaaacaaaacaaaacaaaaaaacaaatctttgcacaatgctgaattgtctttgagaagcaaaagaacatttctcagagatttgtaatctaattgttgcaatcagattaagtatttatgaaggtaattcagtcacaaccagaatcactccatttatttatttttatgtctgtgaaacccaatcatgtgaggccaaagtgacttgattacttaattctttgaaaacttgcttcagtttttaatgtcattttgtgtttcaaaacagttatccatactactcctactgcaaatcatgacaatcgtgacatgggaaaactaaaataagagcaaaactttgtattttgtagtgttttcaattttctaagccctttctcatcgatcacctctcaataactagggagagataatgttgtaatacatacaattgatgctgctatataaataatttctactgtcacttagcaaattaatgaaaagctgagagtagaacaatatgcatccatgttcatacagtccgtgaataccttttatgtgcagaacactattctgcctttctctaaatgattcagaaatgcacactacacttgatcttagccaaaaagtcaagaagcaataggaatgcagctagatagaacatctaataagattttctaagcaccacacctggtataaaaattaagaagacctccaacatgtttctgtacatctgtgcctaggatctgagattcatttaacatttggagttaaatttttaaatagattactagcgttttttaaatttttattttagtttcaggggtacatgtacaggtttgttatataggtaaacttgtgtcataggggcttgttgtacagattattttgtcacccaggtactaagcctagtactcaatagttaatttttctgttcctctccctcctcgcaccctataccttcaagtaggccctggtgtcttttgcctccctttttgtgtccaaggatcactagtgtttatggtccagaattagcatgccagtttggggctacagttgaattaacctcatcactagagagatgtctgcaggctactctcagctgttgtccacttttctcctgatagagctccgagcttcatatttaaataactcaagaagtagttttttatatattactttggaagtgtgcaaaatactagcctaccagactctcaaattattagtctccactgggcttcctgtgtctctgtgaacagtcatagattggggacctcacaatgaaggtttggaaacctatttgaccctaatttactggttcaagtctcctgtgctcctacaatgaagcgggttgggtaagttattagtttctccttttttttccttagaattgtgaagtttgagttgtaagaattagattaaagcagagaaaagtggtggcatgtcaatttcccaaaatcaatttaaatttagctcagtttggctaaaaaatataaaaatggaacatataagaagtggagcataattcggataacatttcttactggtgtaaatgattttttaaaaaataaccctaactgtgttgattgtatacacttgaaaaagatcttggggatgaacaggcatggagttcagagccagtggcaggagggctgtgccctaaaccagaagaagtgaggtgatgaaggctgtcattcaaaaagacagtatccagagaagtggagtggtagaaagcagttatgcctgataggggagtcaaaaagactgaagagacatttctggttgtgaatcagaaggctagtaggttttgctggttcagagcgctaaatcaggtaacatgcctaagttcagaaagggtgggtgtattttggaagggaagtctgccagcctctgattagagtctcagagaagacagtcatcgctggaggactcagccttgcatgtcttggagggacctggcagattaacaaaatgaagggggactcacccggaaacaaggcagtgtccccaccagagaaatactgttacaagagctgggacccaaatcaaagtagatgatttgatttgaagttgaacaatctgagaaattgtcccaggttggcttacgtttttacataaccagggaaaggattctcccagagtaggtaaaggagagcttaatctctaggtaagagttccactggcacttttacgagaaccaggggccagcagggcaaagataaagattagattgttttacaactatataaatgtattgatgaagaaatgtttgtatcattttcaagctgttaaataaaatcacaacagcttagcctttattttttttaacaaagtaacatttcttgcttcaatttaagacatctccataaaattttatttaaaatcaaatattacccaacgtgtacttaaacatactttattactgcacaaatatttacttcaaactttgcatagtaatgtcagagttttccctctggaaatgtatcatactgatacattttgtctaacagttgtctacatgaaattacggatctcaactttagtattctacccaaatttctaacttcccttaatacaagaaattatatatttattaatgctaaacttaaaaatatgtcaaatcaacaaaaatagcatataagagtaggaaaaaatatgggcctttattatatcatattgatattttatcaaatccatgctgggttggtaaaataagtttatagatttacatagtttataaaaagacaaaattgttaatgaaaattgtttacaaatacacataatagaattttttcatagatatttatgttctagcttgaaattcagttagatgttttcaggatctatagaaatatttaccaagtatttagatagatactgtaagttaaacattaaatgttgctattttgtaattttgagattatgagtataacatttgttctgaatgatgaaatttgaaaactgccctttccaacattaaacagaatgaatccatatgggtaatctttgtttctatatcctctgagtgtttccatttgttggatatctggtaggtaagtccagtgttttgttttttcttttggaaagtggattatttttcagaaaaccttatccatgtaaatgcattattatctaccgtgttgcctatgtcagaaacctgtcattcttgatgacttgtcctcctttgcatttgacattcaataattcaccaaatcctgtcaagtctacctccaaaaatatatatgggattttttattttgctgtatcccaaggtttcttcactacccatgcccggaggttctatttggtacagtaagaaatgtgaatggtaccctgcacagaggaagtttctcaataagtattcatagaatagaagttacaaaagtgttgctagacaatttctctctctcagtgctcctttcagttcacagtagaaacaaatgttcaattgttgggtcagtgcacaaataagtaggtccatattcttggcattgctactgtacgtggtcttgcttccttccttcctgctgttttccacttctgcttttctttattctttctacctggcaccctcacaatctttcagtctctcaatctctggatcgctggacctcactgtcactctctctttttctctttcccttttcctcccagtttcccttaaagtagttctgatttactacataaatattatgtgccagcactctgatggaactttcacacgttctcattgtttcctttcatttgtaccataatcctacgagggagggactgctattagctcatactgctgatgagaaaactcagtctctgaaggcttatgttgcaaattcagggtcacacactgaccagaaaggtaactgagatgggtgtgagcagtgtgagagtagaggctggggcgccagttagctatggcaatattctgggcaatagacaaatcaaggtcagaattagggtagtgtcagaggaaatatacataactgggcagaaaagggactcagtgaaaataaattctttcaaagtactgatgggcacactttaatgaaaaccctcagggcctcatgcatactgggagcatattttactctgaaagcaacttcctgtgagattcaagtcaccagaagtccaaaactgattttaaattagttttcaagattcgtagattcctgctatgttccagccaaggcattcttacttgctgcaaggactttcagagtgcccttcatagctttctatgggaattccatctagataaaaccatcttttttaaaaaaggctttttgctagagtaactgactgtgtttgacgaggatcaaaatgggtttgtcttcacctgaaggtcactctggagagagtaaggcagaatgtcagtgtgcagtaggagatgtggagttaaaaatatgataagtttatgaaatgtggcttctgagaaaaattggagtggtgggcttatcaacctctttttttcctgtttcctcacttactactcttgtacgtctacagtggagaaaacagaaagcagtgttttaatggatcccaggaaaaggctaacaccacatcattgaattggacatgactatcccaggcagtttggagactggccagtgacaccctttgttttaaatcaattaactcttttccatcaggtttacttggcaaataaataatttttatggtgatcaaagaggggatggaggaattagaggaagctaaattttatagttcttattttttcccaaatatgaagaaaactgaaattattcattgattcggatagaacactgcaagtgataaggattaatttctccctctcaagtaataaaaggaccaaaagtcaagtcacagctactagaactgatttttcaaaagtcaaaggtcatgtgttaagtacttttaataaaaatcattgccagggttgcctatgaaagctaggttgttttacaaaaatgttcccgtaacagcaacagcttttggtggcttgctgagggaatgggaaatgaagtctgaactactgggcagtggcaaaataggtctcatatagaaaataagatgccttataacattaataagaaaagaatgcctgaatgctttcatttaacttcctaaaacacaatataatttggagcctccagctgtatcatctactaaagaacctaagaagaaagaatctttgtaatctgctgacgcttgaagtcaatgagaaagcacaaaagatgctaataaacttagctgctacctacagatgaggatgaataaaactgataataatcacttccaaagatgaataataaccattcagggggtttcactcctggtgtgttgagtgtataactgattatattaattaattgctgcttggcatcgatattaaggtattggctatgtgggaataatttaagcgatcactggaaatcctcaaatgtgataaagaaaaattgtcaaaaactattacttatgtaatcattagtataattaagttctccaggcttatcaagtgatttacacttggtagacatactaagcacaattgttctctctttttcagtatgtacatggagattcagatcacttattagactcataactggggatggtggctcactcctgtaatcctagaactttgggagggtgagcgggtggatcctttgagcctaggagttcaagaccaatctggacaacatgacaagaccctgtctctacaaaaaatacagaaagtatttagccggactatgtggctcctgcctgtagtcccacaggaggtggaaggatcacttgaacctgagaggtgtaggctgcagtgagccctgattgcaccactgcactccagcctggatgacacagagagaccctgactcaaaaaaaaaaaaaaaaaaaaaaaaaaaaaaggcttgcagaaggtcactcagcaaagtcacagcaaaacaataattggaaattaaaaggttctaattcttgttctaaggtttaatatctacatttgtattttccttttcaacttgaatttatttttgactttaaaaacagctgtagtcttcagaaggtggccctccttgattttccaagggctttgtatgggaaagcttattggatgtattttaaaagaataatttaaattatttaaattctagtttttaaagagaataggagaaattagatgagtataattgccaagtagagtccctgtgattacttattttagtgtgaaataatgaaaggaacattagaccccacagttgggaagtcttccattgatagtgccaggtgaccttgggcctatccttcttttaactgtgtcccaatttccttctttgtaaaatcatcaatggtgataatatctgccatttcaccactcaccactaagatgagtagtgaaacataaaccatgactattcttttaattctggttttctttcctagtttctaaaacactggggagtaaagaatatgtccacacatgtgcacctacatgtatgaatggtggggaagaagggaatagatgggcttgtgtgtatttaagactatgagttctttgcagccagggactctacactattattttatgcattattttatctcctaaataacttagccaaatgccttaaatgaacacattaatccagccttctctctcttttgcatggtctgaaaaattttgtaatgtttttcccaatctacctttccttttccttatcctatatatcctttgctttagccactaagagactacatgagctttccctgaagatgcttgacgttgtccttacatcttgagcttgttcttgatatttcctgttttaaataccattcccaacccctccgtgaactccaaatcacacttgaaggatgagttccttgtaaagtccttttggtcatatgacatagaattaatcactcttggacattctactataaaccttagcatgttgttttttcattattagttcatatgtctctttcctcagccagaatgggtaaatcatgacttatttacatgtttaccacatcaagaatgtagttgatacatgttgaatgagtaacaactaaatgaattagactctcagcctcttgaacttctcataggaggcaatattaagcagaaaagaatgtcctccttttgactcatgttatctcagttaaaattctgcctattgttggatacatgtctattttatttaaccattcttgtcccagtttacctgattttacaaaggtcatagcaatagaccttaactcacagagtcataatgagcataaaaatataaataatgcagagtgcttagaccattgccaggtctaaagtaagtgcaaaaaatatgttaacaaatagtagttaagagtggtgcttaatttatcacacttaaagaatagtggaaacaaagtaaaggatctcagtgcgatagtattttgaatatattctaccaacttaatcagatcaattgtatgtaactagattcctctgaaattagtaaaagatttttattatataagtacagttgatcctcattatttacagattctgtagttgcaaagttgcctgcctgcttgctaaaatttatttgcaactcaaatcaatacccttggtgctttgtggttatgcttagagcagggtaaaatttgagttgccaaatgtccacgttcccagctgaggttgaagaaagagatgctctgtcttcttgttttagccctcatactgtaaacaagcaccctttttgaggtccatttggtgccatgttttttgtatttctgtgcttttggttggtgatttttctgtttaaaatgatcccagagtggagtgctgaagcactgtccagtgttcctaagagcaagaaggctgcgatctgccttatttctcgcattaaagttcaaagttaaagagttgacaatactgtcatattaaataaggtatcattaaatagaaacacacataaaacaaggttgggtacccatcagttgacaaaaatattgtaaccagaggcttgaaggaacctaaacctatatttcccctaggagcaatatttcagtattctcaaattcagtgctggggtgagggcagctatacagaaaataacaaagtaagttactcagcaagtaaatgcaaatttagattatattttttttcttctctcagagaaacttatctgcagagcaccagctaatttgtggtagatctggaagaaggaggttggatttctatctccctggagagtctagctctgcctctgctccatgactgaagcagggacagggaggtcctggacaaatccattatttgacgttggttctggattcattctttctttctttctttctttctttctttttttttcttttctttcttttcactctttcttttctttttctttttcttcctttcctttcctgtcctttcctctcctttccttctttctttctttctttctctctttctttttccgagatggagttttgctcttgttgcccaggctggagtgcaatggtgtgatctcggctcactgcaacctccaccttccgggttcaagcgattctcctgtctcagcctcccaagtaggtgggattacaggcatgcgctaccacgcctggctaattttgtatttttagtagagatggggtttctccatgctggtcaggctggtctcgaactcctgaccacaggtgatccacctgcctcggcctcccaaagtgctgggattacaggtgtgagccactgcacccggctgtgtctggattctttctaacagcctgtaatttgtttctaccacctcaaaaaaaaaaaacaaacaaaaaacctctgtgtgcttattttaaaacttaatttaaatattttcagagtattacatgcacattattttttaagttaaataatactaacaagcctataacaaaaacaaacaggctctttctttcccctccccaaaccctgcctccattccctaaagactgcctttttttttctgacatttacctttatgtttctcagtaatctacttatttagatgtctcttagtttaccagttttaattcatcatttgtagatatcatctattggtttatttttatgtcaggatttggtgctgacacacttccatcctcattttcttctccaatcttttctcttttttctactgctgcttctcctcctcttccttattttgttgaggtgtaattaaaataaatgaaattataaatcttaagtgttcagtctcatgaatatactggtattctagggctgccataataaatactgcagactgggtggcttaaaaaacaggcatttattttctcacagttagtgaagctagaagtccaagatcaatgtgttggcagatttggtttcttctgaggcctcgctcacttggcttatagatggctaccttcttcttgtgtcttcacgtggtttttctctgtgcatatctgtgtccttattttcttttagagacaccaatcatgtcatatttaagacctaccctcgtgaactaatttaaacttcattacctccttcaaggacttatctccaaattcagtcagattcttctaagatacaggagtaataacttcaacatatgactcttggtggtcaaaattcagcccataaatatgtattttgacaattgtatccatctgagtaacaaacatgacatcaatatgcagatttccatcaccccaaaaagtctactggtacccatttccaatcaaaacccagaacaactatttagactattctgacttcgaatactgtagattagttttgcctattctttaacttcacataaatggaattaaacagtatgtactctttcgagtctggtttttcatcatattatatcttttatcacattacaattttcttcattgtcttcaacgctgtttgttgtgttttaaatatttttttttcagactgcactcttttcctggaacacatctttcattagcttcctgttaaggaaaacacaaatagatatcttagaaaccatgtatatctgaaatatccctatactgtccttagcatatattcttatacttgtgctatattatccttatgcttgcttatttgactggacattaaattctagacttagaatcctagattagaattgtatgattcatgttctgttgttttctaatatcgagtgttgttgagaaatctgatgccattcttactgttgatcatgttttatgtgacctgcttttttccccttcattctggaaacttgtggatcccctccccactctccatgaggctctagtattttacagcaatgtgccttgaaatggatctgttttgcatttattttgtttaatattccacaatctttttcagactagagtctcaagtattccagttttgtaaagttttattgggaaaggggtcattttatcatttttgctaattttctaccttttatttttcctgcttttttattctctcctcaggggtgttggaaattgagaaccaaatctctaatttgttaccttttctctcccatttcatgtgataatttattcccactgaattttgagagatttcttttaattcatcttccaacttatttattgaatatttaatttgtgcaatcaaattatatttgtaataagtttctaaaaatcttttaatattcttgtgtttttatcctgttgatggatggattatcatttcttagattaccagggtattaatgacgtctttttggatttcattctttgcattactgatgtttccttcatgtgctgttatcttcttatgtattactttttccacttcctttatgctaagggccttctttgatgtctggtaatcttaaattgtcagtttacattaaaatgaagtatgaaaaagctgattttaaactacaaattttagcacttgagttggacttattaagtagtgaaatgggagaattacttgaccccccttgcaggatatgtgacaccggtgtggcctgtctgtttggctgctgcaccctcaaaccccttatgggacagggagcatgcagacaggcaggagctagggtgagcacttttggtctctgagcccacagtagcatctaggggttgctgtctgtgactcccaaatccccagtgagtgtgctacagtgctctttcagctctgccatctgcagacagcttaagtgttaaccagctcagtgccttcttggtacctgggttcttgtccagcatccaggaagaatcaggtcacatgaacaaattgaaggatggtaaatgtgggggattttattgccagatggaggtggctctcagcaggatggatgggaagctagaaagggggtggagtgggaagatgatcttcccctggagtttggtggtcccatggctgatctcctacccgactatccccagctgaactcctctcgatgttcagatgctccttctcttctcttcttttctgccacactgctcttctgttcctctcctcttctgctagtctgctcatttgcttgtggagcctggggtttggggttaatatgggtacaggatagggggacatggcaggccaaaaggcaacatttgggtgtgaaaacaggaatgactgttctcatttagggctgtgggtttccaggcttgagggtggggccttttgccagagaaccaccttcttttacccagtatttccctgtctcctgtccatatcagtaggagcctcattgttggggaattgatcagggatatgactgctttttttttctctagggcaaagataataattttctctagagaaggattatatgatattctacccaagaagcatatacctggttgccattgctctaggtatcatatgaaggaagaagacatgggtagctcatatctttgatttacttactcttgcctacatccctgttctctcctgtgtttaatatctctgaaactttggcctctgagttgaatatccccagaggataaagctaccaacacctccaaggtcagggagggttagtagcctggttttactgggtataggtagaaacctgatctgaatgactttcagtccttcccctccttcaggactatgcttggaagtcctaccttccaagttatataagcaggaacaatgtctaggaatccctgacttttgatgtgcttttcattgccttgcttttttattattgtctcttaaaaacgtatttagttttccggctctcttctttggctcagtcaacctatgatacggtttgactgtgtccccacctaaatctcatcttgaattgtagctcccataattcctacctgtcatgggagggacccgttgggaggtaattgaatcatgggggcaggtctttcctgtgctgttctcatgatagtaaataagtctcacgagatctgatagttttataaaggggagttcccctacacacgttcccttgcctgctgccatgtaagacatgtctttgcttctttgcactctgccatgattgtgaggtttctcagctatgtggaactatgagtccattaaacctctttttctttataaattacccagtctcaagtatgtctttaattagcagtgtgagaacagactaatccactatagctccctccgatttgcaccttccaaatattagttgacatctctcatgcaatataaccttattctctattgttttgtggctttataccatttagaatattttactgtcattttagcagtgtatgcaaaggagaggtgataatgcattcaatcaatcaaaggaaatgtgtatttttgttaaaaccagacaaataagaatgctgtcagattataagaacgaatttaatttgtctctaagtggcaatcgctaacacttcttgcttctctgctttcttcacacttacgtttgggttacttctttgaccctgtcccattgtcctttctttcttcaatgttttaatttacacctattattttacagagtatcaaagttagctggctgcctcctccatcaggaacacaaaatggatttattaccggctataaaattcgacacagaaagacgacccgcaggggtgagatggaaacactggagccaaacaacctctggtacctattcacaggtcagtgttcacatggtgtagtcttgcaaggttttgatgaattaaatgctttaggaataaaatatagtctcactccaaaggaacattgattttcttcctggcatccaggcaggtgacatctattggctggaacaagaacaacctttatatttttaactttacattctctataatgttttcactatatatttctctctggatcatcgtcttaatacatgtatcataaaatttttattcatactagtttctcagcattgctgattcaacaaaagcatctgttatctaaaaacttaacattttaaccagtaacttttaaaagtcatctaatgaaattgttccaatttcaatcactttgattcccctctaccaatattcaggggtgagaatgggttgaaaactgaagaaaagggtagattgtaaaacaaagagagagattattctaccttctgccaatataaagtaaattcacttatgcagcaatattgatagaattcagagtagatcaaccttctctatgaaaactggacccagtttgcatgtaaagaatatatttttttaaattttataaaataatcatgtatttaataactacaacctttaattcacaacagctcaggttcctagaaaacagaatgaggcgaggctttcaacgtaatacctttaaagttataagttcaggaaaacaagaaggagagaacaaggaaagcaatccagggaagaagagaaaacagataatggtggtacattatccatctgtggtggccacaacttcggggcaaacacagcacttgctaggtctcctgggtgtctcttgagaagccacatgaactatctcacagtccatggatagaaggtgtgagcagttgctctcttgtttctcactggttgagttcaccaacagcttactgattactctgcacctcccaggcagtccccagtgaagccagagcttctgatgactctgcagacacataggtgtctttttgtcaatcaacattttatgtgatggtggcttggcctagggtatgatcagagctcagggcttttcaaacctaggaatatcttgagctactgccagaaacttggcaagcaaagcatatagaatggctcatgacacagctgggtagatgaagttgagcgactctgaagtggcacataaactgggtcaggacaacatacaaaccataaagcacatgacttacaatttatagatgaggtaaactaccattgcaagtgagaaaaaagaaagtaatcccttatgtattccttttctctacgccagatactcagcgaatttccatttgaaatcatgactcacacacattataagcttcttgttcagcctacactcagagacttgaaagtaacttgtttatttattttttcttcttttctctcaggttgtcttttatgcctatataattttagcataatggccagagcacttccaaagtagattgccaaaaatcatgttttaaatatggacaaaatctctgaggcagggaatggttgaatctaacggaaagtttaacatttaccatatcattttaaaagattttgaaaagccaatatcctatgtttttctttttcccctgacaaaataatggggaagatggtaaaaataatcaaagtgaggaacatgtattcattaggatatttggtacaatatgacttttactttgagagaaatcaccaaaattgaaaaatcttgctaaaaatattttagtatggattctaagatttaatattagagtagaggagacactaaggataatttaatccaagctcttccagacatagagatttgaagcctcaaaactttatcatcattgcttttgcttctcaaatgataaacattgagaatataaaattaatttcttactataaaataattaactaaaggattaatattccaataaaaaagctaatgattggatgttcaattcacagaactatacgcagccaataaagatgataaaatgttcaatctcattagcaaatagagaaatgcaaattaaaataaaaatgagttagcattttcctttgattaaagtaataaagataaaaataaatgagggcatcccattctggaaagcatatgagaaatgtaaactctcatatactgcttgtgggacagaaaatgtccataacccttctggaaagcaatgtgtgtgtatgtatatatatatatatatatatatatatatatatatatatatatatatatatatgtattttatacgaggtatatacatgtgtatgtggatgtatgtctgtacatataattttcttttcataaagatatgacccaggtttccaaattctacgagtttatcctaggaagcaatcatatttttgcaaagtttttagctagatgcatattgtcatattattttaatagctaatagtgtttttgaaaacctaaatatccaactataggaagttacctagaaaactcagacacagttgtatcttggaatactatatgtctaatttaaatgaaatagtgtaaaaatgttaaatcatatgtaaattatgattatttaaaacatagtaagcaaataccccagttttaagtcagtattagtacaagagctcgtatttattaaaaaaagcattcacataaaaatatttagaataatatatatcccaaattgttgaccgtgaatattgcttactttgtaacaacagtatgatatgtatttttaattgcatatgcaaaatgaaaaacaataagttaaaaatattacaatttttgctttcaaaaattgaagatttcttcccactaatgctaactcaatatcatctgaatggcttagaaagcagtggtccagaaaacaaatgaatagtagcctcatggccagtagaatttgctagcgttaattgcttagtccttatgagttattttggcaaatggaagttaacacattcagttagtattttcaaaccaagattctgactccctaaataacacatttaggactttccctctgtttaaggtaaaatcattgaaaaaacgcagtacggcaactattagctttctcaccagcagagacccaaaacaaaataccacgaatttcgtaacttgaaagaatagacatttattctcatagttcaggaggccagaagtctgacattaaggtgttggtaggttcagctccctctgtaggctctgagaaagaacccatcccacaagtctctcctaactgctggggttaccggcagtccctggtcttccttggcttgtagatgcattgctctaatctctgcctccatctttttatactttcctctctgtgttctctcctcttccttttttatttgttttgtttttttgagacagggttttgctctcttacccaggctggagtaccgtggcatgatcatagtttactgcagacttgaccttcgggactcaagtgatcctcctgcctcggcctacggagcagctgggactataggtgtgtttcaccacacccagctaattttttaaatttttcgtagagacaaggtcttgctttgttgcccaggctggtctcaaactcttggcctcaagtcattctccctccacagcctcccaaagtgctaggattataggcataagacactgtgcctggcctctctcctcttccaattaggacattagagatagagcccacttgaaatccaggatgacttcatcttgagatcatcaactaattataactgtaaagaccctatttccaaataaggtcacatgctgatccttcagacatgcatgaattctagggggataccattcaaactactatagactcctttttaaatttttcctctcaaggacaatcattttgaattgtatcttctaataaactttacttactcaaaaataaataattcagttctacattttcattcatctaaaatatgtgtgacagttagaacttctaatcagcatgaggtaacccatcaccactctggtttattatcattccagccaaaagcaaagtgagatgaattaattagttattaggaacagctcacaaatgcccatttgcatcttcatagagctgtaagaatttggatccaaaatatgtaggctttattcatattgttacatcttgatttcatgagttataataaagcatttaggaatgcaaacaaaatatgagcagttatatgtgcgactatgcctgagatttactgcaaacatatatgtgcgtgtatatatatatatatatatatacatgtatatatacgtgtgtgtatatatatatatatatactctttctaaatttgaactaaagcaataaaaagagttaatgaacagcatcatatacttaaaatttttttgagtagctttggaaaatcgttccctcctctcccctgctctgtgactgggctacagaaacacctgttgcattgctagatattatgggaatatatgtcttcaatgctacaaaacattaaggaaccagggagcgctacatacttgtagattggctttggtttagacatgtccccaggatatatatagcacttacacactttgttgtaagcagaagtaattgattttccatataaatctacagcactgtaaaatgtaaaggatttgatcctatgattttaatgcctataagatacatggatttattgatttggctgtttaaaaaattggaaatttcagaatgctccatttgtatgttataaatattcaggtgtagatactcaaatttttttttacaatcttctatttgttagacaggtgttttttgtgtgtatgtgtttttttaatgagaataatgagacatctgcaataacaaagtaattcagagttataacaagaattgaaatcactgctatcaggtttattgtgagaacccacgtcaactaaattttaaaacgtttttaatttttgactgctcttcagggaaggttgtttgaattgaatttaagagttttcttgtgtttcatggtcaatatataataaacataataataaagatgcattgatagtttatggactgaaaaattgaaataatagcatagcaattttataacagggctaacattgggaaattgtgttgtttgaataatatgccatctcttactagaagttctaaaaattagaaatagaacataagaattacaaagcttgaggacacttagcattcaggatagaaacctgcagagataatcaactttcaacaactgaattttttacagctatgaaaagcattgctagttacaccgtactacccttacaataaaggtatacttagaagcatctaggacacacacacacacacacacacacacattgagattgaactttatgatcctgacaaacatagcaggaaacacagaattcgtctcatccaaactggttgggttttattttatttcatttatttatttattttatttatttattttttttgagatggagtttcactcttattgcccagactggagtgcaatggtgcaatctcggctcactgcaacctctgcctcccgggttcaagtgattctcctgcctcagcctcaccagtagctgggattacaggcatgcaccaccacacctggctaattttttgtatttttagtagagacgaggtttcgccattttggccaggctggtctcgaactcctgacctcaggtgatccgctctccttggcctcccaaagtgctgagattacaggcgtgagccaccgcacccggccatactgcttattttacagaagaaataactgaggtctggagggtggtatggctaaggtcctccactagttaaggagatgatcccaggtgaattgtgtgttgtctaactcctcattatgtgctcctttcactatgcgtgttgtcatctttagttcactttattgtgagtgattaaggctgttatataactttgtaaaagataattaacattaaaaacaatgtttaacatttacaacaataatacccatattattacttactgaactcaaatcattcactatgctaaaagctatatgtgtgttttccattttaatctttatgacagtttttatttatgtatccccattttatggatgagggcatggaagtaaacaaagaggcctggtttttcatggtcaaccagctaataagtaatggaatgaaaattcaaacctaatactgcctgaatagaaaacctatattcttacctcttaaactgtaaataatgtgtttctcaccgtaggcaatgcattcgtgattgtatcagtattaaaagggataggagaaaaacacaaggatggaaaaagatgtctattggacaataaaacttaaagattaccatacagtgggtagggcgcggtggctcatgcctgtaatcccagcactttgggaggccgaggcgggcggatcacgaggtcaagagatcgagaccatcctgtctaacacggtgaaaccctgtctctgctaaaaatacaaaaaaaaaaaaaaaaaaaaaaaagaaaaagaaaattagcctggtgtggtggtggcgggcgtctgtagtcccggctactcaggaggctgaggcaggagaatggcatgaatccgggaggtggggcttgcagtgagccgagattgcgccactgccctccagcctgggcgacagagccagactctgtctcaaaaaaaaaaaaaaaaaaaaaaagaaaaagaaaaagataaagattaccatacagctagaggagctgactaactctagaacatattaaataaaagctttcctggccaaattatttaaatttttaaaaatattcctattatcccagttcaggaactagatctaagataacagcttttcaaaatatacatacaaaaaaaaaagcttttaattggccggacgtggtaacttaagcctgaatcccagcattttgggagaccgaggagggcagatcaggaggtcaggagatcgagaaaccccgtctttactaaaaatacaaaaaattagccgggcgtcgtggcaggcgcctgtaatcccagctactcgggaggctgaggcgggagaatggcttgaaccggggaggcagagcttgcagtgagccgagattgtgccactgcagtccagcctgggcgacagagcaagacactgtctcaaaaaaaaaaaaaaaaagcttttaattacagactgccttctctttactccacctccaatgaaagagagagaggaagggaaagggaggggagaggagggaagggaaagggaggggaggggagggaagggaaagggaggggagggaagggaggagggagtggggagaggaagggaggagggagggaggagggaggaaggaagggaggaagaaaggaagggaagaaggaggaaagggaagaagggagggaaggaaagggtggaaaggaaggaaggaaaaaggaaggaagggagggaaggaaagaaagcaacattgaaagatcttctgatatcagctatcagagttggggcccccaaaaattgcttggtggtggttattgttggtataactctggaagataactcttttctctaatagggtatatttatttatttattattgttattattattattttgaagacagagtctcgctctgtggcccagggttgagtgcagcggcacgatctcgtctcactgcaacctccgcgtctcgggtacaagtgattctcccacctcagcctcctgaatagctgggattacagacgtgcgtcaccacgtcaggctaatttttgtatttttagtagaaacggagtttcaccatgttgaccaagctggtctggaactcccgacctcaagtgattcgcctgcctcggcctcccaaagtgctgggattacaggcttgagccaccgctcccggccgcatttctaagcaagagaacaaattaactcttcttgagactgaattttggatattactgatttcttagcttgatccactgtcaaaaataatagaatcatcaattttaacctccctacctgcctattattcaagtctgatgtagtgatcatagatagatatttcttccatgcctgcatagtgctttaaatttgttgctaatgtctctcttgggttctagcatagggcatgtgggcctttgaaggtgcccagcaagagacagaacagagtcaagattctttacccaaggatagtccaagctttaactaaaacaccataatacgttagcttaatttctctgagccttattcatgtctctaaaatgggaccaatcatgtattctgcgccaaaatcgcagggtatttgaaaaatcaagaaagtaacctggaaatcactgtgccaatgtcagttatcactacatctatgaaacgcttgattttataaatcacttttacaggcaatttttcatttgaccctcacaagaaacactataaagtggaagcatgtattattacttaatcacgttagataggaaatagctattaaaagagcctccagtacatctaaaattttcccaaacaaatcacagcatagaagcagggccacctgaaacctggaattctaaaggtaatgtccagactgcttctctgaaaagtcaaaatttctgcttctgctttatatcatgcacttacttgggtataaaaaaaggatcgcaagttaaattttcttgataaaggtttgataaaaaagttaccgaatttagaatccaaagtcttggataaacatgttttataggagaaacttaatttgtttttatcccactaggataaaactagtgcagtctatctgtaagtgatactatggtaaatcagattcagtgcaacctaaggaagaacttttctaaaaagcaaaacttgaaggtgagttatctccgttgctgaatttctcatccaacaaaagtattcctgctttatttacagggacactttgttagatattcagcattatatgagccatttgactagatattactgaagattttctttaataatgggattctatacatatctaaattttttttatacttaacctagcttttttaggtgtttgtagttagattccacagcccagcaaagttgaaggtgttttaaggataaaatataatacttcaaagacatttggcaggattttcagagtgacctgaggcactaatctctacaggatgctaaaacttccctgcagatgtaatagaaaggaagatatgaagagctcccctactgtatatggttggaagggatactctgataaatagtatagcctggccaggtgagatccctttggggaaatacttacaatacactagatggcctctaaactgctttctttttattattattataacttaagttctggaatacatgtgcaggaagtatagatttgttgcataggtatacacatgccgtggtggtttgctgcacccattaacccgtcatctacattaggtatttctcctaaagctatccctcccctagccccccactccctgacaggacctggtgtatgatgttcccctctctgtgtcaatgtgttctcattgttcaactcccacttatgagtgagaacatgtggtgtttggttttctcttcttgtgttagttcgctgaaaatgatggtttccagcttcatccatatccctgcaaaggacatgaacccatcctttttacggctgcatagtattccatggtgtatatatgccacattttctttatgcagtctatcattgatgggcatttgcattggttccaagtcttggctattgtgaatagtgctgcaataaacatacatgtgcatgtgtctttatagtagaatgatttataatcctttgggtatatacccagtaatgggatcgctgggtcaattggtatttctgattctagatccttgaggaatcgccacactgtcttccacaatggttgaactaatttacactcccaccaacagtgtaaaagcattcctatttctccacatcctctccagcatctgttgtttcctgactttttaatgatcaccattctaactgacatgagatggtatctcattgtggttttgattagcatttctctaatgaccagtgatgagctttttttttcatatattttttggccccaggaatgtcttcttttgtagtagtattgtctgttcatatccattgcccactttttgatgggattgtttgtttttttcttgtaaatttgtttaagttccttgtagattctggatattagccctttgtcagatggatagattaaaaaaatttttctcccattctgtaggttacctgttcactctgataatactttcttttgctgtgcagaagctctttagtttaattagctcccatttgtcaattttggcttttgttgccattgcttttggtgttttagtcatgaagtctttggccatgcctatgtcctaggttttcttctagggtttttatggttttaggtcttacatttaagtctttaatccatcttgagttaattttcatataaagtgtaaggaaggggtctagtttcagttttttgcatatggctagccagttttctcaacatcatttattaaatagggaatcctttccccattgcttgtttttctctagtttgtcaaagatcagatgattgtagatgtgtggtgttatttttgaggcctctgttctgttcctttgctctatatatctgttttggtaccagtaccatgctgttttgtttacggtagcttatagtatagattgaagtcaggtaggctgatgcctccagcttcgttgtttctgcttaggattatcttggctatgcaggctcttttttgaaaccatatgaaatttaaagaagtttttttttttctaattctgtgaagaaagtcgatggtagcttaacaggaatagcattgaatctataaattacttttggcagtatggttattttcatgatattgattcttcctatccatgagcatggaatgtttttccatttgtttgtgtcctttcttatttccttgagcaatggtttgtagttctccttgaagacacccttcacatcccttgtaagttgtattcctaggtattttattctctttgtagcaattgtgaatgggagttcacttatggttaggctattatcggtgtataggaatgcttgtgatttttgcacattgattttgtatcctgagactttgctgacattgcttaacagcttaaggaaatttggggctgagatgatggggttttctaaatatacaattaggtcatctgcaaacagagaccatttgacttcctttcttcctatctgaataccctttatttctttctcttgcctgattgccctggccagaatttccaatactattttgaatagggatggtgagagagggcatccttgtcttgtgccggctttcaaagggaatgcttccagcttttgcccatgcagtatattggctgtgtgtctgtcataagtagctcatattattttgagatacgttccatcaatacctagtttattgaaagtttttagcatgaagaggtgttggattttatcaaaggccttttctgcatctatggaggtaatcatgtaggttttgtctttgtgacaaaatatctcaaaatattgagataatcatatggttctgtttatgtgatggattatgtttattgatttgcatatgttgtaccagccttgcatctcagggatgaagccaacttgattatggtgaataagctttttgatatactgctggattcggtttgccagtattttattgaggattttcacattgatgttcatcagggatatcggcttgaaatttactttttttgttgtgtctctgtcaggtgttggtatcaggatgatgctggcctcataaaatgagttagagaggagtccctctttttctgttgtttggatggtttcagaaggaatggtgccagctcatcgttttacctgtggtagaattcggctataaatccatctggtcccaggctttttttggttggtaggctatttctgcatcaattccagaacttgctattgttctactcagggattcgacttcttcctggtttagtcttgcagcgggcagggggcatatgtgtccaggaatttatccatttcttctagattttctagtttatttgcatagaggtgtttatagtattctctgatggtagtttgtatttctgtgggatcagtggtgatctcccctgtatcatcttttattgtgtctatttgattattctctcttttcttctttatttgtctggctagtggtctattttgttaatcttttcaaacaatcacctcctggattcattgatttttttgaagggttttttgtgtctctatctccttcatttctgctctgatcttagttatttcttgtcttctgctagcttttgaatttgtttactcttgcttctctagttcttttcattgtgatattagggtgtcgatttgagatctttcctgctttctcctgtgggtatttagtgctataaatttccctccaaacactgctttagctgggtcccagagattgtagtatgttgtgtctttgttctcattggtttcaaagaacttatcaatatctgccttaatttctttatttacccagtaggcattcaggaccaggttgttcagtttccatgtagttgtgtggttttgagtgagtttcttaatcctcagttctaatttggttgcactgtggtctaagagactatttgttatgattttcattcttttgcctttcctgaggagtttttttacctccaattatgtggtcaattttagaataagtgcgatgtggtgctaagaagaatgtatattctgttgatttggggtggagagttctgtagatgtctgttaggtcctcttggtccagagccgagttcaagtcctgaatagccttcttaattttctgtctcattgatctgtctaatattgacagtgggtgttaaagtctctcactattattgagtgggagtcgaagtctctttgtaggtccctaagaacttgctttatgaatctgggtgctcctgtattgggtgcatatacatttaggatagttagctcttcttgtttcattgatcactttaccattatataatgcccttcttcgttgggtttttttttttttttttttgtgatctttgagaaaagcaaccccaagatacataatggtcagattcaccaaggttaaaatgaaagaaaagatgttaagggcagccagagaggaaggtcaagttatccacaaagggaagcccatcagactaatagcagatctctctgcagaaacactgcaagtccgataatagtgggggccaatattcaacattcttaaggaaaagaattggcaacccagaatttcatatccagccaaactaagtttcataagcaaagaagaaataaaagcctttacaaacaagcaaatgctgagagattttgtcaccaccaggcctgccttacaagagctcctgaaggaagcactaaatatggaaaggaaaaactggtactagccactgcaaaaacataccgaattgtaaagaccattgacaccatgaagaaactgcatcaactaatgggcaaaataaccagctagcatcatgatgacaggatcaaattcacacataataatattaacctttaatgtaagtaggctaaatgccccaattaaaatatacagactggcaaattggttaaagagtcaagacctattgatgtgctatattcaggagacccatctcacttgcagagacacacataggctcaaaataaagggctggaggaatatttaccgagaaaatggaaagaaagaagaaaaaaaagcaggggttgcaatcctaatctctgataaaacagactttaaagccacaaagatctaaattgctttctaatgataacttcaagttgttagcagactttgctttgcttaaaacaggtatatcagtcagattttcaccagagaaagaaagccagcaggaaatacatactaagaaaagtattgcaaggaattggtttaagtggttatgatggctggccaggcaattcaaaaatcactgggcaggccattaagaggggcaggctggagctctcaagctaagtccacagccatggcagggcagaagttctgcctcagggcagcctcagttctgcacttaaggtcttttatctgaatgaatctgggccatccaaatagattacggcaatatctcttagttaaagtcaactacatatggacttattcccatcgacaaaataccttcacagtaatacctcagttagtgttggattgaataactgggtgctgtagccacctaagttgatacatataactgaccatcacagaggatatttcaaatcaatcactggagacagtattgacatgattgtttattcattttaaagaaaaatgaagttaaacttctacataacgcaagagtacttttttttttttttttttttgagatggagtctcactctgtcacccaggctggagtgcagtggcatggtctctgctcactgcaagctctgcctcccgggtccatgccattctcctgcctcagcctcccgagtagctgggaccacaggcgcccaccaccactcccagctaattttttgtatctttagtagagacggggttccaccgtgttagccaggatggtctcgatctcctgactttgtgatccgcccgcctcggcctcccaaagtgctgggattacaggcatgagccaccgcgcccggccaagagtacatttttgatggattagaactttattttaaataagagcattatgaaagtcataagctgttatgagtaggtaaccatttcttctcagagttctctccctattaattttttaatttcccagaaaatctctgtaacccctctgcctctgtaatcaacaacagtgcctactaaatggtgaaaaagatgaacaaaattagatcaataccatgttaacaaatcaaagtgagcacgagcctacttaaggaatgacaaaggccttatgttggaagcatctctttgccatcttgttgatgtggttgaatgctgtatattaacctaatgttttctttatgttaagttttagttttagtggatttttcaagtattgttttgtgtgtgcatcttccctgcttcaggtactattgtgggccctatgaatatgcaattaaaacctgaataatattaataacaaagataagagcaccaatgatagtctcaatatatgtcttcatggagcttctagtctattttataaaattagaagcttctttagaggacagaaatttgtgttatagatattatgtaggtgaatttatcaaatggtctaatagtaccgtctattgaaggcaactgtttgttccttgacaataactaatcctttctaaccattatttaaaataccatctcctattagtagtaagtttgaattccccttactactaagtattcatcttcctatgcaaaaaatcttcaaatatgtaattttgtacatgagcgtaattacttttattatgcatttttttcttgacaccaaatatttgcactatttcagatgaatgggggataacagttacatttttatctttatcagcgttgtttaattccttgaggtttaaggacttgatcatttagtctgagtctcaaaaatgtcctatggtcttttcacaaatatcatttattttacaataatttatcatgttaatgagctactttcagctttttgtaagaggaaagtcacttacatcaaaaattttcatatatcagataaatgatccatgtggtctctctagtttacctatgttctctgtgcgttttgaaataagccctaatgtgatcattgtgcacaatattatgccaaaatcatcatagggattgattttctatatctcttgtgtggaagctaatgcaaaacaaaatattcttgaaagatggttttaagagacaaaagccctaatattttcttctgaagtgcattttctttggattcttgatttttggcctaaagaaaacataatcacagaccttgaatgaatgatggagacataaatttttagattgactgttcttgatttatagacgtggatcttctgaacagtaaggaaaaattatccatgtaatttttgattatttcttcatcatttatattttatattctgcatctgccctgaggctatttacatggacacatttttataaactggaaaaaaactcataagaatgtataaaaattaatttgatttcttgctatgatatttctacccttttagtcaaaataatcattaccacaacagtcacaaacaatgtaaagcatgtccactattgttacaattttgctgaagcttttggaaacccaggtaggaatacttggtgcatagtaactttcttcccccctgtggaaaattctttcataggactggagaaaggaagtcagtacagtttccaggtgtcagccatgacagtcaatggtactggaccaccttccaactggtatactgcagagactccagagaatgatctagatggtaagactttttcccagttactatcactctgattatcttcttgttatctcagcttcaaaaggtctcttaaaaaaggaatgaactccaactttggggacattgattcttactatatgttcacatgcaaaacacaacagggaaacattagtgaatacatagtcttcaacaatgccatgtaaataatgccagaccatgaatgacatagcattgattatgcaataatcatggtcctcaaaacaagttacttgttttcaagatcatctgaaataagatattttctatttattttattttgaataactgaccttaaccatttcgttcacaagaattagtgtaatttataatagtaatcatgaactataactatataatatagcttctcttgcttttttatgaggcttttgaaaaacatctatatgtatttttttacttgcttatgatattatcattaccttttcttggtataaaagacaacttactttatttgcttagctgatagttgtcctgaaacatttatcagtaggatattaggattcatataagatttatatattaataaattaaatataagcataatcctcaaaattagcaaatgagaaattgctctggaaataaaaacatcatgactaaatttttaaaataaaatttaaaatgaatgggtaatgaagtgacagaataaaacattaaataataaagcagaaatatatagaattagagttagaaatttaaaaggtaagaattcataaaaatgagaggtccttggaaaagaagtaagatatgataagtattcttaaatctaagtaatcaaaactagtgtcaattaaaggtagatgtaaagataaactcgtatgtattgaaaatgtgacagcacaagataattgcctattatatctaacaatgaaattctcttactccttaactgatacatctgaaattattccagtaaaaattgagagtaaaaactctatattcctttcttttcccttccgtttttaaatctctctttccatgtcttcctcactttaactcttttcctagttcttgtattactttctcatgtcatccttcctctttcttgaactcctccatctcattctctttctcctttgtcttcctctttttctctttttgaatacctcactatcattaatgatttttctatagccacaaatttggttttactaaaataattatggtagcattaaacaatcaacagttgatatttccataataatgttaatctctgccatgtgactgcatattaattcaaagaatgtttatagaagtcttactaagcatcaggcaccatgctgagctttgatacaataataactaagaaacacttggttcttttctcatggagcttggagaatagcaaagaaagacagacattttaggtgaagtataggaagttgccattgttgtagttaaaacctgattgggtacttgaaaactacagttcaacttaggatgggtggatggatggatggatggatggtggttggttggttggatggttggatggttggaaggttggaaggttggatagatggatggatggatagaccatcaggcaaacagacagacttgcatttaaattgagacctgaaggatgaataagaattaggtatgcaaaaatacattggcgattgaggggaaggaatagtgagtaaggtaaatgtggtttttaaagtcaagacaatgatgctgtttggggactgaaaaaggccatcaagaatgaaacacagagttggcatatgatgaagtttgtaagataagcaggttccaaatctgacaagacaaagttaagaattttaaacattgtctaaggatgtctaagtcaataacttactttgttttaagcaagtcctcaaaggttgatttaaaaaaatagtgaattaattagaattgcattttgtagagattactctggctgaagcatgcacacacaaaaaagtattctaagtaggcaaacccaggcaatgactttaagacaaccctagaggtaatataggagtttaaaaaaagtaacttgaggcttagagatattatttaacttgtcttaggttatataattgaaaagttgtggagctagaaaaagtcacatttcacagagttcatacccatcactaatagcttagaaaactttcattcatgtgtttattcaacttacatttcttattaaaggtctatatatgcaagatattaccttaggtactagagataaaacaataaataaagtctatacacccaaggagtataagttgtattcagatggaggtagatagtgataggtgctctgaagaagcatggtagaggggatagcaaggattagaaactactgctttatataaggaactgagaaaatctttctgtttagatgaaacatgaacccagactttaaggaagtgaaggggaagccatgcgaataggtcagactagagcccttcaagtagaagaaaaatcaagaacagtcatcctgaatagagcctaattggtgattgagatatatatggcaagaaggatgccaaagtcatgaggttataatttgtcttatgtaaaaaaatagaagagtggtcacaataaactatataaatagttatttttttctattttaacttatttacctaagaattaagcttcaaattttatagatttatgttttatcctttcatctacccttatgaagtatacattattagccttattttatgggagactaagttaagctatgaaaatttaactaacttaatcaagtagtcagctagcaactgtggagctcaaaattaggttttgaggccaaggcaggtggatcacttgaggtcaggagttcaagaccagcctggccaacatggtgaaaccccgtctctactaaaaatacaagaattagctgggcgtggtggtgcatacctgtaatccctgctactcaggaggctgaggcaggagaattgcttgaacccgggaggcagaggtagcagtgagccgagattgtgccactgcactccagcctgtgagacagagcaagcaagactccatctcaaaaaaaaaaaaaaaaaaaaaagttttatgctttgaggtccagtgtaggtgatcagagaaaagcctccactaatcctgtagaaatgacttgatgaccataaacacagtgattcaaggcaaacaaacgattctaagaagtgagatcacgttatttacccaaacctaaggggttatatctcttactggaaggagagaaaataaatgaagcagaggtgctgaaggtcttacaaaatatccagaatgaaacagacgctctacttgacttatgtgctctttttcctgactctgaatgagtcacaacttaagtagaaccaaaatataaagtcaccacttattagaagacacaaaatttttcatttaactccatgtttttcatatcaatgcagtctaactgtaatccaatttatacatctatttcaatcaagaatctctatgccatgctcatgagagtcttaataaatgcttttaattggatttgtttgaacttttctatgctcttggcttaataatggccctcttgtacatgcaacattccttctttttctttgggtatggttgtaattattacaaaatatggtttaagaatttaccgtgtgctgaatcatggggagtacaaacatgaaaacagcaagaacagctctattgagaaccagacagataatggctgcactgattagaaaagatttcataaaaacacgtagaacttgaactacaaacttcagagaaagggggttctgacagctaggattgtaaggaagtgtgtgtaggacagcatagaagacatttttcaaggaaatattgccttgagaaaatgatttctgccactattaattcaaaatgcatcctcactcatccaactgttactcccttaccagtcaattgtcaaaacatatttccacacaaatatcaacttttttctcattctcttatgttttcttatggatgagaattgcaaagacagtcttatcctttcctgtgatatacacataagcaatctgaaaaagataaataaaaaattaatagaagaaagacagtagaattgatacttcttgcacaaaatgctgttacacgttatgatttgagattgttcacatttagacataatgaaaactgaaagccatttcagagcatttaactgcataaatatgtgggatgtgtatgttttacttgctgtaaaaaattgataataccaaaggccttctcaatttattgatccatgatcactttcaactgtgatacttcctcaaagtgattttggtttcctttctttccttctggttttcttcttttgattgcaccattcatatattaaaaagtgtaacccttgatggaaattaatatttgaaggaatgaacaagatcaatagtggtcactggtaggtacaaaagaacattcaacctgctagtttgctctatttttaaaaagatttccttaaatattcatctcattttaatgtatttgtgtaaatgtttaaatcataaaataaggtataaatgacttgcaccaaaagtttcttggctaatgttggaaagctttgggtcctaaattttgagtcctaacactctgaagtgagaaatttccatatagaattgctttgatctcccaaaaattaaggataaggagaaaaagcaatcattttaaaccacatgaaatgggaggcattctttgctgtagctgaagatatctgtgttggaaggtaactgcatcattaggcctctctggatgcattatgttgtataacttacccccctgcttcagagcctgatggtgatcgccaagagaatgatctactcattactgcataactctgagccctgcaagtcagctaaacagaaacagtgctatttgcagattgttaaaggaaacccctgcctcctgtgacttctgtagttcctcttgccttctcaacttggcttaagcattgtgaagataactgtagcttggagaaataccccaagtcctcttggattgcccttttaattagatgttttgttaaagtaattataaaaccaaaccacattgtttgttcagcgttccctggaaagcacgttgctattactgacagctgggaagttttaaaatatttattttgtgcctcaaaatttcagcttaaaaaaaaaagcaaaccaagatcattagaattccctagggttttcatgtaaatgtcttgcataaagaaatgagagaatttgtgatagagtgatagagttcaacaaagtatccttcaagaaactgagcttggaaatctgtttatgatacttttgtttttggagtgaagaggtgaaaattgctatacgctatcaataatcatgtgatttaaaatcgactctctaccctgaagtggaggagtttagctatcaaaagtcggcagtgcagacttaagaaagtgcaacagtgatgcagcaaaaaaatgtgaatctaggagctggccctaatttcttgcccccaggaaataggtaatcagccttattaacccaaactggtaataaatgggttcgctgcaaattcatttcatttaagaattggggtaaggagtgcgatttacaccagtgagcaaaagaatgtgttcttctggtgatttcacttgatgctcatatgggatttggtgtgcacagaggagtgaaggtggcatgtcatagaatagattttctttcttgtacttttgatagggaccatttatgatattctgtgatttatgatatgctatgatttatgataattgacagataggcttggggaatttgatggaccagtggtacagtagctattccactgtgaaatttaagactcagccccttattaccattcaagtggatttcatcttacacataaggagcatagcaggcaaagcaaaaactgatttttaaaagcaatatggtatctgtttcagttccggtgcaagtggttgttcagaatctcaaagttccactgtacaaaggatggcacaggttgctttgacttagataaaagttcagtgaagttgcaagtattttacttggttataacaaactttaatgtgcccatggaatgtctgatccttctatgagttgcttgacttttttctaagtaccatgtaaaggatcaggtgggttttgcagtcttaatgactaggtttggatccagctccatttaccctatattcttgggcaaataactttcccatgccttggtttttctcatgtgtaaagagggcataacaacagtatccatcacagtgggtttttgtgagaattaactatgataatggcaacaaagtgctcaacagtgtgttgttcttctgatttttctggttttgatacataagaagatctcagactttgactgttgtgttgttgttgttgttgctgctgctgttttagacagaatctggctctgtcaccaaggctggagtgcaatggtgtgatctcggctcactgcaactttcacctctcgggttcaagtgattctcctgcctcagcctcctgagtagctatgattacaggcatccaccaccatgcttggctaatttttgtatttttagtagagacagggtttcaccacgtgggccaggctggtcttgaactcctgacctcaggtgatctgcctgcctcttgaactcctgacctcaggtgatctgcctgcctcagcctcccagagtgctgagattacaggcatgagccactgcacctggccatgactgcagttctttctgacagtaatatgaaatactcagaccattggttttatgaaacttctccttgttcatgatggtaaagctttgttgtctacatttagggaacagatgtatccatttctgttacaaaaggagagtgtacattcagtacatcttaaaagcccatcatctaattaaggtataatttaatggggcatcatataattatagcaatagattgaagagggcgttttgtggaattaggcagttttttaaaaaaatattataggaatataagcaagctttcaaaattgtattgtttttgcaaaaaactaaaacattatgccaaatggtaaaatactaaacacatttgttttaagatccaaacaagcttaaaaacttcctacaatttctgttattaaagaagatagaggttttggcaagaaaaactttaaaaattcataacattttattacaaaaggaaagaaatcttattattataaatggtgttattgaatatttgaatattacaagacactgcactaaaaacctattagagctaataagagaatttaataaggttgtatgtttcaaaaacatagcttttctttatagtagcaataattagtttaaacattgaaaagaaaggcatttataaagcaacctaaaatataatatctaggactaaatttaacaagatgtaaacaaatgtatatcataaaaaatacaacattttactaaaaactataaaagacatgagtaaatagcaagttacatatgttcctggatgaaaaaactgatcattattacattagttatttccaaatcaatgaataattttagacaattctaatcagagtaaattttaaatgattaaggattttctggggtggaaaaagaaatttatatggaagaataaatgtaaaagaatcccaagaaattttggaaaaggataataaaaacgtttactataaagcctgatttagaatcagcatagtactatctggcattggaatggacagataaatgtaacagaacatagaaacagcccctatctaggtatatttgagaaataaatataaaaataaagctagcttctcaagctgcagattagttactaaatagtgtgaaactattgccagtacttttagcagaacagaaaatgtttttcttctcttacatcaaactagttgacagtggttgattctggtgatggaactgaaggcaaaggagggtaaagtcatcacatcttatataattcaaaactggaaaggccccaggtggctgtaaggattttgtcatcattttttcttcaggtatttttaaatataacaaagatgggtgactcaaccacaagtctttttatacaattggaggttttgagctgatctttcaaagtatcatttcccttaagattgattgtattcttcactttgtgactagtaccaataatcacttgtcatccaagccaaaagcctccctatcaccctcaactccatttcactccctgtcaatatccattcaatcaccaagatctgtaatttctaccttcagaatggatttggaatccatcctcccttctccacacccaccaccacactttatgtcaggctcacatcatttgtcacctgaaagtagcctcaggtttgctatttttctggatacctgtttgctctccctcctctctagaccccatagtgttgtcagagtgattttttcagaaccagatatgacgatgtcagttcgctgctcagattcttctccatgtggtccttccctcagcctcaagtgtgacatcccatcctgcctgcctacctgcactgccctccaggttcacttcctcagctgcatcctggatcaagcctttggacttagcaagctctttacccaagtgtattttcacatatatttcacacctgcttgtcctttaaaactcactagatgttttacttctaggaagctttctcttatctgagtttcactcagatgtcttttctctaaacacattttgacactcttctcaatagacttgaaacaaagaccatgctttgtcttgaacttctcgatatttcacacagtgcctgctacatagtactcaataataagtggatgggtgaatgtaaaatattcatagctgggtatttgtgtgaaatgtgtaacacttacatagtttgattcttcactgattttcatccttacatacgaactctaatttcagataaatgagctagaaacatccattgctctctgttgtattttttcataaatgtagaatgcatcctattatgcttatatacaatatgaaaatgaaaaccctagctttctagaagacagcttggcataagattttagagttacaatggtgtttttgtttgtttgttctgagacaaaccaataggtctgtagttttgagagcatacggtttgaatccacttcaaggaaaatgagcctaaagaattcatttagcataccacttggcaaggactaagatctctgcctccccatacagaataaggtttacggtttgaatggccatggagattattcagtgtaaggtagctgatcaaatgcttcatggtagaatgatacaaagttctagtgaggttttgcaatagttgaagctggtatccttaaactctaaagtgagagaacaatccccagatattgaagggctggtgtctgcagctgctccttgaaagccacatcaagagtatttgctctaacagtcaggattaggttatctcagtatttcaggaagttggcagtgtttaaataaaaccaaacttcattgtattttctctgtattgtgttggacatgccaacctgctaccctaaatatgtatcttaactccctggtgattcttgtcaaatcaagaacttgatagacagagaccacgcttgtctaatttttgggccaaaaaagggctgaatcctatctgtaatctggaattgggattctgcagctttgctgagcaagagaaaatcaaggaagggaagaatcttgatggttttgttaggataaaccttgggcatggcattgagggtctcttccctaaaaaatactttacatttttccctctttttccttttgagttataaccaatgtgaggcaaaggcaagtgtacaaaggtgcagagaggatgtggattctggtgaattattttagcatctacgtttcttttcactaggagtaagcgtgttgatattgggaattggaggacatgggagaagaaagattctccatccttagatctaccagtttaattggcttagatttaggagacacatattttcagaattacaattcattgttgtggttttcaagaagtagagctgtcaaaactcccttttaagagtgttggctaggtattcatcgactcctgttagacttctacattctttttctatctaggcaaaaaaagtagctaaaaataaagtaaaatatgaaataataagattaggttgacacaaaactattaagataaatagaaaacacatattaaaagtaaacaaaaagacaaaatgcagttaaaaattacaaaacaatgttgaactgtaaaaacttgtggtagtaacaaaatttgtagaatagctaagagtacaaactatatgtgaaatgctacatgagcaaaaatttgttaaattgatgagtatgacacatgcataataggtctccataaagtttagtcattattaggaacaagaataaaacctatatggtttgaaaatttttaatgatacaaatcaataagtaaatattagtaggaataactgattttccattcatggaggggaaaatattaatgttcattattaaaattaataatgagagattgggggagggcttgactataaaggggcagcctaaggaaattttggcagtgatgggatttttctgtattatggcaggagtggtggataccaaaattttacccatttatcaaaacccatagagctattaccactaagtaaatgttgctgcatatatatttttaaaataaattaaaaatgaatattcccagcctgggcaacacagggagaccccatttctacaaaaattttcttttaaaaattagccaagtgtggtggtgcatgcctgtggtcctagctactcaggaggctgaggtgggaagatcacttgagtcctagaggtcagggctgtagtgagctagcattgcgctactgcgctccagcctgggtgacagagtgagaacctgtctcaaaaaaaaaaaaaaaggagaatattgacaaaatattagaaataggatggtaaaagaatacaaagtagagttcagtggtgaatagaagtggttgtccactatgataaatacacaaacagcctttaaagtttatagaggtgagcggcctaagggaagtgatgtcctttggtgagaacaggccctgtctatagaaatgaacacatttgtaagcatcagacatgcctggaaaggcagagtgtgggtatatcaattgccttatgtagtttgctgtaaagaaatataggctattgaggactagaacaaaactctaacaaaatgatccataaaatgcagcacgctaaatggaggacaaatgtgtgaatatttgtcaaaagttccaactgcctgacacaacttgacagtgccatctatagcaggcagtatgtggtggcgactgtttgcattaccaagatctggcacagacaaatcttgctgtcccctaagaggaaaacaaagtatccagtgtagagtagatggctggagtgaggtgaacgaaggcaaaatgacaggtgaagaaggtaggagataagtggagagagagagagatcatttatggccttttaggccattgtaaagaacatggcctacaatgtggtttgagaacaccttggggggttttgagcagagcaataacatgatcttaattgcagttttctatatacatgctcacactatatctgtattcatacacatttattttaaataccacatatatgctgatggcttccacatctgtgtatatctagccatgacctttcaccaaaatcccagacttacatacccaactacttccttgagatagccacaggtttgactaataggcatctcacattgaacatgacccaaggaaatctcacctgtgtttcctcatttcagttcatcaaccaacagttaccaagtcaaagacctatgggttatgattaaatctcccttttcctgcaccactcacatctactctatagctctgttaactacacattacaaatgtcctaaatctatccactttatatcatcttcacaacagccatctagacaagagcaaaagcaattttatggtctccatgtttcattctatgcttcctctccaaacttctttttcacccagaaaaatagagtgatctttcagtaatatcaatgagaccacacttcacacctccattcctgccagtcaagaccatttaagatcttctccttctacttagaataaaacctaacttcttacttatcttgacttgccttgcctatagtaacctggtctgtaagtgactcactcttttttttctgtttttgtaattgtttacaattatggaaaaatagacaaaaccttaaatttaccatcctaacaatctttaagtatacagttcagtggcattaagcacattcatgttgtcatgcagccatcaccaccacccatctccagaactcttttcatcttgcaaaagtgaagtgctgtacccattaaataataactgccaacctccccaacccccagcctctggcaaccaccattctcttttctgtctccatgaatttaacttccctgggtacctcataaaaggagatttacacagtttttgtcattttgtgattggcctatttcatttaccatatcattgccaaggctcctgcatcttgtagcgtgtctcaaaaattcaattgtttcctttttagaggccaaatactattccattatgtgtatataccacattttaaaaatgcatttatacattggtggaaactttgatttcttccaccttttggctattgtaaatgatgctgctatcaacatggatgtacaaatatttgtttgagtccctgctttcaattctttttgcatttatacttagatgaggaattgcaggatcatatgttaattctattttaaatttcttgagggacccttatatggtttctttatagcaggtatactattgtacattcctactggctgactctctttttatctttttcattctctctcttacccttgatgttccagatgtgatgatcctctttggtttctctgaataccaaactcatccctgcagtacagcatttgcagtagttgtttcctctccctacagagctcaccactctgatgtttgcttgactggccctttcaggtcatccaccttagactcaaatggggagaatttcctggatgggtcagttattgtcccatcagcatagcacttatcaagatctcacgattgtcttatttgtttattaggacttatgttttgtctttcctctcccaccactatatttttagtacctagaactacaactagtatataggagatgcatagtagttgttgaaatgtcacagggattaatataatacatgaccgagtatgctgcatgtgaacattacacattagtggaaacctgtgtaacatgtctgcattcatgttacagagaataacacgtctacatatattacatatgttacaaagaataacatgcctacatacatgttacagaaaataacatgttctttagaaccaaactataccaagagagaatccataattcaataatataatcaagagtggcaattgacctagttatttgatcattcagactctagtaaaaatttggggccttgtattagtctgttttcatgctgctgataaagacatacccgagacagggcaatttacagaagcaagaggtttaatggactcacagctccacatagctggggaggtctcacaatcacggcagaaggtgaaaggcacatctcacatggcggcagacaagagaagagaacttgtgcagggaaagtcccctttataaaaccatcagatctcaagagacttactcattatcacgataatagcacaggaaagaccgcccctgtgagttaattacctcccaacgggtacctcccacaacacgtaggaattgtgacacctacaattcaagatgagatttgggtgggaacacaaccaaaccatatcaggcttcattaatttaaatatttcaggcaaaatgtgctctttggtttcaaattaactcaataactactctactattcctctgtgcttcatatgtgcaagcagcatcttagagatacttgtaaaatgtttcatgtacttctgagcagcaaatttcagttgcagactccaagcaagtaatagtcatattatatatcttccacagcaaattttctaaattgatgttttatagttcattccagtagtaaccactttcctaatccataaggtcatctatgttagagaaaaatcactcaggtagcataaaaggaaaattgttatttctgcctttgtattaagaagtgagtgggcataaattggctatcatggattatgaacaatctcctggcgtagttatcatgatgatgaggccatatattatgaatggcttaggtctaatactaccttgaaggaactgtccttttggtcctgtgagcttaatttggtgataaagggtcattaaggctgggcatgtagactcacatcgataattccaacactttaggaggccaaggcaggtggactgcttgagtccaggagttcaagaccagcctgaacaacatagcaaaactctgtctctacaaaaacataaaaataaaataagtagatagataaatacattagctgggcgtggtggcacatgcctgtagtcccagctactagggaggttgaggtgggaggttggcttgagtcagagggttagaggctgcaatgagctttgatctcaccactgcaatccagcctgggagatagaacaagatcttgtctctctctctcaaacacacaaaactaattaggatttagatgaagaggcaacatatcttcttacgtactaacattttttttctaatgttaaaaattattttgaggcttgcctctaggattgaaacattttcatgcagtgaaggataaagtggagtcttacgttcttcaagagccagttggtgtacacattacaatgatatgtttaaagctccgatgaataaaattgtgtagttactaacttaaccaatttgcaagagaactattctatggtttgcagaaatattaagaaatagttactgttctgaaaacatttttaacagttgaacagtttttccttttattctaaaagatgttaaatattgtcattaaaatcattatgatttcatattgcttttaaaaagtcataaatgcagaagatctagtttattttcttagtgtacgattaggcagattatcttgttgttttaatagttagtgcaaacacttcaaatatgctaaacagaactgactgagagtccattacatttcaagggcactggtgagactgtggcagtagggttgaaaactattaatccatccttttcatctcttttattacttttacttagagtttatattaggaaatatttcacaaacattgtgtttctgctgttaaggcttatatccacgttttgagacataatttttttatgatgtctttgcatattatatcataggcttttttagggcagactaataatagctttccctttttgcccacaaagggccatctttgggggaaaaaaaagcatctttagaaaattctgtcgatgtggcaactttagaatcttttgaaaagctttagaatcttttgaaaatgttacctattttgaaaactttaataagaacatgcttctatctatcacttaagctagaagtgggaatgctgcatatggataaaagtggagggggctgtgccagtttttggtactacattaaggagaaaaatgtaatattacctctagtcatcagatttccttgcataatttggcatatgttaccttcagagattttctaaatcactggacacagacatttctggaacataaataatgaacagaatcactttaataaaattcaaatcactgatatttttgagtacttattaattgccaagaactgtgttaagcacttattgaagtttggatgggcacattctttcttacatatctttgcataatacttccctgattttcaaagaataggttacatgtgcttgtatttagccaatcaaaatatttaccataatctatcgtagctgcctttttacttgcctgtttctcattagactataaactccaatagtgcaggtttaatgtctgccatatttgttcttcctgtatcctgaacattacaggcacctaggctcacacctcaaacataatagttgttgtataaatatttattaattggctgggcacgatggctcaagcctgtaatcccagaactttgggaggccaaggcaggtggatcacgaggtcagaagttcaagataatcctggccaagatggtgaaaccccgtctctactaaaaatacaaaaattagccaaatgtggtggcaggcacctgtaatctcagccacttgggaggctgaggcagagaattgcttgaacccaggaggcggaggttgcagtgagccgagatcgtgccactgcactctagcctgggcgacagagtgagactccgtctcaacaaataaataaatattaattgaataatgatcagtgtccagaaaaaaatatttttttaagactaggaaacagcgaagaatgacaacataaaaatcagaacaatttattattaaaacatattaattttcaacacacaatccctttaaaagaaaatatatgtcagggtggcatgcacattctctttttaatatctagcaatatttgagaatttatttgctactcataatgggtaagtttgcatgaattatctcattaaatcttttcaacaccataccttcattctacaggtagggaactgaggcttagagaggataaatgatatctcaaaatctcacagacagtgagtatacaatacaagtttgaactctgctctttcttacttcccgagctcaagctttgagtcaatcaatatttggaatgccaacttaatcagaagggaaactcagagaagtgaaataatttcatgaggacacagagctggtaaatgacagaacgtggcattaaaccaaatttgcacaggtccaaaggttgtgaggctttaatccaggccactgtcttctttcttttaataataaatgcatttttcactgatttaataaaccatgaatcaagtaccatcctaatcatgctggacagatcatggcccttaactgtttctcctgacaattacataagaaaggactggttagtttgttattgtttttagctaaatcagagtaaataattattggataagacaacattgacattttattttccagtctattattcttacatctgccttggttttcacccttcattaatgatacctaagaagagatatgtaaaaagaaaaaaagcccaagtaagacgctattggaataaagatgcattgatgctacctaccatgcccatggaaagaactcggtattcttgtatgcttaagaaattttgtgaaagtcaaatcaaacatagaaaatatatcatatgctaaaataaagagtgacttgggcaataggtgatgcattatttatgcatctatgaaatatgatttctcttgcttaaatggtgttctgccgtgctacattttctgttatgagacatgctgatgatgcctctttttgaatgctagaatctcaagttcctgatcaaccaagctctcttcatgtgaggccccagactaactgcatcatcatgagttggactcctcccttgaacccaaacatcgtggtgcgaggttatattatcggttatggcgttgggagcccttacgctgagacagtgcgtgtggacagcaagcagcgatattattccattgagaggttaggtgagtatctgtgattttttttattctattaaggggaattaatgatttattttgaattattgtatttcttggaaaactgttccctggtatgatggtttcaacttacagcatgtattagctctgaaagcaactgtctatctacacacacacacacacacacacacacacatacacacacacacaggcacacatatacatttctttgaatttgggatttcaggaatttgatctagagagatctgtaatggcagttgctctggtgtgtgcccttgcttatgggttataggatacaaaaagtgcgttgggccatttttctttttccagtggtcaatggaaacttctgatcctaataatttctataaaaagaaagtcaacacatttttcatctttgttgttgtcactgggaaaatgttctgttaatttttctttaaccttgaaatatctagtcatagtgccttctttaccgttaacattccaaatatgaatgttaaaggctgtgtcattatgactgcaaaagaagatgaaagaaggaattttcagtcaagacaatacattagaatgataaaactccatcctgcatgtttccctgcccctaccaatctaggttctcttattgtactcaactcaacctcattttttactgaatacaatacttcagttgtgatattctgaattcattgaaaacgtgttcattcagagaggtctaatgtgtgtaaaagtgttcatattcattttagatctgatttcccatagtgctgtaggagtttgtattattaacacagagaaataaagtaaatataatatatcaggatgccagtaagttaaacaattttcataaagcaaaatgtaagttgattctacctgttgatttaataccgtattacatgaccccactggaaatgcagcttgattgggcaggcagggtgtagggggtggggggatctgctacttatttgcagtgtctctcacaaacagaacatttgtgatgagaagcctgatttgaatttgaatagctaaaatgcagtagcaagaaaagattttctcagtaaaggaagaaaattgcactgacccattctctctataattgcttcaaacactaataagagaaacacctactggaaatctccacaatttatttagcttggcgtttagaaataatattctttccatcagttcctgagtttgaatgtaaaggcaatcacaaaactcatattttatggctatcaagcctatgtcaagggactctcacttatccattattcagcatccaccatctttgacagttcatcttgatgccactcaacagacagagggagggaggtgcccatggcagtaaatggctcccaggcaatgagaatgtgctgcaaactcagaaggaagtcaggagggaaactgcattgttgaccctatcctttttctaatgattctcttcgttaccaaaaaaaacttgccagaggtctccaaatttagtcaagttgacgcatttgggagattaacgttggcaaatctccccaaatgcttaacaagaaaaacagaaaactctggaaaatatattctaaagagctaggaatatttttaaaggtaaattgggatatgaacctgtctcagtaataattatgagtttgcactctacaacttacctggaaagagtaattacatacacacatagataggtatgtaagttctactagttgatactcttttaacatagtctcatgtgttaatatgaaatacagtaattagcatgttgttgttcattaaatatcctcatggttatgcaaatgaactgctatttttccaatatgtgttttcactatttagccaaagtgtgtgtgagagacataccctaagctctaatctttataaagataaggatttattcaagtccacgttcatgctgcaaataaatcaccaattgttttatttattctattgagcattaaaatcaacacatcagtttccatagtaactttttgagaaggtatttataactttttttaatttttaaagtttttggaaggcaaagctctctagtcattacatatacataataaagaaaatgaaattttatgttttaaggactgtatgacagttatacaactaaaagtgaattaaagtaagtttaattcatttaagcatagggtcagccataacttcaagtatcatggttgtatattaaactataaaaaagctatttgttttataattgactaataaaccccttcatctatttcatgagagagcaagacttctaaacagcattttatttgcagtttagacaccagacactgtgatcagcttcaggactggaaatacaagaacattttgagtaatatctaatattacctaattaaaagcaaacaaacaacttgcctgctataggcatagagcttcattaatcaatgactattaaatatttataattaatctattgacattttactccttttagttcaagagccctagtgccagacttgaagtatgatatagacccaaaattaatttgaaaccaaaccacttttaaaactcactatctacctaccaattgatctatttatctatcaatttatctatctttatatctttattcagatattatttatatacagtacattgtgtacattaaaagtgtactttttggcatttttaaaagagcattattgaggtataatatttgtttaataaagtatatctttataatttctctaatttatctcagtaatattttatagtttcaaatgtaaaggtcttcaatgtttatgttaaacttattcctaaatacatatgtatatgtaggaatatacatatattagaaatacccaaatatatatatatatatatggatataaatacatatatatttggatatatatatttgaatatatgaacatatatttaggactgtttaaattatgcatatatatttgaatattcctaaatatatatacatatgtatattatatatatttgaattattttaaatagaactgtttttaaaatttattttaaataaatttttactatagtggatttatagatgtattatataatgtatatatagatgtattgtggtatttataaatgtgtagaatacaagagattttttaatgctaaccttgtatcctaatatctgctaaatttacctatatattccattagttttttagattatctaaaattttctgtttaatcaaacatatctatgtgaacagaaagttttatatttagtttctgatctctgtcccttttatttctttctgttgccttatttcagtgattaggatctgtagtaaaatactggataaaagtgctgaaagcaggtatctttcctttgtgtctgatcttaggagaaaaaaatttagtctttaccatgaaataggttattacctctggtctctttaagccttttgtgagattaaagaaatgctatactctttctagttttctagaaattctggtcatgaatatttgttgaattttattagataactttctatcttttgaaatgaactttttttttctttttttaaaatacggtgaattacattgattgatttttgaagggtaaccaaccttgaatttcctatataaatcctgtgtggccatcatgtattatccttttcttatgttgtttaatttgatttgttaatgcttattaaggattttttgtgcctatattcagtaggttatatatttgtctacaattttcttttcctatagtgtctatatactgtttctcttttactccagttagattggctcataaaatgagctggatagtatttactccccttctgttacagaaaatttgtgtaaaatggattttatttatttcttaagtattttatagatttcactaatgaaatcatctggacctgagattttttttataggaaggctttgataatagatttaattttttatacagatataggtctgatttgcaaactttcttgtattgattttgctaagttaaatttttaataaaatccatccatttcattttgtctcttgttggcacagttattcataatgttttctttatctgttatctatggttattaactgatttttcatttctcatattggtcttttcttgttcctgtcttttttttgtgatatctagacagagatttactaattttgttgatcttgtcaaagaaagagcctttgacattactaacttttctattatctatctattttatttctttcatttctactgttatcttgactacttccctcctgatacttattttagttctggtcttctcttctatttctaatttattgacatatgaactttataatgtatacatccattgttgttcctctaggtatcattttacttgcattccacaaattttgatatgttgtatttttattaccatttagttcaaagcatttcctaattttcctgtgatgtgttattctccctaagttatttagcaaggtgttacttaattttcaaattttgggattttcctagttatcttgttattattggttttcttttctttcttttcgtttttcttttttttttttttttttttgagccacagtctcactttgttgcccaggctggagtgcagtggtgtgatcttggctcacttctacctctgcctcccaggttcaagcaatctcctgcctcagcttcccaagtagctgggattacaagcgtgcgccatcgtgcctggctaatttttgtatttttagtggagacggggttgcacaatcttgtccatgctggtcttgaactcctgatgtcatgatccatccacctcagcctctcaagtgctgggactgcaggtatgaaccaccacacccagcctaaatttgagttattaatagcactttagcaatatgtctgatattgcatattgcagtaagattatattgcatattgcagtgaggttgcagtgagccaagatcttgcctttgcactccagcctgggtgacagagcaagactctgtcttggaaaaaaaaaaaaaaggaaagaaaagaaaagaaatatgtcttataagagatcagctgactttttctataatggaccagagactaaatactttaggcttcacagaccatataatagtctctgtcaccactcctcaactctgctattagagcatgaaagcagccaaagacaatacatacacaaataaacatagctgtgtcctaataaaactttatttgtggacccaagaatccataatttaatataatttttatatattataaacttttatatgttataaaattctgtcttttttaattttagcaactatttaaatatataaaaaccattattaactcatggtctatacaaaaacagtggcccctcaactataatttactgattcctgctcttagtgattgctctaggagataccatatatgtatttaatctttcccactttatttaggctaacattgtagcacatcatataaaacatagaaacctgcaactgcacaggtctctttatcatatggactattccttttgttgtaattgtcatatgtattacatgtacatgcattgaaaatcccattagacagtcttatatatttattgtattatgcagtcatgattttttttaagacataaggggaaactatgatgttttctatttacccagatatatgacatttcttatgcttttcatttgtacctgaagatgaagttcttatccaatgttatttccctttagattgaaaatcttcctttaccatttctttgtagttcagtcaggtggcaacaacttttcttcgttttgctttatctgaaaatatcttaattctactttttttttctgaaggatattttcactggatatagaattccgcattgacagattttttttttctttcctccagttctttcaagttgttgtctctctgtattcttgactctatggtttttgatgaaaaaccattagagttttagaccattgcaatttaatgtaattatacatatggttgaattttatttttgtttactgtttgtcagattgcttttttgtgtccctgttttccctttcctgacttcttttggattatttgaatttttttgttttaagttttattattattattattttttcctgagatgacatgtggttctgttggccaggttggagtacagtggagctctcatggctcactgcagccttgacctcccaggctcaagtaatcctgctgcctcagcctcctaagtagctaggaaaacaggcatgtgtcaacatgacattcaaaatgttgttaacctgtagtaatatatacttttttatttttttgctgggtgcttttaagacttctttaaaatatttgatttccagcagctagattatattatatagaggcatagtcattttttactatatcttgcctgtgtgttttatgcttattaaatctgtaaatttatgatttcaccaattttggtcattttgtcttcaaatatttttccccactattcaccacattccctctgagactataattatatgtattttagacatttgaattttatcttatacattctcacaactgtgatgttttctttcgttttttaacctttttactcttttcttgatattgagtgatttatcctgttctattatcatgcttactgataaattccttcattacctctatctcattgttaggctcatatggtaaaggtcattatattttaaaacattgtcctctttttaatattacaatctccatttttttctacattttctactactctgttgagattttctatactccttgcaagtatactttacctctgagagcatagttataaaagttactttagcatgtttctctgataatttcaacatctgcaccatttgggttgggcatctatttgctttttcacttgagaatggactatatttaccatttttttggtatgttgtataattttagactatatgttaggcattgtcaatgttaagttgtagaatctgagttttattacaatccttgaaaattttttgatatattggttttagaaggcaatcaacagttagattcagattgtgagatctatcttgctttctcttcacagcaattaaaatcttggttaagtttcccaaggctttgctctgctgttagtgtttaggctgagacttaggcaagttttaactcagaatcagaacatctctatctccagaactcctttttgtatactttttgtaaactgtttccctcatcccctgaaactactttcagtgattcttctggcacaaagtggtgagggtttctactggagtgacagctgacagtactggggtgctttccatactgcaaaattttcttggagcaaaacagaaaactaattccaacgctggtcgcttcatcaagatcttacttaattccaaaatccgcctagttttgtaaaatactcagacctcatatagttgggattttggtttttggggggattgttttgtatcttgtttagagccagtggctgttatcagtgagatggatgagccaaaaagagcttacaccatcagagaataattggaaactcacagtcccattttaaatatttttgggcagctgttattgtgaacattcttgataaaaataagatgacttcctgggcagtgtatttaacatctgaattacatttggcactatcgcacttatttactaacaacatgtgttagaggaactaaaaatgactctgaaatatataacttagttgctatattagtctgttttcatgctgctaataaagacatacttgagactgtgcaatttacaaaagaaagaggtttaattggacttacagttccatgtggctggggaagcatcacaattatggcagaaggcaaggagaagcaagtcacatcttacatagagggcaacaggcaaaaagagagcttgtgcagagaaacgcccctttaaaaaaccatgagatctcatgaggctcattcactatcataagaacagtgcaggaaagacctgttcctataattcagccacctcccactagattcctcctacaacatgtgagaattgttggagttacaattcaagatgagatttgggtggggacacagcgaaaccatatcattctgcccctggcccctcccaaatcatatgtcctcacatttcaaaaccaaacatgccttcccagcagtcccccaaagtcttatttcagcattaactcaaaagtccacagtccaatgtctcatctgacacgaaggaagtccctttcgcctatgatcctgtaaaatcaaaaccaagttaattatttcctagatacaatgcagggacagacatcgggtaaatacagccattccaaatgggagaaattggccaaaacaaagggctataggccccatgaaagtccaaagtccagagggacagtcaaatcttaaagctccaaaatgatctcctttgactccatgtctcatatccaggtcacactgatgcaagacgtgggttcccatcttcttgggaagctccactcctgtggttttgcagggcacagcctccctcctggctgcttttataggctggcattgagtgtctgtggcttttccaaatgcacactacaagctgtcagtggatctagcattctggggtctggaggacagtggccctcttctgatagctccactaggcagtgccccagtagggactctgtatgggggctctgatcccacattttccttctgcactgccctagcagaggttctccactgccagaaacttctgcctggacatccaggttcccaaaccccaattcttgacttctgtgcactggcaggctcaacactacatggaagctgccaagacttgaggcttacacccactgaaaccatggccctatctctacattggcacctttcagtcatggcaggagtggctggaacacaaggcaccaagtccctaggctgtacacagcacagggaccctgggcccagcccacagaaccactttttcctctgaggcatccaggcctgtcatgggaggggctgcactgaagacctctgaccagccctggagacattttctccattgtgttggtgattaatatttggctccttgttacttatgcaactttctgcagctggtttgaatttctcctcagaaaaatcggattttctttgctatcacattgtctggctgcaaattttgcaaacttttatgctttggttcccttataaaactggatgcctttaatggcaccaaagtcacctcttgaatgctttgctgctgagaaatttattccgctagataccccaaatcatctccctcaagttgaaagttccacagatctctagggcaggggcagatgccaccagtctctttgccaaaatataacaagagtcacctttgctccagttcccaacaagttcctcatttccatctgagaccacctcagcctggactttattgttcatatcgctatcagccttttgggcaaagccattcaacaagtctctaggaagttccaaacgtttccacattgtcctatcttcttctgagccctccacactgtttcaacctctgcctgttacccagttccgaagtcacttcccacattttcaggtatcttttcagcaacctccaactcctggtaccaatttactatgttagtctattttcacactgcttgtaagacatacccaagactgggcaatttacaaaagaaaggggtttaattggacttacagttccatgtggctggggaaacctcacaatcatagctgaaggcaaggaagagcaaatcacaacctacatgactggcagcaggccaaaagagagcttgtgcatagaaactcccttttttaaaaccatcaaatctcatgagactcattcactatcacgagagcaatgcaggaaagtcctgcccccttaattcaatcaccacaaaccaggttcctcccatgacgtgggaattgtgggagttacaagtcaagatgagatttgggcggggacacagccaaaccatgtcagttgcaaaaatagaattttaaagcaatcttctcactaaagttgaacttctgactagtaattttaaaaaactgaatttggcttaggcagttaaataatcattttataaagtatagtgttcaacttcttaaacaatggaaaagataaaaagtaacataaaatacatttacaattcatgagaatcagaaaaaaaacagattatatataaatatacagacacagccattgtttttccaactgatattaaacaaacatggcaaatattcctgtgaggatttatgttcttccaattctaattagtccatgtaaaactatcatgtcttaaggaaaatgaatcgaactcgttcaccgccattgatgtggattaacaaagatgtatcgggaattaagttcttagaatttagcattgccatagaaaggaagactatacaattaaaacttttagggttttacatctgttactcctgaaatattttaaccatagtacataaataacataggttatttccatgaatactcaattgtaatttccttttattcttatcatcctttcagtgatgcttactagaagacattgtcttagtagactagcaatttaaaaacataagctaagcatacaaaaaagtaaataaatatggaattaagtggaactcttaatctgagtgtagatccatattttttgcctctccataatgtttaatactggaaaagttttttgagctctggctttgtaatagctcagtaaaaatagaaaacaaaagatgcttttagtccctgtatcatggtatcagagggttaacagattttgaaaaaagtcactagaagttggaaagttggtaattcaagagctgtaaatgtcaaactttatattgtggtcattgcaataatatgaaaatttaattagtattaatttaaaaatctaaaccacacagtgatgctcagtttgatgtgaaagacaaaaacagaaattcctagttttaactataatattctgattagaaaatcttgactgacagaattacattcattcaacatgagtactacttgctcagagagaagtgagcggggataagaaaaggtcactccatgagatcattactcagagtatatcaggaagaatggattttctcttttatgatttttttttgagatgagtgtcttctaaacctatagctgttttcaagaagtctttaaggatagccacagggtgattcattaataatacatactattctatttgtaactgttttcttactttctactccctgaggtccaaagcacaggaattgtcttatacctggtgaattttctaaagctatttggaaaaactccattacaaaagatactagtattgtatattagcattgaacaggagaagaaaagatcttctcattgagtacagtatatatatatatatatatatatacactgtatatatatatacagtgtatatatatatacacagtatatatatatactgtatatatatatacagtatatatatatacagtgtatatatatatatatacacactgtgtatatatatatacagtgtatatatatatatacacagtgtgtatatatatatatatatatatatagtgtgtatatatatatatatataattggaatatatgtgtcattggaaatctccaaatagaggtgtcttcatcattttccttttgttaaaataacactttcacattttattttgtattttataatctgagttgttatttgtaaaacaaaccggtgaagtattatgtaggtcattcattctaccaacattaaattcaagcattcaaagaataaaaataattttcttcatcatctctgtttttcaagaaaatgttttatctgagtcagaatagcttagatctcattcttaattcctcacgtcagtgtttacagacagcaacttgctgtgtttcttctaagcacttcagaaataacaaatctatttcttcatccccctcactatgtcaggtattatcccaattttaaaaattaggtaagacagagaaataactaagtaaataggaaaagcccaagctattttgttaaattttttcaaagttaaatgttactttaacaccatcagataaatattgtaataaacagtaaagacttgactcattagtataaagaaaggagcctggtatcaaatcaaaatctgatcagaacttgcagatagagcactctattgcaggaaaatccctctttctatagggaaaaacaaggtattttagcaaaattaaatatcttcaattcaccaacaaaataatataatccagctacataggacacagcctaaagtttctgattaaatacaagtgatagattcagtacaagtgccagagtttaatcatagaggtatttattatttgttctgtgagctggattcatagccaacttggaggaaagagacagaaaagcaaatgctgtatctgggcattttcctttattaaacaattgatttgtgtgtttttccttttaattctatcagatgcataattatttaggattgttatgtcttgttgatgaatactttatcatttatgaactatcccttttcactagtgatactattgtttactctgaaatctattttgatgttagtgcatccactccagactatacatttttggcttttgttagcattatacatatcatgctataatgggtacatatattcattattttactttaaaactatgtgtgtttttataattacagtgggttttttgttggcagcacacacttggagttttcatcatatccaatctgtcaatctctgacttttaatcaaagtgtttagaccatttacatttaatgtgaatatagatctggtttagtttataactgctatcctgctattcatgttttatgtatttcatctgttgtcccacctttgtatatgtgtatgtgtgtgtgaatttttttctaagtttctgcatttttatttaatatttttaatcattcatcttacactctttctggactcattagctataactgttttgcttcttcagtggttgctttaaaatttatattatatatcttgaccttaccattattgaccttaagtaaatactataccacttaataatacatggttgttattacatttaaagtggggtggtttgaaagagttttattagagtggagaaaataatatgtgagttcgagactggcctgaccaacatggagaaatctcgtttctactaaaaatacaaaattagccagatgtggtgacacatgcctgtaatctcagctactcaggaggctgaggcaggaatcacttgaacccagaggcagaggttgcagtaagccgagatcacgccattgcactccagcatgggcaacaagagtgaaactccacttgagaggaaaaaaaaaaaaaggtatttgataaaatataggagccaattctatttttttaaaaaaactataaaacccaccaacgttatattcaacaagaaaatgctaaagctatttcattaaaacctgagctaagacaaaaatagataaataaatatcctttaaaggttaaaaaaataacgtattgtctaactacacagttagcaattttggtgctcttcagtccttcttgttattttagatatttaactggtgtcatttttttttacatcttgaaggacttctttaatgttaaatatttcttgtaacatcattgtgctggtgattaattttccatctttgttatgtgtgaaaaagttttaagtttgctattaaaacttattttcactggtcatagaattctaggttgataaattattttctttctgtatttttaaggatgttccaccattatttcatatattaccttgtttccaacaaaactattgcacttgttctttttttttatttttattatactttaagttctagggtacatgtgcacaacgtgcaggtttgttacatatgtatacatgtgccatgttggtgtgctgcacccattaacttgtcatttacattacgtatctctcctaatgctatccctcccccgacctcacgacaggccccggtgtgtgatgttccccttcctgtgtccaagtgttctcgttgttcaattcccacctatgagtgagaacatgcggtgtttggttttctgtccttgcgatagtttgctgagaatgatggtttccagtttcatccatgtccctacaaaggacatgaactcacccttttttatggctgcatagtatcccatggtgtatatgtgccacattttcttaatccattctatcattgatggacatttgggttggttccaagtctttgctattgtgaatagtgccataataaacatacgtgtgcatgtgtctttatagcagcatgctttataatcctttgggtatatacccagtaatgggatggctgagtcaaatggtatttctagttctagatccctgaggaatcgccacactgtcttccacaatggttgaactcatttacagtcccaccaacagtgtaaaagtgttcctatttctccacatcctctccagcatctgttgtttcctgactttttaatgctcgccattctaactggtgtgagatggtatctcattgtggttttgatttgcatttctctgatggccagtgatgatgagcatttcttcatgtgtctgttggctgcataaatgtcttcttttgagaagtgtctgttcatatccttcgcccactttttgatgggcttctttgtttttttcttgtaaatttaagttctttgtacattctggatattagcccttttcagatgagtagattgcaaaaattttctcccattctgtaggttgcctgttcactctgatggtagtttcttttgctgtgcagaagctctttagtttaattagattccatttgtcaattttggcttttgttgccaatggggttttctaactaaaacttttggtgttttagacatgaagtccttgcccatgcctatgtcctgaatggtattgcctaggttttcttctaggtttttatggttttaggtctaatatttaagtctttaatccatcttgaattaatttttgtataaggtgtaaggaagggatccggtttcagctttctacatatggctagccagttttcccagcaccatttattaaatagggaatcctttccccatttcttgtttttgtcaggtttgtctaagatcagatggttgtagatgtgtggtattatttctgagggctctgttctgttccattgatctatatctctgttttggtaccagtaccaggctgttttggttactgtaggcttgtagtatagtttgaagtcaggtagcatgatgcttccagctttgttcttttggcttaggattgacttggcaatgcgggctcttttttggttccatatgaaccttaaagtaggtttttccaattcttgaaaaaagtcattggtagcttgatggagatggcattgaatctataaattaccttgggcagtatgaccattttcaggatattgattcttcctatccatgagcatggaacgttcttccatttgtttgtgtcctcttttattttgctgagcagtggtttgtagttctccttgaagaggtccttcacatcccttgtaagttgtattcctaggtatttcattctctttgaagcaattgtgaatgggagttcactcatgatttggttctctgtctgttattagtgtataagaatgctcgcgatttttgcacgttgattttgtatcctgagactttgctgaagttgcttatcagcttaaggagatttggggctgagacaatggggttttctaactataaaatcatgtcatctgtgaacagggacagtttgacttcctcttttcctaattgaataccctttatttctttctcctgcctggcactcgttcttatttttgtaccactgcctctgcacataatatgatttttatttctcactgctttgaagaattatgtccttgtcatggattttatacaattttatttttatatactggtatagttttcattatgcttcttctgattgggaattgttgagatacttcatcaaatttaggagttttcagttattatttcttcacatagtttttctttctcccaatatcactgttctcaactcagaactgcaattaaacagataccttattttattttattcacttatttatttttttgagacagggtctcactctgtcacccaggctggagtgcggtggtgtgatcatggctcactgcagcctcaaattcctgggctcaagcaattctgctgccttagcttcccaaagtgctaggatttccagtgtgagctatgcacatgctgtaccactcagtctctcctctaccttcttgaatatatagaatacagtcataataacactttcattgttcatgtctacaaattattttatctgtctcatttccaggtctgtttctatttattatgtttttttcttcattatgagttgtattttctggtttttatgtttttattttgttgggtgctagagatgttcgtgtttttaaaatattcttgcattttgttctaacatgcagttatgttactttgaaatacatcaacaccttttaggtttgcttttagtctattagatgttactagagtactggggatagtttgtgccactactgagacaataccacctgagtacccaaatttctatgagttacatggttgtccatctggccggatggagtcctgactcagcaccaaagatgtttaactttgttactattgaatggttttgtcctcagccttgggaagtgtcctcatacacatgcactgataagtactcagatgatgacttaagagggacaaaatatctgtagacctccagagctctcctgagaatttctgttctctgtggtattcttccccatcaaactcttgctgctttaagtcacatcagactttcaactttgtgtcttcaatttagggaaactgctaggctgggctccttctgagttgctcttttctcttttgcagcctggaaactttccatataatcagataaagaaatcaaagtgctcactttatttttcttctcttagaagtcgctgaagtgatcttcttcatatccaaagtctcaaaattactgttttacatattttgtctgtttgctttttaagttgatccaggcaagcgggatacatccactccctattaatccattttgaccagaagttggagttctttaataagtgattaaacaatcattttatgatttcagtatgccaaaacttttagctttttaaaggtaccaaaaatgccaaactgcattatatctatttcctgatttctgccacaaatctcatcaagaatgaatcctaactgtcatattgtatttttagagggtaaatttaacctgagtgcttttagaaataggtcttttatcctgtggagaaatgaacctttataactcccagagtgcattctaagttcagtgaattcaatgtaaattacaatgttaacttcagcatctccccccatcaaaaaatcccttcatgcatggaatacagaagttttaagtttatgaaatgcaaacatttaaaattggaaaaatcaatgcactttagccgactcaagaatagctgacatacatgaataaaaaatgaataagtaccatgtagagaacatttattattttgaaacaaagtgcatcataagtattggttaacaaaattctgctttgtattttttgaagcagtttaagaagaattatgtagaatgatgtttgacctaaaatttagaaagcctgatcacaaagacctcactgaaagaagtcatttaatggtaaatgaaattagaaaggagggtagatttattccctgctttttcccaaagtatcttactgagagcatttatgtacagtgcagcaatagtgaacacggacttcagctgcatttcagactgcgggatcagaatagttcattgaaaattcatattgtgtgctgtataagccattctagaaggaaattcatttaccttgatattattttataatttcacgattcacacagagaatccctgcttattcttaagctaataacagtaatttctgagaatataattttattcctagagttttaatgtgtgggctctaaaatggagttttatctcaaatttgattgtaaatgcttcttatttatgttgtttattatttctgtgtgccaatagtttgtccaattactatattctaaatgtgagtagaatatggaatctaatgaatccaaagaaaaatatatcttgtttttttagctttcataaatgctttgaaattcagtttagtgtgtttcggtgcttttattttataaatgtagatgaattcagtataatataatgcattattatctgagttacagttttcttttcaaatgttcttgatcatttagttgacattaatcaaaacactaaatgagtaaattttccatatggcaggcagttgtttacttacaaaaaaaatttcttgtaatagatagtaggcttaaagaccaaatgatttattatttcttaccaaaattattttataaaatggcttattgagtcactttaagcataagaaaccatatttaggaacgtggaggatactaagaaatgtaagacatattctctctctcttttttttttttttttttttttgcgacagagtctggctctgttgcccaggcatggtctcggctcactgcaacctctgccttccaggttcaaccgattctcctgcctcagcctcccaagtagctgggattacaggtgcctgccaccacaccaggctaaatttttgtatttttagtaaagatgaggtttcaccatgttggccaggctggtctcaaactcctgacctcgtgatctgcccacctcagcctctcaaagtcatgggactacaggcgtgagccaccacacccagccataagacatattatctaacatattctaggctaccaaagacctatgtaataaatataagattatttcatgaaaagaataagtgtggtcacatagtttctataagaccagtgattgcattagtagtttgaaagtttactttggtatgaggttgttagaagatttttcctagaaatgttgggtggagaattttgacttaaagataaagtaagattcatcctcatgggacgatatgttatgtactgtgtataagactgcagagtcaaggaaaagcaaaagaggctcaaggttcagtgaacaaactaattgaaccatgaatgcaagttcatataagagagttgcaggagttataaatagagagataacttgagtgcaggttttggaggttcaaaaattgtgacccatgatattcttggatttttctcttaccaaattattccaagagtccatgctgtatatttaacagccattttgctgcagtactgaatcacaaatactggggacttgcgtgcaagtcattaattaagctagttagacttacctgtcacctaccctttattatctttcttatgcttttttgtttgttttagccttctcttctcatttttcacatatctatttttatgagaaaaaaatattctccactgttaaaactcctggtaaaacaagaatccagagttaaaagagaagctgcagctacattgtagttgtatttgaatagactaagcctttctaagatgcagtttattaataggagatattagttactcattattttctgaaaaaatgtgaataattattgttaaatgcctcttcccctcttcacaatgtctgctctaaagaatgagccatgaaaaggaaagatgattaatctgttattatttaattaatcctagttagccctaggaagttctgccctacctcttggtctctttctttaaatccagaattcctcaaggagaagccccttctagttttataatgacatccagagcctaatttctgatgctcttactttggagaaccctgactcagtacccatttcagtgacccctgacttatccatcttcgaggcttgtatcccatcttcttctgcataatatcatttcctgtatctgtgtggctcagaatgatatgaatcctgttcccttcttaggactagtcatgtccgggcatttaaattgttttgagggtgctgggagaagagcaagatttgggccagatagttaagatttatatataattaatatttatatagttcataatttaaagaaattaacctttaaaagtggcaaatcactttataagatagtttctgtaagaattttttgtttattaggtattgtgtgtttgtgtgttttaatcagtactttgttagacaaatgtggaaaataagatactgtatatcttatatatactagtcatgtgactggtacagatatatttggcaagttaaagacagcaatagaatagagttgattacttctagcaatgtctattctgaaacattatcagttaatcagatagattattcatatgtgagttatttacatattttatttagttagcataatcatttgagagaggtgagtgggtatatacagcccaattcttagaaaagtcttttaatcatacttagaaatattatatgttgtctcaaattttgttcattcaataggaatgacatttccctaaactaggcatttactgtctcattgaaatgagaaaaaaaagtggccatacagttcataaatagcatgctataaatcatttaaaaaatagaagcttgtatgtctaaagctccattgtaaattaacttgtataaatgagaagtgcaaacagaactacaataaagcaggcctttacacccttacacgtcattatgtcatttgtcatgtctttcattaggacaggttaaatctttgtgccgatagcatagaatattactgaaaagtcatagtgttatgacataagggatcattttcttctacaagcatttaggggaaagtcaacatagcctccttcataattagcagagaagtgacattttagaaattttttatttctgagatgcttctttaaaaggtgtactggtttgaaggggagcctctaagacggtatgtgcatgttctaacctccagaacctgtgactgtgaccttagatggaaaaggggtcttagcagatgtcaataagttaaggaagtctagatgagatcatccttattaatcaggtgggccctaaatcccatgatgtgtccatataagaggcacatggtggagagatacaagaggagaaggtcatgtgaacacagacacagagatgggaatgatacagtgacaaggaattaggatccagaaaaggcaaaaaaggatcctctcataggccttcagggaccgtgcggccctgctgacacctcagttttggacgtttggacttcagaactgtgaagaaacgatttttgttgtttaagtttgtgtatttgttatggcagctctagaaaatcaatacaaaaccgtagttgttggactttcccccccaatctcctaaacattgttttttaatttctgaaccagcatttcctacttaataaagcagcataactaacaaatatatttttaatgaaaacttgagaaataatttaacacaacactattggagaaagaaagcattagagtgacagggaatgatcacattagaagactctaggcagtgaagttggatgaataagatggttttacctttttagtcaaagggaatattacctcagctatccgaaagaactgtgtcagtcaattgttggccagtcaaacacatctcttatgttagtgtacagcagatacaaattagaaacaataccaatttcaaattcatcctatctaccttttttgtaatgtggcaaggtttttgctttccagaaagaagcagaaaataaatgtgaatggaatacaatgaatactgcataattttttcttgttaagagaaaagcatatttacagcaaagaaattatgtattttttttaaatgtagagcctggaattttaaacacaagagtaaaagtagatgatttttctttatgataatctagttcgcaaggcttgcacaacaatcatttctgagcagacattagggaattctataaaagtattggacaaaacagtacttatggaaagcttgaagaaatggggcagaaaggtgattattttcttttatatttggccctcttcttatcattatctttttctaatatgttacttcatgatggtaatgatacaataataattaaattctcaactgttactttctattttctcaagtctcttacattattgccataccatcttttattatttgaacttgcagtaaaactttggggacgattattttgatcacaactgtaggacttgtgcctctgttgaatcacatacagaaatcaaaagcatggataaatattttgtcaaataaaatttatttaaagaatatttggtaatgagtgacaaatgtttgcaactctgggtaataatagagttatgtgtccattttttcttttggtacatttttcacttatctgaatgggagccggaagtgctttaaagtttcagaatgcaagtgcatgcattgcagtgatttttctgttgttggtcaagttacttaaacgctgtgtcctgctttcctccatctgtcgaaggaacataatggccactcatggccttcacaagaaaaagtgtaggaagagaaaacagatcttgtcagtgtggggtggaggatgaagttatttttaaagcaagtatcttgtaccttcaggaagcaaaatctggcttaaggtatttttttttcttcttttctgaataggctatcatcatcaacattttaaactgctttttaatgtgaagactatacttttgttttctgtgagttatattttattattagacattgaggagaaaacaagaagggacccttccaccgccttacaaatagtgttcactaaaagaagtagatattattacttacgctgctgtattatctacacctaggaaacacacttaatacatgcattatgaacaatggaaggcttgcatggcccataataatggtaatgaataacacttattgaacatttactctgtgccaactctatgtattgtctatgctctgtctcctttgctcctcacaatgtacctaaaaggagggtgttctgattgacgccatcttacaatgcattaacaccaattacttcaagttaaactgaggcttagaaggtttaagggacttgtaccaaatcccttagctagttaagtgatagaaccaggactcaaacagcctgactcaaaagcattccttacccactgggctgtgttacattaggtgacgtacctttcacatgctctctcttgaaaggcaaatacagctttgaaaaatatctagcaagtggagccaattctgctgaaattctatagcaattttctcctgtctgtcatttcttcactggcatttagcatctgaaaaattcttcagagattttcttttctctaaaattacagaagtttaaaattaaagcaagcacaatattaactagtttccaaaaatgaaagttctaaccagctttttgaaagtttgtgataaaagataatatattcttacagtcatactcagaagaataaaggtatgcaagggacagagtggtcagtgaatgtgctcatgtgggagctgcgttcttttataactctccattctctcccgtggccctctctcttcctcaccggcatagacatttacacacacatatggtcgctttgaacttctcccacaggcttctttgtccactgccatttctatatgttttcttcccagataaattccctacctcagctctccagagtctcccatagtattgacagaatgtgtacgatttgttttaggtttttcaaatatattgaattgagtagtagtgacttgtaccacaacttttaagtagaatgatttagtctctctgaaaacaagttgcctcctttccaagtatgagtcttcagtgttttgcctggcttcactgagagtcagtgagcagactaaggtttgaatattactatccatgagatacataccagaggtgcaaaaatcataataaatgttcaagatcattaacgttataataacaacaaaatagatttacttggataagtctgttaagttaattagagttattggagcattaatgtgtttggagtttaatgccataaatcagcaattcaatcaatatgtatcaagtgccaaagaggaaatcactattgccaattatggttgaatagaaagagccgtacacttggaataaaaattgtaacctagtatctggtccttctttttattatctgggagatcattgacacataatagactctctccagtcctcaatttccacaccgtcaaattagggatggaaataagatttcttgaggttgttacaaagattaaataggtaaagtatataaaagaacttaatatttctatttttttttcttttttcataattagcaggaaattgcccctgtttttttcagggaaacatagctgcaaagtcaactgggaaatgtagtctaattctaccataacattggcccagcaaatttttatggattttctcatgagaaagaaatgaagtatgatcagagagagaacactgtgagtttctggcactatattcaccatagtacaaaatgcaaaatgactcacagaattcaaaaattacaaccttcatcgaccattaagtggaaacttaatgaaaataaaaataaatgggtaaatggggatggtgactcgggggaaaaataattttatatctgttccaattgactcctaccttctctttttcatacatgtataaatgaagtcataacatctctattttccagattcttatttatcccctggctttccacatacattatttcataaacttgaaatttatgaacattagacatcatcttggggcttgtaaaggtgtcctaaccatcccacaaatgtacatgtgcacatgtgcacacatgcacacatacatacacagatacgtaacatggaaagcaaaatggctttctatagatccttaccacgatgttttccacattgatggaaattttttcctatgttaaatattcagcaaactatctctgaattctatctttaaggatttgaaaaaagcagcaaactgcgcccattaacttgtcatttacattaggtatatctcctaatactatccctcccccctcctcccaccccacaacaggccctggtgtgcgatgtcccccttcctgtgtctaagtgttttcattgttcaattcccacctatgagtgagaacgtgagatgtttggttttttgtccttgcaatagtttactgagaatgatggtttccagcctcatccatgtccctacgaaggacatgaactcatctttttaaggctgcatagtattccatggtgcatatgtgccacattttcttaatccagtctatcattgtcggacatttgggttggttccaagtctttgctattgtgcacaggtaccctagaacttaaagtacagtaatatatatatatataaaagaaaagtaaaagcattttatgatttcatcccactgaaaaaaaaaaaaaagaaaaaagcagcaaactttttattttctgagtgagcataaatacttaaacccatagatgggagcccagttagttcattaccaaatttaatggttttgaagatatctgtccaaaaattgttatagctgttgggtaaaggaagagacgaggaatgtgtgagtgtctagcattgagcactgttaaaacatccattaatcacatgttaatcctccaatttctagtcataagcaaaaatgcagcacactagaaatgagccttcttattagaattattaatttgagaatcagtcaactacatacttctgtgacatcaaaaaggctgagagaacagtggttgattgctcaggaaatttatgagaccaacatgaatatctttcacattccacaaaagaaatacaacaaatcctttgctgacaaagctctagtcattacagattttatgttctcgtttacagaggaagagcttctcaagccggtggtttgttttatcacaggaatgttcttgcaggagattcacttacaacaaaaacttcaagtagatttgggttgaatccttattctaccagctataagctgtttgctctttgacaaaaatacttaattgtttttttttttgagacagggtttcactcttactgcccaggctggagtgcagtggcgcgatcttggctcactgcaatctccgcctcctgggttcaagtgattctcctgcctcaacctcctgagtagctgggattggaggcactcgccaccatgaccagctaatttttgtgtttttagtagagacggggtttcaccaggttggtctagaacccctgacctcaggtgatctgcccgactcagcctcccaaagtggtgggattacaggtgtgagccaccacacccagcccttaatatgttaatatcatttttttacctttaaatttcatcgtttagctagtcattttttcattcagtgaataaatcattttaagttcttactatatgccagaaagaatggtaggcactaagaatattataaaataaaataaagaaatggcccatgacttcattgtgaataaggacactcatttctccctggtgggatgttcattaaaggagatagcatgtctaaacagttttcaggttctgaaacatcctggaaattatctcctcttctggaagaaattttccatggattgtctcttttgatttcctccaaaagcaattactttaataatagactcgcctatctgagttttaacaagacacgtaaccacccagctaaaaatgggtttcatggccttctttatggttgtgcatggttgtatgactgagttctggccagtgaaggtgagcaaaggtgccaatgccatcctccggccttgcccactcacagaatgcagtagaacgtgtgagcactcagggtccttccctgttattgcaagctgggagatgacaaggacttacacccagagatggaagccacaggggataacagtgtcacatgaccaacactggaatgctcatttctgttttatttaagctgctgcattttggtgtttctttattgtcacagctttgtctgtaccctaactaataaaatatgtttttgacacagtttatgccattatttattgtattgcacacaagaatggacaagtatgtgaagattcatcattgaaaaatatgttttaactcatttttgaaattattacaatattgttcaaatatatttctctaattatgtatcttccccacttaattatttttattttgagccacattatcttataataattacaatgtaagatgaacagcttatgcttcaaagaaaaaaatgagtatagccctctcatttcaagagacgttcaataaaataaaattcttgaaaaacaacaaaacaataagagtgctctccttaggatttgagttctttaatatatttttacaatatttttgaaatttccttagtcttaagagcacccaggaagttttgaaatataacaaagtatagaagtggtatttacataagtcctacatagatatcatttttttccatttttaattatggtataattcacatgacataaaatttattttcttaatcattttaaagtatacaactcaatgtcattaaacacacttgtaatgttgcgcagccatcgaaccgtacatctctagaactcttttaatcttgtaaagctgaaattctatacccattaaatgacacctgcccattctcctccctccctgtccctggcagccaccacactaatttccatctctatgattttgactactctatacatcacatattagtgaaatgatataatatttacctttttgcaactggcttatttcacttagcataagggcctgaagattaatctgtgttaaagcatgcaacaatgccctcagaatttccttctttttaaaggctgaataatatttcattgtatattgtacctcatacctgcttttaaggtttgagagtgtaatactcagaaatggaattgctagatcatatggtaattctatttttaattgcttgaggctctaccatactgtttttcatagcagttgtactattttacattcccacaagcagtgcacaagggttcctatttctctacaaccctgccaacacttgttgttttgtttttagtgttcctcttttcaatagcagccatcctgataagtatgaggtggtagctcattgtagttttgattttcacttttctaataattagggatgttgaactcttttcttgtacttattggccattgtatatcctctttggagaagtgtctattcatgtcctttttctgcttttgaattaggctgtttgtatttgatgttgagtttaggagttcactatgtattgtgcatattaatattttatcagctatataacttacaaaccctttattctatagtatgggttatctttttactttgttggtactttattttgatgtacaatgtttttaaattttatgaagtcagaggcaaattgcctatttttccttttgttacttacctcttctgttggtgtcatatccaagaaaacattgccaaatctaacatcgtgaatttttgcctgatgttttcttctaagagttttatagtgttacatctgacatttaaatcttttaccattttgggtcgattttttgtagtggtattaaaaagggtccaacttcaaccatttgcatgtgaatatccaggtttcccagcaccatttgttgaaaagactgtcctttctccattaaatcgtcttgaaatcttgtcaacattatttgactgtatatcgcaagggtttatttctgggttccctattctattctgttgatttatatcactgtatatatgctagtaccacactattttgattactgtagccttatagtaagttttgaaatcaaaaagtatgcgtcttcccctttattctcctttttcaaaattgttttggctatttggactcctttaagattacatatgagttttagatgagttttctgttctaaaaaaaatcactagaatttttaatagagattgcattgaatctgtaaaacacattgggttgtactgacttcttaacaatgttatagttcttctagtacgtgaacacgggctgcgtttctatatatttaaagtctttaatttcttttgcagtgcttaattgtttttactatagaagtcttttatctccttggctcagttaattttgaaggattttattttttgtactattataaattgaatgctttttgtaatttctttttcagattgttcattgttattttatggaaacacaactgattttttgtgttattttgctaaattcgtgtatttgctctaaaaggtgttttggtttttttgtacgtgtttctgtagaatctttacacttgattttagctaaaaactgaaaagttatatttgcaaaatcttagggttttatatgcataagactttatcatctgcaaacaataaaattttacttcttttttttccagttcagaatccttctatttctttttcttgcctaattgctctgactaaaactttcaagtactattagagtagaagtgttgaaagtgggcatccttgtctttttcctgatcttagaggaaaagtctcaccattgggcattgtgtttgctgtggctttttcatatatgacttttattatgttgagataatttcctttgattcctagtttgttgagtatttctactgaaagggtgttgaattttgtcaaatgctttttctgcatcaattgatgacgtggtggtttttcttcactttattagtctggtggattacattgattaatttttgtacgtcaaatcatttttaccttccaggaataaatctcacttggccttaatataatatatgctgctgaatttggtttgctagtattttattgtggattttggcataaatatttataggagatattggtctgtagctctctttttttatagtgtctatgtctgactttggtaataggaaaatgctggcctcatagaatgagttaggaagtgttccctcctcttcagttttttgaaagattttaaaaagaactggtactaatttttttaatgtttggtagaattcacctacaaacccatgaggtcctggacttttacttgttggggaatttttgattagtgatcaaatctcctaaatagttgcagttctattcagattttctattgtgatttagtcttggttggtagtatgtttgtaggaatgtgtccattttatctttgttatccgatttgttgatgtacagttgtttctagtactctgttgtaatccttcttatttctttaaatcaggaatggtatccccattttaatttctcacttcagtaatttgagtcttctatttttcttagttcatcaagccaaaggtttgccaatttggtttatcttttcaaagaactagctttgggtttcattgacattctccattttcctattctctatttatctctgctctagtctttgttatttccttccttctagctttggatttagtttattattttttaatttaagcatttacagctgtaaactttaccccagcactacttctgctgcaactcatgtgttttggtacactgtctttttattttcacttggttccatgtattttctaatttcctttgttgtttaagagtgtattgtgttatttaatttccatacatttgtgattttccagttttacttctgttattgatttataacttcatcccattacggccagagaagatactttatatgatctttatctctcactatgcattgaaacttacttaataggatatggcctatcctggaaaatgggaagaatgtgtatgctgttgttgttagagtgttctacatatgcctgttaaatctagttggtttgttttgttaagtcctctattttcttatttatcttatgattcatgcttaaccaacaaaaaaaaattttaccgaaacaagtgatgttctctcgtctaagatattttcttagaatactaaacacttctaccagtgatactgctgttaacaatattttttggaaattattgttggcaaagtcttttagaaattatagcatgaccttttgaatttctttattgatagaaatattttatcagtggatttggtttaatacaaccaacagtgattcaaggccaaatcttataagatgagcaacaagttataaagtaacatttcagggtatcttttaaagaaaagtctaaaaatgacaagatcatctgtctatttgcagcttattttaaactgtgtttctcccttaaattatatactcaaaatagttgggagtaaacagcagagacatctcttacctaaagttattctagggctagttcatcttgtcagaagtataatcccagtccacagttttcaaagaagtgggactggtgagtgtcagaaaaatattatcactagtcaaaagcatgattgcatttcctcttgtaatctgcaaagtgtcagaggaacagttattctcagtgttattgcataggcatggaagtggtaaagaaaaaatgtttttggtcacagctaccctaggatgatggttcttgcaggtttttaaaagacagaataggcatcagagataaattagggccctaaaataaaaagaaaatgaacaaaactttaattaaatttataatgaattgttatgagaagtgtcagccagtacagatcataataataaaacaaataccttctattgaatgttaacccaatatctagttgttttaaaatattatatcaactattttataattataatgtccagaatttacaagaaaaaaagcccattaaaaagtgggcaaataatacgaacaacgcttttcaaagaagacatacatgcagccaacaagcatatgaaacaatcctaagcatcactaatcattagaaatatgcaaatcaaaaccacaatgagatactgtcacacaccagtcagaatggccatcattaagaagtcaaaaaatagcagatgctgatgaggttgtggagagaaagaaacagttatacactgttagtgaaagtgtaaattagttcagttattgtggaaagcaatgtgacagttcctcaaaggacttaaaagagaattaccatttgactgagcaatcctattactggaaatatacacaaagaaatataaattgttctaccataaagacacatgtgtgtgtatgttcattgttgtacttactattcaaataagcaaagacatagaatcaacctaaatgcccatccatggtagactggataaagaaaatgtggtacatatacatcgtggaatactatgcagccataaaaaagaatgatatggcctttgcagcatggatggaactggaagccattatcctaagccactaacaggaatagaaaaccaaatactacatgttctcacttataagtgtttgctaaacagtaagaacatatgaacacaaagagggcaacagcagacactgaggcctacttgagggtaaagggtagggggagggagaagattagaaaaaatacccattgagtactatgcttattacctggtaataataatctgtacaccaaacccccgtgaatgctgtttacctatataacaaacttgcacacgtacccatgaacctaaaagttaaaaaaaatcaactatatatgtattaaataaaagtgatataatttacatttgcaaattacagaagacaagcatatatgaaacctagagaagttaaaaaatttttcaagaatagtagttgaaaattcacttctaatgctggtgtgtctaatcccaattccacggccttccactctcttgtgcctccttagggagaaatctgtcctgaaataattctgtacttctgggccttgatcctcagaactctgtaatacccactgaaagtcagagaccatgtgatttcattagagtcataaccccttctaggtttgtagccccttttaagtttgcatctctgtatttttctctggcttcatatcttcttcccacttctcactaaacaaaaggctaaagaaagctgagcctaaccacatgtttgcctctccacaaatgaataagttgctattcatcattttcttttgtttgctttcctttatcagaattttccaaacatgcagctgtattaaaaactaggtcaatttaaagcaatcatgcacaaaattgtttattaaaatacaaatatacaccagtaatgttataattgaatgtatttttctgggacccataagtcttttgtgcctttgatttctctggtttcctcatgtggatagtaatttttaccaagaattttactatgaatagatctagtgaatattcctgcggatgctgacatttggtagcttcttgactcatttatgttaagtccatttaattttttctgtttttatcccctctctctcctctactcccccgaaataatccaagtgagcaactaaaatgctacttgattttcttgagaactttggccagaagctatatttatttataatcacatgtcctaatgctatattgtttgtacgactcattattgtagttattattctttaccagttgtttatttttacataattattctaacttcatttcatcatgttttattaaagcacaaggttaaaaatgagttcagttttactgtcatcttagaattatcattaacttaatgtccctttttgttagttacaatttttccacctactcaggtgttcatgagttgagtatatactcaaatgcacaacaaacccaaattttagagcacagaattgaaaatcatgagtttttgaaagtttcatgaactgaggcaatcttattgccattgccatgaggagagaaattgattaggtcatatagaaggaattgaatgagataaggcaaatgctttatttttgttatcttcaagtgtgatatatgtatgcaaactattaaactcctacccatgctataaagtcatagtatgtgtatgtactgacttactttacatttgaatataaaacagataaatagtaacaggaatcctttacactgaatctgcttcatctgcccttggcattgtccacaggctgtagcaactacagcaatgccatgggaggcaaaggtaaacagagcttttatgtaggtgtgctgtccagtgtggaagctgctgtccatatatggctatttaaatttgaatgaattaaataaaatgaaaaaaaaatagatccacatttcttctactcacattgtaagtactcaacagccacatgtggccagtgactaccacattggacagcaataatacagaaaacttcatcatcacagaaggtaccatggggcaatgctgttttatagtatttagtagattgccttaattgggacttagcctctgaataatgaaaaaagcagaagcaacagtgcacaaatagatgacatccaagattttaaataaatacacacatatatgcatgaaactatgtattatttgtgtgagcatcatctaactggcatgctgggtgattaggttagcatttaggtaacaaaagatgtcacccattgaagacaagatcctgagcaggctagttcaatgcacacattcatacacacacgtacacactcacatacacacaaagtcttaatgcttgttgagtgaaaaggcaaaataaaaatataaaagatagtcaaccatgacatatgctaacatactatgatgttaggagaaaattaaatggtattcatacacgtacccacacacatacacacagtctcagacacttgttgagtgaaatggcaaaataaaagtataaaagatagtcaccatgacatatattaacatactgtgatgttaggagaaaattaaatgttggttaatatttattactaaagagttaaaaatgcaatctgcactcttcttaaagtgaggtatggtaaagcctccagattatttctgtcttgtcattatttccacctttgcatttcaaagagagtgtaaaccatttgggcctacttgctgtcttactcagtgtttatcctgcagtgacccatgggtggattggaaagtaggacagacctggcttggaatctgagcactgctacttaatgagctctgttttctcatctcctgaatggggacaatcactgtgcctaccttttagggttcctacgaagataagtgcatcagagcacttcaggattgacatctggtgcaggaagtgctcataaacagggactcaggttcatatactaacctctgatcttccttcctagcctctctgtatctttatctttatagttctttctgttcatgtcttctgttttaatgctctgctatgtctttgatcccttgccctcactcagaaacccaaaggaatgaatatggagattaagaaagagaaggctaccagaaagtaaagtaaaaggagaaaggaaatgggaagaggaaggaattacaaacatctataaaaagatatgcttcctctttttgttcctgactaaaactcattttgttttattttgttctctttatgctaaagagtcagtttgactgactttttaaaataatgatttgtttgcttgaattaactaaatgaacaatatttatatttcttaataattgagtccttaggtgatcatacaatgttaccaccttatatttaattctttttttttttttttttttgagaaatgtgaacaaaaagaggaaaacctgtgtgtttggttataaggtctctggttaattttctgatgtaaagctttactgaaaaatcatttcattaagtgctccacttgtgagctgcttgtagtgctttgtaatctaagcatttcttcagtcatttctctgactctgagggctctctgccaaagcacggcttaccaactggagcaggtaaggaatgtttattttgctgtaattggtgaccaaaggctgctctgcataatggctcagaggaaaactcagaccttctattcctgacactatggaggagaaaacctgaacttaaaaaggcactcgggtcttacctatatcttttttgatgaggtgattgcaactggacctcagccttgccatttctaaaatagggatgatcattcctactctatctattttctaacgttgttgagataattgatacaaatattattttaaaaatcaagccagacgcggtgacgtgtggctgtaatcccagcactctgagaggctgaggcaggcggatcacttgaggtcaggagttcgagaacaacctggccaacatggtgaaacactgtctctactgaaaatcagccgggcgtgttggtgggtgcctgtactcccagctactcgggagactgaggcaggaaaattgcttgaacctaggaggcggaggttgcagtgagccaagatagcgccactgaactctagccccggcgagtgagcaaaactgtgtctcaaaaataaataaataaatatttaaaaataaacaaacaaaaagcaaagcacagtatgcatgagtttgctttttctaaatgtgatgatgaaagctatcatataaatttggtagtactcaccaacgtagagccaacaattctaagcagcttatctccagtctgagtctaaagaaccctaagacatctagttaattcagtggtaacaatagggaagcaattatttggaagagtgtctggagtacacgtgctgctttcctgagctccaaagaaagaggccaccataccacaggtttttttacacaattcttacactatgaccggagcccaaggcagacagtcatctttagctatgctgccctttcttccctatatcaaatatgacagcagaaatatcttttctcccctcttgacttcctaatactagcaataactttatctcattatcaaactcaaaatttaagagtcactcttgatttttccctttcttcattgagtaacaaattatgttactcacgtccattgtttgctcttaatttatactttaccacctcagttcaggcccctatggtctttgcccagacaattgcaatagcttctgtagtattcctactttcaatatcttttccactttccctggactgcctagttctgaggaatcaatttccctaaaagtgcagtttgaaacttgttgaaaatcttcttcaactcacatctcttattctataaaaggtagataacacagaggatacaaggctgagctttaagaattagacatgataccactgtcttagtctattttgtgatgttataacagaatatctgagactgggtaatttacaaagaaaaggaatttatttctcacaattctagaggctgagaagtccaaggacaaggagctgctgcatctggtgagggacttcttgctacattatcccatggtggaaggcagaaggacaagaaaagatgcatttgagagagagagagagagagagagagagagagagagaggaagaaggccaaactcatccttttcaacaggaacccactcctgcaataactactccactcatacaatagcagcattaatccattcatgaggccagagcccttgtgaccaatcacctcttacatgtcccacctcacaacactcttgcactggtgattaaatttccaacgcatgaaccttgagggacacattcaaacaaaccatagcaatcacctacctataaaaagaggacactcatctattcaataaatatttatggagtccttactgtatgtcacactggattaaggtgagaaataaatgaagtaagggatgggaggtagttaaaaggcctaattaggcatccaacaaatgttactattaggaaaaagagaatgaggaggagttgctgttattattgtcttcaagtttgattctaatatgcatgacgcatccacaatgaactgtgcccttgcatttgcttgtttcactcttttccctcagccattgttcatcaaaagattcagcaaaactgccaccttcacagagaatgctctctgattccagaaggctttgctctggtttatttatttattttaattaattaatttatttttttaagacggggtctggctctgttgctggagtgcagtggcgcaatctcagctcactgcaacttctgcgtcctgggttcaagtgattcttgtgcctcagccttcacagtagctgggattacaggcacgtgcctccttacccagctaatttttctatttttattagaaacagggttttgcctgttggtcgggctggtctcgaactcctggcctcaggttatccacctgcctcagcctcccaaagtgctggaattacaggtgtgagcccgaccctgattttcttttaaacctccaacacaatttttttattaaaaggttcattagggaaaataatggtttttgtttttgttttttaatctttatgtactctagagagcttataaaatacataatatatcttacagaagatgttcaatggcgattgttgagtgtccctttgaatgaacaaatggaaggatgaagattgaatgtgaatatgcaagtgagagaggaaaatattataaaatatctttggattcattttttcacacacctactggtatcagtatgtgcagtttaggatcaggaaatctgagttccatgatcaaattgattagggacttgctattcaaccttcagtaaataatttagcctttctgtgtctcatacattcagcaattcaacaaatatttgttaagcaccttctatctgcccagcactgaaacatttctcactaagcatgttttgacctgattttcttcccggtaatacactttagtagaagattgaaaatgtaccctaatttttcttccttggagtcaaatactttctcacactgagtaggtgagtagctggtatctgcaagactgataaatgagaaaacatgtcataaactgaccattctttggacagtatttctagaaaagaaaaaaagaaaaatctttatcaggatgccattagattagctattaattacgtttataaaggagtatatgtaatgaagtagaattgaatgcattatacaaatggcatctttctcaaatatgtgttgctcatccttttaagagaccaatgcaatcatccatattgtctctccacccactacatttaattaaacagtttgggtccagtggggtcaaaggtgttcagtaacatttaccgtctgacagcaatcccatggcctatattctgtgaatgtggaagccctggttcattgcaatgagcaggtatctgcgttagcaaagcagctaccactctaattttctctaattgacttgttggcagtgctaacagagagggcaaaagatgcaggaacatgcagagtgggccccgacaagaacttggcatggatgaggccagtgagtgaagtatataatctgtaatgaataaaggactctgggctgtcaatctggcacatgccactggcatttaattcacacaaaatattaattaaaaataatgatgttctccccagcttttgtcgccaagtacagcatcttggtctagccctgaagagctgtctacaggtttcttgattcattccctcagccccagagaaagacattcatctcttaccttcagggaagcctcaaaaaaagctcttagaataatgggtctctcacctaccaagtctcaggggaaggagaacccaggcttttcctgattacccatttcttgtctttttcaatctctgtgatcaacgaatgtgcatttattttctcctttcctggccacagagaatatactggccaagagccatctattttggatgctcaacgagttactaaatatttcttcagtttcctttatcccaaactgaggtgttctacaagaaaggttggccaaacaataatgaaaatctgatcaataatttcaaatctgctaaataacccagaatattcttgatttaaaagaattcccgtggacttccaaattattatttggaaatttattttcaaattatttcagtatgattaaatcacagtaaattcaaagaagaaaatactgctgagctttattttgcagaggcaactgataaatttttaagcctatatatttgcaacattttagcaagtacaaaaaaatacacttactgtcatgattgtcactaagtgtattcctgcacaatggggtctggccataattaatgattaattcatttggaatcatcatgataatattaaatgtgtttaactcatttgatgcttctgtagagggagcaattctaggcaattcttttgtgatttactggttttaaagtttaagagctctgagcatgtgcaggaaaatagttccacattgctctccagtggcacagtggtaaattacacccttcttacatactggtagaaaaccctcattctctcttgctcccaattcacacttaaagcatctttcctcttccatatacattcaaacaaaatacctccatcacaatataaaaggatatcaaagcactatagcccacttgttaactaataaatgtacaatattttcttgttttttgttctggaagatcaattattggatcaaactttatcaggaccggaacaaaatcctattgtttcctcagtaggtccagaatgcagtttggcaagagcacaatacagaggctagactccccaaaagatgtttatgagcagttaaagtgtgaaaagcataaaagaaagctcctggaaaaggcagtcaaaggggttgtggagtcttcccaagcctttattacttaggtagttctgcattactttagaaaaaccattgaccttacctgagcctcaagttactaactgacgataggaaaacattgagccaaaacatcttcaggactcctagctctatgggatattcttataccagttacaagtccattgcaagtgtgtttactttttacggggctaagctgttaccactttttgtttaagtgtaaggttgatcttctctaagatgtgcacagcatagtaggtattggtgaaatacagtgattagtataattcattaatccaacagagagtaaattataaagctctcgactcagcatattctataccatggctaaagatcaagtgaaagaagctgtcattactcagatgactcgagatttggtaggtatcaatattagcaagagtctgttttggaatgacagttacctcaaatttatgggggttaggagatgaagaaatgatgactgcttcagattaagttaaaaattcaaaccaatacaatgagaatcttgtattctcagtaccaagtaaggtatttttaattttttttcttttttaaaaaagaaataatatacaccctgaaagactgaaaggtaataatccagtaatgttacagaagcttttacagagtgcattttctatggagctataaattaagcatctgggtggtgggaacagaaaaatgaagacatgaatttagtgtctcatggactatgctgaccatccataagctacagctgttaaccctgattaggaagtcaaaggcttcctattaagtagaacattctttgaatcctaatccaaattggacctgtgaatataaaacaatcacttcaaatctcctagcataaacacctgtttcattcttttatatttaccccccaccccccccccaccaccaccttaccacatcatataaagtttctagtttgttgttgctctaaaggttgacggcttgactatggaagaccagacttcagtatctatttttccgggattatatgtatattggcatgtagttgggtatgtaggaatctgtccaaggttatagactaatgaccacaggcttggattcagtccagagagatagtttttccaggataggaaatttattgtatttattgtattttccaggacaggaatttattgtatttatttaaattatctgccaacactgaaaaatttgataatttctcataaaaatctggatttccagataatctgacaaaactgggactaccttccatacactaatattatcttggacctgaatagtggctccactctttagatcaatcatatactttccaagatcctctctgacctagtggctctcatacactgtagccaaatctagccgtttttcttttctctctctctctgattaaaaacaacacacacacacacacacacacacacacacacacacccctacctcctaagcacttgagtgtggaatttctgatcactttttcactcttttgataaacacttagatagatgcaaatacggagatgtattcaaattgcgaatggaatttgaactgcaaaaaggcaattttaaatggctcaagcctaataaaaatgtttacatttttggtgcatagatgattcatatatttgaaatcagacgtagtccatcctgcaataactcaaaagaatatatttcccagtggaaaaaaaagtgtactttttgatctacctaattgtattttcaccattttttcactgaaatgttttcttcctcctatagtgcttcttagtcctacccttattcacaagccctagttcaaagttcatatattccaaaagtcttctttgatgacctaaatcctcactaatttttcagacctctaaatgtatagcattcataagctatatcacatactttattgtttaattttacatagtctttcattgttttctctgcccagaattatattagtaacctgacagaaattcatcttctccaagtacttggatctcaaagcgcatttaacacttgttgattgattactttcttattaggaaaatagcttgacaacatacattttcaaaaaagaaatattcccttttggagggaaagcaattcactgaatagaagccctttgactacattagatataatcttattttattcttcttgctgtattatagctcttgaatccatgtggtttagagtctcaatatctttaacattaatacttaggtcacatacaaattttatgaagaaaactcaatcagatcaatttttatagatgtctatcagagataaatacactcatttttaaggcttttttattttgatataaaacccagatacagaaaaccacatgcaacaaatgtgtaatttaatgaagtattataaattgaagttcaccatgtttccttgctctgttttctgcaatctgtcatttaggtccagaggctagatcagactaagtaggtttgatccctttggcaaaactctggagagtagtctgttctttcatcaggaagcacatactgtctcgttgtctctattttatcttagcaattattaatgcttaatgcttagatccattcattaatgggggctgtaaaacagcaatattttaattttactgttttgtttttatttgttagctagaattatgttctgatttcacaacctcagaaatgaccaactgttattctttaaaatacctttatcaaattatgcatttatgtatatttggtgagtttccatacatcacagcatttatgcttttctgtttgcagattatccttatctctggtctgagggagtctcttcaaattgactactgaacccatttgacatgattttattagttgcttccgttctatctagtatgtcaaaatatttcaggttcatttggcatgttttctactttaagaatcaaccagttctgcgagaagctgcttctttttaataggaattaattttcccccaaactgcagtctgtgtattagggatggttattgctaccgagtccaggtttccagacattttttagcagacagagctggaagagagaaaaagtacaattttgagttcaaacttatttttccaattcaattttaggaacacagactttatttaaccttttctgtattacatctctaggtcttttcatctacaccaagaatctggttctcagggacagaggggatgatagaatatctcatgtttacccatttgctttattccatattacattagtctcaaaataataaaagtgtcaacatcaataataattattgaagtatttatctttgcatatactgtcattagtctttaattttgttttatgattgtaccatatctataatatcaaaacatttagccattacaaaataaaatatctttcctttaacttagtcttagtttattaaatttttattcaccagttagctattaaatcagtatctcttctggtcatcgtatatgcctaaagctcatttactagtagttctggggatcagggaacaatattcctgagtacttgcaagtggataagtttgtaccctttatgtttaaagttaatttttgttgactataaaactttgaattacattttcttatgttgagtatctaaagttactctaatttcttctgccgtaaaatgttatataaagcctgataatctaatttttttttctaagtcatatattatttttgtctggatgcctaaaacattattttaaatcagcagattttttatttagtgattctgtttttattttcctttggattttcctcatcaaggactcctattatctgtacgttagatcttccttctctaacttcaatatttatcactttctcctgaatcctttttcagtcttcttaatttcttttgttatgtttttgcttttgacttgtattcatctagttaccgttcatgtctaaaattttttaatttacatatatctattccttgagttatgccacctcatttctgagttttctgatttatgttactttttcatatctggcattttcttaatgtagtttagttcattttgaaatcataaattgcagttttgatctatttttcttgggtgttttcttctactttttatccattttctgtacttttctataggaatgatattctcctattttattttttcttgtgctaattttgtaaagaagtttacctcaataatttttttttcttttttttgaggcagagtctcgctgtgtcgcgcaggatggagtgcaatggcgctatctcggctcactgcaagctccgcctcccaggttcacgccattctcctgcctcagcttcccgagtagctgggactcgggcacccgccacagtgcccggctaatttttttctttttttttttttttttgtatttttagtagagacggggtttcaccgtgttagccaggatgctcaatacatttttattgcttacatttatgtaatttgtttttcctgttctttcagaaattcagagagctcttctcaatacatagagctccctgtcctgttcttttcaatagacagggttcagcaaactacaggttacaagtagaatctggagcaggtcttgttcttgtatggacccctgaattataagtggttcttacatttttgaagtgttgtaaacaaataaacagagataaaaattgacagaaacaatgtgacattcaaagctaaagtatttactctccgggcctacgaaagcttgccagctctggatacagactgaaaactatggcagcttgctttctgaattttcatggttcttcttctcccctacttttaactggactttctctccccttcatcaatattgtttcaatcttggttatatcttacatcagttcacaggaggttgtccccagtttgggcccagtgctagagaggagactttgcaggtcagttttgagtgtttaaatttgttgttctggaactgatctgctgtgctttccagcattagctgatacctattttagaattatcctgtttttaggtttgatgcttccctttgatgtttcttacacagatgcagacaacaaacagatgatgaggctgtcggttgtttattcacacccacttgtatattagggttcgagggcacacatcatcacataggtttgcagcaagcagataaatgctttcggttttctacctagtagttcagtatgttttcatatggggattgaggaagatcaaaaaaccctactgctaccacccactgccactttcctttctgaatccaactcactcattcttaaacaatttaccaagtagattatatgaaatttgttttgaggaaaatgtttgccttgagtattttgatacattaaatatatcaacacgttcatattgtttctgttttttctccagagtcaagttcccattatgtaatctccctaaaagcttttaacaatgccggagaaggagttcctctttatgaaagtgccaccaccaggtctataaccggtaagtgaaattgttaatcttcctctgacaaagtatatttgatttatggtgaaaaaagaaaaactaaaataaaatacaaagaaacaaaaatgaatatatcctatcattatcctctgataatcctcagagaataattatcctctgagtctgataagtacatatgtatacttgcacacatatgcatgcatttttttatttctttggttgtcgaaattaagtaggaggaattcagtttataaatttgcacatggacttagagaatatagatctctcaatctgttccttcccaatagcatcatggttttggtgccctgataccatgcttccatctcctgagcagtttgtctcaaatcaatgccatctttgtccctgcataaaggttgccaaatgcctaaatagacacttgcttctccacacagggtctttcaaactaagatgacaaggaagagctggccttctggggtggtttgcattaggctgagtgacatatgtggtatcttcctgagctgggcctccaggtcaccccagcagtgcccagggcctcaggaccttaaagggatagctgatttaaggccttgtcacccttaggaatttttctgttagttggactgtaaaggcagtacataagagtgaaagggctcaagatactgagaaagaaatgggtaagatggtgagatccaaactatttatggaggttatttgttagcatgtgtaggcttagtccaaaatacaataagcaacacatttgtagggctattcagagtccctggaaagtcacttgactacttccccaaacccctgccacagacttatgtctgaaatctccaagtaaaacccaagttccctctctaattaatacattgaatctgccccctcacacccttcggacgtcgtttaacttgtcagatattgtccccttaacgaaaacagaggatctgagatagcaagcatcggagaacgtgagatgttactgatgtttgaaatttggatgagttggaagaaatggttataaaataaatagtggaatcccgtggcttctactcctgcccaaatttatgtgaacttagtgcagtttgtttgccaaatgtacaagcttcattcatagactatcttaagaatacagttgttctttgaattcataattgttatgtcatggcctttagaaaatactgtcactatattgattttagtagtattatttaaggcaaagttgctattgtagtctctttgaatctttgaccattgtttccaggtctacaatctgtctaaagtagaatgcaaaattttgggcagatgtcaatatgtttatttatctgtggagacagtatatatcattcattgtataatcaaaggggttcatgacttctctaaaagagtaaataattaccccagagaatatttactatcaaacgtgttatctccaaatatagaaagatgagaaaacttgaggtttgggttacaaactaagagctaacagatgggtgtctgggattttaactttattcccttgctctgctagcaacaagattctttgtgagcaaacaggccactttggctgcaccattgtgtctcataattttcctttagtgaccatctctgtcctgcctatggtaaaagatccccagtagccgctcattgccatggtgacttggcacttgtgatcaggccatgcaaaatgatactacagtcggtcttttcaagctcttattctcttaccaaagctaatggccccaaggaaggaccactgaggtggcaaataaaaatcgcttttcaatcagaaactggaaaaggtgaaagaattcaaataaactgaaagtaagttgttcagaaagaaccactggagtcattatcagcttcattcttcttagcatttgttgcattaattctagcatatgacattcccaaggtggtttcaaaaacaccagtgatccaggcaatttttattttctgatgactcagatcttaaaggaactgagaattgaaataatactaaaagttggaatttgtgtgaggaattttcttattggagaaaagccagttaaggggttcgagaagaatgcgtgattccagcccttttcaaaaaggaaagaaaacactttttctggaagtggcagaattattttattttgcttccacatgtcatggagaacaaagaacaaataaatgaaatcaaaggttaaggaaactccattaataaaagtgtcagtgccacatagacggcatcctctatctctaagcttctgcaaaggcataccatggacagtctcgaacaagggcccgtgtaaagtaactacaaaatatatcacaggcaataaaacctcaagtcagaataagcatcaggctatagagttttctgcacacatgtgctcacagatgttggtgagctctggagcctcatcccatactgggaatatcagcattagagctgctgaaagtctcacgtggccacatgcattaagagtctcatttttgctgtaaagccctttatttcttgttgtcttaaggacaagatatcttgagcctggagaaggaaagaagatgaaaagaagaagactaataaaacacgctgtttcattgatttattctcaactgctttatcaatgttaaaatgaagtacaatccacatgtaaaattgcatcattatttttaaagttcattttttttgagatagggtctcattctgttgcccaagctggagtgcagtggtgcagtcatggctcactgtagacttgacctcttaggctcaagtgatcctcccacctaagtctcctgggtagctgggactgcaggtgtgccccactatacctggtattttttgtttgtttgtttgagatggagtcttgctatgttgcccaggctggtcttgaactcttagcctcaaacaatccttctgcctcagccttccaaaatgctgggtttacaggtgtgagtcaccacacccatctaaagttcattttgaatgttagtgtaatgactcaacattcatgggcacttacaaaaacacctgttaggaattgaacggatttctttctcagcaaaagtttggaggctatattttgtcttttactaaattttttttcaattctcttgaatgtaaccactcagagtcagcgtataaatcacccagtggtaggaagagaaaagaaaaaagttctgtagcaacaaaagaatgtgttaaattcaattattcaaatattaatagtttctgacctgagagaaaaagacaattaatatatgcaatatgtattaatagctgtgcttgctgtgcacgataacgctctgctttgctggaaatgctctatatctgcatcagacactaggtttttatagcaatttaacacttgaaattgcctagtgctacacaggaagtgaattttttgttattctaatttatttaaacttaactagttcatataactagtggtcattgtactagcacagctctggaggaagtgtcaagaaggatgacaagccacacctgaaaaaatattattccataaaatgggaaagaaaaaacttggccaaggatagaaatttctggactgtgtaagtccatcaagaaataccacccaacacccttgcttgaaatttcagagaagcattctggaactgactccaagaaactcagtaagaatggtcatgaatagtatacccatttaagatcagaaatagcaggattgactatttccatttcttgaagaagaatcaccctatttcaaaacgttatgtatggcacctgtgaaaaaactatacagttaatgtatgtttaccaataaaactggattaagaaaacagtaaaataggtcaaaagaggagtttgtaaattagaaaacgtcccatatgtgtatcacgttcttcttgtaaagccagctaaaactagaaacaagtaaaacaaagtagcacctgctttaatttggcaaaaatgtcttccactgctacacaaaccgatgaatgattggaatccttgtggagactgcaacgtcttctctttccccttcatcgttttataaatctatttgagtttaaaggatcccttaataaaaagagacatcaaataaaatacagaaagcctgggctctgtcattaaattttaaacacaactctctttctctttctctctctctctccttttatttttgtttttgttttcagttttatattttgctccaaagaccacaaactagtaaactactgaataattcattggaaaacagagtgatgaataggggataggcatttgaaatgcagtggacaaagtgaagtaatcatcaaaaccagccagcagtcactccactttaaactaggctgttgaaaaaaataaaccctgtattatgctgctgtagacacccagcatattagtaggtctcatctccccaaatgttatcatatgcccagcctgagagttatattatcacatattatttttcttagaatatgcactacataatataaagattttttaagtgtaaatgtcttaagtacaaaatcaaatgctcaaagttaggctgttactgtggccacaaaatcagcttctcttattctgatatcacagcataaacatgattacaaggtgttttggagaattttgtaaaaacacacacatcattttgcagattcccattatattatggatcaaagcatgtatatacctcagtgcaaatctcataagtctgtaggtagttaatcctgtcttgccatccaataatataaaattgtaggaatgtgtaatatgggaactcctaccaagactaaaaacttagctaattactctgtgagaatgtgggtaaaatcacacttctacattttcaagggtttcagtctaagaaagcctgacaaaccaggtgctgtctgaaacttaattatcaaatatataattgatccatgggatcatgtgtacctggtcactctggttttgtgcaatcacagccacacacaggttgctgtggatgtcagggtactttgttctttattatttatttgtttcttgcccaggaaatgtgtttgcagatataagctaagcaacaatgaaaacagagaaaccctattaagttagagaaggaggagaaaataaacaaaaaattaggtattagataagcaattagctttttgtaggcagaaataaactggaacccccatttttatcttattattttaaattatatagtaataaaactgatcgatcctgtaactagatcttttaagaagcaatgtgcaacatttaaaaaatagtctttaaaatatataagcagaagtgacagtcaaattgataaaaccactctaagagaatgagtaaattatagaaaatattcaattacttttttgcaatatagcaatactgtttctaatgtgttttccgattgaattaattacatttttttctgttcttctcatgttccctttcatcattattgccatgcatttaactcattgtgatgtgttaccactgatatttattttttaacgcttttatttacgtatttatttgtttgtttcatttggtgggtttttaaacccagatcccactgacccagttgattattatcctttgcttgatgatttccccacctcggtcccagatctctccacccccatgctcccaccagtaggtgtacaggctgtggctcttacccatgatgctgtgagggtcagctgggcagacaactctgtccctaagaaccaaaagacgtctgaggtgcgactttacaccgtccggtggagaaccagcttttctgcaagtgcaaaatacaaggtgaagttctaattgatagcatgaaatttaaaatgaactgacatttgtttaacacattgttttaaacctctcctggactgtcatgagtcgttttgctgctgtgtatctatgtagaaaaacaaagcattttaataactcaatatctaagattaacatgagaataattgtattttaggaaacaattctaaggcaaggtaggaaaacatcaagtgctgtaaaacgttatttgcttttcaccagatgctgagtttgtataaatgatttgattctgtgcaagagaatgccattgtccctttaaaatagcagagatctatgttaattttctggattttggtatcttttttttttttccatttggaatctagattgatttacaaagcgaccctattaatgtcacagagactcatctttcagtgaatataactgggaatagataagttgaagatatttttttgtaacctcagcactctaagccattaacatctacttcatttagccttgaaaacacactattatggtaaagaaaactcacaatccacactcccatttagctaatatgaattcaccagctctctgttcttgtccttatcacagagttatctgacaacctctttaagagctcctcagagatacatatttgagacagtcattaccagtttcaaatctctatcaaccagcctcagggatcataacaacaagttatatactaagataattttgttacctcctaaaactgctatgatgttagtatatatagacaatatacaaatgtagacaaaaatgagaagatcaacaagtagttgtcaagaacctactatgtacctagaaatgtactacaccatagagatggtttattttgaaagaaaacatggtgtagtcattgttacttactacatataattttaggatgaattatacactcagctctatggataaacttaaaagaattcataagttatttgagagatataatgtataaaaacacatttagaacttaaaacttcacaagatactgattgggagtgaagaagtcagttttgaaaataagagcataaatgccacccaacaactaagaaatcaaatagttcaaccctggctgtcttcttcctactccttttgtgttctcttaaccgcttgattggggtagctcttgaggagattttaggtctccttatactttagccaatgttcttttcactgaactaccatcctcctgaatccagcctcaagctagtagtgattttggggggatgaaaatatttcgaggatgttttttaaccccaatcctggagctatagctaaatcccaccaccaatcctgtaagcttgcttctctctccccatagccatgctggatcttcctgtggtgtctttcaacttttaaatggcataaaattcacatttcatcataaatcagattttagttgaaaccatttaaagacagttttctttggtactgctgccctgttaggtgaggtatttggaagaactctccaggcaagtctaaatagtatcattgttataaggtatgtggtaagtaccctatccatctccttacagtagtagatttaagattcagcagaactataaataaagataacattatcagaaaagacaaccaatgaaacatatgagaccattaaagaatgtctctttttatatagattacccaattctctaagtttacttttagaaggctactttctccactttaaaaattttatgtcataattgctgtactttgtagatacattcatttcacagaatggccatggcgactttgccagaatgtgaaatgttctaaggaaaaatgattgttttcttcagaatggtttgagttccaaaatttcctgaagcaaattatttcagttgaatagttactacagcagacatggaattactgaatctcacaaagagtgcctgtgaggtgagactcagcccaaaaagattttaactgttcctcttcccttcatcctccctgacagaaggctttcaattactaatgtactattccctctctctctctccctctctccctccctccctccccctatatatccataccctgatatgaggagggttagagaaaactagaaagatataaaacaaatttaaattttacaaataatggtgatagactctttgagttttcactttgtacttttcaagccaatgtcatatctttacttcatctcacttccactacagctttaaaaggtaggcaggacatacacacaataggaaacaaacaaaatgtacatggagccacatgacctgggctcatgggttggctttgcaacctcctgtcatgaaacttaacctgctcagtctcatttttctcatctatatgatggaaatatccatacttactgtaaaaacaatgagattctttgtagttaagtaggaagacagaggtaggtgatataacttgacagaaattcctcattaaactagagcaggatctcaggtgacccaatggcatcatccagggatttccccacaagagtgtccttctagttccatttactcccaaatctataatacagatgctcatgttttgattgtctaaaaccctgtattaactttcctgatcaaatggagacattttctatatgtttttctattaaagtatttaatcatatgatgttttatatgaatttctattcaaaatatatccatcgagtgttgactagtgcttactagatataatatggatgttacagaggatatgaagttgtgcaggactcagtctcagctctcaaactgcatgcaactcaatgggaggagcatataacacatgcttaaaattacatacaacaagagacaatgcatgaaataatgtagttaagatttatttaatactttctctgggccaaacgctatgctttacttgtcttagtttgcactttaaataatgctatgaagtcagtgctatggtcgtctccattttacacacaagaaaactaaggctcaggctgggctcagtggttcacatctgtaatcccagcactctgggaggccgaggcgggtggatcgcctgaggtcaggagttcgagaccagcctggccaacatggtgaaactttgtctccactaaaaaaatacaaaaattagctgggcgtggtgggggggcggggcgcctgtaatcccagctacttgggaggctgaggcatgcgaatcacttgaacccgagaggctgaggttgcagcgagccaagatcgtgccattgcactccagcctgagtgacaagcacgaaactccatctcaaaaaaaaaaaaaaaaagtaaggctcagacaggtaccatctggttattctgtgctcacaaagataactggccatgttgctccaaagtatttctaggcttttttaagataagctgtagctttctatgaggttttagaggaaactcagtaattcatggtatttatagaatgcaaaggtgtcagtctagaacacaaagacgatcttacttgttggcctctcaaatgccagtggtgtctgtgctcagaaactgtttttattgagatatgatctttccctcttacctaaaatacttcttattgcctcatttctcccttttatttccatttctaagacttagagttgttcatgatcacgaaggaaagcaaaaatggaagtaatatatctgcatgtcagatactagctgaccactttgtgttttatttgatggaatttcatcttcctgattataccaaaaatatttacatttatttagggcatatatttttacaggtttttcttattttttatttttaagatggagtctcgctctgtggtccaggctggagtgcaatggcctgatcttggctcactgcaaccttcatctcccaggttcaagcaattctcctgtctcagcctcccaaggagcttggactacaggtgcatgctaccatgcccagttaatttttgtatttttaatagagatggggtttcaccatattggtcaggctagtcttgaactcctgacctcgagtgatccatccgcctcggcctcccaaagtgctgggattacaggcgtgagccacagcgccaacctacaattatttttaagaagacttctgataaatatttgaggtcatcactttaataggctggataggcaaatcaccgaaatgttattagtacagttacatatttatttggtggtgtaatgaaatatacaattttcataactataacctaagaaggattcgtagtagaattaaaaaaaaaaagatatcccttccttcagtagtaagggtaagatacgtatgatatgagtgggggaaaagagcttttcttaattattttagacataaatagataataaatgtaatgttttaaaataaaagtatttaacttcgaagaacgatacctcataccaagtacaaaatcatatttataagaggaatagtcccattttttttgcttatatggaaaatatactttaatggattaaaccttgcatcatgttttttctttattacccgttttggtattttgagtaagcaataaagaactataatttactttctactaaaatatctctaacttgtcatttaaaagacaaagaatgaattcagaagacttcaataataccaacaccactttaaacaccaatgtaatcctttagtatttatccaaattgctgttccttccttgatcaattgctccagttaccatcgttaaatgtttgtttaatgtgaagtctacacaaagaatgaaaaccatgtgactcagcattgcttttgtctcatgttctctataagatgtaaatggattctggaagcactaaaagtttaaaccttaaaggctttttgagatacatgatgagcagtagaactctaatcaattaacttcgttacaagtggaaaataataacaatggtctatttaaaatatacaacattaaaacttatgccaaaaaaaccacagattttgattataaatgaattaagttcaatgcagaaaatttcaaaaattgagttgacagaaggaagtggaatttgtcctgttgttctggttctgtaataaaggtaagtatttaactttgaaaaaagatatgtaaataccaagcacaaagtgatatttataagaggcatagtctcatatgcctgatcatatggaaaatatgctttaacctattagacctttcaacatatcttacctcggaaaattttctatctagtagcccctttggacaaccataatacctaattttattggttatattgtaaatgtataatcagccagcgtgaactggttaatagatgggaattcgagtcagtgctatgctctactcctctgctgtttgggagtagattacttttgtgttagcttatttaatagtctttttatatgtcttgatttaccaagttgatagagtttattttttatctctttgctatttcctacttgtatagtcagaagacacaacatctctaagttacacagcaacaggcctcaaaccaaacacaatgtatgaattctcggtcatggtaacaaaaaacagaaggtccagtacttggagcatgactgcacatgccaccacgtatgaagcaggtatgtgaggaaatgtctactttggacccttgataatggtgtttcccaggttctgtggaaattagaacatgtgttccctatggtgtctcaattataccttatcctatataaaatagttcatcctctatagttcatagcacttttatatctaagagtattctcctcacactagaaaaaacatgaatctccaatggcttaagtaatctgctttcatgattaatacacggtttcttcagggtgttaactcaggggatctgactataaatcttcttttcactacatttaagtaaagaacagaaatccatccaatgaacttggtccaaaacagttgtgtctttgaacaattgtcatggtaggtatttctcattttgaaaaaaagaaaaatagatgcaaaagaaagcattgcattacaaccgaagtctcatggatatttactgtgaataaccttggctggatatgggaaggagtttccaggtggttttgttcactcctgggaaatggggtaacataatagaagacctttatgcaattttaaatagttcaaatctagggtaatgcaattcactgtaatttttactggtcacatttactatggatcgtaaatgtagagtttataactttaacaaggatgcagtgtacttgacatttatagttcacagaaatccaacttctgaagaatccagggcttaacatgtttttttgatgggtttcataatatatcatatttgtgggtaaactgcaccaattttcaaattttaaaaaaatgctaataaagctgtttcctgggtaagttgaatttatctttccattagaatttgtcccatgggattgcagttctaatttttaactccaactattattttaactattagagttctagtgagaatatttttacatatctgtggatacttctttcaacaagaagatttctagttgacctaatttaattttaacatcctatttttctattttacctgttattatctcttcttctcagaattccaccctgaatgcacaatgttcacagcttcttagggttaataagaccagccggatgagatacatactattggatagagtaaacaagtaaacagtctactcttcctttttacttgaaaggagatgaatgtagataaatgtgaaatagtaagaaatttggccttccctgtgtgaaagagaagtagtagtattttcatcttaatacaagcaaattcattcatttttttcctctcataaacataaaatgcacaccaacatctgacttgatatatgcaccctattgatttctcatcaaccgcctagccttgtagggacaccagtggtgagacccattgctaacaaaaagatactaacttttagaaatgtggttagtagaaaaggtaataatctggacaaaggtgtaaatagcacatggataggatccctgagtgatgatgagaagtaagaagtaattcacaagtgtctgcaggtttataactgtgagaaggaaattcagtgaataaaataactctaaagtttgcttctagttctgcagtaagataaagaccatatggggctacaccattatgtgttgaaatggcttgtgataaagatacgagtgactggaaattttttgaaatcaagcatttcattctgtccagataatgaatccttcatttggttttggttaactgaagtaaaataaacgtgacaggaaggacactttaaataattaggccttggaaagagacaggcatcagccttattattcctaggctgtagaagtgaggaactgttggtttatcccttcaaggtgctaccatagtaattatttgactccaccttttttatttccttgtatgtagattcagtgtcacaaaagagagaatattattggcatcttttgagacaggtgatcacacagctaaggagaagatgggataagaccatggaattcccaactgatattgctaccaagctttcatgatatagaggagagcttgttttccaaagagaaaaaacaagtcctcctttaaaaggaagaggagaggatgggatgctggacagtgcaagtaacaaatgcccaatacaattcctatggctgaaatcttctgaaacttaaatgttaccttccattcatgtacttaataaagaaatggaagtataggaaaaaatgagagccaaagaaatcagagggggccgggcgcggtggctcacgcctgtaatcccagcactttgggaggccgaggcgggcggatcacgaggtcaggagatcgaggccatcccggctaaaacggtgaaaccccgtctctactaaaaatacaaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaaaaaagaaatcagagggcagtgcttgtctagtggaccaagatattaattaagggtttttaataatgttaatttataattgtcatgccttgagatacgaacttggtaaggagaatatagtctatgtctttgagcgaattgtggtccaataaaaaagaaaaagcatttttttaaattcctgaagtaatatcagaaatataatcataaaattgtggacaagttaaaatcagagcaaacaaagtacagattctgtctggaaaaataagaggaagtttcacaaaataaatgaggtttgagctatggcttagttgaattatcacatactaattccagggacttccaaagaatggaaaactcatgtgcaaaaatacccaagcaggtgtcagaaagatgatgtgttaaagagatacttatgattggctcaaagtgagttgagcacagtgttcatgggacaacaaggggaatgaagtacataaaataaaacagaatataaatcctagaggtcctggtgtttatttttatttatttatatttaatccaaagagaatgggtagacaatgaagaatttctagaaatcattccaggcagaactcaagaactcaggagaagagcaaggcagaggaattctgctcgacttagtagggattattgaaattgtgagggccatattatttttcaaatattaaggaacagtgtgcagttcacataataatgctagacatttaggtcattaattccaataccaaatttttattcaccaatattcacatgacttgaggaaaaataagagcttgcacagcacctgaattagattggttgttagatttttttaaattaaataactaattcttcattgtattatattgatagctaaagttgaagaatcactttatcctttttgaatgcgtaacagattcagtgaagcaatctaatcatcctcatttgactattttctaaacaaacatcaatttgaattttaacatagttaagacaaaacaggctattttcactagtaaaaaagacaaagattttaattacttccagaagtggaaaattccttattacgtttgatgtatactaatctaagttattttgtgactatatcttagcttcctattcatagccgggaaaatatcctgaatgacctctctgtgagaataatccttctttaagacagcattgtctttttagtattttgccataatgaatctgcatttcttgcaagaatgtccggatatggtttcattaagccatatatatcatattatattagactgcatatgttattttatactgtattagtatctatgcagtctttttactaagggatcaactatactccacctatgttttcttctccttcattcccccctcctcttctaattctctttctccatccatcccttcttcttttttgaaaatgtgaatatattaagtacattgtcaatgattaaaattaagtgcacgtttggttaacctggaatcccagtgactttgaagatcacggtgttggaaagaaaatagtatgatagatgggaatgattgatgtctcctctatttggctcatatttggaacactattcaggaagagatactagaaatacagtgttaataatgtccagattctgcaatatatgaccaacagaagtacgaaagagaatagggtgaagatgagttcagaattagagactgatttctaactatcttttcctacacagaatttttatgtggagaccaggaaattactccagatcccaaacacggaacccaatacgttctgaatctgcctttgttagactaagggtagcaaagttgccgtggataacagacttgtggcattgtgagctacccagaaggaaaacttgtcttccaaaacgtagaaagtgagagagcagattggaagaagcctggaagatccttggctagcttaaccagtttgctgccacctttaaatatttaaaattgttttgagtacaacatgtgggagaagtagtcttaggagcaggacttcgtgccatcttacttcatgctggattgatactaagacactcatagttattttttacgtcttctattttaatttctcatgtgtgccttcctgttggtttagaagatgcctaatatgtcacctagctaagatattttgaccccagttttatctcattttaaaaactttttggcttttaaggaagtatagacttaggtgacatttttatttataaatgcctgcagttgtaacagaattcttctgaagacatgtaatcatccagcgtggcaacatagacccatctctacaaaaatcaaaattaaaattaaaaattagagtagtggtgtgcaacagtggatccggctactcaggaggctgagatgggaggatcacttgagcccaggaggttgagtctgaagtgagctatgattgcaccactgcactccagcctaggtaacagagcaagaccctgtctcaaaaaaaaaaaaaaataaataaataaataataaactagaaaaagatatgtaatcatcaatctcactaagtatacatttcttcattcttataatgattcttttatttttagtgtgagcccacttgaaataccagttgtacttttctcctttatattcacacatactctcttctgttctctatagtcacaccttgggaatcatttgatttccataaaaattattaatttttgtatccttgtttgcttattcaaatccttgaaataaactgtaaatggcaaaatagacatgatatacttcttgatagattctgaatgtcaacatcatgatgaaatttccaacaatgtttattttctttcacatccaatgacaaggccttatctctgtctcacctcacagcccccacctctgctcccaaggacttgacagtcattactagggaagggaagcctcgtgccgtcattgtgagttggcagcctcccttggaagccaatgggaaaattactggtaagcatctccactttctctcccagcatagctctcccttgtcctataattgcttaccccctacatgagctgctcctgcctttcgtgtggcattattctgtccctacatctcagctgactccatgaccctttttgattgtttcttctttccccttttgaccatggaattcttctaatggtgcacacacacacacacacacacacacacacacacacacacacacacgtcatttgatttgcttcacgaaagatgtgtatttcaattagaatagacctttttgtttttcattctctgaagcattaagaccactttctaatggagtgccctgagtataaatgtctataaagaagctggttgtttggcaattatgaaacacaaaagatgcttaatgactgtgtttgtgtgtgtttgtgtgtatggcacatacggaggtttggggatttttagtttctcacttaggttttagcttcttacttaaatcataaagttcacaaaacacttaatattgactgacagaaattgaacataatgaatatttcacagtgacagattttattttgccaaatattgctgataacatcaatgcctaattaaagcatccattagaagcctgtaatgttaatttagtatgaaaaatataatggagttctatcagagattttgcatttaaatgatcactttaggcttttaatagatgtctccatagcatataattattatgaaaaatattgtataactcaaaatgtgaacattatagtctaattaacttgaaccattgggttaggaacatggaagagtcactccttttttccttctttttttgcatacaagagctggatagcactattataaattaacaaagtaattcagccgtcccgtgatacagagagataagcatggaaattatactttcagaaggcacacttactttatgtaatttactttctgaattttgcaaaatgaaaagataacgtgaaaattccaaataggattgaaatttaagttgaaaatttgttttctctaggaaattgctcttagcacaatagcaaacagaatttttattcgagctgacaaatatggaaaaagaagtgaggcacaaaatttccccaagatcttatatgttcacttgtcagtgtgccaggccttttaaaactgagactggctcattccaattttctttttttccccctcattgttataatctcttttcattggttctatgtcagtagttgtgtagcttttgatttgtttatattttattttgttataatcaattatttataagcttatgggaaatcaacagtaataagtctgaggagaaaaaaacagaaagctgtctaaataaaaacaggttctgatagaaaaagatgtttttggcaaaggaaaaataagtcatattctccactcatttgaattctccactcttatttaagtaaatcttatcagtcagtgtaaacaatagaataagtttttaactctggaagaaagcttaattttgcttcttcaggaaaaaaaaaaaaatagaagtctagcccatattaagaaatgcaaatttgactgggcgcggtggctcacacctgtaatcccagaactttgggaggccgaggcaggcagattacgaggtcaggagatcgagaccatcctggctaacacggtgaaaccctgtctctactaaaaatacgaaaaattagccgggcgtggtggtgggcacctgtagtcccagctactctggaggctgaggcaggagaatagcatgaacccacgaggcggagcttgcagtgagccccgttcgcgctactgcactccagcctgggcgacagagtaagactccgtctcaaaaataaaaaaataaaataaaaaattaaaaaaaaaagaaatgcaaattaatctaagcaataaaattgtatatgccaaaatcacagtgcatataaaagaaactttgtccacactctttacttagatttatacgttcaatggatcttactattaaaaatccattctctcacagtggaaaaataaaagtatgggagacaatgcttttgcctttaaaagcctggcttatttatgaaaacaaaattgtattatcaagttgagatattcctactcaatttaacagggagcaaacaataagaacccttaagagaatttctgtgtcatgtgtattttgatttatttattcaaattacttccagaaaatagaatgataaaatattcaaaatactacaccactaagcagagggcacaaatttgctattctcagcttcctgtggaagtgcaacaattaataataaaaagtaaaaaaaaaaaaaaagaaatgagctctttctcagtgcgaccaggtagatgtgtgccaaggagggatgtgctctcatgtaacctctgtattgttttgttttcctaaatctttcatgtgtatggcaggcagtagagcaggatagttaagaactcaggcttctaagggagacacatgaggaagtcatttaacatccttgagtcccactttctcggtttctcacctataaaataaagatagtaatagaaccgcactagaataattgttgtaatacagtgctgagaaaagcccctgatacccagtgggcactgacacgaatcggctattattattccagtttgaaatccattctagggtgaggctttactaatgtgctttatacagaatccagatcatcagtttttaaatataagtactcaaaaagattaaacaaaaaaggaggaaattcagataatcacagtgcctaaattctctgatcataaactggaaacttaggaatttggactgacattttcagaagaaaatgattcaaaatacattaagcatttattatatgcttggcattcttctgagatctttagtatgatataaatgattacatattcctattattccattttaaaatgaaaagcttaggcctttcctgagtaaataacttacccaaaatcaaataagcaagaagtggcagagctaggatttaaaactcaggtttatactcttaattattacactatgttttgctccaatttattagtattctactggtctaaatcagtgatttgcagctgagattttaatttaattcatatgagaagggactgagcatggtaatttttaaaagcttcccaagtgacttattgtatagccagagatatgaaacataggcctaaataaatgcagtgcccaacactatttaagatctgagactaacacaaatagaagagttaggtctttcagagattgtttccttattaatacagtctaatatgtaaggttatattctctttttctgtgtcatttgatagcctagtttaatttgtctcccttttgtaaaatcatcaaaccacttttcttcccaccaccaggatatagcttctcagtctgatttgcagaaatttcttccacttgatattgctttccagaaggcagatctttttattccctttgttactttctctggaaaagtgtctatagtagagttagggattctgaggtttaaaaaaaaaagagaaagaggccaggcgtagtagctcacgcctgtagtcccagcactttgagagaccaaggtgggaggatcacctgaggtcatgagttcaaaaccagcctggccaacaaggtgaaaccccgactctactaaaatacagaaattagccagacatgatagcagatgcctgtaatcccagctactggggaggctgaggcaggataattgcttgaacccgggaggcgggtgttgcagcgagccgagatccagctattgcattccagcccgggtgacagagcaagactctgtctcaaaaaaaaaaaaagaaagaaagaaaaaagaaaaaaagtacaggtacagaaatgtagtgagaaaccagtacatttgttcaacctgtgtggttatatagaaatttataaggtaagcttcaataatgaatttattatctctcaaatataccaaacatacacatcccaatgaagttgcttgttttctctgaggccattttttagacttttgaatgatgaggtctgtttctattctccatctcagttcttaaattttaagaaaagggtaggcttcaccacatatataaggaatttgctcagatacaatttggaattgtcagaaactgatgtctgcaccttcaactttagtttgatcccagagctgtcatttttaaatgcttaagtgaataattttacatagattaaaaacatagtgaagacaaatattttatcatcatctgataaatgaggagactcgggaatcagtgcagttgacctgggatgggggcaaaattctccaattttccagtttcatcatgcacttaaaacagcccatgaaaatttttaacgatttcattaaatatctaaatgtaaaacttatgtacttacaggctaaaggatttcattcaataagtgactttcgatacctcttatgtgaatatgattttattagatttttggggggaataaaaaagtaataagatatggctcctgaactaaagaaatgtttttatccttttgaagaggtaggacatgcacataatagaatatatacatatatatatacaaattttatatatatcttttatatttagctgcatatatatatctccagtgatttttattctggatatatatatatatatatatatatatattcactattactctctctctatatatatgttcagtaacttttacatagataaaaacatagtgaaggcaaatatttcatatatatctataacatatttatcttagatatattacatagtaatatatggatatttatagaaatgtatactcagaaatgtgtgtatgtacacacacatatatctccagtagcagggtcttctttttaatagatgtggagatgtggatcttcatggacaagattggagactgctctggttcaaagaatatgaggcaattttattgatgtttatcatgggggctgaattacaaagggatggacacacatgagacagaaaacaactcctttatcaaacgatattcataatcccttttgaattttagaactccaagtttaatatttaacagacagaaaggtcatacaactttttaaggtttgtggaattctttatgttggtaaggcttttagtttcgaagctctcaacatctcaagatattcatattttcatcattgacatcacaacaaatgccaaaaatgtacagatcccacatatccattatgtccctgaccttgttgatcacagtaatcatttggggtgtagattactgaggttacccttgacctgtagtattagaagcctattgttgtatagcaatattatcacaaatgtagcagggtaaaactgcacatatttgttatcttatggtttttgtgagtctggaatctgagcacagtttagctttggggtctcttacaaggctgcaaattcaaatgttcacctggctgaggtctcatctttggtttcacaggggaaatagttgcttttaagcttatgtaattgttgtcatggctgttggccagaaaccaccctcagttcctgccacaaagtattctccattgggcagacgtcttcatcaaaggcgaaagaagagagtcgggtatctgctagcaaggcagatgtcatgatcttatgtaacacaattgtgaaattgatattccattgcatttcctgtcttctatcggttagaaacaagacttagggcccatctacataccgacagaaaggaatacacaagggcatgatattactagaggatgaggataattggtggccatcaaagattgtttaccacatgtattaaatcaacatatcctgtcttggggtctgtattttatgatctgtacctatccttcaggtaactattatgattacgcagatttgggaaataccaaacctaggggaaaggtgaaagtcaatacaaaatagatgtaagttttcagcattgttcaaaatttaagagaaatgggcttccagatgttggagattgtaacattgcttaatcctacgtaatcagaaggacaaaatatccagtgacgcatcccccaagcccaggcataattctataaggcactatgggattaagtgatgagtgatataaaatggcacatgtgtttttactttattgaagtgtattaccatgtttatggagaggagagcttgtgattgaggaaggtttcataggccagatataccttaaagtagaccttaatggatgagtaggatttggatggagtgaagaaaggtggaatggtgtgggaataagcgggaaggaagaagaatcatggaatggagaatagtcttcctgtagcgaaggtttgtgctgagatgtacatagtgtgcatggctattttctgagtctgagaaccctctgacataacccttaaccactgcgaagacctgtgggtgaaggtccccagtccagctgggacaagagggactcaaaaggaaagaataggtaaatcaaaggaagacacttgttcttaagaaaacgacttacaaagaatgtatttgatgcataaatagaatgagggacacttatagcctatgttatatagatagcattgaagaattgtggcagaaatggagatcagcacgacatttgtttatcaatgacacctatcatgagcgcctttacggtgttatctggcaatataatataaaagttgttgattaatgtttttaaattagagctaggtcacaaattggttaagtataatgttagagtataaatatgtgacaggaatccatgaatttgttcgggtgcatattagactatcatgactgagtacacacaactagcactcaagtaacatatcccctaacacagaaaatcaataatactatataaacataggttattaatatctgagataataactagatcatgtacagttatccagcaatacttatttctttgacaagctagactggactgggagaaatagtatactggtaaagaatcccatacatagtctggtggtaaagaatattgcccagaccttttaccaatcagtttgggtcacctgcagcttcaccgtctgtgaaaggaaagcaacaccgcccctggcaacctcactaagttgttacagtgatcaaatatcatttatttatattacactttaaacatgtatagcattttataccttccaatacatttttattaagcacaagccaaaataaatattgtttattttcatcattggactacagggaaaattatacagacttgttatctctgttttacatttttcatcatgctttcatattagaacaaactaataatcaggatttataggtagcagaaagcacacatttttaaatgtggcagatatttttacttctaacagcttattctattttctgattctgtacattgcagcaattatttatctaatccttgcattatgaaaaaaagacattacttacagaactgctgtagtttacagattgtggacatataataattattgtaaattacatttgggaaacctgggtgtttggaagcagaactgcagcgtgtaggacaccaaattaagtcacatttgtctatttatgcagcttacatcttattttataccttggacaagaacatcccaattgatgactggattatggaaacaatcagtggtgataggcttactcatcaaatcatggatctcaaccttgatactatgtattactttcgaattcaagcacgaaattcaaaaggagtggggccactctctgatcctatcctcttcaggactctgaaaggtttgaataatttcctattatgcttttcttttcctgtgggattgttataaaatagctttgcactctgtgttagaaatggccctgcaccatctctattagcaacatggctgcagtggacattcaaaataaattaaaatgtagctttttatgctcaaagccgacatatcaaagaaagatctgccatcagcacatggcaaacatatttaacatgacttttttcatttacagtcctgctagaagtttattgatgtcatgtatattggttctattcaaaatataatgaaatgcttcagccattttatgtaaggggataaaaattaaaatgtattgaattatgtgaatagcatactattgccgactttaggtattttctttcaggtactattatcccttatatattaaagaaaattttgatatgacaagacagaaagttccaaaccaaaaaaaaagtctatttattgtaaagaaccaaggtagaaactataaaaaagttgcaatatgatatctagaagaaaaaatgttcatacagagaaacactaaagctgaatagtagtgattacatcaaaatattttcatgtaagtacttactattttagagcacagtattatttttctgggggacaaatggtttgaagagtcatttaacaattgaaaataatttgaaacattcaaatgattacaataatttgaatgtttaattcatttaacaattgaataatttgtaataagtttcacaactaatatttaaagttgtatatttaaggcatgatatgtgttgttctaaagaaggataacttagctcttaaatctgtgaccacatcatacctctatatctggcagaaatcttaatacatgatagtaaagtaaaaaattagaaacacacgtatgattggcttcttctgtttgacatactaaaagaagagtcttagtataactgtatagcctattcctcaaatcttctaggaaaggtaccctagtaaataagggacttttgaattctgatgagtgagctattcaaaagctgggttttggtagcagctaatctgaaaatttgccaacaacacacaagcaagcattcagccaaagcttgcatgacagttcttaatggcggagtagaagttgggaggaaagtaggatagaaatgagttcatctttgtcatctaaattttgaggacttcatgtctaaatcaggtttcactccaaatgagcaatcaaaaggcaactcgttattcattttgtggcagcatgaaatgtaactagatagtgttttgcaaatgcttcatttttatctatagatgagtgccaaattaatttcatactcataatgtttgccaactgagagatctgaggaaaggttgaagatgacttaaggcatccaaatgtgttaaacagcagagtgatgagttatcataagatttgcaggcccacattgatagccatcccaggaattgtttaatgagctcagtatttcatttggtactgtttaccctaagtgccctaaacacatctagaaaactaagaacaagttcaggaatttgttctatgacataatggttcaaagagttatttctaataccctgatttgaagtttaatattgtctaccctaaatgtcatgctcgataatagtcaattctattttaaacacatgttgtttatatgctaaaataagtttttgatcatttaaaattactcagaaatattgatattggtcacttttattaataattttgtacatgtatacatcttacaagacacctacaatggcaaatgttctaagacaaataaattactcatcataagagatttcaagctacaacataagcattttaaagatttggtgtagagccaaatctacaccaaagataaaatcatgctattgctctctgatttaagattttcacttcccaaagctgcagcagagcatactgtgctcatcagaatgtaactttgtttgcctgagacaaaggcttagatgtcccgaagctgagaaaactcccagtactcactgggtaatgggcaagtatttcatagtaatgcttgtgccaggcaggtgtccacgaacgtcattccttcatatttagcctttgcaaggatcgcagcattttattctagaggctagcatttggtctttttgatattaacaaccagtcagagaagtacaggaaactcagtcaataatcactgtttaattaaaaggacatttgtaattagaaagggattatcttactgtaaacttatgtaggtacacatatatgatgtatctaattctttctttggaatgttaattaaaagaatcttgaccttgattacttgaccacataggaacctgcacatacccacctttccactaatcctccccagggtcccactgggatacatacacactgtcaaactattggaagacttatgtctatctctgccctatcctgtgggtttttcctgctgataaagcatgcttccccatgctggcctatcgggtaatagagaggaaggatgctcccaatggagtagaccacagaggattctggtggagggagggagtcacttcctacacacaaaagagtggtattcagagtgaaagcccaatagagtacagtaaattctctgggcatccttagtcatcattctgaaatgtgcctctcccctatccaagaatatagcactgaaagctttggaccagtatagaaaaaagttctagtcgtcaaattcttttatgacaaaaatacatgatttttcttgacaaatgatagaaacatatgatagaaaaaaatcaaggcacaaatgtaagccatttttgtctctaataaaaggtagttatgagaatccatatggtccctgttggaaaatactcttcagtagataacattttgagacattcaaaatttctcaagttctattcagtgcagctttgctagtagaaaaataaattcaaaagataaaaatgagaatgggtttgtctatcattacatgtggttatttatcccttgctaaaaatatcttagactgcagacaatgcatgtatatgattaaagataaagggcagacaaagaatggagataagggtggtagtctcgtcttttttgacataattctaaagaattctcacctaaatatgagatgctgatgaggatagtttcttaaatgtgtcccagtctggctgccaaacctacatacttcctggattgggtgggcacttatgaccttgacatatcttgtcaaggatcaggtcattcttgctggggacctgtagcacttccaacaacatactgtcctttctcaacagctgtgttaggatctcagttcaaaatcgtattcctgtccataagctacatataatgcaactgcctgtcaaaagcatctttatcaatactataataaaacactataataaaatgtatttgagaagccattaattttcaatgggaaacagaagagaaactctagataaaattaaactgtggtgattaaattaaatggctggtaaacctttaaaaatgtttgttaaatcttgacaaggtacaagatttcataaaacttatttaaagctttcagagagcaccaaattctaaccactagcccatcagagagtgtcaagataaataaattctgcagctctactatgcagcatagttcctataaataatataactgtattatgtacttaaaatttagtaaggtggtagatcatatactgtgtttttaccacaataaataataataataataaaatgggtgggaggaaactttgggagtttggggcaagtctgtggctttgaaggtggtgatggtttcataagtatatccttactctcaaattcattgaattgcatacattaaatatgggcagctttttacttttcaattatatctcaataactttttaaaataacgcttatagaattgtaaaattataaacattggccgggcgtggtggctcacacctgtaatcccagcactttaggaggccgaggcgggtggatcacgaggtcaggagatcgagaccatcctgactaacatggtgaaaccacatctctactaaaaatacaaaaaattagccaggcgtggtggcacatgcctgtagtcccagctacttgagaggctgaggcaggagaattgcttgaacccaggaggcagaggttgcagtgagctgagattgcaccactgcactccagcctgggtgacagagcaataataaaaatcctggtatatgtagtgtttcccaaagagtaattcacaattcaaaatctactacttatcaagatatcttttcatagaatatgtgtatatgttatgtttaaatgaaagaaattgtaattgatttctgatttagaaatcactcttaggatgtaatagacataaaccctgttcatctgaaaggggctttcgttaacagaatcaatatctacgtatttcagttctaaacattcttattaggcaatgatttgtgctgctttatttagaaaaagaaggaccaccacctgtagggcgtttaaggtatttttcaaatgatgattgatttgctataatagcgccacatctgatgagagactgtattatcagttgctgcctattatattttctctatgtgaattttactgagacatatacaggaagcaatcggcaagtgttgtatcctacctatcaagtttgaatggaatcaagtgagttaaatacgcccaaaagactcaaagctcaaagacggtcaagtctaggtaaaaataattctactagtaattgagggagggaagcttatgaagatctgccttggtcaaaatgccatgtaattttcagaaatgtgataatactagagatttacctcttatttagtttcatctggttagcagaaaaaaaaagtcatctttaaaacaaaatttagcaatttaatttttatatttttaaatttaaatttcaaaaagtcatttttgagactattacttgtaagtcctctgaagttgtcaacaacaactcaggagctatcttcacaagggctaaagtttatcaagatatttagattatattgtaccatatttatggttgccaattattttacccagtctatgtgagaattggtgaagttgtttaaaaaatagtcacatacaagaaaatagcttcctgaattttcttaaatatatatatgggtgataattacttggtaattgcatgcagtttttttttactgttaattctagttttaattaaatttatataattgttctcagtttatgtttagagggatatgaaaagtaagataattttaggatgaatttgtacagcaaaaacattattttcaattttttttctctgaatacttatttaatagaaataaacatgtaagtttgggtccttatcaattttatttcaagagggcactagctttgaaataaaaacttactaaaaagaactgttggtttgatatgtcagctttcttgctaggaactgtcaaagtctaataatgttatttctttttcccccgcagtggaacaccctgacaaaatggctaatgaccaaggtatggtggctcaatctgtcattttgtgttccttgaatcaatcctgtctgttagacatgtcagtcattactttatattcctcttttcacctggaccatacacctgatgaagcagacactggcgtgacgattaatcttgttaatgaagttctgcttggctgaggctgcggctctgataaggaagatgtaaattttcttgagaggaaattgttttgtctccattctgaaggaccaattaaaatgtcaagcttctttgtatgaaataaatttttagtctctgtctgcacttctgaataattcacattaagtataattaagctcagcataattttcaagctgctcttgcaccctttcctgagctatggattaaagttctgtagctctacagagaaaacccgtaaattatgtgtgattttcctctgcaatgagcttcttttaatatataaaatcaaagttgggtcaccttttttagggcattatcattgttcattttgaagccagaaagctcttattcagtgaatcagatgctcatttgactcacagcacagtattttctcccttttccttatttatttactaaaagctgatttgtatagagaaacaggtaaagttttacacaaaggcaaaatggagataaataagagttatccatcaacttataagtggatatgaacttactattaccgtgatttgtagactgattgataaattaggattccgttatctttacacaaaggacaattagtagaaagctgagggagacaatgaatagtttatgagttttatttttttgaggatgttactttctttccagaagagttaggaaaaactataaactggttgtagtcagtgctgtcagtatttgtagattgagagtctgcagttcatatagtttgtttccttcctgctttggacacctactgtgggcagtgcttacttgcaaacgtgtctcataaggcaccatgtcgtgagattaggggaatgctttctttcaacaggaatactttttaacttttgacaaatactaagcctctggatgctggctctccctgacagcagaatgcttcctgcatgagtagcattttcttcagtggtcctgtgtttacattcttctctggcgatgtatactatgcagctgcttaacagaacatggctaggggtttacgtggaataattgaaatgggactgtgcacagcaatggctactcagggttaaggttttcattaatctagctgctcctacttgcttccactgaaaatgttttcatacaattaatatctactaaatgagatttgtaaaaaatattaatgatgagtaattatcacttggcatgtatttacataggtaacttaaatattagtcttggtcaaatccaaatctggaatagttaatagcaccagctttattattgcagttataaaacaattgaaacaacctctcataaccttctttacttaaataaatttgaagcttccgtagacagataactcctaagttttgaaattatattttaaaataatagagaaaaagattaaaataactgaactagttgaaatgtcattattagtcacttagttgacaacaaacatgtccaggcttctcaataaatggctttccacttctctctgggtactattatattgttttttcttttgttaattgcttttagttttttaaggtaactgttttgcataatattattttaaaccaccacacatatattctgtaaattgattattttatgaaaggcaaatgagtaaattatttcccagtccctatgatcacacatcctccatggattttactttgagtctcacatctacaataaatcaggctagttctcaggaacaaaaggaccccctcaagaattactgccagtggctgagtccattaatatatttagtcagttgttctttttcttcatctaatattactcagaaggattctgtcacatatgtaacttggagccatattcagtcatggttggcatgtagttagttgatcaagttgataggttctaaattttacatcaaactcaattcacttataaaattgagagggactgatgacatataatttagtggttataaataatatcttcaaattcttacaaagaaagcatataaaatttgctgcaccctcaaagcacgttttataaacaaaatcagtcttctgagttgatgaccacatgcatgagaaataacccagattaaagatccctctaagattgatgaaaataataggaagaggctgatcttaatactcccattcccagaacacagcaaattagttgaatatgttttaccattcccactgttagacctatttgcccccttctcatggagaaatgatcccactattacatttatgacaggagctgagtttctgctgagagaaaattccctcagagaaaaaaatgtggcatctggggtcagaattaaccttgcaaagatgaatcctaaataaagaagcaagaggttgaatttgacttatatgagagaaagtgagaccagttttgattgtcctaaaaaaagtatctgttcagattcttgtcacaattattattattttagggattgaagatctgccatgaagaacataaatgtgaaaacaatagtcatttgaaatggttttgatttggagaaaatattttcttctgagcaatggtatagtagttgtttgacaatgataggcaattaacatagaacccctgatttctttatgtaattgtaaattgatgaaatatagcatttttaaaactttctaatcttgaccacctctataattctccttttttgcatcaccctatctcttgctccatatcctaattatttctgtagattcttccaggcacaggtggcaaataagttgggaagtaaaagaaattttagagataaaccagagtttcgttttttgtagggttgggtaaggaaattgcacaggctctatgaagcgggtgcagaggttagatagaaaatctatgctttaaaaattatttttaatttttgtgtctacatagtaggtgtatatatttgtagggtacatgagatgctttgatacaagcatacagtgtgaaataagcacatcatggagaatggggtatccatcccttgaagcatttatctgttgacttacaaacaattccattacactgttcatttaaaaatgtacaattatattattgactatagttaccctgttgtgctatcaaatagtaggtcttactcattatttctaactatatttttatacccattaatcatcttcacctcccctctccccagccccccactaccattcccagcctctggtcaccatccttctattctctacatcgatgaattcaataattgttttgatttttgttttgacttttgattttttccctttttttctatattctgattaaaactccttcaatttgtctgtgctgttgtgggcctatgtaatggtaaaatgaaccgctatgcagctcttgccagcagtcactgttttaaaagctttacaggagtgactcacttaattctcgtaacaatactgtgagaaaggtattgtctccattttagcaaggaagaaagtgaagctcagagagatgttatttgtctattgaaacacagctagtaagtagaaaggccataaatccaaccccagaaaccacattccaaaagccttttttttttaattattctatttttatttattttttttaattttttgacacagaatctcactctattacccaggctggagtgcaatggcacaatcttggctcactgcaacctctgcctcccaggttcaagcgattctcctgcctcagcctcctgagtaactgggattacaagtgcgtgccaccacacctggctaatttttttgtctttttagtagagacaggatttcaccatgttggccaggatggtctcaatcctcctgaccttgtgatccgcctgtcttggcctcttaaagtgctgggattccaggagtaagccaccatgccccacccaaaagccctgattttaaccatcaactgcatgacaacagatatgttacatgtatatagccacacattcacattcgacgtatagctataaagttgctttaactgaagttttgtttgctgttatttgtcctatatagatcttccttttcacatctctgaatattctaaagaacaagggaaataactctcaatctgaggtcatcttgttagtggggtggcaacagcgctgattacatgatcctgacacttctttatttcaggaaacagggatggtgataattcactgtctaagccagcttgggttgtcaatacaaaacgctatatactgggtgggttaaacaacagaaagttatattctcagagctctggaagctggaagtcccagatcaaggttcagtgtggtcagtttctggtgagggtcctcttcctggcttgcaggtggccttctcgctgtgtcttcccgtggtggagagtgacctctctggtgtctcctcttcagaggacactaatcctattggattggggccctaccctatgatttcatttaaccttatgatttaattacttccataaaggccctatattcaaatataatcatattgggggttagagattcaatatacacatttttggggaagcaattcagtccatagcatccacatttaaaaagaaagctgttatttcactccttcactaattttttcccagtttttcagaagcagaaggtaaacattttacccaggatcacagaattagctgttggcagagttagaactcaaaacttttctttctggttcctagagtgtgcagtctttctactgtaaatggttactatatttaaacatttgatttccattcttctaaaatcagctccaacattttagtgtctcacagaagcattttagaaaatccctttgttttgagtttgcaatggaggttagctgtaactctgaaacatgactgcttcttaaaagtgattattagatcaaacttttaaggtatttttgtttgcatcgttatgtcccatttaatgtccaaatattgttctccactttgagatgtctttgtatgaaaatcgatattcttagcatgagcagaaatgtttactctttcatgtgtgtttctacgtctgctcattgtaacaataggtgctatggcgatgatacagtaccttaaagtgggcaggattctcatgaagtgattttcaccattgctgagatgaattacaaagaaaatgctcactttgagcactctcaagtgtatttaattctccatgacctggaaaaggggtgatctgaaacactagacctagagaagaggcctacgtacatagggcagtttacagatccagataaagacagcctgctgtaaactgcccgcccaacaaggaggaagaattactctcctgtgaattgtggtaatggctgataatggtctagcttttcatttggaagtcactcagtgtgtgctataggagcactggaatggaattagatactttcagttctagcacagtcctgccactgggacctcttgtgtaatgttgggcaggtgacttaacatctctcaacatcctcacctgtaaaatgataagttcagactaaattatcttttggtttctttcaagatttaagattctgaagttttaaggttggtattagaataaaaactcaggcataacatctttgcatagtgaagcatctcacatttatggcttttccactatgtgtcaattactcttctatgcattgtgcacatgcaatcctatttgattcttatagcacccttacagatgtagaaaaagagacagagaggttaaaacttgcccaaacactcacagtatgtaagtggtgtgaaagttgattatacaaaatggagtcactcatgtcatacccaactaaaatggagtcaggaggttataaggaaaagcactcagatcacatacatttattccaggaactgtcttgtgagactaaacccaaaacttcaaggacctggtcatgattctaagattccacatcttacttaacacctgctgacactcagcagctcctggaagacactaccagcaccaattaacttactttcaaaacaacttgcataaccttcctctattccacaataaaactccgcctttccctttattctctagactcacctggggctaccttggtttgggtgtcctgaattgcaattcatattctcaaataccttcttcgctcagagattcacctctatgtatctttattttaggttgacagtgattaggcccagatacatacccaggctacctaactggagaatctctgctcttgacgttgtgtaatttctggaaatgcagactcatgatctgtcatcaagaaagttatacctaaatggcatcaccataagttcacctagtttaaaggactttgtctttccttaatagggtattcaggcaaagtacttaacactgcacctgccattttacacctcagcagttttaatctcatgaataaacagaatgttaattgtttcaaatttcagggaaatagggtttttgaggcagtctagtcaagcttggaatttagttaatgtaatccagactttgcagggtttggattacagcagccagactgccgtttgaaaaatggaaacctttagtgccttctgatgggagctgtttaattgaaaattaaaacctcttcttaccctattattgtgcatagtttcaacacagtttattattcggctgcttgctacacccacttgaaaaagctattctcacctgggtttttcacaggttcaattctgtaaattaggactgtggtgaaacagtagtagcagaaaatgaataatgtgcttttaatggagtgttaaggtgcttatcatgttcccagcaagcagtcaagtagctgcctatgtcaacttctcagcagttttcatgttttaataggtaactctgaaggaacaaaaacgtactcagtactcataggaattgatgtgattcatgggataattttaaccttctcacacctgtaaggtagacatttttgtttatacacttcaaataaaattccataaacaggttcttcttgtaagagccactgtattttggatgccatttccttgtacagatattggccaagtacacggtcttcctagctttattttctgcccacttcaatcagccctagattctgccgcttcaattttctttccaaaacagatgggtcactgttgctttggggatgagtcagttctttgacatcaagaaccttggctatctgactgtaacgtctctttcctggtgtcatggccaatagatccctccacatatgccacaatcacaaatcaccctggaaaaagtgcatttttcacaactacatgctgtaatgtgtaccattttctcagccttagctgtgctttctctctttctcaactaagcaaagtcttctttgagactcccttctcaattttacttttttcaagaatcctttcttacctttcttgtcttttattcacctgtattttcataacacccatcctatttttattgtgttttccatttcttcttatactttgctatttatattcttagcttcttgaccagattttaaattcccaagaacagagaactggctagattcttcacattgtcatccctacctccctaatttagaatttatcctattttagttgtctgataagtgtttgtttaatagaatcataacacaaatgtttggggaagcagctacagagtaatctggaaagataagttttaccattgaatgaaaagtgtagattggacagctcaaagtaatagtgcacatggctgtgtatattggagatttactgatcttgggggagacgagaagttatgcatatatttccaacaggaaaaagtatattcaataatcacctactaaaataaatgctaaatagaaaaacaagttctctgtaattcagctgatggtagttacatttgtagatggctacgacctcctgcactcattttgtgacctccagtcttgctgtccttccttgttagcagaaaatttatagatttgaatttcaccagctgcttggaattctgagtacagaaaggagaaaatcaaaactaatggaagctgataagtttgttaaaattgtggctatgaagtatgaaaagaactagactcacttttgataacttgtggattactatgtatccagtactgtgctggcactagaaacattagaaggaaatggtcctggcaaagcattagaaggaagtatggttccgtgggtccattttcaagaagcttgcaatatagttaggaggaggatattaacacttccagtccagtatgaaaaatacaaaatgccaaatcagatggtactgtctacatgtgtatgttacgggatttcagataaatcattgtgggctggattagaaaagacttcttaaaacctaagactgggctttaaatatatgagtagaactagactcaatgcaaactattaccgggggaagagtagctgatcccttatgtagagaaattctaggatggaaaagttaggaagccaagatgctgggaaaatagtgaggactacaggatgggctccaggaacatttaggatataatttgctcaggcacaaacatatctcatgcctacctttgcagagtagtaccttatggcagagacctatgttggtgaagaggcttttgctatttctctctgctctaatgtagtagttctggggctttcctacttttcaacatatcagctagctattgtctacactggccagtgaaggcctgcctgctcccttgtatcccgagccctggaaacccatccactcttggttgctgatattgatcatttcctgcttggaggggtgtgactgtgggatagggagagaaaaggatgatgggatgggagtaggaatggggcctcagtagcagtcatcttcaaagaattttcttggccttttttttttctttttaaccacttctgttgtaccttttctgaagtggcaacttcactttttccagtactctgcatggttacaaggaaactatttttcattctctgccacagccttgttttgttctgcatgttcaattgagaatagagccaccatctcaagtcatacatacctaaactctcactcttacaccccaagaccaactctttgaagtgctctaatttctgtccacaattttccccgtttctcctctcttttttttttttttttttttgagacagagtctcactctctcacccgggctggagtgcagtggcatgatcttggctcactgcaatctctgcctcctgggttcaagcgattctcctgccccagcctcccgagtagatgggattacagtcccctgccccactatgcccggctaaatcttgtatttttagtagcggtggggtttcaccatgttggccaggttggtctcgaactcctgacctcaggtgacctgcccgcctcggcctcccaaagtgctgggattacaggaatgagccactgctcctggccccctattccttcttttagttatttattcacctataatgctaaaatcatcatcatcagagtcatacagtatcagccacttcaaatgaaaccctgtgtttattcatctttctgagctatagttttctcagctataaaatggggttagtaatgtctgcctcagagatgcataattaatattgccatatttattggaacagtttattctgatccatttagttccacagtcatccagaataatctttctaaaatatatgtgtaattagtcagagttttgcttaaaatatcttcagtggatccctatcctctataaaataaattctagaccattttgcagagcatttagggagttttattattgtacctctgccttttttttctaagctcatccacctcacggttctctacctaataaatcaagacagatctttatctgtccagctcctttggttccctaatttttgccttttcagtttttgtccactctcccttgtgagacatcaagaatgtgggaatgagaagtactagaattcacaggagtaaccaatgtgtttcttaaaatatatatgtatgtgtctgtgtatttatatatttatatataaatacatatatatttatatattacatatttataatatatatttataatatatattatatatttataaattttatgatatatatttataatatattttatgatatatatttatactatgttatatatcatatatatttatgatatatatttttatgatatatatttatatatttatattatttatatatttatgtaatatatatttattatatatatttttatatatgtatattttcccccactggttggcctggcaaagtatactgcttttactttggtgcttgcaaaaagaattctcacctcacatgccacctcctctgagaaaccttttgctaggcataagtagataatcatcctgtttttccactgggtcacgtgtttgtttgttttcttttttttgaatttttggaaattaccatatggttgtaagtattcacttaacattttccgtctcactgacttacaaacttctgcaatagtcattttatattcctaatgcttagcactgtgaatctacttaatgcatttgttgagtggatggatgaagcacggatggagacataaatgatgaaatactgtgctccaacagtgtcgttatctacacagactagcagggcaccagcagggtgctcatgttctagtgttttcagactgcagctgcaacttccagatctatagtcacttggaggagagaactctctcatcctcttctgcctcttcttcccgggatgcttggcaaatttgctcaggcacaaacatatctcacacctgcctttaggataagcttgtgaaccacgcagatgggggaggcttttatggatcattccgtggcctttgagaacagatgctcttttataagccaaaaaagattgtctcattctttatgttgtagcctggcaaatgaactagctcttggaaatatctagtcatccaaggcagtgcccatatttggaggaacagaatgctttttagattttaataaagactaagctgcatataaaagtggtttcttagacccctaggatgactgttacttcagatatactagaggcaagtgtgcataaaaggagattccaatgacaggaaggacttcagagaccaccatctaccaccatactactgatattatgaagccatctttatgttttattctattaagaattcaattgttattcagttgtttcattcctaacttgcatgaataataattataataactaataaacatattgggctttagctgtgtggaaggttgtgacaagggtgatcaggagcagctgacaagttatcagcagccgggcaagggagatagtcaagtgtagttattgtcacataggttagaacttatcatcttttctcacctgaaatctttaagaaggaggttaactactttcctgttaacaaaagatcttgatctgtccagctcctttggttccctaatatttgccttttcagtttttgtccactctcccttatgagacatcaagaatgtaagaatgagaaatagtagaattcagaggagtaaccaatgtgcttctaaaaacagaaatatatataatatattaatatatgatatataatatatatatttctttttatatataatatataaatatatacatatataatataataaattatatataatatataataatataatatataatataatataatatattataatatataatataataatataatatataatataatataatatattataataatatataatataatactataataatatagaatatatcatataataatatattataataatgtgtcatatatcatataatatattataataatatataatatataatataatataataatatataatatataatataatataataatatataatatataatataataatatataatatgtaatatataatatagaatatataatattatatataagtatatataattataattatatatataattaattatatatttaataatatattatatagaatataataaattatatagaatataataatatatagaatataatatataatataatataatatattgtatataatataatatatgttgtatataatataatattataatatattgtatataatataatataatatattacatatataatataatatattacatatataatatattatattattttatatatattatataatatataatatatattttttatatatttatattgtatattttatatattttatatatttatgtattttatatatatataaatatatttatatatatatttatatatataaaatatatatttttatatataattcatatatatttttatatataatgtatattttatataatatatatttttatatataatgtatattttatataatatatatttttatatataatgtatattttatatattatatatatttatatatattatattatatactatatattttatatataataaattatatattatatattttatatataataaattatatattatatattttatatataataaattatatattatatattttatatataataaattatatattatatattttatatataataaattatatattatatattttatatataataaattatatattatatattttatatataataaattatatataacatattatattttatatataacatatatatattttatatattttttatataatatatattttatatattttttatataatatatattttatatataatatattatatattttatatataatatatattttatataatatatattttatatataatatatatattttatatatatataaatatatatatatcggttggtctggcgaagtatactgcttttacttgttggcctggcaaagtgtactgcctttactttggtgcttgcaaaaaataatgcagtatttgtaaacgtttttcctactttagaagatggtctctgcaagagaccacatgcatgcctcagacagtcaagacccattatcaggctaagatgtaaaccaagagcagaaattaggataagaaattaatttgtttaaatttgtctaggatacccacagtttctattttgtatcctggtattttttttgtaataactgtatgctcactcaatttcattttattcgtgtgtgaaattattatcttagttttgaatttgatttctaaggatttttaaaaaatgaatttacttctcaggaagagtctaacctgttcatattttatggcctaaatacagaaattggaattgcaaaaatactactacttatgattaagagaaatatgggtaatggcatatttggttttcttgcactttggctcagagtagtttaccaaatgcattcctatcctgcagattattgcccttagactttccacaggtggaaaataaaaccaaaggttttgaagaagggaaagcagcaagaatttgtagagcaccagggctcaatattggacaggcatagcagtaacaatgtattttctttcaatcagtgaactttctttcatgttgttttgaaaacaatgtgttgaaccttaggaaaaggttaagagagctcattagttcttttctattaaaatatttgaaatatcctacgtgttggttatgattttgctttctggtttttgatgcccgatgcctttgtttaaaatcagcattgttatcaactgcctggtaaaccgatcttttagaaacacatttcagcctctgacaaatcacctactttaaatacggtctgtgtgtcagatggacagtaaaattatattcaggtaatattaatggatattctttatctgctggtatacaagacagaaaatcaatgcaatttctatcatcattagaattattttcagagaacaaattttaagatcaagaagatatctcagtgctcagcacccttggaaagatatacattgaacatttgttagatggccagtctgtccatttgatttagattatggacaatacgtttttctctagggattgattgtatgaacgtcgtcctggatgaccctctcttatgcccattcagggaagatggattaaacaaacgattagaactaccacatccacttttctccatgtcttctgcagattaattttccattctctcttctctgaacttataaacaatcacacagaaaaactagactctaggactgaaatcccaattgaattaatctttgttcagtgctgaaaattttttatcgtggaaaagattctcaatctgcccatgtgtgctgcaaataaggatttaatataaacattaatgttatttcattttatacgtacaccacaataaaaacatgcaaataattcaggtgacatgtaaggataataacataaataataaattgcataatagtaataacttaagatttgtacttattattaaaacattacaaagcatcctagctagcattagttactcataggacattgagaacacatttttgcacatcacttcagttagcacaaaggaatataacaatgaacagacttcctaaaggaagtcatattacttctgccaattttttcttcaattcagagaacaggtagcagggagatcaagaagacttttgtccaaggaagcatatggtatgtgccaaaaagggataaaaagaagattccttatgaggcccatcttttaaataaaatgtgtaaggcaaccccttaaacgactttatgacattttaaaaattcaaagaaaggagaggtatatgaaatttctgattaggacctgcctaagcattacctaaataaaatatatttaaatatataaaagctattttgaataactcaaaacagctacaaactccctctgttttaactcagccaatgcccatttaatatttatttaatttttgtttctgaagctaccatttcctggttccaaaatctaaggtaaaagtagaaaatcatttgcttttattatcaaaactttggcagaagctttttttttttttatgaaattagctgcataaaattccaaagttgttaagtgaaaatcaattaattactctttaatatctcattcctccccatcctcaatttgtgttattgagaaaatatgggtacatagtaatccaatacagaattcttctttatatcctgtagaattatattcatatagtacactttgttttttgttgttgttgttgttgttgttgtttttttactgagccagagtcttgctttatcgcctaggctggagtgcagtgtcgcagtctcggctcactgcaacctctacctcctgggttcaagcaattttgcctccacctccagagtagctgggactacaggcatgcgccaccgtgctctgctaattttcgtatttttagtagagacgaggttttgccatgttgcccaggctgtcttgatctcttgacctcaagtgatccaccctcctcggcctcccaaagttctgggattacaggcatgagctaccgcacctggccttcatatagtacatttgatcactattcatataaaattgtattattcatataaaaaggaaaaaataaactactgatttctaaaatgctttaagccatgttgaactttatttgagggaagaaaactgaaatttattacgtgatttcccccaaatttatatttgaatttccataaatccatttaattatttagaattttaatttgtaaaagtgttaaaaatttagtatgatatgcaaaaaagtaattcaagattttaaaataaatataactatgaaacatataaagttatgtgactgaaaataaaacatttttatttgcatgcagttcttttaataatacttttgataagaatactttaataataattaaaaagcatttttaattaaacctagtagtaagtttatagtaataaatgaattaagttattcttaaatctttaatgtcagaaaatattaagaaccatctgcagttggttaatattaaccataaataggcctgcataggatctgattacaatgaaccaactctccctgtcatggcaggatccatgtctaatatatctttttatactactccttccctgaggatctaggactatgcgttgcatgtagtaagcatttaataaatgtttgaaagaattattaccagttttatgcttcattaataaaatgacctctgggatagggaagtattttatatctttgcattagctgactttcactccagctgttttctaaattctgattactcctctctttctcgaaatcagtgcttatgaaattaaccaaggtaactaaacacatccaatatttgttctacagcaacaagctcttaaaaatgctgtgatatgccaagaagtaacacccataaacccatatcctttcctttttagcctttattgtctcttcatttgacaactttgtgatgctctccttaaagcaatgggagaatcttttatcattattattattattattattatgtattggccacataaagggagacttcctgaaatttaaaagacatatttcagagaatggaaacttaacatcactcaaaattaaaattaaaattaaaatctgatgcctctgtctttagatcaagagatcttaggctcatcaacatcccagaaatgggttttgtggttttttggctgaagtggtgcaagaaatgtgaatcactataaatctaaacttgctcgttggtgacatcaactttttaaaaagtgctttctgttggacttgttgagaattacatgatttccttttgtgatattaatctaattataagggacaaaaagttaacccacatcaatatactagattctgtgagtagaatgtccaagctttaagctactccttgttatttagaaacatttctagagttcctttatctcacccagcgctttgacctatacggcatctgatttcttctacctattgaaattcacgatgtaatcaatagcctcactaaatctaaggggtgctgtacccatagagctatatgtgtatgtaatatatgaatatgcttattggcttctttttgcatcctgccacaaattacagggagagttggaaacttcattaaaaagacatttgccaggctgctggaggaaaaggaaaatcctccataggctacctagctaatttccagccgatacaggattattcccaacaggaaacatgtattgctttactggcctaagtgatgatgttagcatctcttttggctgactgctttgcaatctagctgctttcagttgctagaaaagtcatcttaatatttatgtagagcttccacctcacatcagccaacgttgatctcacgatgtctcgtgggcaaagcttatccgctgctcattgaaaccccaaatgcatcacagttatataaacaaggtatttgtaaaagggttagacttgtccacatttttgtcagcccactaaaattttcacaatttcagctcattttgattgttcctctcaccaccaccttccccctgtacacacacataggagcctgcatcctatctcctacttccttacatactcacagtcattgtcccagcagatattaaacatgccgttttatgctgaagatataatataaggtgactgaattaatttatcttattgcttgctagaaatttgacatcctaacttcagctgtgacttgatatcaaaagaattttttaaattgtgaatatagagtcagttaacaggattctaagttgtttcttgaaagctgttttgcaaataaaatgataaaatcttgggaaagctttagtaagggtagtgtttgtcatgcaaaataaagtcacaaaaccaggacttgaaagttatagagatgaagaaaactgaaatctctaaatgtgagaaaacaacctatgttactgtatctgagtgtcctggttggctttctctatgtcatccactgattggaactgctttcagaaataactgttttaagcaaataaaatagaaaattacctatactctggtctttgtttgcatacagattcacctctcaaatgttttacataagtagtctacctagatattctagaactcaaaatctaatcaaatgatttcagttctatgaatgcaccagtagagaaaaagattatctgtggtgaaacaccattaattaaattttggatgatagtataattatttctggtgaattcctggcttatttctcttaaatacggctttcacatctgttacacacctaatggaaggcagaatttccaataatgctatactgaaggagctttcttccctttatggtgtatttgtaggaaatattcagaccatatggtttgtgacataacctccactcttacttccaatgtggaatttcatttccaggtactgtatttgacacctaacaaagagaatacccaaagcccagttataagatgaaatgtgctggccccttgtaggataacaataattttccataaagtcttgtcagttgggtgacagtatctgcaggacctaggagccaggacctgagttatttctgttctaaaaggttcaggagaatagcatttagaccggcactgctgctgcacctttaataaaagactttaataagaatattgggagaaataaaaagaatggaggatggcatatcagtgaaacactgaatttagtttaagagagtttacttttgcgacttgtttttctcacacatggaaaataacattttcttataggtgtaagggtatgagagttgtcaggctttcttgggggtgatcaaagtaatctgttctgttattgtgtgtgttaaaatatttattctttttgtcttcattttgtttcatttgtactgacattgtgacatgctctcccaatgaacaggtcgtcatggagatggaggttattggccagttgatactaatttgattgatagaagcaccctaaatggtaagtatataaattaggtaatattgaattagttatattaattaaatggttaattcaagagtgtctggggcaaattttctatcaactacaagtgccaggaaccttggatttagtgtcttagtgggataatagaaacatgaagttattaaaaaacaaaaacaaaaacaaaaaaaacaaaaaacttctagcacattctgccaggagatgatgccaataagagttgacaggtatgtaaaaaaggagtcagttagagaagcccagcatggagcactttgtaaatgacacaaagctgttaaataccaagatttttaaatgttacaatacatttaagatgtttgcaggaatctaattttatttgagagaggtgatatctaaggttggttaaattgaaacccacccagtttcatatattaaagttacttggatttttgcctgcagggtacatttaattcttcaaaatcctctaccatcttagggctaaattttctttgtgttgtctacattagacatttatttctgctcatcctagtggagcatgcccaaatatctgctggctttaaggatgaccagatggaggtactatctagagctacatagaaggacaaggttggtgtgggggctgcattccaggatcttatccttagttttgctgaaacaaactttaaaaggatggactaatactggccaaattttcaggggactaatgtatgtatgaggccatgttataagtttctttttcattattgctgttgtttggtttgacttactaaaaagaccttcagatattcaaaatgtgaagatgaacacttgtatacccatcagcaaggttaagatatgaaatatacagcatggaattgaaatatcttgtatgtctgtgttttctcacatgcttcttaacactgttcctcactctgatataagtgctctaatttgatgtttactacgtatgtatacgtatccctaaacattatattgttttacagttttacaaatttatagaaatgatattgtatcctgctacaacttgctttcttttttaacgtagttttgaagatgtatccatgtgtttacaaatagctctcactcatttatcttggctgctgtacagtattctattttatgaaacaacaaaattaaccatttttgcaggttttcttaagaaacttgattactgaactgataaatttccatttgtttgatctccttttaaaaaatccagaaaggaagtcaaaattccaatctaaaaatagtttgctgcatgtgaaatagaatagtggtgtaaattaagtgattatttcttatcataggctgtgataatctaatgcagcaattttcccaagaggatatatatatatacagagtacaccaaatgcttgcatcaaagacttagggttatctctcctctggccaatggtagacttagaaatatattttcacctcttgacttatttttgaattgcctggcaataccttcctctgttattaatgcctttttcctaaccagcaacacgtagaacgtcttatgtttaaactttgagtccatttctgctgctattaaaaaataccccagatttggggtaacttataaacaacagaaatttattgctcacagttttggatgctaggaagtccaagatcaaggtgccagcagactgggagtctgctgagggctcattctctgcttcacagttgatgccttccagctgtgttctcccatggtgtttggaaagggtgagcaagctccctcaggctttttctaaaataagggcactaatcccgtttatgaggccaccactctcatgacctaattatctcccaaagcctccacctcttaatgcctccctaacagggattaggtttcaacataagaattttggaaggacacaagcattcagaccatagcaagcttcccaggatgctctttccaggctactcacaacttcctattgtctcttagactcctcattttccttcatttaaataacatgactgtccctggtaggtatttgactttcagacacttgttttaactaacaccttgctctggcagtccctaacatacccaacaggtagtttaggaagcacacagggctgggtgtggtggctcacgcctgtaatcccagcactttgggaggccgaggcgggcagatcacgaggtcaggaaatcgagaccatcctggctaacacggtgaaaccctgtctctactaaaaacacaaaaaattagccaggagtggtggcacgcacctgtagtcccaggtactcaggaggctgaggcaacaggagaatcacttgaacccaggaggcagaggttgcagtgagccgagatcacaccactacactacagcctgggcaacagagcaaggctccatctcaaaaaaaaaaaaaaaaaaaaaaaaaaaagctcacagaaggtgagaggagggacttgttgagacagaaaacagaccccaggccatgctccataaaatgggcataagtaacaataattccctcctcccaactttgcaatttcattagctcactctcgtgctccaaattttatcttaaatttcaacaataagccaaaaacattatatgtattcaagcagtcagtcaagaaatgcgactaagccctcagcgagtgcagggcacttgcaatgagctatgggcgcaaactgaaggacagaccactgcaggaccaatacaccaagagggttaattgcctgggtggacaaagcagaaatatacaccccaggaagatgaaagaggatgagaaaatccctagagatatatagcagggtaaaaaaaggaagttgctgaaattgggagaaacataattgttgtattttataccctgagatacagagcttctgactttggagttcatgcaggaaattagcattgtcccctttagaatcatccaacagagccaattttaagaagctatttctacaaggattttcacattgaaattcattcccagtcaagggaatactatctatactggtacgggacagtactttttgaagagacatactgccagaaaattaaagagggatttggtatggatgaatgagagagagaaattaacctataggtttcaaccactactgagcagtggttatgaggcttaaagcttgggcaaatgtaagccacagacacaaaactatgtactctcttaaactgcatgtccaaaaggactccagtattgggaagaattgccagatattgcaattaaaaatataaagaggccaagtaacatttaaattatttctgtgagtaatagataaagaaaaattataaaagggattgccatctcaatttatatatgcacccctaggtatacatgaataggcaactagaaataattctaacctaattgggcctcctgtatttttaattgtgaaatctggaaatcccaatttcagattgaattcaaaagtttgttgttgactatttgaagttgctattcaaattaaaataaatttttggttgaaaagaaatcccagcccacatttgacatgagcatataagtcaacaatcactttccttttcaaaggtgtcagatgttagaagaagagaaagagaaatccacatcattgggttcatttttgttttaccatttaagattcctagtgagaaaactgaccaaaattaaatttgacctggtacacattatctcacaggagaaagtcgtgaagattaaatagaccgatgccattcagtagctttgaagcagtttagatgcgttattgacattacttcttcccaattttctgcatcacttaatgatgttttagggatttcatgctaaatgaatgagatgaataacgtatctgaaatatttctagattccctactggaataacaaattatttcaggctgtctggctgattaaggtgaactgataacttcagagagccagggatggtagaggccaaactttatctgcttcctattctattttgctagcaaataaatgatgataagtatataatataactttagccttggctattacaagcaaatcagcaaaggcatctgaaaacctcagatttctaattaaatttttgctaatgtcttaagctttaaaaggggggtatgttttccaagtagatgtgcaagtgaggcccctgagtaataaaactccaattgtacttcacccttataaagtgggctacatcaaaacatttaatgtctgagtttttaaaccttgtatacaataaaatttcatacgtctccccttagagtgacagaattatagaggtttcctagctccctctacacttgctggattcattcttcaaagcattgtaatagaataatggcttactgtcaggatactcaagccagttgcaaataaatttagaccttgctaatcatttactttctcttacagcgtgccactcttaaaaatgtactcttggaattcaaataaagaaaaaccaaactatagttcatgtttactcctgtagttggaagcccttaattaaatggtagaactgaaagaggcttcctaaattattttctgatggcaggtagaatcaaagctaatatgtggtgatgtagtagtatttttctttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaatttttttgtatttttagtagagacggggtttcaccgttttagccgggatggtctcgatctcttgacctcgtgatccgcccgcctcggcctcccaaagtgctgggattacaggcgtgagccaccgcgcccggccgtatttttcttttatgatgcattcaattttagattatggtccacattcttaatgcagaaaaattcttcaatatctggaaatgtgttttgtagtttatatttgtataaatgacggaactatgaaaattgcttcaacataatcctccctttctgattagagaagataaaatggcaatttccttttttctatagctctacctataatttgtaaaatcagtgtaacaagtttgattaaaagatctataaacctcataatagtattttattgacctcaacctttaaagataaagttaaacttgatgagttttaaaactttggtacatcaatgttaataaatagatcaacattattaatttttaaatactcagaatcatattaagtgctctataaaatttgtcagaaaagaagcagtttgctctctatttttgcaaacctgtttttttttttttagaattcaataacattttaaccaatgtaaataaagtatacataaaactctttccacacttctataaaatgatcattccaaggttggtaactattagaagacacccaatgctacactcagcagaaatcttaatgcaaaagaaaagatacagaaacaaaattttacagctttttttccagatgaaaagaaaagataactagagtaatctgaggtcctaggttctagttcagtgattacaagagactgctcacctatcatccacccattatctttatcccaaaggatttttaaaagtcctagtctaaacccagattctagacctgactttgtagagcttagagctgtgtgacaaatcaagtcacttaaactccggatctcaattttcatctggacctagaaactgttaagctagagcagcacttctgaacctcaccagcattaacatgtaagattggatttttctttgttgtgggcacatgtcctgttcaggatgtttagcagcatctctggcctttacccactggatgccagtaatatctcctctcctccatgttgtagcaatccaaaatgtctgtagacattgccaaatttcccccttggcagggagggaatcttcccagttggaaaccactgagctagattagcataccctgtaggttgctccaaggtacatgggtcctcttgagaagctctgagaaaataaataaatcaagtgtcccattgtcagataagcatcaggaaagtggtatggcacctcactgcccttttgccaggcctttgtcttctgtttgaaaagtaggttttaaccttgacagtgcttctctgctcagtcttaacctcttgattttggtgatctcatcctttccatggatcggaattccatccatgtgccaactcccaaatgtatatcattaatgcagagagagatcaatgttctggctgtttctttaataattatcatgagatctccaccccgacgtattcaagactaaacttttgctcttccctctttgagccttccctttcaccctttccctcatctcaagacatgaggactactacttaggcttgaacctgagtctctcattctttcctcccccatatccaaccggtgttgtgctcatttactttcaaactgtattgtgtaactggccactttgcctgattgtaattgccactgtctcaggtcaagctatcatcatctctcatttggagaacttcaataacctcttagctgatctccatgcttccaccactgacccctctccacacaacagccagagtggtcttcttaaaacaaatcacgtctgtttctggcttgctgaaacccgttagagggtctgtgattgcatttaagataactgaatgtaatctacagactcagtaaaactgggtcctctttctctgtgtagcctcctcttatgccattatcccttttgctggctgtgttccaggcacatgggctgctctcagttctgtttaaaggaataggagctgatgcttagcaataactcatgcttcagcctgttgctttcataataagtcctttcatgagcccccaccaacagccatacattctcattgttatacctctctacatgaatctttctacttttctttttagcactagttataattgtaattttatacaggcatccttccttttattgtgcttcacattattgtgcttcacagatactgcagtttttccaaattgaaagcttgtgctaaccctgcattgtgcaagactattggcaacatttttctaacagcttgtgctcacttcatgtctctatgtgacattttggtaatttttctaatatttcaaacttttaaattattattatatctgctacgatggtctgtgatcagtgatctttgacattactattgtaattgctttggggcaccacaaactgcacccatataagatgatgatcttaaccgataaactgttgtgtgttccagctgccccaccaaccagcctgtctctctcccccttttggggcttctctattctctgagcacaacactgttgaaattaggcgaattaataaccctacaaggcttctaagtgtccgggtggaaggaagagtcacatgtctctcactttaaaattcaaaagctggaaatgattaggcttagtgatgaagacatgtcaaaagtcaagataggctgagagctagacctcttatgccaaaccaagatgtgaatacaaaggaaaagttcttgaaggaaattcaaagtgctattctagtgaacccatgaatgataagaaagcaaaacagccttattgctgacatgaagaaagtttttgtggtctggataaaagataaaaccagcgacaacattcccttcagtcaaagctttatccagagcaaggccctaagtctcttcaattctgtgaagatttatggaggtgagaagctgcagaagaagaattggaagctggcagaagttgattcatgtggtttaagaacagaagccgtctctataacagaaaagtgcaaagtgcaacagcaagtattgatatagaagctgcaggaagttatccagaagatctagctaagataattgatgaaggtggctgcactaaacaagagattttcaacacagacaaaagaaccgtatattggaagcagatgccatttaggactttcatagctagagacaggtcaatagttggcttcaaagtttcaaaggacaggctgactctctcatcagggtatagtgcagctggattttaagttgaaaccaatgcttatttactattctgaaaatcctagggcccttaagaattatgctaaatctactctgcctgtaccctataaatggtgcaacaaagtctggttaactacacacctgtttacagcatggtttactaaacattttaagcccactgtagagacctattgcttagacaaaaagattcatttcaaaatattactgcacattgacaatgctcgtagtcacccaagagctctgatggaaatgtacaagagattaatgctgttttcatgcctgctaacacaacatccattctgcagcccatggatcaatgagtcatgctttcaagtcttattatttaagaaagatatttcatagatatgtcttccagctgccataaagtgtgatttcctctgatggatctgagcaaagtaaattgaaaacgttttggaaaggattcaccactctagatgccattaagaacatttgtgattcatgggaaaaagtcaaaatattaacactaacagaagtttggaatagattccaataaggagtagattccaatccttacagatgattttgagaggctcacgacttcagtggaggaagtaagtgtgatcgaaatcccagtaactgcgatcgaaatagcaagagagccagaatgataagaggagccttgaagaagtgactgaactgctgcaatctcatgataaaattttaacagatgaggagttgtttcctatggaggagcaaagaaagtgattcattgagatgaaatctactgctagtgaagatgttgtgaatatttttgaagtgacaatgaaagattggtaatattacgtaaacttagttgataaagcagtggtagggtttgagaaaattgactccaattataaaagaatttctcctatgggtaaaatgctatcaaatacatcccatgctacagagaaatatttcttgaaaggaatgatcaattgatgcagcaaactttattgttttcttattttaagagattgccacaggctgggcatggtggcttatgcctataatcccagcattttgggaagccaagttgggcagaccatttgagatcaggagttcgagaccagcctgtccaacatggtgaaacaccatctatactgaaaatacgaaaaggaacctgaggcaagagaatctcttgaacccaggatgcggagattgcaatgagctgagatcacaccactgcacttcagcctgagtgacagaacgagagtctgtctcaagaaaagaaaagaaaaaagagagattgccacagccaccccacccttcagcaattcccaacctcatcactcagcagccatcaacataaaggcaaaagcctccatcagcaaaaggtctgtgactcgctgaaggttcagatgatgcttagcattttttagaaatgaagtatttttaaattaaggtgtgccatttttagatgtaatgctattgcacacttaatagactacagtatagtgtaaacttttatatgcactggaagaccaaaaaactagtgcaacttgctttattccagtgtgtggaaccaaaaccacagtatttctgcagtatgcctatatttatttccctcatgatttgttgaacatctacctttttttagtaaattgcaagttccatgaagtccataatcatgcttcttttggttacaacattgtatctccaacatctaactggatcttcaacacatatttatggaataattgaatctgttttctaccacccctgccccactcctcctggcaattaacaattcacatcagcatattaaaaatccaaatttttttaaaataaatatgttctgaaacttagttgtccaaggaactgtacccccataacgctgataaatatcttattttagggtacaatgggctaaattatctgtgagttgtcttccagctgattgattacagcatcttatttcagggggaaatactttgaaacgatcaaggccgtatgaactttggttcaaattcaaatgcttataaaattattaagacatatgtagagctcaaagtgttctaataattataaagccattatcagggtaaactgcaattgtaggagtgaagttaaatccccaactatacactttcattggacctctttccttcctcggaagtgaacttgtcattcttacattcacattgtttgcctattgatattgtgtagctattggggcacagccattacagccattgtgccaaggggaccaggtcctcaaagtaggagccagggctcttagagtcaatatctagctttcttttcaatgataattaagtactcagagctctggtctatcaatgagcttgctgcagagtgtttatgagagcaaaatatgataagaaatataaaacatttttgacagtctataaaatttttataaaaacaagttacttcaatgaaccaattttttaatatttaataagtctttattaaatatatgtatttgctttattaaatttagaaggaaaaggctgaaacattttatcatgttcaaacatcatggaaataaaaaataaatggaatgcccatgagatggtaaaaaatgtgacacccttattactaattttaatggaacacatctaggtcttgattactcaggcactggatacccacactattatgctaacagcagagacaggtatattatgatacaaggttttttttcctttaaactgggaacattacataggatataatacattgggtggacctggtcgttcatgcctgtaatcccagcactttgggaggctgaggtaggagggttgcttgaggccaggagtttgagaccagcctgggcaacataagaagaccctgtctctacaaaaaaaaaaaaaaaacaaaaaaaaacacttaaaaattttccagggatggtggcatgcacctctgtagtcctagctactagggaaactgagatgggagaattgcttgaggctaagagttcaaggctacagtgagctatgattgtgccactgcactccagcagtagtcacagagtgagaccctgtttctaaaaaaggaaaaaaacacattgagccacatcataatgtctaacgagtgccaactttgtgccagggcttgtggtcactgtggtgcaactattatctcatgaaatcatcacagtgccctataggatatttgcaagtctttgaatgactttatgcagcttccccactgaagctggaaagggggcaatgtcacttgccccttctggagccagcctgtctcccagatctcctaactacactaatctaggtttgagagctctaaaatttgtttctaatttgtagcagtcttttgatgtattaagatatagatcctcattacttgcagaatctgaatttgtgaatttacctgcatgctaaaatttatttgtaacccccaaatcaatactcacagtgttttcatggccattcatggatgtgtgcagagctgcaaaaattttgggttgcccagtgctcatgtcaccacctaagacagaaaaaaaggtactctctgtcttctcgtttcagcccccatactataagaaagtgccccttttttggtatgtttctgccaatttttccatttttttctttttgttggtgacttcactgtttaaaatggtccccaaatgtagtgctgaagtgctttctaggttcctaaacacaataagggtgtggtgtgacttacagagaaaatatgttctctctacaaattttgaaaagctttgctcaggcattagttatagtgctattggatgtttcagtattaatgaatcgacattatatattaaataagatgtctctaaacagaaacacacaaaaaacaaagtgtatattaattggttgataaaacagtgtgatcagaggctcacaggaagctaaccttgtgtttcctctagaagtaatcattcagtattcactaattagcatttgtggcaactttatagaacacaactcctgcaaataacaagaattgactgccactaaagacaccattgcacttgacttttttaattgcctgcttgatgtcaggtaatctgattattcagcctttgatttcagattgagtgattaatgaaagaccttgaatacaaaattttaaactggtgggaacttttatgaggaagtcataaaggcctgcagtcaaagatttgtaatgggagtcctcatgaaccccgactctcccaggcaaatgacatcaatataatctcactggtactcagcagaattcagagttattttttttgacttggaatatgatgtcttccagggtgaaaagaaagaaatagaagtagaaatttgagtaatttcagtttaccatgcttttaaaaatgttgacaaggtgtactgttatgtatgattcaagctaagtttgtcagaaacagtgaattgttaaatttaagtcatgcttataaaaatctatgagatccctaactatcttccttgtaagttctcacataaaaggttaatttattccaatctattaacttattaagtacaaaaagggcatattgaaatactactgtaaaataactttttaaataataagtaaaactgtgaaaaaagggagttttgacctttcattttttgcttcattcttttatggtaagtgtaaaaattacttcaaggaaatcctatttctttcatttgtaatcataattttttaacagaaagtgctgttatttaaaaacttttgatgagttttttcctccaagagtcaacttatagtagaagtacttctgtttccaataataatgaatgagctataatttatttaaattttgatgagtttttttttttttttttttttttacaaaagcaatgattcttaggcaacttgtcaaaagacgtcatttcagttttgaggcaagtactgggttattatattaaattgtgagaataggttaatttagctatcacaatgagtatttgtattaatacgttcttacaatgctaataaagacatagctgagactgggtaatttataaaggaaagaggtttaattgactcacagttcagcgtggcttgggatgcttcaggaaacatacagtcatggtggaagtggaagcaaacacatccttcctcacatggagaaggacagcaaggagaaatgctgagcaaaaggggggaaaggaccttataaaaccatcagaccttgttgtgagaattcactatcacaagaccagcatgcgggtaaacacccccatgattaaattagctcccactgggtcccttctgggacacatggggattatgggaactacaattcaagatgagatttaggtggggatgcagccaaatcacgtcagtattattcctaaaaatgtggtggctcacacctgcaatcccagcactttgggagactgaggctggcagatcacctgaagtaaggtgttcaagaccagcctggtcaacatggcaaaacccgtctctactaaaaatacaaaaattagtgtggtggcacatgcctgtaatcccagatacttgggaggctgaggcaagagaatcgcttgaacccagaaggcagaggttgtcgtgagccgagatcatgccagtgcactccagcatgggtgatagagcaagactctgtctcaaaaaaaaatcctttacagtctggaagttcacaccataagtcccaaatgctattgtagatattataaatttaggcaacattttattattgcgttagtcatgtaattttattataagcacctcctctgtatcaggtgctgagatggttgttttacatgtattttatctaattctgtcagtaactgcacacaataagtattacattctttatacagatggaggcactgaggtacagaaggtctaaatattttgctcaagatgtatagaaaattaatataggttattaaagaaaaataatcaaatttaggtataggaaaacatacaaattccttgcttttttatactttctaaattatttgtaaataatataacctaatgtttaatttttaagaaatgtgtaacttgtaatgacaaacatgactgacatagaacagagtattgctagttgatttatcattgactgagagcttaagaaagctacgtcaagggtcattagtcattcttatttagcaagtaactcatcacagatgtcttattattctgttattttccacctacatattttctgccacgaggtactgaggcaattcaggaaaacatttgtgttaggactttgtggcttttgaacccggtggctgcttttaggtgggattcatacacctttaacaggttgaaaattaaattgctttatagatggcatcttcaaaggaatggtggtaaattgtgagtgattggtatcaagcagtttgtcttttacagcatcaaatagtgtttcctcataaaccatagcctctctcgttcttgtcactcaggaattcttatggtacaaagtagcatctcttctcctctccgtaccttccactcagtaggaaagcttaatcttgtttttattgagatatatcttatgcgccataaactcaccctttgaaaatgtacaattcagcggtgttcagtgtattcataagcttgggctgccatcactgctatttagttccagaacattgtcatcattccaaaagtataccctgtatctgttagctatccctccccattcacccctctttccatccactggaaaacaccagtctactttctgtctctctagatttgcctattctggatatttcatataaatagaatcatataatatatgtccttttgtgtctggcttctctcacttagcacagtgtttccatagtttatccatattatagtaggtattagtgcttcatttctttttatgcctgggtaatattccatcatagggggatatatatatatatatatatatacacacacacatacacacatacatatgcatacatacatacacacacacacacaccacacatttgtttattcatttatcagtccatagacatttagcttgtttccacttttggctattctgaacagtgctactatgaacgtttctctataaggttttttgtgcaggcataggtttttatttatattgtgtaaataggtgtttcctctcattttttcattgcttccctcgaactcccatcactacccctaagttcagaaaagcccagaacattaggaactttgtatatcccaagagagcttggtaaaacttctgccacatcttcctaaacctgaactccattttcctgtcttttcccagagccgccaattggacaaatgcaccccccgcatggcagtgtcactcctcagaagaacagcaacctgcttgtgatcattgtggtcaccgttggtgtcatcacagtgctggtagtggtcatcgtggctgtgatttgcacccgacgctcttcagcccagcagagaaagtaggtaacagctggttcccaagaggaaagaagtcattgtcttttggggttatatttttgatggtcctctttctgcgttctttcataattcaccccatgtccttacttcctaaccctggcaaaaccttgcgttttgtctattccaggcctatcattaagtgagtgagggctagactcgcagataagataactaacaaaatccatctgggacccacttatatttctgtttgcttttacttctctgaccccttctcattttcaagtgagcgcaggtgttccttaggtaacacctagagaatagactccaccatgcccctgtttctggccttccctgaaatcatgtacacgagatttgaggaatgtgtttctctgtgtgcacttatttaccactttttacaaggagccctgtaggcagttaatcaatacttattggagagatgactaaatatagaatgccagactctgtacagttacaatcctgttggtgcttagtttggaggcagtagttaagaaagaagagagagttctgagattcaaaatggtttattttctgtggttaattgtcagaaattaaaagtgttgagggctttaagaatattttcatattatgcagctttaggttctagcagatgcagagaatgatacatcaaagtacaaagtttaaaatggaaaagtgatttttattcagcctatatccttgcagcaacaccctgtaactggccagttagtctgtgtcagccagtgctgggagtcagcaataatctcacagccattctctgcctctttgactttctagtccttttaaaattcagcctgatgtgtctttttcagctacactctctcactgagttgactatcttaggctcttccatgagtttttggttctggttttaggtttttccattggcctcaggcatgacattacctctgaaagcctgaggtatgggttcataggtggctggtttgacaactgtgtactttacactttgctagaaaagattctccagcaaataatgttcccccttctgttgctaatagctcgctcttgctctctctctctctctctctctccatctctctctctctctgtctgtctttctttaagtcctgtaactctatttgtagatctctagtttaccttccagcactctgaagtgacatgtttagaaagagaacaggggaagatatacatactgaagaaaagtaacatggggtgtagatgcaggctttgtatttaatttatttctatggcaggacaaattttctaaccagctgatttatgagatttgactagtttgaagctggtgatagctggtgtgctgctccattgtgcctaagcaagaaacctgctagagtgagcttagctgggccagcctcatgtgtgagcattctgggaagtcataatcactcacagagcttccacagtgcagggctgttaataaggctctggaggggaaagtaactaattgagtaaggcattgaacaatctcttggtgctgtgttatcaggaaaggggttgtgaaatcacggaacagtggaacatcaaggcagcaggtctctgaagcagagttaagagggactcatgtaaaagaaggtggggaggcggtaccaaaatgacacctggcctaccatataactgctttcaagacactgaagcattcactaaactagccaaatgtaactaagctatctgtagtgggtttgtttttgatttgggttcccccccgccccgtgtcatttctgtgagaagaatgttcgagcattagattgacctgatgaactggattcctggatatattttgtttctccacagagagaacaccagtcttctcaatgtgcaaaagtgggatttggtgccatgttgagaaaatctccagtcatcttaaatcctaccctaagcactttggcaaaagcttcagggctttatttggaaaagggagactctgagccctgagtatgacttgtttttaaaaatagggacctaattaaagaataagtggttctattaatgactgaaaatccaagaacagttagttgtagagtcactttggtttttcctcactgcactctcaaagtcttttaatagttacttgtgttcacactttgtttcatatctttcttcagtagcagacccgttggcattcatttttcatccctttgtgtgcatattttcatagagaaaaagaaaatgtttccttcaagttatttctgaactatagtttagtggggtttgtttgtttgtttgtttgtttgtttgtttgtttgttttttgagatggagtctcactctattgcccaggctggagtgcagtggtgcaatctcagctcactgcaacctctgcctcccattttcatgccattctcctgcctcagcctcccgagtagctgggactacaggtgcccgccaccacgcccagctaatttcttgaatttttagtagagacagggtttcaccgtgttagccacgatggtcttgatctcctgacttcatgatctgcccgcctcagcctcccaaagtgctggaattacaggtgtgagccaccgcgcccggccccttatagtttagttttttgttatttgttccattgaggaccgctactcctctgcatcacaattgagcccttcagaacaaactggataatgcaggtgaaagcaaaatcaattccaatctgaaacagaaataagatcccctccaaagctcttagaaaattggactttaatgtaattaataagttgaagtagaaaacgcattcacgagcttcttcaatatctcttttggggttctagagaatataaatttttctttatgttttttttgggggacttgaattacatccaagtgaattgaaaaagttctatggactctcagtaatatcttattcaggttaagtgtctatgcatttaataaacctaacctttttataaaatcatacatatattcaacaattaggctatccagttgattcagactagtgggtaagatttcatttttattatataaaatagctaatgaaagtcagtacccaagttctagttctgggttctactgcttctatagtaaactaatcatatcacctaaatgaagacccttaatacttgggtggcagtttctttaaatataatgataatttgggctaaatgctttctatcattctctttagctttttttgttggtttttttgtccagagccaggtaacaatcttctacttttaaaacataaaaattcccaatggaatacttctaatttatagaatcacatggtagcattaagctttaaattactgcagttcttttcagttatttattaaacttttttactactgtactttgaagagaccccttccacagtttctattagtgagattatcgtatgacatctaatacagaaaaaattatattttatgaaaacttaaggctggacacacctgtaaccccagccttttgggaggccaagacatgaggatggcttgagaccaggagtttgagaccagcctgggccacatagtgagaccttatctctaaaaaattttaaatcagccagatatggtggtgcttacctgcagtcccagatactcaggaggctgaggttgggggatcacttaagcctgggatgtggaagctgcagtgagccatgattgcatcactgtactccggcctgggtgacagagtgaggcctgtctcaaaagagaaaaaaagaaacaaaacttaagttgatttttgtccctgtttctctgttttttaataaggcaataacattttctcgcccaacatatggaacacatgttattagttagactttatccacagatactaaggacaaaaatatatgaaattgagcaaatccaggagatctagaacgcatggttattacatttctaaggcagttacctgggtaggtgatctacagtcttgtctgaatgctttaaatttaaacatgtaaataaaacctaaggtgtacttgttagaaccactggctggctgggccttctatttgacttgacatgtggacagcaagttttaaagattagtatgcattcaaatcttgacaaaaataattatttttagtactgacgatgaaatgtctaggctcttaaatgaaatctacagtattttaactattataggtcacttttactgatttttcacttgttaacgttttaattggttttcaatattcacctcataagagatttgaactatcagctaccttaagacttcattatatcttaattccatctcagaattttttctgagatatatttgagtatctggaatttgacctgggtttctaatacaaatttttggttttgtttttatttttattccactaactgctattaatcaaaatggacaattaggggctagaagcctttggaaaagatttggaaagaaagcagagaaatgtttctacttatcaatatatctttttctgattaacttgtaattatttattcacactcacttcaagcttccttccttcctgaagacttcccccaaacccctggtgggtcagaatgttcctgcctcaatccctatcagatgttgggcatgtcttttaaccacgggaattagtacagcactctttatttgtctgcctaataaagttgggaacaactttagcagacgatgcctgagtccgtagtggaaatttaataatttattatgatgtgccaaaataacctatatggtaacagctgcattttagaacttcaatggacacagtcttgcataaaatggacactcaaccaatgttggtttttactcattcacatccccagcatactaattaaaagtgaaaaggaaaaaaaactccccttacagtaataggttatgcataaagtaaggaatgggtaaaccagtacagaaccagagaagaagctttcagataaatacttgcatgtcaataatggaaagtaattcttattatttaattcaagtaattattgtgtgctttatatgggatctgcatcatacaaagtaacaaatctgattaatattaactctcaagctaaaaatctttttgcaatttcccactgacttcttgatattattaaaaatgtatctatttgggccaaggcctcctatgtttttgtcccttctactttttcatgcacacaaactgtcatgccgcagtgcatgctcctcattccaacaatgcagaaattcccaggagccatgccatgttacaatcattttttaagctttcaatgcctccctgatctttacatttgtagtacttagcacatttcttgacacatagtcaatcatccataaatattgattgaataaataaataagtgttgtaaaacaatggatgatgttgaagaagtaaaggaaacagagtttgctccactttcactgaaggaactgaattatcacaaagggagcagctggacagctcaataagacacacggtgatcaatgccaaggtgagtggtacagagagagatgagggaaatgatttagattctctaagattacagtgacctgagatggtcaggaaggttccctgaaggagagagtcttgaaaggagacttaaagaataagtcatttgcaagttaggattttgaaggcactgtgggcagaaattaaataagtaaacaaacaaaacaaaaaatagagcaccagcacctgaccatgctgtcaaagttttgccatgatctgagaaggagaaaacagagagcctgggagggttctttgtttgcctttatcaagaatacctggggtagaaggagaccctcctattctagggctattttagaagcagaaggatgactggtgcctgagggaaaagatacatttggtatttgcagaggggccaaacatgaaatactctatgtcaaatagaaaaactagctttaaaatacaaacaaaaccaaataattcactatgatagtgcttcttaaattttagacagattcacctggagagtgttaaaagacagactgccccctgcaaccaagtttctgattcagtggttctgcagtggggcctgagaatgtgcatttctaacaagttcccaggcagtggcagtgctgatgcctctggtttagagaccccactttggcaaccactgtactaggagcacctgaatacacatttcgaagaatctaatggtgagacacaggaaccgtgggctgcaatgagcagcagtcgtgtcaagaaccaacagatgggcagaaggtcagggtgacacctgttcctataggttttaagacaaatttcagacaatttaattatgagcacatgttagttttattacaaacctgctgtggtagaggttggagggacaaaagaaggagaggctctccaaggccaaagatttctcctttaataagagatacgataggaaataaaagtggttagatggtcatggctagaataaatacaaaaaggaaataaagtctatttagagatctttagcttcttgactgacagtcagctgggtgggtgagcaacttcttagaacttgtcttgatctgattaaaatccagcagaaaaatgcctgttcattttatgaggaactacaatttcttccccagtggagattatgaatcacaacatacaaaaaggttctgccaggtttggaactcttttaaaaacagaagccatctggggctcgttggtactgaagtcatggaaactagcaaataaatgaataagtgaaaaggcatgcttgtaagcaaggggaaaccagaatttgtaatttattgctggtttcaattttatcttgactactttctttattccaggttatttaaatattgagttaaataaggagtttggctatgttttcctgaatttgggaactggtacttctctgtgtgcagccacacagatgctggtgttaagttatttagcattttgatcttctagaaagagagataacagggtgaaacatccaagtttgagaatgacattacattttctatgaagttaccaggagtagattacacagggagctgtgtgtgagttgcagatcagtttgccgtgggcaagtgaagtatatagaaatgaattcaggaaataaatggttatcagtgagttattatcttagacacatagacacttagaaaataggggttgtttcagaccattgttttaaaacattgtggggctgccaccaggaaatcagcaaagtgcaggtagtgttattttttctctgctaaaatacaaaatagatactaggtctgggattctttatctcctatcctcatcagcacgcttcaagaaagacaaaaaaaaggatgtcagggaaaattcaacaaattacaccaccaaatatttattaattacctagtatttacaaagctacttattcatcatcggaaaaccaaagccactccaatgactttgcacaggttacaggtgttttcactgagagtagcttgtatgaactattgagcagccatggaaggtagttattataataaactgttcactgcaaattaaggaagtgggaagtagatgcttctctagtctgctgtcaaaactagattttaacagtttgcattatttcttacaagagacattatttttaaagaaatagaagttacaagtagagatttaaaagttataaaactagggaaagggtcaaaaatgatttctgaaaaggaccaaataatacatggtttaggatttttgagccatatagtatctgtcacaactattcaattctgccattgcagtgcaaaaataaatgagcttggccatgttccaataaaactttatttacaaaactaggctgtgggcagatttggcttgcaaactgtagtttactgaccccctgctgtagagaatgactaacatgaacattgtgttacttcacttatcacacagggaacatttaatctcactagcctcaagaagagattatcaccccaaaaataaatttatagttgttaaagccttattgaggcaaataagaaacatgtgaaatacattttcaaactgtgttcttctcctttcaaaggatctgtctcactgtgtttgaatctggacactcagtgatgccaaggcaaaagtgttttattctcctaagaatatcctcatgtggccttttgtcttcaaataacaagtttcccagttgcacattaaattatacagctgaggtatagactttcttctaagacctcatcttagctattggcataaattctggccttttttatttctatttgccctttcaaagcaactccttcatttatctcctaaacagatgttgccatcaggtaccttatgcctggctccaaagattggcatatggttccatctaacccattttcaccttgcacatgaatctgcagccgctgaagctggagaaaggagctctctgccaggaagccgaggccctggggattcagcactgcatcctttataatgtggtgaagctccaggggggaagaggaaaggcagccaagacaagtctgccaattcctgggtttcacagggctcattctgcgagtccttttgtttcctttcctgcttctaacttgaattgactgatgaaagaaaggaagtgccattgaatagaggttctcacatttgccttctaactttgttccataggaaacgggccacccacagtgctggcaaaaggaagggcagccagaaggacctccgaccccctgatctttggatccatcatgaagaaatggagatgaaaaatattgaaaagccatctggcactgaccctgcaggaagggactctcccatccaaagttgccaagacctcacaccagtcagccacagccagtcagaaacccaactgggaagcaaaagcacctctcattcaggtaattatcttttcactggcattagggaaaacataccattctgaacccaagggagtttttcactccttttatggaaatgtcttccctactaatttgcatgtcattatgggtcatttatcaatagttaaatggatctaatataaatttggttgattaaccaattatatgtctttcttcatcctgtgacttgatataattttaataattcttttataattttgataattcttgaattttctatgaggttggaagtaggacagttgggaaatacagaaacttaaatcctaaatggattgactgctttttgttaattgttaaacaaatgttttgtcaaggcaataaaatttgaagccatctgtacattttccagttccttatttcgatagataattgaaagttaattctaaatttactgtcaattccctgttttaaaaatcacatcagggcacttgaagtacaaaaaaactgaatattctgttactttggccttgattactatggaaatcaactgtcatccacatacagtcaccttatgtgatccccagactagtttgatgggattctgtctgaaaactatgttgttatacaaagggatctgaaaaaaaaaaaaaaaaaaagcctactgttcaatgaattggtgcagaacaatcactggtgtccagggataagtaagaacactagaaaataattgtaagatagttcactttctctgggtcttcatattatctaagtgcttatgggaatcatcaaccaaatactatcatcaaaaaatcccttggtctactcataatgtgattatagaatgaggagctcctgtttttttttttttttttttttttttttttaagttttagggtacatgtgcacaatgtgcaggttagatatatacgtatacatgtgccatgctggtgcgctgcacccactaactcatcatctagcatgaggtatatctcccagtgctatccctcccccctccccccaccccacaacagtccccagagtgtgatgttccccttcctgtgtccatgtgttctcattgttcaattcccacctataagtgagaatatgtggtgtttggttttttgttcttgtcatagtttactgagaatgatgatttccagtttcatccatgtccctacaaaggacatgaactcatcatttttatggctgcatagtattccatggtgtatatgtgccacattttcttaatccagtctatcattgttggacatttgggttggttccaagtctttgctattgtgaataatgcctcaataaacatacgtgtgcatgtgtctttatagcagcacgatttatagtcctttgggtatatccccagtaatgggatgcctgggtcaaatggtatttctagttctagatccctgaggaatcgccacactgacttccacaatggttgaactagtttacagtcccaccaacagtgtaaaagtgttcctatttctccacatcctctccaggacctgttgtttcctgactttttaatgattgccattctaactggtgtgagatgatatctcattgtggttttgatttgcatttctctgatggccagtgatggtgaacattttttcatgtgttttttggctgcataaatgtcttcttttgagaagtgtctgttcatgtccttcgcccactttttgatggggttgtttgttattttcttgtaaatttgtttgcgttcattgtagattctggatattagccctttgtcagatgagtaggttgcaaaaattttctcccattttgtaggttgcctgttcactctgatggtagtttcttttgctgtgcagaagctctttagtttaattagatcccatttgtcaattttgtcttttgttgccattgcttttggtgttttagacctgaagtccttgcccatgcctatgtcctgaatggtaatgcctaggttttcttctagggtttttatggttttaggtctaacgtttaagtccttaatccaccttgaattgatttttgtataaggtgtaaggaagggatccagtttcagctttctacatatggctagccagttttcccagcaccatttattaaatagggaatcctttccccattgcttgtttttctcaggtttgtcaaagatcacatagttgtagatatgtggctttatttcctgtttttaaagtgaattatttgaatgtgttgctgttttactgtactctgtcatctcagaattgcataaacaagaaatacaagtattgactgtcaaccatggattgttgaatatttcttttcaagctctcaaatgatgtcttaggcagatttcctaacttccttgtcactccagttattgaaggacagtctagttccattaaaaactatcatctgaaatttaattaaagattctcctttctcatgctcagctagatatttggctctagggactgggggtcagaatttgttttctcaatcctccagtacattggagtgaaatggaacggtgggattgagaagaagctggaacaaagtctgtttcagaaacactgttacatcttttccccttctctccacttttcctgagcatgtgagagaagagggatggagtgaagagggaggggaggtgaggataaagagaagaaagtaccatttgaagttcttcatagcttttgtggacacgtgggctaacctctatgtggtatccaaattctgggtctcttatgaaacagaagtatgacttatttatggcaggggtactcaacccctggaccatggatcagtactggttcatggcctgttaggaactgggccacacagcaggaggtgagcaacgggcaaaagagcaaagcttcatatgtatttacagccattccctatcactcccattactgcctgagctctgcctcctgtcagaccagcagcagcactggattcttataggagcatgaaccctattgtgaagtgcacatgtgagggatctaggctgcacgctccttataagaatctaatgtctgatgatctgtcactgtctcccataacccccagatgggaccatctagttgcaggaaaacaagctcagggctcccactgcttctacattatggtgagttgtataattattccattatatattacaatgtaataataatagaaataaagtgcacaataaaggtaatatacttgaatcatcctgaaaccgtaccctgccccctgcccccaggtccatgaaaaaattttcttccatgaaactggtccgtggtgccaaaaaggttgggaatggctgctttgtggggccttgtagaccaggcccagttccatgatgggagacatgaagtccaggcttaccacctaacacagctcttcctcttccgtcatgaggcctctgggaaattccagcaaggggactgaagcccagccaacttttcacatgcccacttggcccacaagaatctcctatatccttgccagacccaatggtgagagagcttgcactctaccactggccctctctcaaccttgctctcttcaattactttttcctctgcttagatagactcggggtagaacagcaagcccactgcctaaacaggctttcgcctggggagtgacagaaaacaaatcccttttgcaggaacctccatattttacaagtgattcttcttctagctttgttcttgactggatatcagggaggggagagcacctccacctcccactgaaagggatagaattgcctcactgccctaaggaggttttgccaatgacttctaagacacatccttctaaccttttcctttcgtcttttatatactgagatgacattaagttgatatctcttaataagtcctgggggaaggtttaatcccaaatgatgactgttttctttaaaataaaagagtacttatgcctacttgtcctcaatttgaggacctcgttgccaattttgtaacaaaaggaaagtaatcctcaaagtcctgcaagctatactttatgttaaattaagtattcttctctcctgcttaaaaaaacaaaattcaacataagtgaacagcattaccaagaaacattatatttaacaatggggttcctgagtaggcaataactatgtaaggagagattactgtatgttaaattctatgatttggacttttatacattattttgcctaatcttcacaaaatactttgaggtagatgctatcattcttttcatatagtaaatgaagtaaccaaattaagaagggttaaataatgtgcccagatttcagagctagtatcacagccaggaccaaaaaaatctgaccccaaattaatgttttgttgatccagtttcaattaactcatgtaatacttttatataagtacttttcttgttttgcgcccatgaaattagctttttggataaaaccagaaattagtttacagtattcatactttagctatggaaaagagaattgaatcaagcaattgctgcataaacaacaacaactaattttattgagagttaattttttattttactcattcttccctactgctggtatgcaaactgcttaaacaaaacctacttcattctctaaccacaaaaatagaggatgccactaaaatatctaggaattaagatgataagttattgcttcatgatacatctcttctacatctagtggatttcaaaattattttctttacttaaaagtttacaataaagaaacgaaagagttcaggtctatttgatctctaggacttacaaatagaatttagtttcttgaaatggatttatcctagtctaatttcactacagaagcaccacaggattatgttacttagcttcacttcggaagaatgaacaagtaaatttcagcatgtggcatttggtagtattcaatttctaaaaatgttcaattcagtgaataacatctataaaagagctacataacaccaaatgggcaatgtgatttaacacttaactttttattagttattttgaattatatacatgtctattaaatcctgtatttaaatttcccaacctcatttggaccaatggtaaataatgtcaggtggcaagtttatgagacaagccacaaagtgttactaccaaaaaattttatgcttcaaaaaaagtaaaaggaaaaaatcttgtttaacttttcaatgaattcatgtaatatcaagcacagtctatttttagaataaaaaaaaaaactgaaaacccacacacagacacccaacaatatcaaaggacttatttgaaaactatgttaccaccgggagctgtggctcacacctgtaatcccagcactttgggaggccgaggtgtgcggatcacctgaggttggcagcttgagatgagcctgaccaacatggagaaacccctctctagtaaaagtacaaaattagccagacgtggtggtacatgcctgtaatcccagctacttgggaggctgaagcaggagaattgcttgaaccttggaggcagaggttgcggtgagctgagatcacgccactgcactccagcctgggcgacaagagcaaaactcaatctcaaaaaaaaaaaaaaaaaaaaaagagaagaaaaaaagaaaaagaaaactggttggatctagagttacttttttggagtggcaagaagaagcacattagatagtgttttaatgtttgcttctactgtcaaacataattttgaaaactaaagaggaggaaagtctgttgtatttaattgatattttcactctttctgttgttcatttttcctgtttgattgtctgagattcctcttactacttcctgtttagagaaattccattagcttttttttttttgatggtttatctgcttgagacaaattctcttcattttccttcattggacaatgacttgatttcaccttcattcttgaagtatatttttgctggatattgttaacccaattctgtttggtagttctcttttagcacttgaaaaatgtgttggatacttctggccttcatgattcctgatgagaaatctgctgtcatttgaattgttttacccatataagttgtttacctctcactacttctaagatttttttgttgttcttgtctgtagttttaagaagctgaactgtgatgtgtctggtatggatttctttggttttatcctgttcggggattactgaatttcttgaaactataaggtttatttatgtcttttgccaaattttggaaatatcagccaataattctttaaatatttttcagtttcacaccctttttcctctttattgactctttggacactataatttttccccaaaattgatgcttttctattctttttatttatttatttatttatttatttacttgagatggagtctcactctgttgcccaggctggagtgtagtggcacaacctcagctcactgcaatctccgcctcccaggttcaaatgattctcttgcctcagcctcccaagtagctgggactacaggcatatgccaccactcccggctaattttttgtatttttagtagagacagggtttcaccatgttagccaggatggtctcgatctcctgacctcatgatccgcccacctcagcctcccaaagtgctgggattacaggcatgagccaccacgcccagccaaagcgatgcttttctaatgttgccactttatttcttttagtttattttgtttttagagatggggtctcactgttgaacagactggtctcaaaacatcctcctgcctcggcctccataacaggtgcaatcacaggcatgagctacacactcagtggttgccattttaaaacccacacacttttaaatgctctggtctcctaggaaacttttttagtatttttaccattagggtgcacttctttggtagatggttttaggtcagtcttgtgatccttatttccctcttctctcttctatacagactttccagatagctggcttttcacaaagactttgtggctgtagcttgagaaatagctttgctagaaagtattatttctctttgtacttacaggaaatttgaaatgtatcctcttttctgttttgtgattctgctgaaggagtaatatttgcatagttcatttttacttttattttttgagactgagtctctctctgtcacccaagctggagtgcagtggcgcaatctcagctcattgcaacctccgcctcctgggttcaagcgattcttctgcctcagcctcccaagtagctggaactacaggcagccaccaccacacccagctaatttttgtatttttagtggagatggagtttcaccattttggccaggctggtctcgaactcctgacctcaagtgatccgcccactttggcctcccaaagtgctgggattacaggcgtgagccaccatgcctggccaggtttgcgtagtttactgttttatatgattctgtgtagtttttgtaggatgtgtggacagagttagatttaggaagcttccatgacttcacctatgtggacttctcccagtataattttttattttaaattgtagtaattatgctgttaattttttaaaaaatgcatgcatatgataaaaaataaaaagaataaaaaagtttcaaaaaatagtaagtacccaaaatagtaaaacatatgtttgcctcttgcctatcccaaattcctaatccctttcgcaaaaggaaaacaatgttaaaaattttgtgtataaccttattacatagatataggtgtgtacttatatatatatatattcatatacacatagaaatgtgtgtcacaatatggttttatatgcatactacacaaatgggaacatacactattcagaacttcagtttttttaatacgtattataattaacttttcaaatctgcatatatccattttttctaatttttagtgactctttagtatgatattttatggaatcctaataaatttatgtaaatatgtctgatcttatttttgaagaatgcagtttatttcttgtgggttttttgtaataaaatttaatatggttgggcttaaagtattagttgaatgaattctagtaaattaatatagtggaatattacatagctgttaaaaattatactgagttatgtattaacagagaaagatttttgtgttaccttttatagcaggttacaaaaagtatgcatgatataatgccatttttgaaaaatatattaatgtacgctctcccactttcacatgtataaacatatgcaaaaattataagcatcaaaatataaataatggtttattgtatgcaatgagtttagagtttatggttaatttcattaagatttgtacaatgaaatagattcaggtaacaagaaggtagatactatcatagaaagcatctgtaagactgaaaaggcattggaatgcctgctagaaattaggtaaagtgttgcatccttgaagagggcatgtttctcaggagtgtgtattttttaggtcaagacactgaggaagcagggagctctatgtccactctggagaggtcgctggctgcacgccgagccccccgggccaagctcatgattcccatggatgcccagtccaacaatcctggtgagtcaatattggtgccacaatgaagaaatgaaatgctttctgtatgtatcttttctataaaaaatcaaattatcaaaagtaattataattttccctgaactttctggacaaatggaaatgaggaatgactaaaaccgtatcattaataatttgaagtctaagtcttcattcgttactgtatttttttgtatacaatcagatggtctgttggcaaacagatggatatatatttaagaaattgtttgtaaaatatatgaattcacataaaagagctgatatatattttaatattattgatcttattctaataatcatctccatagtttatttttatttatttatttatttattttatttatttatttattttatttatttatttattttgagacagaatcttgctgtgttgcccaggttggagtgcagtggcacaatcttggctcactgcaacttccacctcccaggttcaagcgattctcatgcctcagtcttccaagaagctgggactacaggcatgcaccaccatgcccagctaatttttctattattagtagagacagggttttaccatgttggccaggctggtctctagctcctgacctcatgtgatccgtcttcttcagcctcccaaagtgctgggaatataggcataagctactgcacccatcctccatagctttttaaataaactttttaatgagtctaattctcacacttaaataatctagctcctttaaagcagatgttgacagacacccacttactacacaccccttgttgaagttttctgtcatcctcccacattcactgaagatattattatctgagaatcacttcctttcccattacttctatgctcagtcttggtaattacagtattcatgcagataatccatctgataccctagatggttagttcctctatgttgcctgcaaagatattgattccttcccacctcaattcataaattccatgtcacaccaaatcaaaccagtacaaaatctcagttcctattaccttattagttccctgctcactttattgcccccttgccatcaattcttcaatcccaccaggacctccaatccattaactctgccatttcttcccatccctcatccccttcgtgtcctcatttatctgcaagcttaacttaggttttatagtcacttattatcttcagtctcatctcccttggtcttccttccccatcttactcgcctgaaaaaaacctggtaaaataagcagctccccaattcttaccccattccctcatagctaaatgtatctggagaaaaacatatagcctgcttactgaatatttatgaccaaaagtccaaggtgagctctcactatttggaaatgacactgtatttctctagtggttcatagttacactttataagatgaatgtcttatatgtattcttacttttcagatttcagtatctcccatctttccctattcttagctaataatcttatatcaggaagaaaagaaaagcattcagaaagtggtatccttgtccttccatcaaatctaattgatctgttagtgctgctctctgagtgtcttgttgaaatcccctctcacccatttagggactcttctgtaattactccttccctttcctgcatcatcagttttttttccttatttatcactgcagtaagcatacaaatattaatattctgtcataactcctgttttataacactcaatgccacttccccctccaattgaaaccatatttactgaaaaaaatttctaaattatctgcactttctcctctatctaagctttcttattagttttaataagatttttacagtcactctccactgaatccatgattgccaaggttgtcaataatctccacattgtcaaatccaatggtcaagtctcatactctcagaaacagttgacataggttctcacttatttccctgaaacactttctctttggcttgcaatgtactagatgcccctggttttcttcctacccttctggctgctcctcctcagtatccttcatttatttctcttcttcctcctgatctctaagagtcagagaatgccccagggctcagtcttcaggtatcctctcttttctccctacacctgcttcttagataatgtcatctagtatcaatggccttaaataaatattattaaaatgctgatgaatcctggaggacattatcctgaggcaggatctctagggcaagggcaaaatgccaccagtctttgctaaaacatagcaagagtctcctttgcttcatttcccaataatttcctcatcaccatctgaggacacctcagcctggacttcattgtccatatcactacaagcattttggtcaaaactgttcatcaagtctctaggcaattccaaactttcccacatcttcctgtcttcttctgagccctccaaattgttccagcttctgaccattacccagttccaaagtcacatccacattttcagattatctttatagcagtgccacactctttgtggtaccaatttactgtattagtccgttttcacactgctataaagatactacctcagactgggtaattcaaaaaacaaaggaggtttaaatgactgacagttctgcatggctgaggaggcctcatgaaactcagaatcatggcggaaggtgaaggaaaagcaagtaccttcttcacaagccagcaggaaagagagagagagagaaaaaacgaagggggaagagccccatataaaaccaccagatctcatgagaactcactcaccatcacgaggatcatggggggaactgccccaatgagccaatcacctcccactttgtccttctcttgacatgtggggattacaattcgagatgagatttgggtggggacacagagccaaattatataaatcaacttactctgttcagaaactctagtttcatgcctcttcattctgatttccttataccctaaattcagtcttttaccaaattattgttttcaaaacatttcccaaatttgaccactcttttccaccttcactgttttgcccttatccaagctaccatcatctcttacagattactagactacagcaataagcttgtaactagtctcttctttagctttttgaaaaacaaaaaaactattcgtattttttgtgggtacatagtaggtatatatatttatggggtacatgagatgttttgatacaagcatgcaatatgtaataatcacatcgtggagaatatggtatccatccacgcaagtgtttatccttcttgttaaaaacaatccaattatactcttagttatttttaaatgtacaattaagttattattgactacagtcaccctgttgtgctatcaaatagtaggtcttattcattctattttttgtacccattaatcttcattagcctttgcctttacagtcaattctctacacagctgtctctcaatatataaattagataatgttgttcctctgtgacttccatcacatgtagaaacaaaatccaccaattttactatgttctacaaggtcccatgtgatttagtctctgggtttatccctcactttatctcctattgctcctttctgtaattcattacaatcatgtaaccttcccctgtgttccttggataataggcatatctcagttcagggactctgcacttgctgtagtctttggaatctctttttgtagatatttacatgtcttatcccccatttctttcaggtctctattcaactaccacctttataagcaggtcttccctgaccattgcctaacacagcatctctggtcactctctacttctctattatgcttcatttttcttttttaatgcattacactattctatttgtggttttgtgtttgttatttatttgcttcctgtattttaatataatctttataggggcaaggattatgcctattttggtcattttgagtcgccaatacccagaacagcacctggcacatggtaggcatgcactcaataccatttagtcaaatgaaagaattaatagttgtttatttttacttaccatatgccacatcctccctatgctccattacatcttctctcaattttactataataagtgcaaaaacttacatagcatttataatgaatgccagctgttcaagtcatgtagtaagcactattgttatgcgtctcattgttaggttctctcatttactagagagagaagaaaggattggagagtttaagtaactagctagcagtcacacagctagtacgtgctatagccagaatttggactcaaaaggtctgatttcagagttcagtgttcttaatcattatgctcctagctgtcataccctgtgaagctattgtcctttatcttttatacctttcactactgagaaagatactgtgcacttagttgccttttttcccctctagttgcactcctcttgtattaataactaagttctatctgtgccaatcatttattgctttcttctcaaacattattgtactttagaatctgtggagccttcctgtcccatctaattagaaatatcttcctcatctaataaattcccatatgccattgctttttctttcacagtatctttgaatccctggctatcctcccattctcaactcttttatgtcttctttgtgacttcacatctaaactgccaagacagcttcctagctaagtcttcccggctctagcatcttccagactcttaggcatcctgcttgccagatttcttcctaaaacaagttaaacatggcatcccaccccatacatttctccagtggctcccatttgtctgccaagaaaaacaaaacaaaccaaacaaatttttaaaaacgtttttagcatatcatattggaatctagatttctgttactctatccttatatgtacccagactcatgctaaggtagactcattgctgatccacaaatatgcactgtccttcatttgttttttccctttacatatttctttccttttgaaatgactcagtggatagctcaacctaagaagttttatgtatcctccaaagaccagagtagatattgatgctcttacaaatgcttttctgattactccatctagaaataatgactcccttttatatgtttgaataacatgttcttgtagcacgatatagcatttattacacacaatactgccttatatgcttaggctttcaagtacaaatcttccctcctccaacagcttgtgaattacttcatgataaggatgtaatgtatctaattcatcttcatattcacacattttattgtttaatacctagcacaaaattggtgcttgctaaatatctgtcgaatgaaaaaacaaataaatgtattattaaaatgccttccttatgtttgtaacacatcaatgtttggagagctctttttttgtcagttataaatagaatgtcatctaacaaaattgtctgatgtattaagagcagttaaacttgttttcattaaacagaaaaggaaataagaggcttagaaagagaaagaaaatctaacaagtatgaaaatgtttaatattattcacttggtaaataccttgctaattattattttcatttaatcctcacaatattatcatgtggtaagattatcctgattttacacatgggaaacagcgactcagacagcttaagcaacttcctctaggctacctgggcaacttcagaacctctacggtatactgcttttccaaagataaatatggcttttatctcctaaattattcatatccttttatttttcaaaaagattttctgaaggtgctatctccattgtctaaacatggaagctgaggctctgagagtctgaacttgaaacccctgcttgatccatctactctactatattgcttcatactgttatcttgagctctgagtttttgtaggcctaaaataacaaatcttctcttagtgacttattctacatgaatggaacccataaaattaccagaaattaatttttgttatttttgtaattatcagataacaacacatacatggttttaaaccatcacatagttttccaaaatttataagaatattctgattcagcaattccattcctagatatattctactcttggatatgtacccaatggaaatatataaaatattagtcaacaggtgcatataagaatgtgggttatttgtaatatcacatcttcattacaatagatgaatatagtatattcatatagtggagtacaatgcagcaataaaaataaactaaaattatacaaaacaatatggataatctcatgggtgtaaatttgcaataaagaaacctgatgcatctatataattcaatttatgtaaaattagaaaatcagtaaaataatccatggggtttaatatggtttggctgtgtccccacccaaatctcatcttgaattcccatgtcttgtgggagggtcccaatgggaggtaattgaatcaggggcaggtctttcctgtgctattcttgtgatagttaataagtctcacaagatttgatggttttaaaaatgggagtctccctgcacaagctctcttctcttctctgctgccatgtgagacgtgcctttcaccttctgccatgattgtaaggtctccccagccacatggaactgtaagtccaataaacgtcttttgtaaattgctcaatcacaggtatgtctttatcagcagcgtgaaaatggactaatatagtaatttgttctgggagtggggcattgctgttaagatactcaaaaatgtggaagtgactttggagctcagtaagaggcagaggttggaatagtttggtggaggactcagaagaaaacaggaaaatgtgggaaagtttggaacttcctagagacttgttgaatggctttggccaaaatgctgataatgatacagacaatgaaatacagtctgaggtggtctcagatggagatgaggaacttcttgggaactggagcaaaggtgactttggttatgttttagcaaagagactgggggcattttgcccctgccctagagatttgtggaactgaacttgagagagatgatttagagtatctgacagaagaaatttctaagcaataaagcattcaagatgtgacttggatgctgttaaaggcattcagttttacaagggaagcagagaataaaaattcagaaaatttgccccctgacaatacaatagaaaagaaaatcccattttctgagaagaaattgaagctggctgcagaaatttgcataatcaatgaggagctgactgttaatccacaatataataggggaaatgtttccagggcatgtcagaagtcttcacagcagcccctcacatcatggccctggaggccttggaggaaaaagtggttccatggaccaggcccagggtctgtgagctgcgtgcagcctatggacttggtgccctgtgtcccagctgctccagctgtggctgaaaggagccaaaatagagctcaggtcttggcttcagagggtgtaaccctcaagtcttggcagcttccttgtggtgttgagccttccagtgcacagaagtcaagaactggggtttgggaacctctgcctggatttcagaggatatatggaaatgcctggatgtccaggcagaagtttgctgcaggggtggggctctcatgtagaacctctgctagggcagtgcagaagggagatatggggtcagagcccccacacagagtccctactgggtcaccatctagtggagctgtgagaagaaggccaccatcctccagactctgtaatggtagatccactgacagcttgcactgtgcacctggaagagctgcagacactcaatgccagctcatgaaagcagctagaagggaggatgtaccctgcagagccacagggacggagatgcccaagaccatgggaacccacctcttgcatcagtgtgacctgaatgtgagacatggaatcagaggagatcattttggagctttaagatttgactgccctactgaatttcagacttgcatggcgcctgtagcccctttgttttggttaatttatcccatttggaacggctgtatttaccaaatgcctgtaaccccattttatataggaagtaactaacttgcttttgattttacaggctgataggtggaaaggacttgccttgtctcagatgagatgtcgggctgtggacttttgagttaatgctgaaatgagttaagactttgggggaccattggaaaggcatgattagtttttaaatgtgagaacattagaattgagaggggccaggggcagaattatatggtttggctgtgtccccacccaaatctcatcttgaattcccatgtgttgtggcagggacctggtgagaggtaattgaatttcggagccaggtttttcccatgctgttctcatgatagtgaataagtctgacaagatctgatgattttaaaaatgagagtctccttgcacaagccctcttctcttttctgctgccatgtgagatgtgccttttcccttctgccatgattgtgaggccttcccagccatgtggaaatgtaagtccagtaaacctcttatttatttattttttttgtaaattgtgcagtcttgggtatgtctttatcaggatcatgaaaacagactaatacagggttagaattcaggaggacaattacttttgatggaagtcgattagtggaccagaaggtactatagggcacattctcataatgtgttatttcttgttctggattacagatgccaggcatttcactttggaaaaacattgagcactgtatttagcatattctcaattttccctgtgtatattataattcaatgagaaaaaagacaatagaatatgtatatttttaaataacttggtcacatcacattcattgttatctacaagctgtttgttggtgaaactgtattcaacaaaagaaaattattttaacatataaacacagttaattttaaaatattttttattttttgagtcagactctcactctgttgcccagctgcagtgcagtggtatgatccctgttcactgtaacctccacctcacgggctcaagcaatcttcctgcctcagccccctgagtatatggaactacagacataagccaacatgcccagctagtttttgtattttttgaagagacgaggtttcaccacgttgcccaggctggtctcaaactcctgggctcaagtgatcctcctgcctctgcctcccaaagtgttgggagtacaggtatgagccactgtgcctggcccaaataaattcttaaactttttgataaaatagccctttgcatctgagatgattgataaggccataggtaactatgtttaaaaattttgtatctgtatcttggcagagttatgattttattcaggagagtagataaatttataatggccccatttgcaattatttacacttactggggtatcaagccttgtataaactaaagccatagcattgttcagatttctagtcacatatataaagatcgttgctatttcattgaggaatcattattcctataagattgttattttctttcttccttgacatttcttattatgtgctataaaatgttaacagataaaacataagttatctgaagttgtattttggctcttaaaactcacagagaaaatgtatttaatttcatgggaaggcagaatcttcttatttgtctaatattatactttttggttgaaaatattatatggcatatgctactccttatccccaagcattcttcacagtaaaattagctgaggctcatgaaaaacatgccagctgacagcacaggcaggagatgaaccccaatcttttgattccccagcctagttacccttaccataaaatggtggcaaaggttgactatttgtataatggccaaaaattattttaaatgctgtttcttactataatgaaattaattacaaaaaagtcagaacagagactggaagataggagatttattggcttaagtgctttctggaataacaccagtgagggtgaaggatacagaataacaccagtgagggtgaaggatacagaattggggcaagggtgggattgaactggtgatgctgtttaatggagacctcagctgacctgaggctgtcctttagggttgtcctaaatgaagcaagtggggctggccttctctatcctgactcaagtaatctttcatgcaggctatttccaagaagtggggtgtggccttgggtgagcgacttaatttggatgagagcattccttgaagaaagatttagatctacattacatttctagatggtattgcacaatcggatgtaactatttggccattttcaacccattttcttcttttgtaagatgccgaaaaggaagaggggaataggaactaggaaggatatagattgaagcagattagctgtaagatcatttaaagtatgagaggtttttgggcagtatcttgaattttatatatttgtcacttacctttctctgtaaatatttgagggaaaaaaaggaaatcattctttaaaggaaaaagaagtctcaaaaaggtagcctgaaacatctagcaaaaacactgaagcaaaggaagttatacactttgccatggtaatggctactggtttctgggctttctagaacattcactatgagagccaatgctctccttccctttcccaccatctgcattagtcacttggctgtagaacacaaacagtgacttggagaagctgttgagaagtgaaataaagctacatgagaaagggcagatttttaaaactggagttctattgactctaggtgctgtcctaccaggaggcctgcttctacacaaatggacattgagagggactcgtctgtgagacgatcatccctttgactcatgcatataaggtgcgagaaaccagcatcctaagattggtcccagctcaatagtcttctgagactgggcatttattccatcacccttcagcccttgtggatgcccacaaccaaccaagaattctttcctaggagtaaggagtgcatagagccgttctagtatgataaatatcaacagcacacccattttcaactattcagaactgtaggaacggtggtgagaaaaaagttcaaagcacacttaaatttgcattagaaatgatctcattacctaatacatgattttaaatactaatctgatcaattcattatcaatatcagtttttattctttgagtcttcgatgacatacttcattccacctcttactctgaattactgaaaggaacagtattttttattcaaactctataggcacacaattcattatgcattatgcaatgttttgtgcgatgccatggctctgtataaaaatggaattaaaaagttgttaatgaatgggaactggagacctagatgtcgtttcttggtagctctataagcaaataaattttcaaacaaaattaatctattgttaattctattggactaagaaaatcagcaagtcagtagagttatgcagacacagtcagagcttaaaaaggttcctgtagagagtacagaattgtatcttttgggaggattttacaagataagaagtagtttgtttttcaaagatatagaagtaatgaagaagggatctgacaaagggttggtgaaagtaaatattttagatgatggagtataaaaagtataccaacttagcttctagaaagagtttctattgcaatgtaaaaatacagatatccttcaagacttagattacctaattatttcttaattcctaatatcttagagatttcttcaacaaaatggaccatttcttaaacctcacaacatttcctatctcacacaaggttttggagatctgggggtaacttatgaatgactaaggcaaatggattcacaatttgttgtggaaatctttctggtctgcttagaaaagaatactgtgataccttaagctcatttcaaaggaattccatggaaccagatcagagtctatatctttcctatggcctcatcttctgtctaatatcatggagccaaaatgtacacctggatgttcacaactatttcatatatctgggcttcatagacacatctcatttgagaagatctcagctgaaaaggtccagatagaggagtaaaggtccagatagaaggagtatagtaggagattgcaggggtcttaaagtttccttctcacagttcaccctatttgatcttaacacatagctcctgctgtggcaagcactaagccagccagtccacattctgtctcatcttggaaagcgtgtataaaccacattaaaattgggccagatagacttcaataaatgccttccttcagcttataaatgacaaaacaagaacttgaactagaaattatctttctcatgtcaaaaatctttcagggtcatacttccctcaggttcaaatttgaatttaaaaactattatttattttcctctatcttaatgcatagcactctttttttcaaatgtaagacaggatgttttaaacaatattttcaattaaaaaagatattcaatgcagttttggatggatctgttgcagccttgcaaattaattacaatgcccaacatttatggggtgctgacttctgaccctgtactctgttgcacttctctgtggatgatctcttaaatcctcacaaccacatcataaaatcggtactccattgtgcagatgaggaaactgaaaaacagagcgtgaataatttgctcttcaacgtgtagctattatcatgtaacaaattactcccaaaatgtagcaacataaaataattattgtttattttctcaatagtatctgagaatcaggtatctaagagcagtttagctaggtggttcagggtcagagcttcaagttgtttcatgaggtttctttcagtgtcttgagctgagggtctagtttctcgctacatgggcgtatgcacaggtctgccagcctgtccttaagacataacacctggattccccaagacatgacacctggctttccccagcatgagtgatctaaaatagagaagagaggagagagagagaaaaacagagtgagcatgtacaatctttttaaaccttatcttagaagagacataccatcatttctgccacattctactgctcaccagaccaatcctggtaaaatgtgcaagggaacccaacaggcatgtgaactccatgaagtgggatcagtgggaggcatctttgacgctggctatgatgcttattcactagcaaggagtagaactaggtaacgaatccaggcagttttacttcagcacttaggactctttaccattatattaagaataactgcaaagcacatatttatgaatcttagggcttttccaaaagcgaccctctatggagtttgtggatacttgtgaatgtcattctgtggcacttgcttatcaaagaacacctgaaaatgtgaaggagatatgaatatcaaggacaatagaggctaaatttccaaatgtcccagataatatacaggtcattgtggaaaagagaagataaaaagaggcagaatgaaaaatcatttcagttaagctctttcatttcgacataccattatctttgtctccttcgtctcctcaacaaatctctcaattctgtcaagtaccatgttgagaaatatctagggagggttttattatttcttaaacattgtagcttaaaaaaatctttacttttgatttcctataggtagtatttagtgctaacattttagaatattatggaagttttcaaataccaatgtgccttgttcagggagctaagtaatttggtgagggaatttctacttgaaaaattttgtgcatcaatgtcagagataaattcaattgtcagaaagctgtgtcagaacagatttcttgtcatattttgccgcagagcagagatttattgaaaatgcttgatgatatcgctctctgagctgttttacataaacatagcagtggagtgaatgctttgagttgaagcatttgtgtgtttgtgtgtatgtgtgtgtttgtgtgtgtgtgtatttccgactttcaaaactgacgtcaaggggaaaaataccaaaagatatcctaatacctaatgttttatccaacttactttaagaatgattattttttgttataagtaaatgtagacttctgtgccttttcagaaatgaatcatagaataaaatacttcaagatcgaagctttgggatactggctattctatctgatgtcacaaaataatgaacacttttgagatgcagaaacatacaacagatttattatttttgaaagaaggtttattatttgtaaaccctttgtaatcaggtcagcagcaaaaatacaaaactattagaaagtaaaatttctttcttcagtaatgaaagacttggaactgcagtgtaagttcagtctctagagtgctctcagcactctaactaaaagattatatggcttgcaaaattgttttatgtttctctctccaaatttgtttggctccaaatcagaagatacgtatgaaactctttttctaaacgtactgtgaaacatttgttaataatattattgcttgtattataatatactcattttgataataaaatatagtatgcacagtttgtggaatgagtattttctatatttaaaggagactaacattgtcacatttatgagtaaaaagtatcaatactgggaatgttttgcaatctagcaatccactttaatgactgcagtgatccatttgatcagtaagacaggtgaaataattcagttgactgcctcagagtctgggaatttgagttgtttaaaaatagactttatgctctggtatggcttatatttacaaatgtgttcaactacattattattatcattattattatattaactatataccccaggagagtaaatcatatatcaagtcactctaaaagtctccagtgtgttaaaatgacagatttctaaataatactcctagaaaatccttcatattaaactcacttgaaaaatatgaagtatctctagcactgtcctagaaaagacacaaagacaacaaaattataacttatttctttaaggaatttataacattttggctggtatctggtttgaatctctgattctttttaaaagtttccttgtcattttttaaatttccctttttctggagtctgtttacgtgtttatatatccataatgtgcttttcataaaatatctttattgaggcattgtgctttgtactaattactctcaaatgttcattcatgtcttctctaaaataatttagaaaaactatgtatcccctcatatatttaaaatttgacacttaaaatattttgttacacattaaatacctgtgaaagatggaatttttctgatgtaacatgcttttaaaccaatctaaaagcacaaaaataccatagtagtttgatatcaacatcatccccttaaaaaatatgtgaggaagtgccttgttaacagatagaagttaacaccactcatttttctccttgaactggaatctacaatttattttccccacagattaacatacaaacatgatctatttttatgtttgtgggtctttttttgattatatatctatcttatttttttgcagcataaaatttatataaaccaaaattttattttatgtttgtatttccagtgactatgagtctttgttaattttctttcctatggatcttgttaacattacaattagtgtttctccacaatggcatatagcgtaaaattttattggagtgttatcacttaatgacatgaatggggctttttgtacattaattgcatacatccatgtatgaatgttgcttattgcattaattctattccagtgtgcttgttgttgatctaaacactgtgaaacctttgcctatgtttgcatagatagatagatagatagatagatagatagatagatagatagatagatagatatagtgtgtgtgtatatatatatgaatgagtactataacaatgagatctttatagcaatcactgaacaatttgaacttctcccaaattacatgccaaaatcacattgtgacttcttattctgttatttttgataatttttcaactaacaactacctgagattttccttcaattatgctctaaatgaaaatgttagaaaccacctgacttgcagaagtatttgttactcattcaagttatttactttcttgttttctaggaggttcacaataaaaagctgtaccaaaatttatcagcaattttaaaataaacttgaaaattgctttcaccgagaggcactttttgtaacaatatataaagacaagattaggttgccttttcttttggtgattatttcctttgctgtgcagaagctttttagtctggtgcagtttcatttatttatttttgattttgaagccaagcttttggtgtgaaacctaaaaagatcataaacaagaccaaaatcaaggagcttttcacctatgctctctcctaggaattaacttctgggtcttacatgtaggtattttatccattttgtgttaatttttctgtatggtgtgagataagggtccaatttcattattttcaatgtgaaaatcattcccccagcaccatttatggaagagactatacctttttaacataatttctaatcaggaagtgcagtgcctccaactttgtttttctttctcagtattgctttggttattcaatatttgttatggtttcatagaaattttaagatttttttctatctctgtgaagaatgccattagaattttgatggggattgtgttaaatctgcatattgctttgggtagtatgaacctttcaacaatcccatttatatgtgaaatatatgtgtgaaataatacatatataagctcaaatacacagagatagagaatgaaacagtggttcccacaggtgggagggggagaggaaatggggagatgtaggccaaagaatgcaaaatagcagacatgtgagatgaacaagtctagagacctaacctacagcatgagaactaaagttaatacaattgtattgtattagggatttttgttaaataagtacattttagctactatgttactttgtcacaaaaagtaactgtgagccgatagatatgttaatctacttcactatggtaaccaacctactatctacatgtatctatatgtgtctcaaaatatgtcataaacctctaatatacacaataacatgtatttttaaaaaaattctattaatgtcatcactcctctacactccaaagcaagaatttgtgatagaacaaaaacccaataaaacccaacaattttttactgaaaaataaagacaagattaggaaaattgaaatatcacttagatcttcactaaagcaatttttgttgaaatgatttatctttaaatgatttatatttttattcaatttataggaaatactaatcatttaatctgattagcagagtcactcttcattttcaaaccagtccatcaaaatgctttatctgaaacagtctgacttcatttttcagtttaagtaaacatgttcaaatgcattttaagaaacgttataaatatactgaaaaataaattctggtatataatttcaatagctagtttactagaagcagcccttttaaaatcttttatcttttatatatttaatctgaattttcagttagaatttaaaagaaatctatatgttgcttctcattgagttacaatatgcagtgtaatttgtatctacaattataatgttataaaatgaggaatatgacaaaagaaaagattttcatttggtaaatgtgcatgcatgtatgtgtatgttgaactccagttattggcattaccatctaaataaataaaaataaattattaatttcatagacaggaatatactgctaaaactgatcattcaggtagctgacttaaattttgctttggcataataaaagatagggaatgctaaacattttataagaaaatataagataaagattgactacaattggaatatttaatatatattataattgaatagctattgaataatgaaattgaacaatactatctaaacctagaagatattttgtatgttttttatctgtgggtttcagccactgtaactaaaaaaagttgatattcctgaaaaacattcagttacacttaatatgtcactcacctgcactgatttgggtatttgaagatattttctatttaaagataaatcctaagtatgactattgagaaaacactttgcttctctctctctcgactgtccctcaagagcaatacattcttttacagaattaatggaaaattcccaacattttttcaacccactctacacaatatatttgatttgtgaacaacctaacctttctaatgccatagttcatccttaaaagaaagactaagaccaagacaaacaaacaacatgaccgacataaaatgttaaggtggatttatggtaacttgattaactgtttctttgtttggagccctggaatgttttaaactgcagggtaatatttcgtagtatgatgcttgagggatgagctgtcttttctaaagtaaaaagtgggattggtggagagaggtaagtaagggaacctagttgatactatgaagagtgtgtatagatttgaggatctgaaaattccaccgttttcttttttgcttgttgagtgaatacataaggttcaaaaaacccattaacctttttcttttgcagctgtcgtgagcgccatcccggtgccaacgctagaaagtgcccagtacccaggaatcctcccgtctcccacctgtggatatccccacccgcagttcactctccggcctgtgccattcccaacactctcagtggaccgaggtttcggagcaggaagaagtcagtgtaatgcattttcctctctttttaataagcacaaatgaataatagcaaaggtgtcttgtaaaatatgttgcattctgaccttatcccttagaaaagttgatttccctatgactgtggtactagaatgttcctttccaacacagtgctttggatcctagctcatgtgcatttgtactgattccctaggcacctttccacagcacactccactgacaatacaaggggaagtggtggggaaacaaatgtcaagtggttccatcaaacaatgatgtgatgggtacttgaaattaatatgtcctattaaataggaaattaataatcaagtgatatcttccaacatatttggtatctgttggttatgtctcactgattgctgatgaaccaataacttgggtgaatgctttagatttctttaatcaggtaagtgatactttttcagctttaaaaattaattatcagaaaaaaaggatttccagggtattatttcatttctttgaaggaaggtaggaatgaaaagagactctcaagctattatatacaccctggtgatttctgctgtgccatttgactctttttttttttttttttttgagcacagtgttttaaaatctattttatggttttcatctcttagaacaggtgactcagcagctcatgtgagataggatgttttgtaatagatatgatagtaacaacaataaaatatatttttgaggtaaggtatatttttctaaccaaacagggacagctctaagaaatcataaatcgtctagatacagcaaggttagaattaaaaggcatcaaagatctgccaagggagaattagatttattttctcttttctcactgcacataatatctacagaatagagttgtgtgcaaaaactcgaggaaaaatagttgcccaaactgcattgaagggaattaaataggaaagatgtagaaagtctaataaccaaaattttcaaatcccaagacaactggaaatggaattccaatcaaagaattgagagcccacaagtgccttcttcacttctaaaatgaagctctctgcaacaaaaaaaaagacaagttttaatgttagtttagtattcggtctattggtttgttgtctcctacactcttttgatttcttgtatattctctgactttaaagggaaacatgaaaagaatgtgtagactttcagaggctgaggtgggcagatcacttgaggtcaggatttggagacaagcctggccaatatggtgaaaccctgtctcttctaaattagttgggtgtggtggcgcatgcctatagtcccagctatttgggaggctgaggcatgagaatcttttaagcctgagaggtggagattgcattgagctgagagtgtgacactgcaatccagcctgggtgatggagctagactctatttatttcaaattaaaaaaaaagaatgtgtagaatgacctttatcgggtttctccatcatgactggtacaagccaaaattcaggacttttaaaattagtaattcactatttttattcgtgttgtgttactcatttcttgtccctttttttaaaggcatagttttcttttgaaaatttattcattgagatccaacatcaatttactctttccgttttcctctttcctcttaaattggtgcagcatgtgaaactctctcttattgaatcatggggaaaatgattccaaaagttaaagctcaacgaaaatgaataaagggaattgactagtataaaatttgtttttatctgtggttaaaagtctcatgtgtgacttgtgattttgagagtgagtaggttgtgtgtatgtgggataggaggcttgtgagaaatctctgtaccttctgctcaattttcttgtgaacctcaaatgcctctaaaaataaaatctattagaaattaattgattgggccaggcgaggtggctcatgcctgtattcccagcattttgggaggctgaggcaggcagatcacgaggtcaagacatcgagaccatcctggccaacatggtgaaaccgcatctctactaaaaatacaaaaaaaattgctgggcatggtggcatgcgcctatagtcccagctactcaggaggctgaggcagaaaaaaaaaaaagaaattaattgattaaaatatttattctctagaagatgtttttattttttaaagtaaggattattaaataaaagtagttatacgacaaaatgcttagtgattttttaactttatctaaaatgaaaaggcattggatgttctactcctgcccaagattttacagatttttaaaataaatacatcttcagtcattcatcaagaactttttgagcaaagctatgcacaatgcaaagcaactaagatctaatatgtgttccaagtgactgtttaaaataaataacactcaccctcctttctaggaaactaaatattctctaaatcactgtcagaaacaattaactaacttcccatttcccgtcattccctattggtttctaaatgccttagagaacactaaacaaacattcctgttctctctcaagcagaaaacatttcatgaatctgggtggatatatcttattagtcgccttgggaaacagagaaaggcacacgtattaaaagaaaaagttgactttgccaaggtggaaactctttttcctccaaagttatctgaaagacctttgagttttataagaaatgaaatgaatcactaaagtcctattccaaaggtctgctgccttctgaaggcacaaataaagctgaatttctctccaaccataaggaaagaaaagatatggtacatacatttgcattacatgtattcgctgacctatcagtaaataatatttatatttatatagttgtgatggacaaatatttcttcttcttaataagtaactgcagtactgctcttagcctcaataagcaaatgagttatccctagggaacagtttagctgcattgtatttgaaaacttcaaccaatagatagtcttggggcctcatttctacaaatcagtacaaaattggtgcccccactttcttgtctttgaaacaagtaggtggtagaggagcagtttaagtgatttccactcttccttttagttctgacattgtcttaactagtgggaaggctggtcagctttattcatgctatttttctgcctctgttctccctcaaatgggaaatcaactaataaatgaaacttgacctagataaaatgaggagtgcaatggagttcatagagtaatctctagggtattttaaaaaaatacaggctgtaagaaactggggttatgtaaaaatattgtgttacgtcgttcttctgaggttaatgagtgaattgggtttctagaagtgttcatgactcagtctttgcttagagttattggcttgctatatttctatcaatcacatattgtagtttttatatagaagaaaattcctcatttccatttttataatattttcccagttattctgtagcaattatttatatgtattgacattaattattataaagtaccttgagatttgactctgctgtgtaatggtatgctatttgtataatgaattctgactatttcatcatgtaacaacaagtgccttgctagcatgtatttgattctcactcgatactctgaattgcagagcaggggcacgtcatggacaaaagcaggtttctttgctttcagagatcttggcagagctaaatgtcatgccactaagccaatttgttttgtttcacataggtgtcctaaagccagtgcctgaactggacaaaagtgctcatctgaaatgagagtatttcactggcggaccagttgctattgtatttgttaaagggtttttgctgccttaagtgtcaggcagttccaaaaagcatttattttgctccacttaaaatataagaattatgaattatagatggaaatcctatacctgttcattgtattcattttgaacacaacagaaattgtcccttagggattggtgatatattccgtcttgaggaagggccctctcactcctgtctagtacattaggcactttcctattctccctatgtggtactaaggatggattttgctaaagaggggacctacctatgtaaagccatttttacttctgtcaaagtcaagagccatatcatgatgtttgtttgcagccaggatcacaggagccagctgaaaacttggggatagaagactgggcatgcagacaatttttgtttttggagatgctgatgaggagcaatggcgttaaagagtaggattaggaaaaaagaaaattcagtggcgtaatcagaattcatgtgaaatatgaaagttttcaaaataagagaccaaatttcaaaagactaacaaatgcatgtacattctattaaacttacaatcacaataatgtagatttctttattatactttaatttctggggtacatgtgcagaatgtacaggtttgttacatagatatacacgtgccatggtggtttgctgcacccaccaacccatcatctacattaggtatttttcctaatgctatccctcccctaccctccaatccccgagaggccttggtgtacatgtgtcctcattgttcatctcccacttatgagtgagaacatgtggtgtttggttttctgttcttgtgttagtttgctgagaatgatggtttcctccctacaaaggatataaactcatccttttttatggctgcattgtattccatggtgtatatgtgccacattttctttatccagtccatcgttgatgggcatttggattgcttccaagtctttgctattgtgaagagtgccacaataaatatacacatgcatgtttctttatagtagaatgatttataatcctttgggcatgattctgggccaaatggtatttctagttctagattcttgaggaattgccacactgtcttccacaatggttgagctaatttacactccaaccaacagtgtaaaagccttcctatgtctccacatcctctccagcatctgttgtttcctgactttttaatgatagctattctaactggcctgagatggtatctcattgcggttttgatttgcatttctctaatgaccagtgatgatgagcattttttcatatgtttgttggctgcataaatgtcttcttttgagaagtgtctgttcatatcctttgcccactttttgatgggatttttttttattgtaaatttgtttaagtgctttgtagcttctaaataaatattagtcttttgtcagatggatagattgcaaaaattttctcccattctgtaggttgcctgttcactctgatgatagcttttttgttgtgcagaagatctttaattagatcccttttgtcagttttggcttttgttgtcattgcttttggtgttttagtcatgaagtcttttcccgtgcttatgtcctgaatggtattgcctaggttttcttctagggtttttatggttttaggtcttatgtttaagtctttaatccatcttgagttaatttttgtataaggtgtaaagaagggatccagtttcagccttctgcatatggctagccagttttcccaacaccatttattaaatagggaatcctttccccattgcctgtttttgtcaggtttgtcaaagatcagatggttgtagatgtgtggtattatttctgaggcatccgttctgttctgttggtctgtatatctgttttggtaccagtaccatgctgttttggttactgtagccttgtagaatattttgaagtcaggtagcatgatgcctccagctttgttcttttttgcttaggattctcttggctatgattctcttggctatatgagctcttttctcgttccatatgaaatttaaagtagttttttccaattctgtgaagaaagtcaatggtagcctgatggggtagcgttgaatctataaattattttgggcaatgtggtcattttcatggtattgattcttcctatctatgagcatggaatatttttccatttgtttgtgtcctctcttatttccttgagcagtggtttgtagttctctttgaagatgtccttcacattccttgtaagttgtattcctaggtattattttgttctctttgtagcaattgtgaatgggagttcactcatgatttggctctctgtttgtctgttattgatgtataggaatgcttgtgatttttgcacactgattttgtatcctgagcctttgctgaagttgcttatcagcttaaggagatttagggctgagatgatggggttttctaaatatacaatcatgtcttctgcaaacagagacaatttgacttcctctcttcctaattgaatactctttatttcttcctcctgcctgattgccctggccagaacttccaacactatgttgaataggagtagtgagagagagggcatccttgtcttgtgccagttttcaaagggaatgcttccagtttttgcccattcagtatgatattggctgtgggtttgttgtaaatagctcttattattttgagatacgttccatgtatgtgtccaggaatttatccatttctctagactttctagtttatttgcacagaggtgtttatagtattctctgatggtagtttgatttttgtgggatcagtggtgatatcccctttatcattgttgattgtgcctatttgattcttctctcttttcttctttagtagtctggctagcagtctattttgttgatcttttcaaaaaaccagctccttgattcattgattttttgaagggtttttcctgtctctatctccttcagttctgctctgatcttagttatttcttgtcttctgctagctttttcctgtctctatctccttcagttctgctctgatcttagttatttcttgtcttctgctagcttttgaatttgtttgctcttgcttctctagttcttttaattgtgatgttatggtgttgatttcagatcttttctgctttctgttgtgtgcatttagtactataactttccctgtacacactgctttaaatgtgtcccagagattctggtatgttgtgtctttgttctcattggtttcaaagaacatctttatttctgccttaattttgttatttacccagtagtcattcaggagcaggttgttcagtttccatgtagttgtgtggttttgagtgagtttcataatcttgagttctaatttgattgcactgtggtctgagagactgtttattatttccgttcctttccatttgctgaagagtgttttacctccaattatatggtcaattttagaataactgtgatgtagtgctacaaagaatgtatattctgttgatgtgggctggagggttgtgtgggtgtctgtttggtccagagctgagttcaagtaatggatatccttgttaattttctatctcattgatctaatgttgacagtgggctgttaaagtcacccactattattgtgtgggagtctaaatctctttgtaggtctataagaacttgctttatgaatctgggtgctcctgcattgggtgcatatacatttaggatacttagctcttcttgttgcattgatccctttaaccattatgtaatggccttctttgtctcttttgatctttgttggcttaaagtctgttttatcagagactaggattgcaacctctgctttttcttgctttccatttgcttggtaaatcttcctctatcccttcattttgagcctatgtgtgcctgcacgtgagatgggtctcctgaatacagcacactgatgggtcttgattctttatccaatttgccactctaattggagaatttagcctgtttgcacttaaggttaatattgttatgtgtgtatttaatcctgtcattatgatgctagctggttattttgcctgttaattaatgcagtttcttcatcatgtcaatggtctttacaatttggtatgtttttgcagtggctagtaccggttgttcctttccatgtttagtgcctccttcaggagctcttgtaaggcaggcctggtggtgacaaaaatctctcagcatttgtttgtctgtaaaggattttatttctctttcacttacaaagcttagtttggctggatatgaaattctgggttgaaaattctttaagaggccaggcgtggtgactcatgcctgtaatcccagcactttgggaggccaaggctggtggagcacctgaggtcaggagttcaagaccagcctgaccaagatggtgaaaccccatttctactaaaaatacaaaaactagctgagcatggtggtgggcacctgtaatcccagctactcaggaggctgaggcagagaattgcttgaacctgggaggcagaggttgcagtgagccaagatcgcacactgcattccagcctgggtaacagagcaagactccatctcaaaaaaaaaaaaaaaaagaaagaaagaaaattctttaagaatgttgaatattggcccccactctttctggcttatagagtttctgccgagagatccgctgatagtctgatgggcttccctttgtgggtaacccgacctttctctctggctgcccttaacattttttccttcatttcaaccttggtgaatctgacaatttgacgattatgtgccttggggtagctgttctcgaggagtatctttatggtgttctctgtatttcctgaatttgaatgttggcctgtcttgagaagttctcctggataatatcctgaagagtgtcttccaacttggttccattctccccgtcactttcaggtacaccaatcagacgtagatttggtcttttcatatagtcccatatgttttggaggctttgttcatttcttttcactctttttgctctaatcctctcactttatttcattaagttgatttcaatctctgatatcctttcttcccaagctggctctctagattcctcgtctctgggcagggcatctctgaaaaaaaagcagcagccccagtcagggacttataggtaaaaaccccatctccctgggacagagcacctgggggaaggggcagctatgggcacagcttcagcagacctaaacgtccctgcctgacagttctgaagagagaagtggatttctcagcacagtgtttgagctctgataagggacatactgcctcctcaagtgggtctccatccagcccatgtatcctgactgggagacacctcccagttggagctgacagacacctcatataggcaagctctggctggcgggtgcctctctgggacgaagcttccagaggaaggtacaggcagcaaactttgctgtcctgcagcctccactggtgatacccaggcaaacatggtctggagtggacatccaacaaactccagcagacctgccacagaggggcctgactgtttgttagaaggaaaactaacaaacagaaaggaatagtatcaacatcaacaaaaaggatgtccacgaagagactccatccgaaggtcaccaacatcaaagaaagaccaaaggtagataaatccacgaagattaggagaaaccactgcaaaatgtctgaaaattccaaaaaccagaatgcctcttctccaaaggatcacaactcctcaccagcatgggaacaaaactggacagagaatgagtctgatgaattgacagaagtaggcttcagaaggtgggtaataagaaactcctccaagctaaaggagcatgttctaacccaatgcaaggaagctctaacccaatgcacggaagttaagaaccttgagaaaaggttagatgaattgctatctagaataaccagtttagagaagaacataaattacctgatggagctgaaaaacacagcacaagaacctcgtgaagcatacacaagtatcaatagctgaattgatcaagtggttgaaagtataatgtagattttatttcaaaaatgcagaaaaagtagaaaaggaaaaattgaaagaagggagtaaaaaaggaaataaaacatcataaacatattgtccctttaatggctaaaccagtgtttaaaatgtaatgtgcattaattgcaatccatattcaatagagagaattatttaaggcagatttttgaggaaaattgtgaaatttctttccctggatgaatatttttaatgtggcatttatagaccctttaatgaaaagctagcccattggagataaaggaggaacctagagaaatagccacaggaacatcatttgtgagacgcacaattcacagaggaacacagaagccaaagcattttcacttccccagaatttcttctgtgaaattacaaactctttctgatgaataattttctccaatccaacgattatcttgagaatcctttgtgaaagagcctgccttttcctcctaagcaatgcctgcaatctaacatttcacaagcatcctctgagacctgtggttggaaggaattgctatcaaggaggcccacattaaggtaaactttcttatgggaacaaagagtgaggagaggacttgatgtcatctctttcaggccagtgccacaaagatgcccaaagttgggtcttggctaaaaattgaccatcggtcatagtctcctttagattaaatgagtcaaaagtcaaacctgagtaattttcattgtctctagaaccacactcacaaaaatctcattacatgacactgtttgaatacaagcacacaagtgtttctctcccctttacagtcttaaaagaaatttagtgccttgtataacacctacctaaagcctcgcatctgaaagccaacatcaccaaggatttgccttaatggtttacttgcagccctacactttatccttaatactgtgcattcatttgctctttttcttcttctttggtaagaaagatttcctagcctggaaataaggcacttctcttcaaactccttgggattctctcatttgctgccttgattcatttcccttgttcaaagaaatcttttatcaagtctctgcctgtattttggctctgattgctatatggctacatcctgtgctcagccaaccttgtatctatctttctaccttcatctctgaatgggataagcctggaggctgctcaatgacccagaagacctctaaccccttctgaatatagaagaatgagtatagataccctctgaagacacatttcacttctgcataactttaattctatgtcttgatcttttgtatcttaaatctctattcccttcagaattatcagattttctatttcctctgccctttgatgacctccttgagcctccgggagacttgtctcaaaattatctcactaattatcttgaaatatttcctggttaaaaattctctttcaaaagcaagatattatcttatatcactgcattttgttttgatttatctgacaaaactttattaagaaataagtcatcagaaaaaatattttattaatacttaaacctactatgcagctcgttttgcttgcagtttaacctggacctgttaactttgaatatgaatgaatagttcaagttcaatcactgtgtcattaacaaggaaaacttccttgaaaatattttattctgtcttaactgtgttctctggaaaaaaaaaaaaaaaggtgtatttccatatacaaagcttttcaaatgcccataggcactcacagtaaccgtgcagaacctcttcaactaccgtaatctgcctgaaaattacaaggtttactatcaaagaggaaaaattgcaattccgcattcaggcaacttgttctggcagagtcatctctcatataactttttagctagatgtgcctccattttgttatggaagataatgatagtggttattatttgtatcattttattagcaatgcctctgagcatcctgtaactctgatttgtttgacagttgacatggcatgtttaaatcacagaaaaattggctggtagaaaataatgcagctgtaacagggtttggtacattgaatttcactgacattgctacttatgaaaggagaaataactcttttttctcgcttcatcacttatgattagagggcccagacagttcaagcaatatagtcagtgctcaatatattttactattctttctcaaagataaattcctgtcctgctggatctatttctattgtttaaaggggaagtgctgtcatgttccgtaagtatatgaaggtagacgaatgacaatgttcataacttggagaagagactgaccacatcctatcacatctctctgaatggatgcagggactgttccagtgacttaaggaaaacagactttgtccaggaataatgaatgacttttcttgtctccactgcagcagtgagtgaaggaccaactacccaacaaccacctatgctgcccccatctcagcctgagcattctagcagcgaggaggcaccaagcagaaccatccccacagcttgtgttcgaccaactcacccactccgcagctttgctaatcctttgctacctccaccaatgagtgcaatagaaccgaaagtcccttacacaccacttttgtctcagccaggtaaagtactcggttgttcacctttaaaattcttattattattggtgcctctatttaagtgcatgagggtgcttgagaaggcctagatgtcatatatcttttcaatgctgattacatgcccagtgtgctcatttttgttactgatgcttgtagtgtaacccttaatgacccacctcccaagcaactgattggttgtaggtgcttttcatccctttggaaagttgtccatgaatcctggaagccagtccaccatttttaatatgtgctataggtgtgcttgctagagaatactggaaacattcctgattccctaacttcattctgccacatgagttctaagcgttaaagctagactgcaagactagatgtaaaggtataaaaatctgcaaaaccactttttagagaaatcataattctaatttgtgcctttcaatagtcatttctcaggagttcttatttatttcagagtactaggccacaaagaaatgtcagaaccagtgctgagtacaactcaattaattttaaaaatgaagaaactaactaacatttagattgatagaaagtaaaatatctatggtcctttctaagaaaataagatggcagggatgggaaatgagtcccagattcccaatgcagtattgattttattacttcagctagtatccaaattgagctccattttgtttttgttaggggttgaggagggggagagagaggcagagacagaagaaggaggagaggaggaaaagaagaaacaggtagaatgaatgtcaatagataagtagagataaataaataatagtacttaaaattatttggaatattagaataattcttaaaatcctcagtatatcaggcataagatagtaaatttcagtaatctgagatggcctccttgatgagcataggcagctgaactgggctaatctacattatgctcatacatttgactaacttttctgttactcagacctacaataatttattttgttgcattagtacacaagccacataatgactgtaaaagctagaaaaatgattgtctatgaagtataaatattaattattttatattaagaatgtatctagttgctgggatgacattagttgatttgtacacatcacctctgatgttctcaacattcacatgatgtgcaatatggatactcagctacacagcccctgggaggtggagtggagcatgaaagcatgtaggattccattggttgggacgcacgttccactatggagtcttccttgacacataggctcagcacaggtcatgatttcattctacaagagatggcccttctcaccccagcaaagcccacatagggacttaaaaaggtctgtattgcccaagcccctctctccaccctcccatgcatacacactccacacatactacattatggggaggatctgctactttatatggccccaaaactatgaagtctttgataattgaggcagagacaacttgaagcaagagcattcatttactgaaattctggtgccaagagtatgcttccttgtgatttctggctgcatctgtttccccactgcaagcacaacccaaggaaacagaccttgaaggaaactagtattcaagatagttgacagcttaattgcaactgctaacaataacgagcctttaatgaatctttaatgcacctgcctataggacaggcatgattctgaaggcttattacatctcatttgatcctctaaacaactttgtaaggtagctattagtcttaaccccattttaggcacaaggaaactgagacacagagaatttaagtagcttaagtctacatagcaagtaagtaatgcatcttttccctgctctcctgggttctcaaattttagaaactcatttgtgcctcttagtttatgtctaacttgtttaataagaaaaagactaataaaacgactaaatcattaaattaaatcattagaagaaaaaatcaagaaacatcttaaaataattctgaattgaagaatatattttctcatcagatttcttcactcacattttaatgaggaaaggtaagaaccttaactattctatagtaaagaggaccaatttggtagcaacaaaaagtaaagtgcggttgcagcagtttatgctgttaatgttctctcggcttgcaagtaaaaactttaagaataaaacagctgaaaatgacattctggaggctactatggctactttaaatgaaaaattttactgcaccagtgatgtttagtttgggacacaagatttggaagtcaacctatgctctgaagtgctacaataacaaaaggatacaattttttttaaagaagatttgatgatagatggagcagagaattggcatttttttactagttattttcttctaattacattaatgccaaagctgcctaaaacaaaatctgatacaatgcagtataagtggattatgtccttcatagaagggaagtagaatcagttgtgctgtttctatactaatttcatcaaataataagcatgtctgaagagccaaagaaccattctctgatctaatggcaacaaggcaaaatctcgttttcttttattttcatggtacccttaagatccttcttttgtttttatttgaactatttctctcaagccatctcttctttcctattttcagatatctctggctagagtttttgtttgattttatgttttttatagctcctctttaaatgccactcctctcccccactcaactggaggcatgccccgccatccctttggaattattaaattctttttcctttagtgtttctctcttattgtcttcctatgattcctgttcatttcataatgtcttacctcatgattttcaaataagttcttcctgcattgctcctgacacatggtaaatagcatgctttttaaaagggctaatgtttacttattctgatagaaaaagaaaattagcagactgacaaatgtattagctgtgacattaactacatgcttcttagacttaaagatgaaatacttagagctttcaacaagttttgattctaagaaaatcattactttcctcaaaccgattgatgaagtaaagtcattctcttgtcagcttttaaaaaaaatacctcaaataattttactgtggatttcacaagaaaggactgcataattagtgatgaatttatctttacttaccgcaagtaattactttagaatatggtaatgtgaggcattgctctaatttttaaaaatgagaaacttctactttgaaagctttgagattaggatcaaggaagaagctctttccccactcaaattcctgtgtgtgaatttgcttttttttttaaatttattttattttaggttctggggtacatgtgcaggacatgcaggtttgttacatagttaaacgtgtgccatggtggtttgctgcacctatcaacccatcacctaggtattaagccctgcatgcattagctatttttcctgatgctcttcctcccttcaccctacccaccgacaggccccagtgtgtgcagtgtgtgttgttcccctccctgtggattttcatgggcaacaccatcagtctgtgccttagtttgcctcccaataaggcacacagagctatgcttgcagcagttttacatgggtctagggcaaaacatattatgcagtaatagtctccatggggttgcagagcattttgcaatatttttatagtaagcagtaattagaaagccattctgttgtcataacgactgaaattctgcttacctgaaaacagattcatttcctcaattttttttccttccacctgctgagttaaaaatgtaacttacaagactctagggtatttatggtgtttcttacaatttcatcatcaccttataatagagtgcttccattttttaatgctttatctatagacgtgaataaccgtgagatctttacacatttcatggaggctgcaatcactacactttgcaaatcacaaatgtagacatgtaagtgatttggcttagtccactttcaggttaaatagaaaatgtttgatagagtattgggcttattgcattatagatctgacataaattttacaaagggctaagatagggtgtgtgggtttttttcttctttactagttaaaattccttttagtgatcagctgcactttaaatgaacctgggttaggagaccatttgtcttctagagatgtaattctaaagggaaagaaaatgtgatctcttaaatagtgacctttatatcataatactcttttataacattagccccctggacctcttgcaactttgtaaaactccataagcactatattttccttcatttacacattgcattttacacacatatatttataaaagcaaaactccagagcattctgatcttttccatcttcaagggatcaatatgtcagtggacatgacaagtccaaaactcacttcattgtactgcgaaattgagtttgattttccccgtgcaaattgtggcatgtgctttaatttgtctgaggactgaagacaaggagggggtggaggtggctgacagtggacagaaaaggcgtttgatttatattttatggatggttgggaaatcatgtattcctgctgtaacctgatctttttggcaggccttatttcagtaaatctgctatcacacaaaactgccaataaattactataatgccttaatacaattgctttccctgagccactcgtaggctgccattgcgggtattcatcaagaataccacacgagtgttccattctgctaaaatcagccacaggcagaggtcatgggagatcagacatcctttagaaggtgacacaagacggtcattttaaaggccagtcagatagaataaatcattggcacagctaaataggagagatgtgttgatttgctgttattgaagccaatacttccaatcaatgctatagtggaaaattacactacatctaagtttcatctcatgtgaaagctatcggtgtggctttttggtagacatctccttgaaattttcctgtcctcactcctaacagaattaggatgattcgatttggtctggtcatcctaaattaccattggtaaaatgtaattaaggcaaatttaagtatcaataatgtttgtgactctggaacctacctacttggtggcttaataaattagtatttcctctgaggttttagaaaataaatattaataggaaaagagctctgttaattgcccagaggagagagaaataatttctagaagagtcattatgcgtaagccaagtaattgatgccctatttataagtgacaaagcagaggcctaaaaacgttaggtagcttgcccaaggtcaacaattgaggtgacagccaaatgtaaagaatttggagaaatgtttttttgtttgtttgtttgtttttttaactaactttgaagatagatagatacaggattttacctagcttttttgtgatgttaacagttattcttagagtgactttttccccccctaaaaggggtcttctaggatcctaataattaaatattctttaggaggaactacatcaggtaagttaagtcatttagctgagtgtttgagtaaacattttattcctttatgttggcattacatggagaggagatgttatagcaaaagtagcaactagctggagcactctggaatagctgccatctgcctttaactcacctgtccagtctgtctgtcgagtatccctctacggtaaggcaggaagccaggggctgacatctgacatctgttgctttcaccatcactgatggccaaggctttagaaacaaattaaaaaaaataaagatgagcataaagaagtatataagagtttaaggcatatgggactattgcttacaatgggagttggagagtgtgagcataggtcaatgagagcaaaaactgaacagctagtatttttcagaattgcaaaaacttcttttggggagggagtgaatgactgcagtagaaaagtttgagtcccttttatgaaaggtttgcccaattacaagaaaatatcgcatcaagaattgttagaccatatatgaaactgaagttaactatatcaacctaatacaatgaaactctgaggttaaagtattcagtggccatccagataatcgtaagagaaagtgaaaaataataaataatctattttcagaactttgtaacctaatagaagacataattcgaaacatgtaagctacaaagaatgtacttggattatactgcagagtgggtggccgcatgagtgacagaaggaatggtgaaggaaaggtgggcagtaggttgttttcaaggcagtaaatattccttttacatttcttatacacttgatgggtcacatggttaactactgctgtatagattttgttgttgttttgaaatattttgaaaataaagcatctttttaaaaatcaacttacataaaagtagtaaggcttatgctttatactttgtcacctttttatagtttacagaggacatttccaaataaatgtatatctacctgagaagtaactttgaccagcattaccaatacagaggtcaatatttagagaggttgaatacctttcaacttttccagggtcatgtgtcattattcttaggaccttcatcgccacccttacatatggtggacactcgaatgttggttgaattggtcagaatataataaaataattaaggtgagagccagaatttgactgcagttcttcaatttcaagtctaataatgagtttagacaaaccagagcgacttgtaagtttgtaaggattagatatcaggtactagaaaaagataaaggcagatacgatgaaataacttacaaattcatgaacattttataacatgtttaataatctgaactataaatagcatcttatgctaaagccaaataaattgcatagagtggaaaagacacttgaaaccacagccctcggaaattcagtggtttatttttatgaaaataaacagacatgcagtggcctccataaagaagaatagaattctctgcgttcatagaaaggaggcggccaggtgtggtggctcacacccgtaatcctagcactttgggaggctgaggcaggcagattgcctgagctcaggagttcaagaccagcctgggcaacacagtgaaaccccatctctactaaaatacaaaaaattagccgggcatggtgtcatgtgcctgtaatcccagatactcaggaggctgagacaggagaatcacttgaacctggaaggcagaggttgcagtgagccaagatcatgccactgcactccagtctgggtgacagagcaagagactccatctcaaaaaaaaaaaaaaaaggaggaggagtgtggatcagtggaagtcagtcagagtcctaaggactagtctctccatcatgccaactacagaactgattttgctcttctgaatctcacttttctcatctgtgaaatcagatggtctttcctctttaaggaggaaggaaacatgaaattctacaacctcagttactacagaaataagggtagatattctccctttctcctttttgttttgtgaaagactatgagtaagagaaaggttttaatttgaatattttgagactcatggtatacattttaagtattctaagtagttgacagatctttaaagttcttcaatgagcatcaagttacagttgctttctttggcagcaaggggaaatgttgaaataaagtgctcacataaacctctgtgctaatggactattgaaaatgtgttatgaaaaatctaacatactgaaagcaaacaaaaagtctctgtcatattaaacagtttaaccatcagcaacccatttctaaagacatgacctgtagtacctaaaagactgtgtgaaaaacagtcttcgatttgaatgtttataactcttatcttactagcagggacttataaacgaattcaggtgtcatgttaaacatcttgtgtgtgttccagcattgactttcatcttaggcttgcaggaggactgatgttcttatctccaggatctccttatttaccggaatatcaaggctcttagaggagaatgcctttatcttctgtggtaaaagggattctacaagcttttttggtggaaaacaatgataagtaagccctattcatgaaaccgtatgcctctcattttgaaatgaataattgcacgtacagacttataagaataatggcacttatagtgactgctatttttaatgtctttttcaaagtgctcttctaaaacattcttctttgacatttctgattcttttacccagcaagttttatgtatttttctacttctgaggtcacctgagtaagaattttctaacagataccactttttttttttttttttttgagatggagtctcgctctgtcacccaggctggagtgcagtggtgcaatctctgctcactgcaagctctgcctccggggttcacgccattctcctgcctcagcctcccgagagctgggactacaggtgcctgccaccatgcccagctaatttttttgtatttttagtagagacggggtttcaccgtgttagccaggatggtctcgatctcctgaccttgtgatctgcccgcctcggcctcccaaagtgctgggattataggcatgagccaccgcgcccggccgagaccacattttttttttagacagtctcttactctgtcacccaagctagagtgcactggctcaatcacagctcactgaagctttgtcctccctggcagtggttatcctctcgcctcagcttcccgagtaactgggactacaggtgagcgacacctcacatgactaatttttgtattttttgcagagatgaggttttgttatgttgtccaggctagtctcaaactcctgggctcaagtgatttacccacctcactctcccaaagtgttaggattacaggcatgagccaccgcgcctggctaagactgcatttttttaaaccacgataacctagtatgctcttgagtcaaaaattaacttttagttttagtgttgcacttaaaagaatatagttatttgtttattttctttttggctacgctctgagtggtacctcatttaatagaaacaggctgcttggtgcacacatgcctgagctgacacattagaatacttgataaatctggagaacacattgcctgataagttgagcccagtgaagttttcatcaccttatgagagacggtgagcagaggaggtcagagcaactgctcagagctgtctgaatgtcgttcccttagtctagagaaaagagtggcctctttcatttggacagggcttgctctcaaatcataaatgcatttgacagccaggaagccattttcactgtctcacttaaatggtcacactgcaaatgatcccaccacattacaatagcataggtccccagtaaggccttatatccaacaggtgtacagattaggtggtcactacctggcttcttctctctcataaatactgcatctcccgacttgctcctcacaatggaccaatttaatgtgattaaagcttctggagtttcctagatcccagctctaacttccagtttagctattccctgcaccaactctctgcaaagagaatcaatagcaaagcaaagagggataagaagtgaggagtaggaagtaagctattgaaagtgagaaaaagaggttatttctcattgagcacatgtaaaacactactgatgtctttgtcttctcactgaaaaattatacattttgtttttattaagcatgttacagtatgggtaatgtccaaacatgatttgagatataaatattaacttctaagctcagcatggacatggctatcaaaagcagtgtttctcaagttttgtgtgcctgggaatcacctgcagacattatgaaaaggcagatttagatttagcagatctagagtagagcctgaggttctgaattgctaaaaagattctaggctttgctgaggctgaccctctgcagattagattatgaggtagtttggattctgaacagattggatgctcttaacctggggttcatggaagaacttgtgggtttggtaactcacttgaaattaaatggatatttctctgtgggtgtgcctgtacatttttctagcaagtgagttcatagcattcattagtgtctcagatgatttattatctataacaggttaagaaccacttgacctgctgttttgtcatcaccctcaatgtagctcacctgtggaacataaaccaatgtctgtttttcttttgttttgtttttcaagatcagttccaaaaccttgtactgaaacaacttttctgaatctgaggccaaaagctgagtacttgtgctctactcaaatgaaactctgcaaaatttattcattttcatagaaacacctgaggctttgtacatttttcaacatgtgatgagggaattagttaaattagtatttataaatttgtccttcttctgcaacaatctcttatttttattgcctaaatgaacatcagtagatcagagccaccgctgtccatggtatattttctccaaaagatgagctcctgtggggaaatgggatgtgttgtccttcgaaaggggtcatcctaacctgtccttagcacccctcaaatggtacactgaaaagcacttcctgcagagacttaatgactgcacacacatttccccaaacatgactcatcatttaataaaaatttcccattcagccagtgtcaccccaggttgaacagcatatgcaatctgtaaaataaattttaatattttttctggtggtagggagggtaagtgaacccatgaatagtgataatgttaaatcacagagaatgggagctaattaaaataaatgtttatttgagcagtcaagtagttcaattgtattctataatttcccagaagatattatcataaatcatttattgggtataaaaatgccgtaagtcaaaagagtatgtgtttgaggaggctggagagtgctaaagaggagttgagagaaaggagtgcaaaaacaagaaagatatttgaagacagttttcatcctttgcattattcaaactaaagaagctctaaagccaagtactatgtttgtttgttattctttcccaagacttcagaaattttcacttccatgatactgtgatgtttatatttatattggctccccatttaaactggaacaagtctagctgggatcaacatagagaagacagcaggaatatgctgatttactcctattccttcttctacctctttcatcaccccctgccaccatcccacactataactgctgtctcttctccttctctctcactctcacatactcctctcctctaagattgtctggcctgttctgtttcactcagctttctatcaaagcctaccttgtagaattttttatttttgtctaagaaagaacatataatttaagccttacttatcagctgagtggctttgaacaagtcctttatcttctttgaattttgattttcctatccccaaggcatgagcaataaggtatgctttaaaagttctattttaaagaacagataagaaaatgtaggaaaaggtgttttactgcagtttatgtacctgtaggtgggacaaaggttacctgttttaccctttctctctctaggttttagtttataaaaataatagagacaaggtactgataaccagatgggaatcaaggattgcagagaatcacagccttttggaaaatggtaggagtaggtggaagacctcttcctccctccctgactacaagaatattcgacctgctagctgtaaactgaaacagacagtagagaggtggctgggacttctggagtcaggccttgccttgtttgcttaacaaatgcaattcttgtgaagtttaaggatagagggtcgagaagccaagatggccgaataggaacagctccggtctacagctcccagcgtgagagacgcagaagacgggtgatttctgcatttccatctgaggtaccgggttcatctcactagggagtgccagacagtgggcgcaggtcagtgggtgcgcacaccgtgcgcgagccaaagcagggcgaggcattgcgtcacttgggaagcgcaaggggtcagggagttccctttccgagtcaaagaaaggggtgacggacggcacctggaaaatcgggtcactcccacccgaatactgggcttttccaatgggcttaaaaaacggcgcatcatgagagtatatcctgcacctggctcggagggtcctacgcccacggagtctcgctgattgctagcacagcacggcagtctgagatcaaactgcaaggcggcagcgaggctgggggaggggcgcccgccattgcccaggcttgcttaggtaaacaaagcaaccaggaagctcgaactgggtggagcccaccacagctcaaggaagcctgcctgcctctgtaggctccacctctgggggcagggcacagacaaaaagacagcagtaacctctgcagacttaaatgtccctgtctgacagctttgaagagagcagtggttctcccagcacgcagctggagatctgagaacgtgcagactgcctcctcaagtggatccctgaccccgaccccccagcagcctaactgggaggcaccccccagcaggagcacactgacacctcacacggcagggtattccaacagacctgcagctgagggtcctgtctgttagaaggaaaactaacaaacagaaaggacatccacaccaaaaacccatctgtacatcaccatcatcaaagaccaaaagtagataaaaccacaaagatggggaaaaaacagaacagaaaaactggaaactctaaaaagcagagcgcctctcctcctccaaaagaacgcagttcctcaccagcaacggaacaaagctggatggagaatgactttgacgagctgagagaagaaggcttcagacgatcaaattactctgagctacgggaggacattcaaaccaaaggcaaagaagttgaaaactttgaaaaaaatttagaagaatgtataactagaataaccaatacagagaagtgcttaaaggagctgatggagctgaaaaccaaggctggagaactatgtgaagaatgcagaagcctcaggagccgatgcaatcaactggaagaaagggtatcagcaatggaagatgaaatgaatgaaatgaagcaagaagggaagtttagagaaaaaagaataaaaagaaattagcaaagcctccaagaaatatgggactatgtgaaaagaccaaatctacgtctgattggtgtacctgaaagtgatggggagaatggaaccaagttgggaaacactctgcaggatattatccaggagaacttccccaatctatcaaggcaggccaacattcagattcaggaaatacagagaatgccacaaagatactcctcgagaagagcaactccaagacacataattgtcagattcaccaaagttgaaatgaaggaaaaaatgttaagggaagccagagagaaaggtcgggttaccctcaaagggaagcccatcggactaacagctgatctctcagcagaaatcctacaagccaaaagagagtgggggccaatattcaacattcttaaagaaaagaattttcaacccagaatttcatatccagccaaactaagtttcataagtgaaggagaaataaaatactttacagacaagcaaatgctgagagatttttgtcaccaccaggcctgccctaaaagaactcctgaaggaagcgctaaacatggaaaggaacaaccggtaccagccgctgcaaaattatgccaaaatgtaaagaccatcaaagactaggaagaaactgcatcaactaacgagcaaaatcaccagctaacatcataatgacaggatcaaattcacacataacaatattaactttaaatgtgaatggactaaatgctccaattaaaagacacagaatggcaaattggataaagagtcaagaaccatcagtgtgctgtattcaggaaacccatctcacatgcagagacacacataggctcaaaataaaaggatggaggaagatctaccaagcaaatggaaaacaaaaaaaggcaggggttgcaatcctagttctgataaaacagactttaaaccaacaaagatcaaaagagacaaagaagaccattacataatgctaaagggatcaattcaacaagaagagctaactatcctaaatatatatgcacccaatacaggagcaccaagattcataaagcaagtcctgagtgacctacaaagcgacttagactcccacacattaataatgggagactttaacaccccactgtcaacattagacagatcaacaagacagaaagtcaacaaggatacccaggaattgaactcagctctgcaccaagcagacctaatacacatctacagaactctccaccccaaatcaacagaatatacatttttttcagcaccacacctattccaaaattgaccacatacttggaagtaaagctctcctcagcaaatgtaaaagaacagagattataacagtgcagaccacagtgcaatcaaactagaactcaggattaagaatctcactcaaaaccgctcaactacatggaaactgaacaacctgctcctgaatgactattgggtacataacgaaatgaaggcagaaataaagatgttctttgaaaccaacgagaacaaagacacaacataccagaatctctgggacgcattcaaagcagtgtgtagagggaaatttatagcactaaatgcccacaagagagagcaggaaagatccaaaattgacaccctaacatcaccattaaaagaactagaaaagcaagagcaaacacattcaaaagctagcagaaggcaagaaataaatcagagcagaactgaaggaaacagagacacaaaaaaaacccttcaaaaaattaatgaatacaggagctggttttttgaaaggatcaacaaaattgatagaccactagcatgactaataaagaaaaaaagagagaagaatcaaatagacacaataaaaaatgataagggggatatcaccactgatcccacagaaatacaaactaccatcagagaatactacaaacacctctacacaaataaactagaaaatctagaagaaatggataaattcctcaacacatacactctcccaagactaaaccaggaagaaattgaatctctgaatagaccaataacaggatctgaaattgtggcaataatcaatagcttaccaaccaaaaagagtccaggaccagatggattcacagccgaattctaccagaggtacaaggaggaactagtaccattccttctgaaactattccaatcaatagaaaaagagggaatcctccctaactcattttatgaggccagcatcattctgataccaaagccaggcagagacacaacaaaaaaagagaattttagaccaatatccttgatgaacattgatgcaaaaatcctcaataaaatactggcaacacgaatccagcagcacatcaaaaagcttatccaccatgatcaagtgggcttcatccctgggatgcaaggctggttcaatatacgcaaatcaataaatgtaatccagcatataaacagagccaatgacaaaaaccacatgattatctcaatagatgcagaaaaagcctttgacaaaattcaacaaccttcatgctaaaaactctcaataaattaggtattgatgggacgtatttccaaataataagagctatctatgagaaacccacagccaatatcatactgaatgggcaaaaactggaagcattccctttgaaaactggtacaagacagggatgccctctctcaccactcgtattcaacatagtgttggaagttctggccagggcaattaggcaggagaaggaaataaagggtattcaattaggaaaagaggaagtcaaattgtccctgtttgcagacgacatgattgtatatctagaaaaccccattgtctcagcccaaaatctccttaagctgataagcaacttcagcaaagtctcaggatacaaaatcaatgtacaaaaatcacaagcattcttatacaccaacaacagacaaacagagagccaaatcatgagtgaactcccattcacaattgcttcaaagagaataaaatacccaggaatccaacttacaagggatgtgaaggacctcttcaaggagaactacaaatcactgctcaaggaaataaaagaggatacaaacaaatggaagaacattccatgctcatgggtaggaagaatcaatatcgtcaaaatggccatactgcccaaggtaatttacagattcaatgccatcctcatcaagctaccaatgcctttcttcacagaattggaaaaatctactttaaagttcatatggaaccaaaaaagagcccgcatcaccgagtcaatcctaagccaaaagaacaaagctggaggcatcacactacctgacttcaaactatactacaaggctacagtaaccaaaacaggatggtactggtaccaaaacagagatatagatcaatggaacagaacagagccctcagaaataatgccgcatatctacaactatgtgatctttgacaaacctgagaaaaacaagcaatggggaaaggattccctatttaataaatggtgatgggaaaactggctagccatatgtagaaagctgaaactggatcccttccttacaccttatacaaaaatcaattcaagatggattaaagacttaaacgttagacctaaaaccataaaaaccctagaagaaaacctaggcattaccattcaggacataggcatgggcaaggacttcatgtcgaaaacaccaaaagcaatggcaacaaaagacaaaattgacaaatgggatctaattaaactaaagagcttctgcacagcaaaagaaactaccatcagagtgaacaggcaacctacaaaatgggagaaaatttttgcaacctactcatctgacaaagggctaatatccagaatctacaatgaatgcaaacaaatttacaagaaaataaacaaccccatcaaaaagtgggcaaagcacatgaacagacacttctcaaaagaacacatttatgcagccaaaaaacacatgaaaaaatgcttatcatcactggccatcagagaaatgcaaatcaaaaccacaatgagataccatctcacaccagttagaatggcaatcattaaaaagtcaggaaacaacaggtgctggagaggatgtggagaaataggaacactttgacactgttggtgggactgtaaactagttcaaccattgtggaagtcagtgtggcgattcctcagggatctagaactggaaataccatttgacccagccatcccattactgggtatatacccaaaggactataaatcatgctgctataaagacacatgcacacatatgtttattgcggcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcgcaagaacaaaaaaccaaacaccgcatattctcactcataggtgggaattgaacaatgagaacccatggacacaggaaggggaacatcacactctggggactgttgtggggtggggggaggcgggaggaatagcattgggagatatacctaatgctagatgacgagttagtgggtgcagcgcaccagcatggcacatgtatacatatgtaactaacctgcacaatgtgcacatgtaccctaaaacttaaaatataataataataataataataataataataataaaggatatagggtcttcaatgtcaatgcccaatgtcaagcccaagcaggtttaaaaacttgagtagtaaccattagtaccttaaccctctcgtctcatttttcacagacaggtggcccaatgaaagccacgttacttgtgactcagagtagccctttcttacaatgggaggaggagaaaggagcagagaggggagcagggcacctcatcagcacgtccccagtggtcaaataggctgtttcccttatttttgaggagaaataagaaggttgggagaagaacacaatgtttctctccccagaagtggcatttagagatgtttatcacccttaaagtacaattcacatggtagactaaaatgccttaagattgttgcaaaatttatagtttgaaattcgatcacttatgagggatgcctgaggctattgtgtctgagtaaatgcggctactctctttttgttcaatatttgttgaagatgaaagggtagagtattacacaaagtttcccatacatatcttttatttctcccatgccctcaaaagttccttgcctatcagaagtgtaaatgattatgtgacacttctatatctgcccccagataacccgagcacaggctagttacttaataataagtatatataagaataatattctggttcacagggaaactagactgagagagtccatttcattttgtctggcatcacagaatggatcagagacaaagcagagataagaacccaggcttcttcaaagccaccctttttaactttgttcttaagggtaaaggaatggaaaatgaagtaggaaataggaaaaagtggggaagatgtgagttaatagtgaaatcaaaaccatgctgtgcattggcctctgatcggaccctggtgagcatttttagagcattccggctgcagcctaatgtttctcaccccaaaaaattattttacatgggaaaaccttctgcagagagatgctagcaggagtctgcacctggcagtcctatgttatgtacctaatgagtaaatgaaatgtttaataactgtactgtgaaaatgaagcttaaaacagtaaattcctgctgaggctgctcttctgcacctgaggcacactgctagcccatctcagaactccagcccatttttattttttcctcttagtgggtcctgctgaggagataacactaaaaccaaagcgatgctcacttaattagttgtatatcagtgtaagaacatttacttagcacatcaacagccagcgttccaccaaagggtcgcctgaaacttctccaacatgcaccctggataggggaaattctgcagtggcttcagattgagcattcgtaaatttaaatttgtcaattagccatggatcatttaacctcagaaacgtaataccacttatttttagagtatctgtttgaaatacaaaagcagtaaaaccttaattgttggtatagcttttcactaataattttaagaaaaaaatgacagaacatttattttttacaaagcactagtttaaaaataaattattgcaatttgagttaagctttaactggctggagattcctttagattcaatggatcaactaattcttcctaagtcttaaggagaggcaagaaatccaaatgtaaagttaagtacaggtagaatagctatattatccttgtgtaattttcatagctaataacttaaaaattaaatttcttacatttatagacatacagaccccaaaatccaaagaaattagactatcgagccaaggtcacaaaactaggtcctaggctaaaatgcttcctcagtatctggaatatttatttgagcactcattaaatacttggaatttgttgtatagatcacacacagtttaccatcattgaaaataataatatagatcagcttagacttcagagtgggaaacgtttcatctttcaaggcctatttgcaaaatgaaaggtgatttttccaacttctcagagccccagtactgatcctcttctcactagctcccacccagccttgagcacctccctctcccaaaatgaagtgttttttttttttttcttaaccacattttgaaaatcacttttcatatttgggagagatcccagaggatgctgactccaaaattgagattatattcacagctaggagccatggaagagattcttttcatttttatttttcctttgacatatgtttctgatagagctcatagaagttctatgaaaagcgttcatgtttaggccaattgtcagtgttaagtgttgttctccaaagtgaataaataaatatgaagctttccctgtagctacaatctagatctaccaacatagaaaaagtcatcaaaaattctatcatttcttaacattaaagaacagcattttgatatcccaaagtaataagttttcagtttgtttttgtgttttttcctaattgccataatttctattagttcttgggtaggatggtggctctcttctagtgagtcaaaacactgccaggcacaccaaaggctctcatgcctcaaggcagtccattatcaagaaggagtcaccaagaatgggtgaggccagggatgcataaacaaagtgggctttaaacctggcttctgaaagcagtgtagaaaaaaaccagttagtctcccaggaagtgtggcaatgccccatttcaatgtcaaagtctttgaaatctaggaaagcttcatgtggaggaacagatcggggttaggacaaatagtcacccgacagtagcagtgagtccatcagcagatgagaggccgcaatatggtgtccagtatcctgtttggattggaccatgctccaggcctcactcactaatccacatgcctgacgactacattgccttctcatttgaacatagtccataccagcagactgattattttacataaaaatgttcatttggtttaaatggtgtagaagatggattgagaatttagacacacgggaaggtgactgatcaggtctcaggcacaaggcaaaagattaaaggcatgtctcatagccccatgaaagaacagagatgcagaccagaaaatcaagaaagaagccatttatgcttggtgagctacaagcacttaaggaaaaagcactgcttggtgagcttgtagggacccagatttcaccagtgcacaagcttgaaatattgaacactgaatctacacacaaaaaaatacaaacatcatgtagggatggagttatgcacaaccaggaacatggtgtctgccttccgacaaaggatgttttcatggaaatcttggttttcaaacatttattctccttaactaaagggcaattttgagaccacggttgcctaattagttgttaataaatctctcctgggaaatttccctcatactctttcctttaattgccctttcaaggaaaggaaagaaaaatattaagtccatagagtgtcccagtcaaatcctgctgacaatgaactctgggaggctgtttaaattctttgtctctactagaattttattgaaattaattctaccttcctctccagggacctcagtattctcttcaacaaaataaaaggaaggtcattcgatgagctccaagagccctcgtggttccggcattctaaatttctgtgattctatgaatattacttgagaaaaggcagtcatctgaggtttaaacactctgtgcggtctttgagccgagacaatgtcttcgattccttttgtgaggctcaccatgtcttgtacatttgttcaacactcactacattttgaatgcataactgttgcctgggcactagagaaaatcaattattataatgaactttctaatgagtttgagggatggtagtctttaggcatgtccatgccctattgtaataataggagtgtggttgatgcagtatgatacacatagtgcaatacacctaagtgtttggaattctgggaagaaaatacaccataagaatgtatttccatcgtgataaccgtaggctatgcctaggaattcatttctctgcatgtaaaactgacaaaaaaattgtgatgaagtacatgttatggaattatatacagcagtctggtatattctaaaagaatctttacttttacgtttctcagaacaggcactggccctacttgaatttcctacatagtaagctatgcctatgcctttcactttttattgtagatacctatgttagagtgaattgattttcagaatgtgttaaacatgcattgcatgtgtttggttacatattaaattgtaaattttcagaagtagctgagtttcttaaacatgtttttaaaatgaaaaatttaaaataaaataaataggttttatgatcaagggagtctaggtcaaaaataagtaaaagatgtgtgaaaaaatatatagagacaaatgttcatttttaaaatgcagctgctgtgttaaacataggaatggataagagctagcttctggaaggtgctaagaggaacagcttttgtgactattataaattcaggtttaatcagaacattgcaagcattcttgaagggcatacaaacaaaattcaggcaacacaattcaaaatatgtggttggtagataccttctcaaggtttatgcctctttttaaagcttttaaactttgtgaattcctttttaaactttatgccttcacttaaataataacctaaaatatcaacatgaatttcacatgctgggttatctgtacctgccaaggtttttagtggctgccttcctatttgggtttacaattaagatggcaccaggaacaccgtggttatagtcagaagtttggaaaaaaaaaaaaatggtgtgtgagtagaggtaaaccattcacatccagtgaagaccacctgacattacagtccctgtatgaatgaggtcttggctattgttgagttagaaaatcttcacagaattagaaaaaactactttgaatttcatgtggaaccaaaaaagggcccctatagccaagacagtcctaagcaaaaagaacaaagctgaaagcatcatgctacctgactgcaaactatactacaaggctacaggaaccaaatcagcatggtactggtaccaaaacagagatataaaccaatggaacagaacagaggtctcagaaacatcaccacacgcctacaaccatctgatctttgacaaacctggcaaaaagcaccggggaaaggattccctatttaataaatggtgttgggaaaactggctagccatatgcagaaaactgaaacctgacccctccttacaccttatacaaaaattaactcaagatggattaaagacttaaatgtaagacctaaaaccatacaaaccctggaagaaaacctaggcaataccattcaggacataggcatgggcaaagacttcatgattaaaccaccaaaagcaatggcaatgaaagccaaaattgacaaatgggatcaaattaaactaaagagcttcttcatagcaaaagaaactatcatcagagtgaacaggcaacctacagaatgggagaaattttttgcagtctatccatctgacaaagggctaatatccagaatctacaaagaacttaaacaaatttacatgaagaaaatacacaaccccttcaaaaagtgggcaaaagatatgaacaggcacttctcaagagaagacatttatgcagccaacaaacatgaaaaaaggctcatcatcactggtcattagagaaatgcaaatcaaaatcaccacgagataccatctcacaccagttagaatggcaatcattaaaaagtcaggaaacaacagatgctagagaggatgtggagaaataggaacacttttacactgttggtgggagtgtaaattagttcagccattgtggaagacaatatggtgattcttcaaggatctagaattagaaatgccatttgacccagcaatcctattactggattcaaaggattataaatcattctactataaagacacaagcacacgtatgtttactgtagcactattcacaatagcaaagacttggaaccaacccaaatgcccatcagtgacagactggataaagaaaatgtggcacatatataccatggaatacaatgcagccataaaaaaggatgagttcatgtcctttgcagggacatggatgagactggaaaccatcattctcagcaaactaacacaagaacagaaaaccaaacaccgcatgttctcacacataagtgggagttgaacaatgagaacacatggacacagggaggagaacatcacacactgggcctgtcggagggcagggggctgggggagggatagcattaggacaactaatgtagatgacaggttgatgggtgcagcaaaccaccatggcacatgtatacctatgtaacaaacctgtacattctgcacatgtactccagaacttaaagtataagaaaaaaagaagggggaggcaggagaaaagtattaaatttatattaataaaaaaagaaatagtaaaattatgattatcagaggctgtgaggtgagaggattgaggagatgttggtcaaatggtacaaaatttcagttaggaggaataagttcaagagatccattgtatattgtggcgattagagttaataactatatattgtatacttaaaaattgctgagaattgattgaaagtgttctcaacacaaaacataagtatgtgaagtaatacatatgttaaatagcttgatttagccattctataatgtatatacatgtatcaaaacattgttttacaccataaatatatactgtttttccttgttgattaaaaataaataagttgttgaatacatgaaaaaaaaaagaaggaaaatgttcataatgaaaactgggcgtgaatgacaaacccaaaatgattgtaatatagcaacagtatcaaattcatatggcaattttgttttagcccaacaatctcatttatcatattaaattaatgattataatccaaattgtactattttcacagggctttctgtttaactttaaatgtgtttttgttttatagcataggataagcactataaggtatgatgcttatagcaagttttatgtttgtatatattttaaaaatattggaatacagtattttaagtcaatgctggagttgattaaagtcttacttttccctttaaattccaagtcagttatgagaaacaatgataaaaaatgagcttttatccccagatttatagtccttgaactagatttcatgttcatttatgttgcttcctcaaaaaacccatgtaaattggatgggctaggtcaacaagctagtgatcatccttcatttgctccatggagttagacagatgttggtgcaaaattcttacaccgcctgcccattcctaaatgtgcgaacttaggcaagttacttattttgtctttattttggcacccccatgtgtgaactgagaataagaatacttagcaggattgttttgaaaaatagtaatatataatattataataagatgattaatattaaaaatagccctcatttggataactatttttggcaccaactcccaggcaacttttcacagcgtgaatagttagccctctttgaacaagttactaagtaccagccactttaaatacataatctcatttaatcctaacaaattactagtatcattcctattttgcagatgaaaaacaggccaagacaggttcagttgacaagaaattgcacagatctaaatgcagactggacttactgtgaatcccaaattttccctcaccatgttattttgtccaaaatgaaactaaaatgcttggcatagatctagacttttgtaggcactcagtaaatattatttccactctgaagaaaacgattcatgtttcatttcgcttctcatcagaggtaccacgaacagaatatcacccttttatgataaatcactcaaattgcagacttttgatccctaaagttcaagagtgaaaaggtataaatatgaagaaatttcatgttaggtcacgggatgggaaaagatgcttatgtcaggatttaccatttctagtgaccagcacctagcagattgctggtttattagatttatttattattttcattgtttccttcagatgactcctatttatctgattgtagagtaacctctgagctttattagctagaattttattttccacagtgtagtccaaacaactttttcttggcaaaatataggaccccattagaaccattaggactaaaatgtcagctctcgtgatagaagagaactgaggccactgtcttttcatggctttctctaataccttttctgctgaagtcttggttacaatgctaagaatgacataaccccttagttatgtgaggtgtactagctgattcaataagcctttatgaaagttttattttcagctataaggtcaaggttgtattagcgctacaagctaagcagaatttataaggcaaatttcagtttcctccaaaaaggcagcccttatgtataggaaacagaaatatcatctatttgatactcagcagtgcctcttatgattttcatgagcagcagaatgtcttttattgacaaaagccatacaaaaaaaaccagaattacatcttttttgttccaaaatagaattaaaaatgatagtctatcaaattagccatgatggattttattttattctaacgtcttatgctcatttgtagaccagagcaaccatctcttctaactctgcaaatcttccttggttctgctatgcaacttagggctcatttaggtggtttagcacagggctttctggccctaagccgagactggcaccaaataagcttgcctgacactttatagggtgtgatgaacagtccagagctcccaggcaactttccacagcatgatttggaatctacttgcaattacatatggctagtggagctgcatctggagaagcctaatcagaatttgtcttccatttagtagaaataaaacgagcccactcattgtgtcagaattcatctttacactacagaatgagcaataacctaaaatcaatgccaatctcctggatatggtgtatatacttgagaaagtgttctgcagaatgttttctacattactttcatcactgtgttttctatttcagggcccactcttcctaagacccatgtgaaaacagcctcccttgggttggctggaaaagcaagatcccctttgcttcctgtgtctgtgccaacagcccctgaagtgtctgaggagagccacaaaccaacagaggattcagccaatgtaagggcatctttaaaattcatgcttcatcaagggacagattgactggcgctgtgtaatagcatctaaaccaatgagtactgtccattcaccccaggccaccccaggccattgttgttcttattgttgtttgttcctttgttttcctgcacttaaatatgaagaggaaataaaagctatgaaaaaaaattatgtcagagacttagttatgtaaaaaagttgattcttaaggacagtcttagaaatatgaccagatagctacagaacgtgtggttttacacccatatatgtacataatatatacatatacacatgatatacacatggatacgtgtgtgtgtgtgtgtgtgtgtgtgtgtgtgtgtgtgtgtgtgtgtttcttttcaataggaagaaataccttggcattcttggaaataaataagactatataactcttcttcttccttttttttttttattttaagagacagggtcttgctgtgttgcccaggctagagggtagtggctattcacaggcacaatcatagtgcactacagccctgaacttcttagctcaagcagttctcctgcctcaatttcccaagtagctaagactataggtgcacattactacaccaacttatacagttattctctaaaattaaaaaaatatagtgacaaaaagctatattatgagggctttttgaagttattatatatgttacttctgaaatcataaaataccagaaatatagatttgtgaaggaaaaaatataaaataaaaaaattgaaggagtttaagtaatacaaaaaggaaatgacgtaattaaaaaataagaagggaaagtttatttaaagacagaaaaagttttactaaggaaataagctaaaaagggttccagttagaaaactcagaaggaacatcaatagagaaggggaaaaaatcagaattttaagaaaaaaaaaacatttatcccgaaaatgcactgtaaaggagattcaaaaagacattgcctaaaggcagctatttatagtacactttagttgtttctgaatataattcaagagaaaacatttaaaagaagcctaaggaattaacatatcagatatcttgaaaaatcagggcactagaagagaaaaaagatgaaaagagcagattaaaattctattttgttattacatttggatcttttttaagcataaattatgaaatgaaaataatctgccacccttccaactagcttgttttcttcatgcataaatgaagtcttctgcaaaatttgcaaataatgtattgaaaaataaatttataacaatatcaaggaataagtaggtaacatttaatcagtcctctgtaagcaatgcaactaccaggtcttttataaaaattatactttcttttgatatctggttgttgttaaaaacaaagaatcatttcatttgaatgaagaacaatacatttttcttgacttaattttttttcaatactacaaacaataaaatattttaacgacatagagatcagggaagctgagtatgtgagtgtgtctgtaaatgttttggcagatgagtgttatctacttaacatgcttttcaaagattcaaatttataagactctaatgcacttttgtgcgttagaatatagctgtttatgtcaatatctgtttaggatcaaggtttgtggccacatctcaaataaaatcaaacttctaagtttacatgaagtatctcatctcataaagaatcatgtcaggtaggcctatttttacattaaaggttgactctaaagaatggcagccaaattaaaatattaaactttattaatattaaaagcagtaagaaacacatattaaaggaaataaagaggacaaatagtgtagaccaacatttgcctatgaaaacataatgtgtaattttaaattgactagaagctacattaaaagatgtaaaaataaataggtgaagttaataccttttatctaacccaatatttccaaaatattatcatctcaacatgcaataaatatttaaaattgtcaataatgtattttactttttttgtactgttccaaaactggtacgtattttttcatgtaaaacacatttcaggtgagactaggcacattttaagaatataatagttacatgtggctagtggttgccgtattatacaatgaaatctagacagtttgagaacgacaaccagacaatgaaaacaacattttggaaatgagttgcctagtaatcccctcacttcaacttctctctctctctctctctctctctctctctctctcacacacacacacacacacacacacacacacacacacacacacacattgtatgtatataaacaggcttttagccaaattggaaacttttcagtcctctattaagccctgaagattgggtagtgtatgcccgaatcattcactgacatgctgagatttctataggaagctcatacattaataccatacattttgagctgttttttcaatggctggagtagctttgtgcctacctcccacccatgcaaattctatcaatgctctcttgagatcaagggtacttatttggcaagattagatatacatctctgatcatagtgctaaggaatgtgtcttggcctatgcagagctagaaatcatggctcaggcctcattggttcaatcatttaatcaatggaatgcgctagccaagaataataagtagaacatctgtataagtcaactaatatgttcaagaaaggaaaaaaagaaaactaacatctactgaacacttaccactaggcagccctgacttgttgaatcctcctaactcctcaaaagacaaacttgttattctcatttcacaaataagaagactaactcaaataaaatgtgcaagtatataaaaggactgggattcaaatcagtttcacatcttatttccccatctggctaactatcaaaactacctgggaatttttcttttaattaggatgtctaggttcttcccataccttctgaaacagaattcctaagcctagcgacctggtatttgtggtaactagtaattctattacttactgacatgataatagtgacttatagtgagtgagtttacagagtgaattagtgacagttcactaggcattctggagttcaacctcttcttttatccaccattcaaattgtcccaaaaaggattgactgtggtttggggcatgaattttgtttccacacacaaactaaagtcataatctccagacgtttcattggccaaggcaaagcccgctgagttctcacatacaaaaaaaaatgtatctatgtcatgatacagagaaaaaatattctgttcatatcttggttaacctagtaagaggaacaggagctaatgtattgaatatctaccatatgccagaccctatcatgggtactaaacatgttacaggaggctcagaatagcctatgaaatagatgtcattatcattttatagatgaagaaaattacgtatcagagaggtgcactcacttgtctaagaccacacagctaataattgggagaacttgatttgaaacccaatctttttgactctgaaacatcttccttgtcacaggtggagatggagtgggtgaaacaatatgcaatctcttattatccccttttattaccagcatcttcattcagtgagtatattccaaggacagccctggctgtggtctcctaggtcagacttgggaatacgtagcaccccaactagctgtggccccggccttcataaaagaaatggatcaatatttgttactaactcttggctctcattctctttataggtgtatgaacaggatgatctgagtgaacaaatggcaagtttggaaggactcatgaagcagcttaatgccatcacaggctcagccttttaacatgtatttctgaatggatgaggtgaattttccgggaactttgcagcataccaattacccataaacagcacacctgtgtccaagaactctaaccagtgtacaggtcacccatcaggaccactcagttaaggaagatcctgaagcagttcagaaggaataagcattccttctttcacaggcatcaggaattgtcaaatgatgattatgagttccctaaacaaaagcaaagatgcattttcactgcaatgtcaaagtttaagctgctagaatagtcatgggcctttgtcactgcagtgaccacactgtcataactaatacctatgttttcctttgtcaaggcctgttgtttaatgtgtaggtctagtcttacaaaatgcaagtgcattatttaagcctgtaccatgccatggcaaaccagtgcaagctcactattttgttttcaacttaaacatacaaagcacccatgggaatctctcatgccatagcaccaaaggattggatgttttccttacagcacaaaaagtaaatagtaaacaaacaaaaggcagagaatgcttatgtttgtaactcagtcattcatcttgcacaagtggtggatattagtgagtggctaaaaattcacctattttggcaagtatttgtaaatccacccttggttaatatgtatgtctggagtccaggaatataaaaatctgcaactagtggcattctgccagcagcagtacatttctggaaagaggatataatatgcaatcttctcagacacatggtaattatatgcttaagcttgtaataggacagttttcaatttgggtggcttttgtgccataccacactgtgatacaatttcaaagcttcactaaggccatcttccttaggagtttggccagaagaatgcccccaccccttcaccccatccctccctgagttctccttggcaactagcgttgggtgaaatggccagctccacatgtcatatggtgcactggccaatgtcgcctgtcttctaatcccgtagaaatggcagactccctgagagcaggaagagaaggaaaataaaaggtagcttctaacagtaccttctcttaaagaatgccaactctgcctacagggtcagtgttggcaagcattggccaccagacccttttgttaagggaaacttttacactacacctgtgtcagagtcagggggaagcagaggggcaggtgccacctgacacttccgacatgtaaatccagcagatacttttcaaagcagcatcttaaactgtggactacagttttaaacttctattgccatgtttatctacagcttggaactagctaaaattaagaacattttgtatgcagcattttagtttctgaattttcagctgcatttggagttaatccctgtttatgcagctgaatcgccaaaagggagctagtttgcatatttatcagttaggtgacttgaaaacccaatgagagagtttcagctgaattattcctttcagctctgcctttgatttcaagcttgagtaggtcataattttaaaagagcatggaagggataggatctttacaacctaatagctccttttattaggtgggtaattatatatgaatccctgaataaaatattttgagcaaaatggcactgtaacagaagtaataattcagtttatttttttacagttttatgtcgggaaggaaatctgatgtcaaagagagggctgttcaaatggttcattagaaagtccggtccatttgcgaatttgttccttcaacaagagtgctcattcaagttactcagattttctggaagtcttttctgaagagctatgtgatgttgttctatgggacagactactcttatttaacatctgggcacttaggtagacaaccttctactgacctggaataaagtgtttcctaacataatattgaattattcagaaataatccattacttcaaaaaagaaaatattcattgggctagcccaaccttctctaggccctaagaattattacctcccctttctaattctagcaaacatggaacattctccttaggcacttgacacccacgagggtaatcctgagtgctcagtttggaataggttgcaaatctcagattttagggattgagtcacaccttcaatctatagaatgaagttgaccaattaaaaaaaaaaaaaaaacctatcattttcacaaatttctagatccttctagtcaaaaataattatttaggaaataaaatttttaaaaatccatttaaatacatgttatttgtcttcagtggaagttatatttctgctgcatgcttttgaaactttcttcattaaatagaatggtttgtcttagtaactggcaatgccagtattagcaccatgcatttaatctataatacaatcaatttaaacatcctcaaaaaactctagtatcatttacctggtagtattaatatacaatgatgtcaccacaacttttgtataactctgttccctttaccctcaaatgattcatatatgtatataattgcctgcccaagttttcaggtaacttattaatttcccagtctcctgatctcttgacaagaagaaacctgtgaatactgcaaactagcctctgacttcctcctactgagtctagttcatggtatccaggactctttatgctcataactctctctgattcccattgggtgatacctgacagccaaccagccgctctgccaccagaactcatttctccctgaaaaagaagaaaatcatatttggcagagcattctctggtctgccctgtaatgtgcttaaatgtcaggcaacatcctcttttttttaaaaaaaatggtatttttctttaaatttcaccctaataagaaagctattttctctcctctgcagaaatttctgcatttgtgaaacttataaaaatttagatagttcaaatgtataaagaatatttggatgatgctctagccaaaagttaaatatttcgtagtgaatcatagccaataagaaaccagtcatacttgcctctttgaataacagagatataagcttctagaatatttaaataatgaagttttacatttgggtattataaaatgcatactcaattgaatgagctgaaaaaaataccaagccagtgatataagtggagatttattaaggattcctgttgagtatattcttagtttcctcaaaatagggattattcaaaattaggtgtatgttcaatctcctgctttggttccagctacacaaggagagccatcctgtgctagtgtgatgtttcagacaacattctgaaactaaaatgtttggcacttattggcttttccaataaagaatctcttaagtacaggtatttctggaagctgttggtgtctgtgcttgaagatgattgctgatacttatccaccctttgggtacttctgttgactttgtttaaataatcatcttatggttgtccccaaatgtaatatggtatctcagatatagcagctggactgtaattacaacaaaaggttacctctaaagataacatcttaccattttagataaaattgtgtcccagaattcttatggtttcggaatgtacatttctagtcaatgaaagaaagaaaaatggaaaaattgtctagtttcaggcatgtttaaagaaaacaaagtcatctgaactttaaaatagatgcagagcagggttactttccctttcactcagttcccttcatgcaaccacaggcagtcctgcaggccagaggttactatcctaacctgctcataaccatatactatacagagcccacaactttctggagatgcagaagcagccatacactcaagtctctgtttttgtaaatcacattcaaagcaacattttactcataatttgcatttctctggtgactttcagaaatcactttagtattgtacagaaaagctttttatttgagtctagtgtttaaaattaaattggatacttgggaaaatcatagataggtgttttgtatgatattccattccaatgcaaaatatatgtacccatgcctcaatgtatcttgctatctaaatacctgttgccaaaaagtattgatttgggaaaaaaaatgccaatttcctggtcagtgaggttatgtaaaagacaaaataccacacccatatcagcaaatgaatattactactcatctggactcttcgttgccactattgcataacgttcacgtggcagacttccagttgcactctctgaaggacttttttctcttactctcaatagagagcctttgtacattgtcatcctatgattgttgttggtagaagagcaagagcaaaactctgcaagatttaataaacacaggggcatgggccaagggatctcactgtgtgctgaacatgtattttcagatgcaagaaaggaatgatggagaggaggagaaatgctgttttttattattgtagggtaaatctgacaattctgaactttgtgaattgtcagcttgtttgggggaagggtgggcgggtatggggtgtactttttataagtaatatttaatttattatttagagtggcttctttttggataatttatgataaaaagggagatctggttgggatctagatacggctgttaaagctgcagtgttccatacctcagagggaccactttggaaatgaattgtccattgctgagtatgaagagatgtccagtccaggcaaagccttcactgaagttccatcatcgccacttctccctttttagggtcattcaaagaagataacaccaaacctaaataattctgaaagcattttgcagatcagtgctactcattcaaagggctttgcaactcaaacagattgttagtgtgctagtgataagtttatttggtagaaatgggtatactacagctttaactagccttagtgagaaaagaaattttttgttgttacaaaacaccttttttaacaaaaaggtattttgagcctacaaaaagtttctttaaactgtcagattctagcattgttaaccaaattagactagtgattgcaatatttaagtgtaaatcttgttctacaagaaaggaaacttgcttacagtttaaaacaatgactgtttctacacatgatcttgtatactactacacaaggaaaagggggttttgtaaacactgtagaacagtctcatattcatttttttatagaaatgttattccaatggtgcattttttgtttaataaataaagttttgatacaaagttc

SEQ ID NO: 388 - DNA, 115689 bp, Homo sapiens
ggataaaaaatgtcagtactcacttctccaagaggaaaggtagaagttgttcattgccgaagaacagaatcacaggatgtttattgtatcaaaagccttattagaaaatttacctgcaagctgtttgggaagctaaatatcatctatcttctgtaagtagataactaagttcaagaatgttcatcaattttggttgggtgcagtagctcacacctgtaatctcagcactttgagaggccaaggcaggcagatcacctgaggccaggagttcaagaccagcctggccgacatggcaaaacctcatctctactaaaaatacaataatcagctgggcgtggtggcgcatgcctgtaatcccagctgctcgggaggctgaggcatgagaatcgcttgaacacaagaggcagaggctgcagtgagccaagacacgccactgcactccagcctggatgacagagcggacccctgtctcaattaaaaaaaaaaaaaaaaaaaaagaaggttcctcaattttatgacatgccagaaaaggatcctacctttttgtctttatggggcttattgtgagcaaatgggtagcttactgcacagtgaaaaaattgtagcaagaaatctctgggaacaacaaattcctatttcctataataatatgcaaatcaaaaaggtttctcatgggctttggattcaaacaaacttggttcaaatctcagctgcctcactcactagtggagtcacttaaaacaagttaataatattagctgccagattttgagaaattagtttatgtcaggctctgtgctatgccaacattatgttattgttctgatacttctctgaggtggccactatcatgtccatctcacagatgagaatgggaggctggcgcagggtcaaacagtacgttggaaacctggatttgttcacagccgctgctgttaaagtgttcttctgaactttaaagtatgcatagatttgtttcttaaaagatcttttttctctctgttttgtttgtttatagaccttctgtgggtgccaaaatataaatatccttgaatctgttcttcattatttaattaatttatttatttttgagacagaggtttgctctattgcccagatctggggtgcagtggtgcgatctcggctcactgcaatctccgcctcctgggttcaagagattctcctgcctcagcctccagagtagctgggactacaggtgcatgccaccatgcctagctgtttttgtttgtttgtttgttttttagtagagactaggtttcatcatgttggccaggctggtctcgaactcctggcctcaagtgatctgcctgccttggcctcccaaagtctttggattacaggcataagctactgtgctcgaccctgttccgcattatttttattgaaaatattaaatatcctagtattttggatttcataaagcttcatatcaaatacaattgaaatgtttaagctaaggccagcctaagacattaaagtttgtagtttctaattacccccctgatgaatgtaatataaattggcacaattttactagagggcagtagggcaatagttataaaatgcctaaaaaatagatataccaatgaaatgattttattttttggcattatggtggactcagtaccttaaagatgtccattggatggaaacaactaaaatactgatacacacaaaagctaaggactgtgtagggaacattatcaaattgaaatcagaaacttcattagataaacaggaaccaatgctagcttcatccttgaggatttttgccacattctattaatagcaacttcatatttctgttttgacagctttgcaaagaatggaagataactactccctccacctaaggaggaaagcatgtgacccctttgtataaaattgggatgttcattgtagggatgaacaagatataaacccactaaataaaaatggacagtgagggctcactcagccttagcatggaatagagggggataaagtctcttctgagaattcataagcacacactgatttgagatccatgttaattatttatgtggtccaaaaaatgttgaagtaaagaatttaattaaaaatagtcacaggccagtagtgtgtccaggaaactggctgacataaatgcaaatcaagtgtgaagggatgcagcttcagctcagactccaaataataaccccagataaagttgcaaggtatatgagctcacagtcaaaaatcgtaaacacacaaggaaacatgtatcattagaatcaacaagagaaattatataggataatcaactcccaaagacttcagatataaaattaaacaatgaatataaaataactatgtttactatgtctaaaataaaaaaggtaggtttaaaaagatgattaaagaaggccggacacagtggctcatgcctgtaatcccagcactttgggaggccgaggcaggaggatcacgaggtcaagagattaagaccatcctggccaacaggtgaaaccccatctctactaaaaatacaaaaattgactgaatgtggtagcgcgcactctgtagtcccactactcgggaggctgaggcaggagaatcgcttgaacccaggaggcggaggttgcaatgagccaagattgcactactgcacactccagcctggtgacagagagactctgtctcaaaaaaaaaaaaaaaaaaaaaaaaaaggattaaagactaaaaaaatctgggatgctgaggtgggcagatcatccgaggtcaggagtttgagaccaacctggcctatatggcaaaaccccatctctaccaaaaatacaaaaaattagccaggagtggtggcacacacatgtagtcccagctactcaggaggctgaggcaggagaatcgcttgaacctgggaggtggaggttgcagtgagccgagatcgcaccactgcgctccagcctgggtgacacagtgagactccatctaaaaaataaaataaaataaaaaataaaaaattataaaaatgaataatcatgtttaaacaaaagtgaaatagaccatctagaacttaaaatgtaattgaaattaaaagctctgtagatgaattaaacatccttcatagacacagttgaagacagaagtaatgagctggaggatcaataccagtaaattacccagagctcaacacaaagagaaaaaatatgaatgaagcatgagacctagtctagttagacttttagaagaagataataggaagccaaagggtaatatttgaagagagaatggctgagagtttttcagaattgttggaaagcactacttcttacatctggaaaactcagtggatcccaaaggggataaatacacagagaaatcccaactgtacccatcataatgaaacagcaaaacactccagttaaaaagatctgaaaaataacagagggggaaaaaaaaaaaaccaagttacctgcaaagaactaaagattagactaatagatttcttaggagccacaatagtagtcagaagatagtagaatatcttcaatagtggagagaaaaataacatcaatttagaattgtgacattgtttcacccagtgaaacaattcctaggggacctgggagaaaataaatgcattttctgacaaacaaaaacctaagtcatttgccaataaactctgaatggaggaaattcctcagaatatgtttttggaggaacagagaatacctcagctggaaagctcaaaacacaagaaggaatgtcaacaaaaatatggaaaatatataggtaaatctaagaaaaagtatgacttgcataaaacaataatattgataatgactgatttgtgaggtataaaccatatgttaaaactaagattcaggacaaaaacattatataaattgggaggagcatgattagaatgaaagaatccttcaggttttatttaagatggagggtgtggtaagtggtgtgcaaacaggctcccctggctccaatgagccacacatcctgtcacttacgcctttgtgtagtctgttctcacaaagaatcatggctcgccttatgcagccaatggaaagcagcagaagtgagactctatttgacttcaagtctaagtcataagaagtcttgcaacttccactgggtctccggaagtgctccttctcagaacccagtgccacactgatgaaagctccagtcacatgtttccctgtgggtgcttcatttgacagcctctgctgagctccccgctagcaactgccaccagctgccaaccatgcaagtaagccgtcttagacactgagtcttcagatggctttagccactgctgccatttgatagcctgagataccgtgcaaaaactgcttagttcaacccaggcagcccacagaaccatgagagataataattgctacttaaagccactgaggtttggggtggtttattacacatcagttgataactggaacagataataaagactgttaggaatatatattaacatggttaagatcatcattaaaagaacaggtgtagagatgataacttctgatctatagagggaaaaatggaatgagaaatttaaaatgaaccctgaatctaaaagaggacaagacaggaggaggaaaaaagaaacaaaaagcatagaatgtattaaaattacagaataagaaaataaattttactatatcagcaatcataataaatgcatctggacaaaaatcttccattaaaagattaagaatggcagattggctcaaaacaaaacagtcatattctatttgtgagacatacctcatatataaagtcacagaaatatttaaagtcaaagtatcaggaaaaaagatatgccacccaaaatctcacccaaaataagggctagtattgctatatcaacagcagacagtgtatagttcaggacaaaaagctccctacagataaagagggtcactatataatgataaaactgttgttgggagagctatgacagctttaaacttatatgcttctaacaacacagttctaaaatagataaaagtgaaaatcacaggtagagcactggagactctcccgcctccctgtgttccccatgcctttttgtgccattctccctgctgtagtccccatgttttctatctttgttgagcctgtgattcccctgacagaatgtaatggaagtggggctgtcctggtcccaggcccaagcgttaagatggcctggcagcagggctggcccaggagaggcacgcagggtatcctgggtactcactcccagctagggcccctgcatgaacctgagagtgaacacctccttccatttttgaaccctgggtccctctggcctcaccctagttcgagcctttgctgggagctttcagttttgtgatcttgggagccttgcactaccatgtaaaaagtctggctactctactggacataccacccagagaggccatatcgtaagagagaagtgtgtgcctacatggaggagaattgaggagcccagcctccagcaagaaggaaggccccatgtcactcttccaggcacaccccagcccctttgggccaccctcactgaggcacaagacacatgagggaaaaaaaccgtcttggaggttcttgccccaacagatacccctactgtaccctgtctgaatctctcacccatagaatcatgagcaaataaaacagagtagccactaaatttgggataatctgttatgcagaaatagttgaacaaaatagcaggtcttagagggaacttataaccttaaatgcttataacagaagagaagaaaggcctgaaataaagttcagagtttacctctaagagcaagaacagtcgaatcaactcaaggaaaacagaaaataaaggacaagagcgcatattaatgaaacaggaaacaagcatctggtagaggataaacaaagccaaaagtttgttctttaaaaagcctaaagaaaaaaaaaatctgacaagattaatcaggaaaaaaagaaaaactttcaaagtaatgtgaaaaggacataatcacaaatgttgctgaggttaagcaggtaataaaagggcattatagatccacaatcctttaactaaatccctcgtgactagttgtgtttcagaaagcagaatttaaaaaattagtttcttccattgatgaaatattattgaattccacccacaagggctggagagattttccataattacacacgttaggatatctgtggtaaaaatgtaagaatattttatatatgggatcaagactgtagagtaacctcctgtcacttcaagtccaattttgctgcttccagtttttagggctttatggatttaaagggattggggacctgtataaaaaaactgcatgccaataaatttgaaaatatggggtcccagaaaagtttcttaaaatcaacttaagaaatgatagaaacccattaaattgaatcgttagttttaaatcctcccgccaataaaatggtcggcacaagtgcctttataagcagtcctaccaaagattcagggattgggtatgtcccaaataaatacaagttcttggaagcagaaagatggagaatactttttagctcactttatgaggctagcataatgttgatatcaaaataagacaaagacagtacaagaaaggaaagttaacggccaatctcacatagaaagagaaatgaaattaatgttcatgccttgctcatgaacatggatgtaaaaattcaaaaaaaaattggaaaggaatctaatgatgaactaaaaagatatgattatgattaactgatcatggtattcatgattggcttaatactagaaaattgattagtctaattcatcaaattaacaaaggagaaaatctaataatctcaataaacagagacaaaatcattcgataaaatgcaatattcttagtaataattcttaacctaataagaatataagatgactctcatatgtatacaaacctttaacaaacaccatatgtaatgataaaatattaaaagaatccctgtatagtaaatgaggatgcctgttgtcatgagatcctagctattgcagtaagggaaagaaaaagcaataaaatgtactaggatttgaaaggaagaaacgaaattgtcattttttgcaggtaatatattctctacttagcaaatggaaaggaatgtgaattagaatgaatatagaagttcaaaattgctggctatgaagtcattgaataaaaacccattgcatttttatatactaacaatgaacagaaaacatttttctatttacacccatgccaaagaatataaagtacctagtataaaactgacaaaataactctaagctcattatggggtaaattgtcaactattgaaagacattaaggaaagcctaaatagagtaaccgccccccaccccgccttatctgaggggaatatattccaagacccccagtggatgtctgaaactgaggatggtaccacatccgattgttatcagtcagaacacatttttgttcatgccttccacccacaaatgtaacggcttttccatcgtaactaagcatttgctatgcactgtgaccataacttttgtagtttgaagtgcgacaggagaactaacaggaatttctttttccattttcacaatttcacggattaaagatttcttcttaccctagatcttagcaagctcagcatacaatttattttttcctcattaagttgagaattttcacctttttgtgtaaaggaagccttttacggcttcttttcagcatgtctgaattaccagcgtcactactcttgcactttgaaccaaagcactgtgatgcagtgacagtcgatctggtaacagaaggcagttaccagatctaatactaagtgactcatgggcagcagcatctacagtgtggatctgctggacagttcctgggcaggacgggctgggatggcacgtaatttcatcttgctactcagaatggcatgcaattataaatttatagattgtttatttctggaattttccatttagtattttctaactgctgttgactgcaattaactatgaaactgtgggccatgaaaccacggagaagtggggggactacggtatttcccaagaggtagaccacattttggacaggaagattcaaatcataaagttagtttctctccacccccgtcaaaatcctaacaagattatttgtcaagcttaatgagtctaaatttgtgtgggaaagcaaaggttcagggtaatctgaaggaagaaaaataaggtggagaggcttgccaactaaaggttcattgtaggtataataatcagggcagtgtggtaatttgcagggaattttgacaaaagacagatggaccaggatagagatcccagaaacagacgcatactatatgaaaatttgatgacggctttgtgaggaaaggatgtgccactcaataaatggtgctgggagtgttcgttattcacatgggaaagaaaataataaccaacctcatgtagtagaaaacttgtaaaaattaattctgggtgaatttatggtataaatgtgaaaaacatctgacatcgatgacagaaccttctggattccaaattcatttatccagcttcctggtgaatgccaacccttggatacctagtaggcacttggaacctagcatgatcttcacctgcattcaatccactcttcccacacttttcctatctcagtaattccagccttccccttgctcagaccccaaacatttaaaaaaaaaaaagttaaaatggaatctttataactgaaaaggttgcaacctatcttagaagccagcgtattttcagaagtaaaagcaaatttaaattttcattgatgtcctgaagcttccaaaacagctgctactaagcccacacagtgtttcattttttatattaggcaactcctgtcccctggccaagtcaactgcaaggcttaatgacttattttatagacattttgaaaaaaaaaaaaaaggtggttcttttgtggtctgtgtgtttggttttattttattgactgcctgttcagttacagaaatagaggaatgaataaaactgatctcacctaaaaatccagctaaattttagcagattgggcatggccgatgagtggggaaagggctgaaagaatcacctgcgtccagtgcaaatagcacagtggcgatcggggggacagaactgtgcccaggctgcagtttgtgagcaatggatgtgaggaaactctgaggtttctgggtgatggtgttgttaaatcaagcagaaaaagcgagtgctgtttctctatgatggaaatcttagaaaatcttttgtacaaagaacttaaacaaatttacaagaaaaaaaacaaccccatcaaaaagtgggcaaacagacacttctcaaaagaagacatttatgcagccaacagacatatgaaaaaatgctcatcatcactggtcattagagaaatgcaaatcaaaaccacaatgagataccatctcatgtcagtcagaatggcgatcattaaaaagtcaggaaacaacagatgctggagaggatgtggagaaataggaatgcttttacactgttggtgggactgtaaattagttcaaccattgtggaagacagtgtggtgattcctcaaggatctagaactagaaataccacttgacccagcaatcccattactgggtatatacccaaaggattataaatcattctactataaagacacatgcacacgtatgcttattgcagcaccattcacaatagcaaagacttggaaccaacccaaatgtccatcaataatagactggataaagaaaatgtggcacatatacaccatggaatactgtgcagccataaaaaaggatgagttcatgtcctttgcagggacatggatgacgctggaaaccatcattctcagcaaactatcacaagaacagaaaaccaaacaccacatgttctcactcataagtgggagttgtacaatgagaacacatggacacagggaggggaacatcacgcaccagggcctgtcggggtgggggctaggggagggataacattaggagaaatacctaatgtagatgacgggttgatgggtgcagcaaaccacaatggcacgtgtatatgtaacaaacctgtatgttctgcacatgtatcccagaacttaaagtgtaataaaaaataaaataaaataaaagttccagagcaggaaaactaatatgatttgatagtaacaagtccacattattttatgggttgtttactgggtgataaattaggaaactttttgtgatgatgtaaacattgacttctgtgtggagggggcggatgtgatacaaaggtgtatttattttctaaaattagttaaatgatacccacaaaatcatttcactgcatgtaaattataccacattaaaatattataaaaagttttataacatctgactcttaaaaaaaaaaaagaaaataagttttggctatactcggaaaatttcctgaagcagttgaataaatgaggcattgctctaatgaaaagagctctgatttggtgtgacatacgtgtgtatgtgtgtgtgtgttaatagggctccttcagtttggatttggcttattacaaagaacagtttaaaatccaacatttaaaaatatgccttctcagccgggcgtggtagctcacgcctgtaatcccagcagtttgggaggttgaggtgggtggatcacgaggtcaagagatccagaccacagagcgagactccgtctcaaaaaataaaaaaactaaaaaaagtaaaagagatcgagaccatcctggccaacatggtgaaaccttgtctctactaaaaatacaaaaattagctggacgttgtggcaggcatctgtagtcgcagctactcgggaggctgaggcaggagaatcacttgaaccctggatggggaggttgcagtgagctgagatcgcgccactgcactccaggctgggtgacacagcgagactccatctcaaaatatatatatatatatataatatatatatttatattatatataatttttttatatattcatattttatatataatatatattcatattattttatatataatatatatttatattattatatatgtatttattatatatatatatatacctaccttctccctctaccttttcctcctcttctttccctttgttcccatggtgatttttatctgtgctatgggggacctagtgactaaggggtaataagaagtgaaaattatatacataaaaggataatgctacaaaagttactttttacagtcagctatttgtaaactgtagtgcattttcccattgaaacaaagtaattcatggctggcttcccaggccaacccacaaaagcatactgaatctttaatgtctatgtggtatatagtattgtgctaattgtactgtaagacccaaccagcatcctgaggttcccatggataaatgcatttcgttagaattggattccaggaacacattgttctttgcttccctgaggggatggtggctgcgctgtcccaaattcttgcccacttcctcctccctaccatcaccactatcgtcagagctgacatgtacagcgtcttgtgcattttctcatctggtttagagggagcactctcagcttgagaccataggtcatgactctgggagtctggggcagaggagcccagaagaccaagagctggagggagatgacttacaggtagacggaagttaagggttcagtgagaagttgtggggctgcatccctgtgctaaagagccctgtgtggatactgtattctaggaacctgggacagtctactccctcctttccttgatagccagtgctcgtatggggcccctggaccaggagcagccctgcttcattcccctgtggctgaggagtgtgatcatatgtggctgctgtgacttcctttgagaagggacagtggctgcaggcactgagattgatatccccagcacaatgtttcccaaagacgcccgtacatccggtggtacccagggggatttcacttgctacatgcaggaaaaattttttgttttaaatgttacatctttatagttaccttcctttttatttcttttgagacggagtcttgctttgttgccaggctgcagtgcagtggtgccatcttggctcgctgcaacctctgcctcccaggttcaagccattctcctgcctcagcctcccaagtagctggaactacaggcatgtgccatcacgcccagctgatgtttgtatttttagtagaaacagggtttcaccatgttggccagaatggtctcgaactcttgaccttgtgatccgcctgccttggccttccaaagtgctgggattacaggcgtgagccaccgcgcccggcctttaccttctatatataccgagagatactggttttccatttatggtagtgatgtatatttcctattaaaattttaagcccaaagtaaattgatttaaagaaaaaaagtacaggaagcgcatgtgtgtgagagactgctgtttggtgaactgctcttgtaaaaggttacactgtcaagtgggaaaaagcaggctacaaatagtataggttgtgagattccatttttattttattgttatttattattattatgttttgagatggattctcgctctgttgtccaggctggagtacagtggtgcgatctcggctcactgcagcctctggctgctgggttcaagtgattctctgcctcagcctcccgagtagctgggattacaggcatgtaccaccacacccggctaatttttatatttttagtcaagatgggttttcaccatgttggccaggctgtctcaaactcctggcctcaagtaatctgtccaccttggcctcccaaaatgtgggattacaggtgtgagccaccgttcccggccagattctagttttaaaaacacacgatgtacatttcaacgtatagttacctcacgaaaagataagtctggagagacagaaaccaaagtgttgacagtggttggttatcaatggaaggtgggattaaaagtgattttccaaattatttattttttctcttcttgcttagattttctcgttcttgtctgcactgacagtgtattccttctgtgataaaaacataactggaaagcccatgtcactttctgtcctcctgtcatctcctctccgcctcttcctccagttacatgcttgcttcttcctgttctcctcaagaaggaacatgggtaactgctgccttctttgtgttttgagtgaatgtttaactatttcttcctccaacttaagatgccagtagatttcatttcactaagaaagtaaaaaatgcatttaaatttatgcacaaatggttcttggggtggtaaactatatgctgcctttaagtgcctttaagtcttgctgccttgatgggccacaagacagggtagcagttgggagggattgtcaagatagtccctctgagacaaccaccagaataagactggaaagcctgcttctcctctcttcgctttattaactcactgggttaccttagcttaagcaagacccctgggagtccccatttctgcagctgggtcagatgatattccagatgcccagattccatatgaatgaatcagtaagtccagggacatgaactcacagtttggaggaattgcttgagaatggtaactgagatggagctagactgttagctttactgctgttcataggtgacccattcatcctagtttgcccaggactttcatttttttaatgccatgaaagtcctatatcttgggcactcccagtcctgggcaaagagagacacttggccaccctaaccatagatgtttaggccaaacacagtggtactggcaacatggagaggataggggaaactgtgtagtcaaatatcttcctagtcagtctccaagggaaagatagtagatactcaatatcataaatgtaatacctttctaatgaaatgtcattttgaatacaagtttagttgacagcaccacttgtcctgaacgatgtaccccaaagtggctgcaatatcattctcaccttttccaaagattatctgacctcatgcagtggctgctgagctccagtagccagagggaaaaaaatggcatgtcctcacctcactttttgtaatcttattcatgtttgcaattgtaatcatttctgcagagaaaaggccaaccttgctgttaccctctgcaatgacaaggaggagatcatggcccaggccaccttcctggactaccccaactggaatgttgccaagcaggatgactgggtgtcagtgttccgggagctcgacagtgacatcccatgcacagtaagaaatcacatacagtgcttgttagaacaccctgaatcttgaggggaagtcctgtgtttgtgattatgtctttccaagttttgtactgagcagtatatgacatcatgacagttaaaagtgaagggagctggtggggaggaaaagagggctgagagtagtgccaggggggataggaaagggcagggagtagccaagttggctagccgctggcaaggcctggatcgtgcttcactaatgacggcgggggaggaattagtggaagtgtcaaacgtgtgcttccaggtctcacgttgttctccaggcgtcagtgtccaaggtcattgatatgttaggagagcacctgccgtctacacaattgcccttgtaatcatgacagcagagcctcagacttctgtcacattctataattttcaaagtgccctcatggaccttggcttatttgatgtcttctagctgctgacacatgacaacttgtcagccaacagaagctaggttagtggttcccaggagtctggcctgggtacctgatgccaagtctgagctttctctgcatgcaacctgccagagccaggccagagacaggccccagtttttgtggagtgccagaggctacaactctgggcagcaccctggccttgtggtggaattctgcagcatgtccccagagccctgatgtcagaagaaaagggaatgcccaatgagtgtgagtgaattcaccccccgtacatgtgtgtgaatgtgcacacatacacacacccgtaagcatattattcagcatttatttcactagatggtgccttcccctcatcttttgtgttctctcctaccctgccaccctgtatacctaaggactattgtcagaaaaattatcgcaaacttggaaatagaccaaaacgattatttcagtccaatgcttgcacctttggttgagtagcctgttttacaattctgtaggaatggtgattagcctgtagatttttgtccattaggatgtaaagaattcctgtctggatagagctaacctcaaaggttatggtttattgtcttacaggatgtgacctatttggtatctaatctagcaatctttttttttttttttttttttttttttttttttttttttttgagatggagtctcactctgtcgtccaggctggagtacagtggcacgatctcggcttactgcaagctctgcctcccagattcatgccattctcctgcctcagcctcccaagtagctgggactataggcgcctgccaccacgcccggctaatttttttgtatttttagtagagacagggtttcactatgttagccaggatggtctcgatctcctgacctcgtgatccacctgcctcggcctcccaaagtgctgggattacaggtgtgagccactgtgcctggcctaatccagcaatcttattctttccttttcctagtaaatcacctgaagtatccagctcttcaagtgcaaagaatcatttttatcatctcactggttgcctcattaattgatttgttgaagttgaataaacctctgatagatgtttattttatatttgcattagggttatgattttacctttctgaaaattataaattaacactcttattcataaacacatgccccttttgtttcttttcaagctgtcttctatgacagtatagtgctgggctgtccaatgtggtagccaccagccttatgtaactaacgagcgcttgaaatgtagctagtctgaattgaggtgttccataagtataaaatatgccagatttcaaatacttcgtaggaaaaaaagagtgtaaaatatctcattaataatttttataatgattacttgttaaaatgatataatttgaatatattaggttaaatattaacttaaatattaaacattaattcacctgtttatctttattcttttttaatgtgtctactagaaaatttgaaatgacatttgtggcttgcattacttttctgctggatgtaaccagtatagagcctttaaggcttaatgcagtatctatcccagggatatttgcagctgaagtaatgatttttatcttaaagctaaagaataaatcttgcattgtaatatttatgatggaagagagaatttgggagacaaatcaagcaagtaataagccatatgctcctgaggctagtcctattcaggatgtaaggcaaatgctgagtgagattattgtgggattaaatgagtgaatacacagcaagtacttgaaatcatgtcgtcgtcatcgttatctggacttttgggatttgtgttgtttgccttttgggagttttcaagctcatgaatcaaaacatggttttcctcttgcgcttttagtcaccgtacaattctttccgagtgcttctgagtcacacaccatccgacagaagtggggacaaggcacacagaagtgccactggtcccacaaagctgtccagaaaattattcaaaaaacaagaaacctaggcagcacctgtgctgtcctgatataggtaccagcaccaccctcaccagtcagccagtctacatctgcactgtttccagaatttgaagatttgttcataagcacaggggtaccgagttgagtggaccaatgtgtggatgtttgaaccatttactcattatttaggccactttaaaagtctcagaaggaggagacaaagctcttttaaaacttggaagatttaactggaaagtcttgctagaatcttgctactgtgagttttcagctcccaggttttttggatcccaagagtaatatttgattctgactctgggaatgttgaacaaaacaagccaatggattctgaacgtggcatctgccttccatttttcaaattcataagagcatctctccctcctgtcacatgaatagagcagcagctgctgactcaagagcgccgggaaaagggtgattgtctttcacttggcatagacacccctgaggacaagactactgagttaataatcgatttcactcccctgcaggctctcccgcagctcattcgtgagggcaggaggaagggcgggtgctctggactcatttacagtccctgtttccttaaataattgtgagtaaggaggacagaaggcggcaaacggagtcagtgagacagctcaaatgccgcctgggtgttgcatcacttagacataaaatatcaaccctaaatgccaggctgttctgtgtctgtggatgccccgaaaccctctttccaccctgtgctgacctagcccgaatactgactcagcctttaatccgtgttctctcttcttctgcagcccctgaatacgttgttcatgcacctctttgtggccgtggatgagtattctgttggctgttgcaaagagattcttcggtgagtggatatggccgtgcagtggtgaacatgaaagagactgtgtggatagttttgaaatattttttaaaagacatgaaattctttggggtgtttaatttgcttgtaatttgtggctatattaaaatatttactttgaatagcaatgatatttctgaaaggagatagttctttgaatctattgtccattctgcacgctgttatcatttgaggcaaacagatagtgcagtaatttaaagaaatggatttaggttgaggggagtaggagaagaattaagtgtcgcaagcttggacatttctaaaaactgcttttctttatcttatctttagaaatgtttattaacatgacagacttcaaagcatcctgaataataggatgcatggaaaatgaccagcagggctaccgagtcatggcgatgtgtctctgacagcctctgacagcctgcacagacatttgggggtggtggtcacagctttcaagtcactttgtaatgtcacaccagaccgtccagatgccaggtcaaaggttaatattagcagaaatctggtgtgccatatgaacatggcaccctttattctctctgcctccatgggacagatcgaaaaggggccctttagaacccaaggaaaagtagagaagaaaaagaaattgccttgaggctgttcttgccattgcaggtggggagcaaaggagcccatgtggatttaggaacacctcacctttttagtgacagcatttgtcttcatcaagtgccagctgatgggattgctttgttagtaacactgccccaccctctctttcctcaccagaaccgtgtataaggcagtgccagagctgcacttcatatttctcatcgtgccatcctacatgagcctaggtaaggcccgcccaaccacctctggtccccggtagcaaacattgaaaattcactcccagaatggtgctttggggaatgagaaataagagtggtctccaggtcctcaatgtaccatgtgcatattttattagaacaattaagcacaatttagaatggaaactacattttgttctgacatcccaaatttatttcttgataaataaggacatgtttctttatctctgtgatttaggctcaactctcataactgtttttgaccaagtggggaacatcccgtgtctgacgtatgaggaagactttgcagtgcatatatgtcacaggcacagccactatcctcagctgcacgttcgcaaagccaggtacagttggagtcatgccttgtgtgacctaagcttcactgggacagtcatcttcccaagactctttaaactaccaatgctaagtgactatagcttagatcaaaattttttacaatactcataagcattacttcatttggatatctttatagttccccttaatgacattatttgcaggactatctgatgatactcatttggttctatgtggctataacattattcattgactccttaggggtttctgaaaacacacaatcctaggtcccacaccagtaagataactttcaaataaaacaagcttaaaaatgaacctgcctattcagttttctcggtaaaacccacctattttctgacattcagtgaatgaggatgctgttgaccccaaagaggggttttccaaattgaaggtctctaccatcaggtgccccaagtccagcagtcttagggagatggctgtggcagtgttttccaaagatggctgccacactactttccaccccgcaggctactctttgatgtgactttgccactcctctcttcaagccttgggcgctccgtcctctcttcctgaagctgggtgggttgtgactgctttgaccagtagaccgtggccaaagggatgctctgggacttgtgaggctgggaagcttctgcctggctctctcaggatgcttgctctggaggaagccagccatatgtaagaagtctggagaagccacatgttcgcaaggggaggggtggttgacagccccagctgggctcccgctgacagttagcttccactgcctgtggtgtgaatgagccattgtggacacccagcccaggagagccccatatatctacagcacagctgacatctgatcgcagccacatgacagaccccaagtgaggatgcccagctgagccctgccagagttctgactcacaaaaccatgagcaatgtagagtggctgtttggaaataagagtgcattatgaaatcatctcacagaggtggttgcttggcttatcagtgaagaataaattgtatcttttgggatcagccattgctgtgtttgaggaatgctgactttctttagaaaagtattttaaaagttttaaaaactttataaaagtaagagcctatgatttaccaggcatgtagcagtggtatggcatcgttgttaagagtttgtaatgctggcatcggatagatctggattctgatcttggctctcctgctcacgaggtgggttaacttacaaaaggaacgtgacatctgcgggggtgtaagttccctctgtcagtgggtgtaagcgtattgtctacagcacaagattgtgatgattgtgagctaatgaacatcaagcacttagcacacttcctgccacatgtaagggcccaataaatattaaatattattatgacaaaggggcttagagttaagtggtggggagagactcatcttcagttaactgtcatgttggtagctgagaagcgggatgcacagacagagatgaagacagcttcattacaactgctcctccgcccaaaaaaacccctctaaatgtccatccaccagttaatgttgtttacccttataaactgtggtacatccatacagtggatgctactcagcaattcagtggaatgaaccatttacatatagtagcatgaatcaatctcagaaggtttatgctgagtgaaggcagacttagaaaagcatatacagtactgctgattacacttttgtgatatacaaaatgggtgaaaagcatccacagagataggaatcagatagagatagaaaccaagatcatggagatcatgacacaggctggaattctagcagcgacaggtcacagagatccaggttgttgacagcaagagtcagactctgtaaaatgtttgaagaggtttattctgagccaaatacaagtgaccagggctttgacacagccccaggaggtcctgagaacatgtgcctgaagtggttgggctacagcttggttttatacattttagggagatataagacacaaatcaataaatgtaagatgtgcattggttcagtctggaaagacaggacaactcaaagcagagaagagccttccaggtcataggcggattcaaagattttctgattggcagttgattgaaagggtttatctaaagacctggaatcaatatgagggagtgtctgggttaagataggggttgtggagacagaggttcttattgtgcagatgaggcctccaggtagcaggcttcagagagaatagattgtaaatcttttttatcagacttaaaaatatgcctgactcttagttaattctctcttggatcaggaaaaatgcctggaaaggaaggggattcaccacagaatgtagaattttctccgaagagacagttttgcagggtcatttcaaagtatgtcaaagaaatatattttggggtaaaaaacttcagtttatttcagggcctgccctgctgtcatgtttgtatcttattcctacaaagagtctgttctgtcattcttaagatctctgttttcatgttaatcctggtcaaatgttcctaaattccaaagggaaagtataatgaggcatgaccgaccacccaatcccatcatgcgctgaactggtatttcaggtttatgttagaatacccttggctgagaggaggagtccattccattggtttgggggagcttagaattttatttttggttacgtggtagggaaaggatcaggtcaggtgcatagatacagagagacatgttagagagtagcgcttggctaccagttggatggaggagttgagggatgaggagtttatggtaattcagggttttcaagtttaggggaaatggtgctttcattaactgaaagtagaaataatagatttaaatggacaggagaaggtaggaaatagaaacagagggagaagccaggtttgagatacacatttgtgagttgtcagtttgtcagtaagtggggagatcatgaaatgaaggagattgtcttgctgagggggagattgcacagtgaaaaagcacaggaccagggcagaactttgaaagatgaaaatgagctatgaataatgaaaactagaagagagggagaggaatacagaagaaattaagactcataaagtggcaaaagatgcagggaaatgaaattatttaagtaaaagagaagccattagatttggcaatttaaaaaggcacagataggatgaataaaactgatacttccagccaaactgaccaagaaaaaagacaaattgccagtatcaggaatgaaagaggtggtatcacttacagatcctacaggcattgaaagattaatatggggacattacagataactcaatgtcgataaatctaacaatttagataaaaatgggccaactactttaggaacacaaattaccaaaactcatttaagaaaaaataggtaacttggatgcttccgtatctattaaagaaaaatcagatgaactttgggtgagaggaagggggccctcctgcccagacattggcctctccccaacccacagcctgatttgctctttttctcctctttttctcttgttctcatgactctgaactctgccttcctcaggacctagtcctcagttttctctcaagctcatccctttgactcctctgtgccaaccttgccactcagtaaccagtgccctacttctgaactcttggtttggggtgtggtcttgtcactccttgaagggcagagtttcacaggagaggccaaattgcagtgagcggaataaatgggaggtaaggaaatgaaagcaaaggagtagtcagtgctattttttttttcctttttgctggagaaagtcactgctcttcagagaagttttgtgttgaagggaagcagagagagggaggccagaaacctacctgcagatgctgaacattatgcaaacagtgtaatgtgatcccgtttttcctatccacgtggagcattttatttgcattctgagagcggggcagcatgtctcttaacgaagttcaccaagaagcagatgaacttcagatacatattatctacctaatttagtttgagagaagaaaattcctcatataaaatgatctttcattactttctttttattaatagctaaataatcctctctttataaaaccctttgataatgatacaaatactaatgcaagccaaaggcagtctgaagaaatggaattttgtgtatgaaatgacatttttaattggttctctcatgtctttcaaatttttattcctgatttataaagtgtctcttgttagtgtcaggggaggcaaatagaccctcctgtccttcaggaaattatattttttaaagaaatattaccttcagtttttaaattacaagaatctccacaaattaattacttaggatcttgtaagtagtgtaacaattgttacacttttatattcattttaaaatctctcattttttatgccatttactaattttttggggagatgggtttatttaataaaatgaattctagtttcaaatcataaaacttaaaagtaaaagttattctttcatttttctgtgtatgtaactatacacacacaagtatagtggcatacatgcactctctctacatatatacctatatatatctccatgatcatatgttctgttaattatatttttcacttaacatagcatctcatcatttatcatctttagagatcaatttctttcttttctgatggtgcctggtccatgatggcctaaccatcatgtagctctaatacaattcatttagctcttgcttatttatggaaatttaatttaagttgtttcctgtaaaaaatttaccactttttctataaaaaataatactgtagtaaacagcattgtacatatatcatccagcattcatatatagtagtgtacaacagataactaaatgtggaatttggtgtaggaaatacccagatgtttgcaaattctaagatttaaaaatagatgccaccaaattattcaacgtaaatatcatatccatttatattctgaccaaatagagttgtttccttacatcttcatcagtgctgagtattttcagttattaaaactgtttcctggccgggcacagtggttcacacctgtaatcccagcactttgggaggctgaggcaggcagatcacgaggtcaagagattgagaccatcttggccaacatggtgaaaccccgtctcttctaaaaatacaaaaattaactgggcgtggtggcatgcatctgtagtcccagctactcgggaggctgaggcaggagaatctcttgaacctgggaggcggaggttgcagtgatccgagattgtgccattgtactccagcctggcgacagagcaagactccatctcaaaaaaaaaaagaaaagaaaaaaggttccctgttagaccaaaatagtattttgttgctttaaattgcatttgtctaaatctgtgagagtttgagtgccattttacaggttccattttaaatgaataaaatacttgaatttaaagtaacttccagttaagctatcatcctaccagatgattaaacatgttcctacaaagtaggcaattctagacaattccaaaggattgggcaggggatagatatgagttacttacaactgacaaaggcaaatttctaaaagtattttcttaagttttagtcaggatacccgatttgtatcttgggaattatcattttctggaggtatgtagggcttaattaaggactttcaacttagttattcagcaagggattattgtaatagaaaacttgtatataaatccaacactgaaaatgacatgtatagaagcagcccattcaaaaattccctattcctttcactttttagtaaggtattgtctgttaatttactcgctaatagcctacttgtcactcaggatgcagggtgcaggagaaaagatgtgggatgtgctcagcccagtgccaggctcccagtaagcatttggtaacagatggttatggtttggtctccctttctgcctcctttcctacaccccttccttcttttcttccatttttctcttgaaaacttgagtgctatggactataaccttcagtggacaaggttcacaaaacttgaaataaacctggataccttaacctgaggtcttgcacatacagcccctgatgtgcccatagaaaatctgaaagaagcaaaacacaagaggaatgatagcaaagaggtgacagtgggtactttgcagtgaggaagggatgtttattagaagataagtggacagtagtgaattcgtgtggaaatggtgacagtatggcagtcagtgcctttgcctgcagaaggtagagagtgtggcacattttagaaagccctctatccacatgttcagattcgagttttgatacttgcaggcacagaatttcatgtatctggagattgcagttgtgtggactacctccctccttaacaacgctagaaaaatggagactttacagaacatcaaatgggcgtggctgtgtgcctcttaggttgcctcctttctcttatttccctcacatgtattttttgacatccgtttcaacgatagttacttgcactgatagttaatggtgaagaacacaattcgtaagacactgaaccagtgaagggtttggggatgtaattatccttcagccatttggctagtgacacattcaaaaccaatgaattaacactgtaatcccctgtcctgtttctttgatttacccatgtggaaaattatgctgtaatctgcccatctacttagacagtaattagtgaagttactgttctgtacttttcatactatctgaaataaagcatagctacttctggacacacctctaaaatctacagtgggcttaattaatcatccatggtggatttgagatgtgttcagatttagaaactactggcatgctctttttctgggggaaaacctgtctttttcaagtcctcctggggctgggaggagacttggccaaggaaaggattatgtgctttcaaacaatgttgtgaaataactggtttccttagtggagtattgcttctttgttgataacaatggttgattaaattggctcaaccttgttgctttttaaaatagatgaaaaatctctaatcatcagggaaatgcaaattaaaccacagtgagatactactaccttactcctgcaaggatggccataatttaaaagtcaaaaaacagcagatgttggcatggatgtggtgaaaaagaacacttttacgctgctggtgggaatgtaaactagtacaaccactatggaaaacagtgtggagattccttaaagaactaaaagtagagctaccactcaatccagcaatcccactactgggaatctacacaaaggaaaataagttattatatgaaaaagatacatgtatacacacgtttatagcagcacaatttacaattgcaaggatatggaaccaacctaagtgcccatcgaccaatgagtggttaaaggaaatgtgatattcatacaccgtggaatactactcagccataaaaatgaacaaaataatgtcttttgttgcaccttggatgaagctggaggccattattctaagtgaagtaactcaggaatggaaaaccaaataccgtatgttctcacttgtaagtgggagctaagctatgaggacacaaaggcatacagagtgacatagtggaccgtgggggctggggagggggaggttcggagggggtgaggaataaaatccaacctattgggtacagtgtacactgctcaggtgatgggtgcactaaaatctcagaattcactactaaggaactcatccatttgactaaaaaccacctgtattcccaaaactattgaaattaaaagaaataaaatagatgaaaaaaacattctttaagatttaagatgggtggtttgtaattacaaacttttaactcttaaggcaatcattttaatgaaacatttgatagtcccatgtcatgctttttagaaatccacttaaacttgacttctgagcaatttcatatgaataattatgaatatcctaaagcattccaaaagaagggatagggcaattacagatttcccccaacaatcttcatgaataagactggtaagtgaccaccaagtctatggtggagccaagtccagctggagccatactagcccaggatggacgtttagatcagatgtgctttgaaaagcacatgacaaatttgagcttaaaacccttcataatttttaaaatcatgacattttccaaggactagaagctaaatgactccaaaacccatttggaagttctacagtggaatactatatggagtttagaaatgatagatttgattttcttaaagaagaccactagaggtcacaagagatcttgaaaagaaaaagggtgcttggttttgcatacctgaagtgaaagaaaaatctagttgacgccgatcttaggttctcctaccccatgttgagatggtgttcatggtaaaaagttggcttaactagaacacactgcattctctatcactaccactaaattagattttctatgacttgttttcttaattcactggtttcttaaaatacacacacacacaggtttgaagaaatatatttatggtgtttgaagtgacaacattcagttgtacattttacaactgtacattttaaagtccagctttaaatacaaatcctctctggatatggagaatatcatcagacaggaatgaggaggctgtgccaggattctggatgcggaggtggcctgctgctgctgctgctgctgctgctgctgctgctgctgtcactccagtccttaagtgtgagttttccatctgtgcatttgcagtggtttctgtgctggcagggaagtgatgcacacctctcagactcgagggaagcaggcctgcaggttttcctctggggccgtaatcatgtagtgcagcagccaggctgtggaggtgatgaagcaatgtcaggatctgcgtgtcacccagagacccatcaggctgcgagggagagttctgcatgttctggatgtcgcggtgctcctagcaagctcagctaaccgactggtggaagtgctgagggagtttgtcctcacttctccccaccttccaggaagccagtgagagctaccggctcatttctagctgtggacttagaagacacccatttcccaagtagggtgtcctgaaagggggttgatttccttaaggtgtgtgttcaactccatttcacatggcacagttttcagagtctgatggaaatctgggtgtctgagagattgataagtgtttatgaggtggaccttttgtttcctccagggaagttaaaataaaatattgtataattgatgacgttaacaagcacattgctgccccctccaagacacattcagaatggaagatataaagtaactttgcttttcgctcagagaattgtactatttccgttgcactctgtgctgatctataaactccgcatcttcatcgccactggaacactgtgcggcctgtcagtgccagggcatgtgacgctgcggtgccaaattcacagtggctctccttgcatcctgactttgacaggcagcgctcattgcctcagaacagtcacgttgaaacatttgactgcatgagttgttttccatagctggggtgttttgtttctgtggggctggactttgtcatatgccatttgagactatgtgaggctgatgtcatactttatcattagcactcgggctgatgcaagatcataaattatcaattaccccaaggaatgcatttagcagaacaagttcctctttatccattttgggaaagggcttaagagagagcctcttcagaactccaagatttggatgtttttctatttttcccagaagaattcgtgttgaggtatgattatggataactttgttaacgggctgctgaggttcatgagcaggcctagggctctgggtctttcggaacctttattcctgatgtttatagctacagagtaatatttctgtgtccatcgtatatttaaaagcctatggtgcacagttgattgtgtgtgattgctgtcttcattcacttaaatgattaggttattgaattatttttccattatttaaaatgtctgttaataaatattgatgcaaccttttatttttggcaaaacgtttgaaaatggatttgttgactactctctcctagaattttttacaaattattcttagccaatatcatcaaggactcttttttacagagaaaagccaccacctcttattagcaatgcccttttggcaggttaagtggggaagtgagttgttcctggaatgttctaggctttttctgccaaggttctgagggctcacgtggagaacaaacacttgctaaggacttagtgtgccccagagagcaggctttagtgcgtcatctgtgtcttgcagctattcttgtccctacctgttttttgtacatgagaaaaccaagtcttagcattgaagtgactttgccagtttcttttttttttttctttcaaattttattattattatactttaagttttagggtacatgtgcacaatgtgcaggtttgttacatgtgtgtacatgtgccatactggtgtgctgcacccattaactcatcatttagtattaggtatatctcctaatgctatccctcccccctccccccaccccacaacagtccctggagtgtgatgttccccttcctgtgtccatgtgttctcattgttcaattcccacctatgagtgagaacatgcagtgtttggtttttttgtccttgagatagtttgctgagaatgatggtttccagcttcatccatgtccctacaaaggacatgaactcatcattttttatggactttgccggtttcttagtcagtagagtcagaaggctaagtagaggggctgtgatgccaccagcatgggaccataggttcagactgcccagacgctgccccttgggcataaaaattctgcccttcactgctgtcagtgtaaatgggacccttggcaaggtctcagcacaaggtaagggcccagttcacgttggctattgctgctgggttacatgctaaagaactgctacagaattccttctgtgtccctaaagagcattttccgtggttgggaagatgccacaccttggccgtaagaattagcaccagaactggacaatatatatccagtgatgatcccatcattgggttcctgggaagggaagttgggagagaagagtcaccggagggtgtagggtggagatgagctttggaggatgctggaattggggataggcaaggggatcagagcactggctagaaatagaggtgggaaggagggaagatggtgaagtctccttctagagacaataagtaaatcaacttgtatcattattggtgactagggtggaaagatgcaggcaaagaattttgtgcccatcccagaaacagtggggagcttgcaaaagtggagttttaaaaaaataatttcaatttttattttagatttagggggtacatgtgcaggtttgttacccgggtatattgcatgatgctgagatttggggtacaattgatcccatcacccaggtactgagcatagtactcaacagtttttcaacccataccctgctccttctctcccctccctagaagtccccagtgtctatcgttaccatctttatgtccctgagtgcccattgtttagctcctacttataagtgaaaacatgcagtatttgtttttttgttcctgcattaattcacttagggtaatgaccttcagctgcaaccatgttgctgcaaaggacatgatttcattatttcttatggctgcatgtaaaagttttaaagtaagatgaagaaagcagggttttaagaagattagtgatggtggatggaatgacagagtttctccttacagtagtcaatgggaagtgagtgcagtgattcaagcttctgtagtaagaaactctcttattccacccactgactgtagaaattcttcagttctttttggtttctcctgcctaagtaataatgataataacaataacattgcacataacccttttttaacgtttgctatttttgtgacagatgcacacacggtaacatagagaggtaaagtacccaaggtcacagctgggcagaagcaggatccagacccaggcagcctggctcccccgctcaggctgtgaccactatgctgtatcatttttttttttctaatctcttcaagagcaccataagacttaatgcatttatggtggcgcctcagtccactgggccacaggtgaccaccgataatgctcagtgatcacatgcagaaatagatggacaagtggtcaaggccctaccttttgtaaattattgcagggctgaaatagcttgaaaaatgactgcagcatcagtagtacagtcatacccattcaaaaaatggttgacatttgtttctggcttcctgttttagcctcatcactagaaattcctgctgatgcccttgcatcatggaataagactgtttggtggtgatgacatcagggccaggttgacagttttaaaaaacaaaggatctggttgcctggttaaggaccctttgctgtctctccttccagagagttttgacaagaggtgtattagtccattctcacactactataaggacatacctgagactagactatttatgaaggaaagaggtttaattgactcacagttctgcagcgctggggaggcatcaggaaacttacaatcatggtggaaggggaagcaaacacatctttcttcacaaggcagcaagaaagaacaatgagagccgagtgaaaggggaggccccttataaaaccatcatatctcctgagaaccttctcactatcatgagaatagcatgggggcagtcacccccatgattcaattacctcccaccagcttcctcccatgacatgtggggattatgggaactacaattcaagatgagatttgggtggggacacagccaaaccatatcaagaggttaacaagaagattcaacctgtggagtcatggtgatggtccctcccatcccgagttgtcatcttctgtgtgtgttttttcctccttgtaccgtggtcttgttggctggctccctccttccctctgaagttttatagaccagagacctggcttttcaactgtgtagttcttccatcaagatacttactgtttttaatgaaaaaccagcatcatttcaaccgttacacttgtgtcagcagaggcaaaggtttcatcctgggagcagggtgaagattttcatccagagtgcatgcggtcattcagtttaaagcatttagacttaggaagtgcagctgtggcaggatcaggggattcgttcctgcagggcgcaggaggaatggtggcagggctggcaggacgataacctctggcccctagccaaggactcccctctcaactcttttgcttccagctacaaatgttcaaaagaagagtcaaaataaaggaagattttgaagtgcattgtcagcttagcagagtgtgaaggcagggcttaagtcactagaccagagctcatatcacggctctgctgccaactatttctgtcatctcaggcaaagcatttcctcatccccatgggccttgctctcctccctctgcaaagtgaaaatggcagtgccaccctcctgggatcactgtgagaaacacagtagcagaaatcatctggataaagccctgagctttatatatatatatatatactgatcactcagtagatggagctgctattaacgtcaaagagaacatactagaagataaaatgggatgatgaagatggtagcatagtaaagctagggggaggaaatagacattagtagccaaagcagatatactagaaaaaaataacacaatgctgaaacatttttacagaaagagtatcagagaaaaaaaaaaaaaagcaaagtataagaacatcccacacaggtaaaaaagagcactaaacttacccaagaatgtgctaaaaagaagaaaggagtgttaaatcctgcagcaagatggaacacaggagctagcctccccaagctgcaataaatctggtttttgttcccacctgccaccgccccctgtgccagactagttgtcaaggtctctgtagagggtcctgagaatggaagcggagtggatgtccccaggagggtgagcagtgctccatcacttcaccagccttcccctccatggcaagtgcagaggcatctcaggaataaaggatgccatgggccagtgtttgaaaaatgcataaacaaggttaaatattctttactgtagtgcttctcagagtctttaatatgtaactatgaaacaggaagggacttatagtggttactgtttttaggcattggaattctttgggctgagaggatgctcgggacaatatcatagtggtgtttcttagaacatccttgggaagtgctgcccctagtctcttgtcctttggcccatgacaagtgcttccctgcatcccacacccacacatgccaactgtgttccctctgcctgcaatgttccacttctaggtttcaacatagcttcttccctttctgttcattcagctctcagctcagatgaccctcctcatagaggtcctccctgaccacttgaccctctcactctctatcccaaagcatgtatcattatttgaaatgtttagaattgtctaaattggttacatctttattgtctgtttctcctattagaaggaaagttcaggccaggcgtggcagctcacatttgtaatcccagcactctgggaggccgaggcaggcagatcatgaggtcaagagatagaaaccatcctggccaacatggtgaaaccctatctctactaaaaatacaaaaattagctgggcgtggtggtgcatgcctatagtcccacctactcgggaggctgaggcaggagaatcgcttgaacccgggaagcagaggttgcaatgagccgagatcacgccactgcattccagtctggcaacagagtgagactccctctcaaaaaaaaaaaaaaaaaaaaaaaagaaggaaagttgatatcatgagtgttgctctagccccggcacttagaacagggtctggcacacagttggtgccctgttgaaggaaaaaaatgagtgaacgaacactgaacttcagcctttctattaaacagggtggaagaccatgacgatctcatgccaatatttatgcgctatgacacaattctgaaggaaacttacggtgaatacttcctggccgaactaatagaggcccaagatgaagagaatcatgctgttgtgtgtgaggtcagtgactgattcatgtgggaacacacttagtgagaggaaggagggatgtgagtggtgttgctcttgcgttgctgggcacccctggagctgccattgtctccctggccaccccggccctcccactgcccttccaggtggtgcaccaggccagcttcctcccctgggttactggctttaggttgtcttttgcgaggtccttccagatgcccacgatgctgtagattcttgccttgtccctagagtgagagggaatggaaaagaccccccaggggtgcgtagggggatttctgaggatccccaaatctcagacttcagaagtcacaaaccagcgttctgctggcagatggattttgtttgagttggaaaggtattttttttaactttttgttttgacatagtttcacacttaaagaaagtttataactacccagattccccaaatgttaacatccaaccccatttgttttatcattctcttgttcaacctttctaattccctctctctctctctttttctctcttgctggctctctctctctctctcatgtatattctgaaccatttgagagtaagttgcatacataatgcccctttacctgtaagtatttcaatgtatatttcctaaaaacaaggacactctcttagataactgcaatacaatgatcaaagccaagtaattatgattcctgtaattattattattattattattttttgagatggagccttgctctgtcacccagactggagtgcactgtcatgatctcggctcactgcaacctccgcctctcgggttcaagcaattctcctgcctcagcctccctagtagctgggattacaggtgtgcgccaccacgcccagctaacttttgtatttttagtagagacggggtttcaccatgttggccaggctgacctgaggtgaactcctgacctcaggtgatccgcccgccttggcctcccaaagtgctgggattacaggcgtgagccaccgtgcccagctagttcctgcaattcttttatctaatctacagacttcattcagatttttctgacagtcccaggaatgtcctttatggcagaggtaattccaggccattcattgcattcaggtgctctgtttcttcagcctttttaaatctggaacaattctccgatccgtctttatcttccatgacaattacagttttgaatagtacaggtcagttattttgtagaatgtctccatttggatttgtacaatgttttctcatgatttgattcaagttatatatgattaaatatttttgaattagcagctattgtaaaaattatgaaagtctatgtaaaaattggaatttctagcttttctaaacaaatcagaaggcccagcctattgggcccaaaaggcagcccacaccctctaattcatgattcttcatctactcatttctcattatttgttaaaactgtaagagctgtttaaagaatattacttttcttgaaacttggaatgaaaagttctcttacttggatgacatgagcagtttgaggctttgttctacatcagtggttctcaaacttggcatatatgcagatcacctgggaggcttttaactatccataccatgccaatgacttggatccagaatatatacaaagaactctcacaacaatagaaaaataatccacataaaatgtgggcaaatgattcgaatagacacttttaaaaaaaatgaataaataaaagatacaactggccaataagcacatgaaaagacattcaacatcattagtcattaaggaaaggcaaatcaaaaccacactaagataccactttacctctgctaggagggttataataaaaaagcaggacaatagcagatgttggcaaggatgtggagaaattggaagcctcatccattgctggtaggaatataaaatgctgtggccattttggaaaaagtctggtattttctccaaaagttaaacatttgacccagcaattccatacacagaattgaaaacacatgtccacacagagatgtgtacgcaaatgttcatagcagcattattcataatagccaaaaagtggagacagcccaaatgtctatctactgatgaatagataaacaagatgtggtatatccacacaagggaatagtaccaggaaataaaagagaacgaagcactgatacatgctacagcgtgtatgaaccttgaaaacatgatgctaaagaaaagaagtcagtcataaagaccacgtattgtatgatggcatttagatgaaagcctagaatagacacttctgtagagacagaaggtagattagtgactggagggaaaggggaaggagaagtgactaatattgggcatagtcgttggttggtggggggatgaaaatgttctgggattagacagtggtgatgggtgtacaattttgtgaatatattaaaaaccattgaattgtgtatttcttttttttttttttttttgagacagagtcttgctctgttgcccaggctggagtgcagtgatgtgatcttggctgactgcaacctccacctcccgggttcaagtgattctcctgcctcagcctcccaagtagctgggattacatgcatgtgccaccacaccaggctaatttttgtatttttagtagagatggggttttgccatgttgaccaggctggtctcaaactcttggcctcaagtgatctgcctcccaaagtgttggaattacaggtgtgagccactgcaccaggcatgaattgtgtacttcttgaagggttgtttttatggtaggtgaattatatcaattatatccatttttaaaaatcctgttgcaggggtacactcaggccaattaagtcaatcttttgggggtgagacacaatccatatatttatttttaattttggacactcactatgttgcccaggcttttcttaaactgcagtcctcctgcctcagcctcccaaagtgctacggttacaggcatgagccaccatgcctgacctcaatctggatttttaaagatctccccagatgattccaaggtgcagtccaggtggtgaaacactcatctacatgagggtaaaacatacctggtgagaatgacatgactttatagagatgtgggtattagtttctgaaggtgacaattggcccctggaaattagattctgaagtactacattgaaaggatttttatttattttttaaatgtttattttattttcttatatttaggttttggcatggtttctcaaagacccgctttcacgtattcttgtttagccattagccccaggctaccaggctagccatagaagggagggttggaagcatttgggcccagcagtaccatttggaaagcttgtctttacacaactagacagaaactcctgagaagtgaaatgattcatacagaccccaataaggattttcatgaccaaactttacttatcaggtttaatcagggtctttgtttttggaaggcttttaattatttggttccaaggtactagttttactctgaatcacttgagtcagtgctttgtagagaagctgcagtgacctcttcccccacgttctttctctctcttgccgtatgtttcacactttcagtgtgtgtaaacatcagagcaaagctgtaggctgaaaactgcagttccaaccctgcaagaatcctttggtgtctcgaaagaggcagagggcatccagccccatctccttccagaggccgtgctgcctcaagcatcagaggctttgtgttctgtggaggggagaccacagacctcgatcttaaaatggaagggcagaaacaagactgtgagccgggatctgggaggggacgtctaatctgaagtgagccatgtctgatgtctgaagccttttggggttcaagatcaatgctgttgctaccctttttcctgcctccctagggggcttttaggcaatggtgtgctggagccagcttgctctggctctcaagggctgattgttaaatcctcaggaactctgcaaactgcttgttaaacacagctattattaaaaattaaattatagaaacctacagtgtaataaattatattaaaacaaagttaataaatacttgaaattcatcaccttccatttttttttactattctccatgttcttgagggtttttttttaaatgtctgggtctctatacagtagatataagaaataatggctagctactgcgcattccctcccaactacatgtttagtgagatcacactgttcacttgacattgaccatgatgacagcgcttacacctcagaaatcggcaaatgctacagatctgggcttttcccccgcaaatgctgattaggcatttacaggcacacgttactttaaggcaaccactgtcaaccagaggaaacagaaagaagtccatcaagtttgtctttctgaacagccatggcagttccaggccaggcatgcagcatgcctgagggcaaggctgtgccctgtgggaaacccttactactgaaagggtttttagttacaaggactttctttggcttgatagctagtttggaggagtttggggccatcacttcatacaagttccttgtcataactgtaccctggcttaccttgacatctggtgtttactccaagctgaggttttagggaagggtagttggaggccagcggcggctcctagtgacagatgggcagagcgtctgctttggcatcatccagggtgtgggcagcagtggtccgagtaggcaccactgacctgcaggcagggaaagcctgccaggtcagccatgcgcttggcatcaggaggagaggatcagagccagcagtggtcacaatgagggcaaaaccctcacagtggaatattgtcacccaaaagggatgggtggctgtagggctttttggatggaagcataaatgagaaaatacacacgtttctgtaaatggacctgtttgggaagacaaggccacagtacacatagttttctagcaatctaaaccttatgtgtcatgatgtagatatttacaggacaagcaagaacaacaaaaccttcagttttgttctccagtataagataattgaagacacttgtggtgaaaagtacttctgtcaccaggaagatagataacagccagcaatcaatgcctttctgttgtacaagttaaaaagtccattaaatccatttttttttcagtgcatacacaagaatacatttggatactcctgcaaattcatatttaagaatagtgtttctcaaatcggttatttgaaagaaactcaaaggaaaaagcagacacttccacaatatgtccttgctctgttgtagtctgtaattgtgaacttttgtaaattgttacaaccctggatgaatgatgggaatataacaggttgtagaattggagaacgttaaatctttgttcctaatggcaaaacatgtttttctcattttcatcagaatgtgtgatccatgccatttgaaatcaaattccaaacacaatgagccattagtgtaatagctcattactaacagcggtcttataaataatacattcttatcatacacatgcagctcgctgtgaagccagcaaaaggtatttcaggccatcgaagttttgttgcgccagcgcggctgtagattagaaggacatctccatgtgaaccaagatggatgccaattttccctgccgagagtcaggctggccgtctctttctgcacatatggtagatggattggttaatcagcgtctgctgagtcttgggcctgaaattacagagaagctagacaactgcggctatgcagcctttgttcacgagtgcaaacaagacaaacaatcacttgttatttgggaaaaaaattaaaatgtttattttggacttttattaaagtgtcaatggctttataaaacagctgtgtaaatccaggctttttcagcaagtatcattttagggggcctgtaaagaaaggaatatacatgaaaaaattaatttttaaaaattcccctcatatttcagtattgagaagaaaatagaggaggtctcacttttattttgcaaacacgtttgagaacaaatgatttttaactgggagacatattcgagaacaaatagtagtttaatacctatttttttttttttttttggtgtcatttaaaaaactgagtattattgtagcccgattctctgttttaggagattaaagcattttctctgactgggcatttatggaaagatgctgcgttcttgggaatagagaatgcctgtgattattgagttctgctactttctgaatgcaatggttatctaaaagtctgaacacttgagagataggacccagtaaatgcaggtttctaataagagctatcagagtctaatcagtcaaccagaatttgcttaaaatctactaataattattttatgtgaaatttaaaggactatgtattttctctctctttttaaattttaaatactttccttgcagaaaacaatgaaatacagaattacttaagggatatattaaggagtttcagtcacagccgtctctccatgtggaatatgatagaattaaagtctgttgttaatttctaatgttttggtaccaatcaggtacctggtacccaaccaaggttcagatcagctagttactcatcttctcgcctatgtattactcatcaaagactgaaaatcatggggacgactgcaagagcttcagaaccaggcatttcagggtgatgggaagttcaacatttgcagatcagacccacctggtgaaccagcctagcctgactcaagtttacttcactggaacattttccaccaaacttccttccctcatatctcctccctatcagactatccagttaataaataagtgacttcaagacaaattgaagagtttctacctgataaggagctagggaccgtgaactttctctgtactgggggctgatcagatgggcactggaacaatgacctgtattcctgagaagtgtgcatggcagagggaaagaaagtagacaggagcgccaggcttatggtggggtacaaacacaagacaccaaatggcagaggatatggagcaggcaggagcatggtctgagcagagggcaagtgttccaatggttgaagggtcaagaactctggcaatttccctgttacttatgcaccactaggtgtgtccccagtggtcacttattgggacattttttgagcatgttttatgtactgaaggaagacacttattcctcccttaaatctcaaggtgactgccaaaccaccagccgaccacattctgagggctctggaggtttcctgatgagaatcatttgacctctgataaagtaatgaagtgttttggactgggtgtggtggctcatgcctgtaatcccagcactttgggaggccgaggtgggtggatcacttgaggtcaggagttcaagaccagcctggccaacatggtgaaactccgtctctactaaaaatgcaaaaattagctgggtgtggtggcgggcgcctgcagtcccagctctgcgggaggctggggagaagaattgcttgaactgaggaggcggaggttgcggtgagccaagatacaccactgcactccagcctgggtgacagagcgagactttgtctcaaaaaaaaaaaaaaaaaaagaataatgaggtgttttggatatttcaggtggaaggcacagctgttgggttcatgagtgtgtgctcaagagtgaacatgcaactgctgcatgagtgctttgacttgggccctttccacggactctgtttcccacatcctgatgacgttctggaatcaccacaagacctaagtgtccgaagaagtcaaggtacagtggctatcacagggacacactgggaaattaaatctatgctttatacacattgcgctcttcgctaagtgatggaactagataggatgctttatatttccttccccagttccccttaaggagtagttcccatggttggtcacatccttgtgaaatacctacaagcacagatagtcacagtgcaggggtggagttagacatagtggacttggggccttagggctcccacattcaggatgctcacttcttgaatgttcattgctagagtacatgtaagttatgatgaaataattactggtgtttcaggtttcacacacacacacacacacacacacacaaccaaatacaacaagtgaatttttcaaatcaagaactcaggaaattttttatgcttttaagttttaatcccaactttcagtgcttctgtttttgtctttgacaaatcattatgtagtataggtctgttgcaagtagtcatttttaacttgcttaagttacttctagttatatgaaataataccatcaattttaaaatattgtctgtatcaagattttcaccacgttcaattaggtaacctcaaactttgatgttttaatttagtgaggtcttactgtatccatgggtatctttgcggttacatatttgggttcttacagaagacagatgcagacaggcaagttaccatgggtacatcaattcacttctccaaagctggatttcttcatttgtaaaatgggcataatagtaatacctcccacacggggggggggttgtgaagtttcactgagataagccatgtagagtgctttgcacagtcaacactcaataaatgttgatcatcaccgttagcaattattttttctttgtgtcggccttccaccaacttgaatcttcctagggtaaaatcagggtatttcaaattgctatgctttctcctgtctgaaagattacaccaagattgttcagaaatggggaaaggagcacttggctggtggcaaaggacttgccaatctagacaacagaaggcagtgacttggctaagcttatcccctgaatgcataaaccccgtgcacagtgtctagacctcatctgaacatacacacttatcacagagaacctgcaaagccacagatagaggagtttcccttttgtgctgatgataacaacaccctccccaaaagagatttggggtccttattgtttaatagtgaagccttgcttgccatgcttcccagagaagaactctaccataggagagttctgagggaacttatcagtgtgagacagtctggaaccataagttgtcattgttattttccaatgcttaaattcttctttgaaagcagcactaaatggcctttttttttttttgagatggaatttaactcttgtcacccaggctggagtgcaatggtgtgatcttggctcactgcaacctctgcctccagggttcaagtgattctcctgtctcagcctctggagtagctgggattacaggtgtgcgccaccacgcccagctaatttttgtatttttagtagacacagggtttcaccatgttggccaggctggtcttgaactcctgacctcaggtgatttacctgcctcagcctcccaaagtgctgggattacaggtgtgagccactgcacttggccctaaatagcctttttatggctgaatattctcacatgtaaaatggagataaaaatagtatctaacccaaagaattgaggggacaattaaatgttagaatctatgtgttgtgcttagctcagcgccaaacacaaagtaagtcctgaacatttaaaaatattttttcccctgtggctgttgtaatgaagaacaagttgaaaagatgtagtcccttccagtgtgtttctgagtggctctgatgctactgtttcctacatagaatgaatggaaaattccttagaaactttatggggcagtgaaattcaaaatttaaactgaaccctggacttaaaaacatacgtaagctagtatatctctagcaagagcccacagagatatgggcactaaaagaagtcctacttctgtttacctccttcaatatttttacctaaaataagtcaatctaggacagatggtaagtaaaagaaataggaaaacttatcttctgtgccttgtttatttttgaaagtcagctttatgttcattgacacaaagatgattccttatgaaattttcaccagggagctggcattgtagacttccacataacttccagggattgagtcacaaatcatcaacagctcattatatctaagaaaagagtcatcagcacattttgctgccatcttcctatcaacaacaacaaagaatgaggctccagagaaaattctaaatgtactgtgatctgttactttcctttcctgatgaaagtctcaagttaaaggaaatataatttctctaaaatatgaactaaaattcttgtttcaaatgagcacacatcactgtgtctcatatcttgtattttgtttagtgcttttttccatttcaaaggatttttatatatgtaatctcatgttatcctataacttggtgtaggagagctagggaaggtgaggttctctccattttttacttgctaaagctcatccaagcttttaaagctcatcagtggctgacccagaaggcagacccagcctctctctgctttcgtgcatgatgatagtcttggcaaggtaacgtcttatcttggatggttttgacagaaaactccaatgacgggtctgctacacaagatacatgatgagttttttcactttatttttattttttatttttattattgttatttttttgagatgaaggcccccctctgtcacccaggttggagtacagtggtgcaatctcagctcattgcaacctctgcctcccgggttcaggtgagtctcctgcctcagcctccccagtagctgagattacatgtgtgtgccaccacacccagctaattttttttgtatttttagtagagacagagttcatcatgttggccaggctggtcttgaactccgggcctcaggtgatccgcccacctcggcttcccaaagtgctgggattacaggagtaagccaccatgcccggccagttttttcactttaataagttatttaatgaatgatcacttcagtgggtgatcagtgacctgcccatatccctccgacttttattttgtatgtgtgtgctccaaacaactcctatctgctggaatcttcacctctgtgtctgcaggcttttttaaaactgtgaaaggccactctgacctatgcaggggtcaggctggaagtgtcaggaaattatcactcaaggaatagactctgtttccctatgtcacatcccagcttccctgctggtgctttctccattgactcccaaataaatggttgtaactgaatctttaacttaagatttgcctctgaggcaagtgagaccaagacactactagttaggtcttttcctaccagctgtgaaagcatttatttatacacagctgacttgggtgagagtataaataccccagctccctcactcctcaggtgggaggactcagatatgtgagtattggctggtttcccagagttcccccaagggattaagtttcagttgtccataatagtaatctgggtgataacacatgtgttgttgttttttaacttttaagttcaggggtacatgagaaggtttgttacataggtaaacttgtgtcatgtgggtttgttgtacagattatggcatcacccaggtattaagcctagtacccattagttacttttcctgatcctctccctcctcccaccctccaccctcaaaaggccccagtgtgtgttgttcccctttatgtgtccatggacaacacacattttattagttgcctttccttccctgtctctttcctcactctcctactggtacatcctggaaccacctccaaaataaactgcttattctcaagctcttctctcaagatctgatctttccctgccagctgtgaaaacttgcaatttcacaccaacctcaaccctttcaagcagaataatgtcaagactcagcattcttaaatgaatccagaggccctcctttttctagctcctaatacacatggtaattagcttactgtccttcatcatctcagccttatcaaaagtttccctggaggtctggctggtgttaacagaaaggagggcagagctggtgtggctgaccatggagaaagctgacttggctggtgtggtgcagagaagccagcttgtttatgtgcttattccatgactgcttgtcctgagcagaaagtgcttttcaggatctatttttggaggtttattaagtatgttctcaattccaacagtttaatgaagatctaaataaaatgctaggttctaccttaaaaaaaaagtttccctgaatctaaaatgtttaactgtgtacaatcaatttgtgttttacctgaataatttgtgtatgttttcatagctacccattttgcatgtataacctattacatacttgtaaactttggtttttatgtactaaacattgggagtaaactgggaccaatgggaataggttctaaggatgtaaattttgtccaagcataaggaaaaactagtagaagtgtattttttttatttaatggaggacctagtgtggaagtagcaagttcccagaatattggaagaattcataaagaaacagtcatacacacttacaaagggctttctgcttgtgtggaagattatactgaatgagatgtaagatccccttaaatgctaaaaaaaacttattgaatacatatcaagatgttccatatgcctggcactttatgaatattttccttcagtgacaataaaatggttcaaaacaatattttttccagttggccgcagcactggccctgcctggtgtttgcaaatcaagctgtgtcttttgttagctgcatcacccaataaatattttggaatcaagcttgagctggcaattttcttgataatgcataaggcaaaatagggcacaacctgcatttccacagctgtactggcattgccgcatttaatagttaaaataaaaaaataaaaacaagcaaaaaacaaaacttttgttcctcatgtaggccgttgagatctgggcagcatgaatctctgttttaaaagactcctgcaaggttccgatttgtaaatctcattatatacccagggcccaccttacaaagtctctgcagaacttgatgtgctccttggcagggagagatttcactttacataatagagttatgggcattcaaaagaataactagtgtagccccttgtcaccaagtcatccaggaaaactgttgctcactatacatataaaagacccttcaaaatagaatttttgtaatgtctccacgtaaaacatcgcaatattgcctttaactttttttttttaaattactcctgctgtcaggaaatgtctttatatgtcttatttcaattttatgtcttgttttattgaactcacatttgcttcttatctcagattccctcatctcttgggttaggaaacacctagacccactctccctgtgtcggagctaaaaaacaatggctacattaagtcttattgattgtgtattaaatcatcccaggtcttttcgcctctcttcctaaggttccattttatattcctggattcccttctattttactttattcttcttttaacatggattccaaacaggactggagcacgtatctacagggtgtgttaggatttctgctgccgtctttacattacagatctcggaaccttgtttttaacagtcagttcattctgtagttaaccagtgacccaccaggacttagtctgccagggctgccataacaaagtgccacagactgggtggcttaaaaaacagaaattgattttctcacatttgtgaggccagaagtcaagatgttggaggggtcagtttcttttgaggcctccctccttgacttgtagacggccatcttctccccatgtcttcacagggtcttccctctgtgcccatcagtgtttttggtttttctttttataaggacaccagtcacaatgcattagggctcacctgtaactttaactcagttacctctttaaagactgtctgcaaatacagtcccattctgaggtactaggggttaagccttcagtgtacgagttttgggggtgggaggaggcacactacagcccaggagaggctctatggtatcgtactgccttcctctggtccctaataggggggcggtatgtgttcagggtggggaatgtttggatgtctacatcctctcataagcccatgttcttcccctggctggatgtaagccgcacccacccaaccttctgtgcccgaggaaagtccctgtgtcccaccaatgggcttctcattgttcctggcatgggtttcagatccccctaggagaggagttctgttcttacaggcttctgtgccctggtcacctccacttcccaggaggctagggtgagttctggggcccattatagctctcactcagtggccacacagcaatattactcacttggtagcagttgccaccaaatttgccattttctcattgtgatctgggctttgagcatctcagttctccctcctccccttttctttccttctcctagatcctgtggtgtggttctttgatgcctgtactcaaggctctgatagtaatgcagacagtggcagcaaagtcggctttacttaatgttcatacatagccctaatatactaacttatacttgttaaaatttgaattatttatttatttatttttattgttttgagacggagtctcgctctgtcgcccaggctggagtgcagtggtgcaatctcggctcactgaaagctccgcctcccaggttcacaccattctcctgcctcagcctcccgagtagctgggactacaggcgcctgccaccatgcccggctaatttttttgagttttttttttttagtagagatggggtttcactgtgttagccaggatggtctcgatctcctgaccttgtgatccgcccacctcagcctcccaaagtgctgggattacaggcatgatgaatttcatttttttaagccactgaatgtctttagcatatgaaggcaacatcttcgaaagctttagctactcttgcctatatatatatatatatatatatatatatatatatatatatatatatataaaatttgattttctagaatctactttgttaattctaaagctttgcaagagatgttgataaaacaaataaatcataccagacctatacccaggcatctccaatgttgagagtttagactctttcagggctttcagggcagagcccctggactggtaggataccaggaagactgtaatccagacctgaagcccagaacttgttgtcagggacatgaccccaaagccatcttggtgagccttttggttatttcataaaacctgttgtcaattctccatcttaattccaaagctgatttctaagccttttctaatgtcttcaaaaacaaccatagcatcaaaggatggcaaccacttaagaatctattattttgcagacagcaacatgactgagatctgcattcctcctttcctcttcagccctgggagcgacctgtgatatcacagccttgttctccaacagtcagattcatttcacaatggtggaaatacaagcgcatttttgtatggggcctggaggtcttcagaagaaaagtggctttatttatattcgttatgatcattatgtgctgggattattttctcagtaggggatgtctcttttgcccatatttatgaagcaggggagaaggcatttaatgaagttcaagagtgtatttgactgtaaaacacatctcagtacattcacatgtaaataacccttttatttgttctctctggtgacctttttcctgttggggtagatcacagtttgttgttgttttccattttcagatggaaggctgaaagataataacgaaagattatgcaaaaaaaatccgtgtttaaaataatgttgatatgccacttgtgttgcaggataattatagtaatttggctattacgctatatggagtcagcagttagttgctagaaaacacggtgataggggtgattcaagggattttcatcccaactgggtgtttgatcctgctgacttttctcttgaaaatcaattgcttgcactgaatactttgaattcccccttgattaaattggccatcagtgggtcacacccattgcactgaggtcactgtgagttctgtttacaaagagtttttgatgattcttaaaatatcatggaccaaatttaatctgagccaagcggctaaggaagcaattactgaaaagcacagtttttgcacatggcaacaaacaaaggaaaatttattaattctgaagctcaacatgaagccagttatttgactactgggtcagaggccttctctccactgcattttgcttggactttcggtattttcagacctccatggacagataggctcactcagtagaagacctggtagaggcatcttggaagcatctttgacaacttttccatttctcctcaaggtagttaatagattcaggttttctatttcctttgaatcaattttggaaataagattattctagaaaagcttaatttagtatatgaagatgaaaaattagcatacagtagtggagatatatataggagtatatgtataatatatgtgtgtatatatgtatccaactctgtggaaaaatacttaaaaaaattttttttctttttttcagagacaaggtctcattttgttgcccaggctggggtacagtggtgcaagtatggctcactgcagccttgaactctttctgggctcaagtgatcctcctacttcagcttcctgagtagctggactataggtatgtgccaccataccttgctaatttttacatttttttggagacagggtttcgttttgttgccaggctggtcttgaattcctggctttaagcaatcttcctgccttggcctcccaaagtgctggaattgcagggatgagcaaccacacccagcctgtcttttttattgagtactgatttaagtctacatgaaatattctaaaataaagagaaaagcaaatcacaaaagtagttatataaaaatattattcataataaatgtgggaaaatattaaacttccctaaaactgaaatgcacattaaaacccaagatctttttctcccccattttgcctactaaattgtaaatatgcattgtaattaaaacacttagctctgggcaagaagcactgtaatgagcactcagattttctgatgctctgaaggttgactgatataacattctggagtacaatttagtcatggttatcacagaatgcattagatgttcatgttctttgacttcaactatagcaaatttgaggaaataatactaatactataaaaagatccatatgcaagaatttcactaagcttaatcataatactaaaaatgaacaaacaaaaaatatccaaataaacaaatgtaaaaaccccaagtctcccacaaggagatggctaaacttgtgaatatcccttagatagatatgcagaagcctttaagaagaaggttacaaatagtgaggggaaatggttcagatataatctcaggtgaaaaaaaaatcaatgcaaaatgaattgcagtatcagtaaagtcacctaataaaacacatgttatgaagagtacagggaggcaatgaactaaaatgacaaaagggctggagtcatagaagtggcaatagagcaacgcttttatttcctccctatattttttaaaatgtggaaactattaaatctacagaaaagttgcagatacgtttttttcttcctaatccatgtcaacgtaagttgccaacatgaagttgttggagcaccttggaatacttttgtatgtatttgctataaagagggacattctcctttgcaacctcaaacatccactgatatcaggaaattaacatgaatatgttactacaatttaatccacaatccaaagacaccagttacatttcttcatttgtcctgaggatgtcctttgtggcaaaagaatccagtccaggataacaaactgcagttacttgtcatattgtctttcaatgtggaacagttgctcagtctttccctgctttttatgacctagcccataattttgtagaacgtaatttatttttgtttgtttgatgtttattcatggtgagagtcatgtcatgcatgtggaactctgggctctcagtccatcctatctggtgtgatacattttcagtctgccctgttactgatgatgatgtgtgtcactttgatcacttgactaaagtgactcttttaggtaaaaattaaaattattttcacttatcccagtctgtgcagaagtctgtaataatgtctttcttcctgaactctgtattagctctaccctgattttcacttggaatcaactgatcctgttttactccttgcttggggtttcatctttgcaccacccagcatcccaccacaggtacttgaggctgttgagctctccttgggtaaatgatgctcttggttgttccatacgtcagtccttctatgcttgagctggtgtcagcctctggtaattgctgtgcgtggtccatttcaggcagatggctcctgacttactttgtagccagaatagacttcagcaaggcagactcccttccccctctaactagggtgctcacaaacgacatggacccagctcccaagtgctcggtctaaagctttacctacaatttattctctcctgtagctgtgattatatctctttcttcttaaagtcatctttgctttttactctgtcttgtcttttaattaggttttcctgtttggtcttttcaaagagctagctcttaatctatcaagtctatgggtttctttttgaatttattaatatctgctttcattttgtgacctctttctcctgatttctttgaatgtgttttgttcttcctattctaattgtctaattgcctgattcattcttttttttttttttgagacggagtctcgctcttgttgcccaggctggagtgcaatggcgcaatctcggctcactgcaacctccgcctcccaggttcaagtgattctcctgtctcagcctccctagtagctgggatcgcaggcatgcactaccatgcctggctaatttttggtatttttagtagagacggggtttcaccgtgttggccaggctggtctcgaactcctaacctcaggtgatccacttgcctaggcttccttgttttaaaataaaagcacttcttgggaagacaaagttttgctctaccaacttaggtccaagcgggtgggggcctgcaaattgaccaacagattaacaggagaaaaaagtattatatataaaataatatataatactatgtataaactggtttggtggttgttaagctcttcatttcccccatttgaaacttctcaaaaacattcacaaacaaggagcagggttgattgctatggagagaagactagggctacaagttccaaggaaagaaatctgcaaaaggagacagcaacatagattagaatgcggaaacaaaaataaaaatcaagattaatatctggagcaactatcaacctagtttctgagaccaaagggcatccagtcaaaaagacttttaaacattgggtttgaagcgtttctagacaggggagtgagcatggtattggcaaactgacagatttcccagtttgcagtttgaaggttgttggtgatggcgtagatagcaaatcactataaccacggtcatggctgtttcctggagcgcagcatagaagatgagtgttatagtgagcttcctgagtggcccacacagcagcagctccaagcacgaggcccatactcacacttgatctattgtgatgatgactattttgaagttcatgtcaagccatctagcttcagctcacagggcttcttaagaccttggagggaaaggggcaaaacaagacaacctagagtctcaaggttccgggcagtcagatttttcagtgatgccaagtcaggaggatgggagaaaatttggaaacattaattactggcaacatgtgtaagatagcaggattcagtttacaaaaaggtagaaatggctcagaggtaatgagcaggattagaatctgataactcacatgagcagattatagttttccattgaaatatagaatttataatcaccccaattttgatcaaagataataaaattaatattattttgtttgtaaaataaatctagtttcattaaatttggtttgattatttatatgaatacttcaaaaatggtaacagaccacattaaagtttgctttgctgaactgagattaggaatctcaaactggacttttaaaagcctgctgggactaggaagtcaggccaagaacttgctaccggatttcacctataatgcctatagatttggatggattccttttctcaaggtcccccaaatatcctaagattcctgggcctgccgggaagtagccttactaactcacctccaaggctgggaaccctgaatgcaggcaccagtatgctttttccaagagggctttgtaagcataggctccataaagtcaaccttatttccttaaagctatcattctcaaatgacattccaatctaatccttggtcataaccagttatgtcttgttacaaggaggacagattctcattgaaactatgcaaacaactatattgccatgaaaatggggacactcaataagagttttggaactctggagggatcaggcagggagaaaaataagatatttcatttctgtttacaaaagcataatgtacgaaattgttgtaagttatagatagctcacaaagaaaagagagacgggttccttaaatccaggataaaattttaaacaaagccataattttattcatcagttcatttagtccaatgtaattaattcttgttctgcttgatctaaggttagtagttttttatgaatcccccagcttctccactagagttttggaatatatgatataatctcaaagttatttatgcaataccttcagaagcctgcaccctagagtacttggcatattccttttccatgggtttccttttgttgaaaacaagtattatagcttattatagcttctagaaaaacttcagaataaaacaataactatccaggataagaagagacttaaatggtgtgattaatgatctgatgagagttcactataaaaatagcaaaattgatgaggaaatttggttgtttctgtggcatagaacttctaaaataaaaactggaattatgactataatattatgctattgttgtctaatatcaggcaaagcaataccagcacacatcatagcgtgggcattgacaaatttctaggaacttcatatacttcctgaaatatttatattcataacatttacataaaatatgtgtaaaaatataaccttgggaaagttatctcttcttacttgacaaagcttttcatgcatttcaacatatctaattttattttattttattttttcatttttccatcactccctatcctaattaatttttgatatctctttttttaataaggtaaaataacaaatcctttgagattttccaggggctttctggaaagtcaggaatttatagcagctgaacttgaacttccaggataaaagggtcatcattcttctcccacactgtaaactcctttgtgggggtgagggagtcaatggaagccgtattttcaggaggctctgcttaagtttaatgtttctttctgtggctgctgattgttcgaatgttttcagtttaaaataatcttcaaccattttggtgggctgttcatcacttcacatttaaagccatgcatcttccactcagtattgccttgtctttatcccataagctattaccaagtgatattgatattaacatccttattctcattgtagttattttatgaatatctgtggttgtgattttaatcttctcttttatctgaaattttttagggaagtggtttgattttcattgggtgtgattattgtgtgtgcttgtcctcttgtctttaatttctaaatttttgcattgtggttagaaaatatgacctgtgtaatttctacttttgttttaaattaagatcttttattacagcctcatataggatcagtttcatagatgtccatggactttcaaagagaatgtgcattctctgtttataaggctcaaacttatgtatagtgtggttaaatatagcttactatgatattcaaatcttccataacttcattattgttgacatggtctatcttattctgagaaagtaaaatttcccagttcactgtggtcttatcttctccacttatcactgcatttgtaaaacttttgctttatgtatttagatactgtgctctttggtacctgcagtttcatgacaatgaggttatacttgtggatatcttttatcaatacaaaataagtatcttcgctccatctaatatgtttagctttgaattacatttaatctgatataatatttccattcctaggcccacactgtaccacaataaattttatagtgaagtgttctaagcaatgtcctccaagtcttgggcatagataattttgacatgggacaatgaagaatggatcttagacaactttactcaagtctcctgccccatgttgttttgccttttacatttagatctaccacccacacgtaatcgattttcacatatggtgtgatatagaaatcacattttatttttaaaaatatgaatatccaattgactaagtaccatttattgaaaaggtcattctttccccctattgcagtaccacctgtgtcacagattaaatgtccatatatgtgtacatttgttttgggattctctgttctatttgtcaacaatacactgtcttaattaccatagacttatgataaatcttgatactggcagagtaagtctttccaccttgttttttaagattatcctttttattcttagttgtctaatttttccacataaacatgagagctcaaaaaaaaaaaaaaaaaaaagcctgggtgccatggctcatgcctgtaattccagcactctgggaggccaaggcaggcagattgctagagctgaggagttcgagaccaccctgggcaacatggtgaaatcctgtctctacaaaaagtgcaaaaaattagccaggcatggtgacatgtgcctgtggtcccagctactcaggaggctgaggtgggaggatcacctaaccctgggaggtggaggttgcagtgagccaagatcacaccactgcactccagcctgagcagcagagtgaggccctgtctctaaaattaaattaaattttaaaataatcattttggggatcttgaatgggattgcttcaaatttatagatcagtttgctagtggggaaactgacatttttataatatattaagcctcctaatctctgaatgtggtatagcccacaatttatttattgaaggataattaagtgtcttagtttcctcctataatgttttatagatttttatagagaggcttcgcatatctgttgttagatttattcctagatatttgatatttttacactattgtaaatatcttttaaaaatcatttttcaaattgttcatggctgttatgttgtagtggaatgggcttttgtatattgattgaccttatgtctggcaacctttctacacagacttactaattctaagatttatctgtatattattttgtatttctctatataatgtaaatttttgttctttactttccaaactttataatttaaatttgtttatctactggctaataccttaaatagaaatggcattaacaggcatccttttgttgatctcagaattaactgaaaagttttcagtatttcatcattaaggataactttgtgaatactcattatcaggtcaaggaagtgtctgtatttctgatttgctaagagttttattaggaatggtttgtttgttttaattgaattgaattttataaaatgtttttttctgtgtttcctgaaatgatcatatgattcttctctattctgttgaagagatgaattacattgattgacttttttatgtatttattttgttaatttcaatttagtcttgatatacaattctttatatgcagtgctggattttgtttgctaatgttttgtttaggatttttgcacctatattcatgagtgagattggcctgcaactttcacttcttgaaatgtccttccttgccagactttggaaatgaagtcatgctggtctcataaaacaagttgaagagtattctctcttctattcatttcaagtttattactgagtttattttaaaagttagtttattacttccaaagaatagaagagaaatacttttaaagtacatgtgataatatattcatataatttctaaagatcaaatcagtgtaattgggatattcatcaccttaaatatttgtctcttctttgtgctggaaacattgaaattattctcttctagctattttgaaatatataatagattattataaactataggcaccctattgagctatcaaacactaggtcttatttcttctattaaattatatatttctacccattacaaattttcctctcctccccaccccactccactgttcttcctggtctctggtaaccaccaatctactctccaccttcatagatccatttttttagctcccatatatgagtgagaatatgtgatatttgtctttctatgcttagcttatttcacttagcataatgggggcatccaattctatccatgttgttgcaaatgacaggattttactttttaatggctgaacaatattcgattgtgtatatataccacatttgctttatccattcatccattgatggagacttagcttgattccatattttggctattgcgaatagtgctgcaataaacatggaagtgcagatagctcttcagtgtactgatttgatttcttttgaatatatacctagcactgagattgctggatcatatggtagttgtagttttttagttttttgaggaaactccatatagttttccatagtgattgtactaatttacattcctacaaacatatgtatatgtttgggttccccttctctacattctcaccatcatctgatacttttttgataagcaccattttaactgggatgagatgttatctcattgtggttttgatttgcatctctgtgatgattagtgatgttgagcattttttcatgtacctgttgtccattcatatgtcttcttttgagaaatgtctattcagatcttttgtccatttttaatgagtttttttgctattgaattatttgagctccttatattctggttattaaacccttgtcagatgggtagttagcaaataatttctcccatcctgtggattgtcttttcactttgttgattgtctcctttgccgcgcagaaactttttaactcgacgtaatgccgcttttgtctatttttgctttggttgcctgtgcttttgaggtcttacacaaaaaatccttgtccagaccaatgtcctggagtgtttccccaatgttttcttctagtagtttcattgtgtcaggtcttagatttaagattttcatccatttttattttatttttgtgtatggtgagaggtagggatctagtttcattcttctacatggttgtaaactgtagtcaccctactgatctatcaaacactgggtcatacttcttctattaaactgtatgtttgtacccatcaatcaacttctctttctctcccccacccctctactcttcctgacctctagtaaccagcagtctattctctatcttcatgagatccacttttttagtttccacatgtgagtgagaacatttgatacttgttttttttcacatttgttatactcctgggctgaagtgatatataggtatgtaacactgtgcccagatggtgaataatatttttaatgtgttgttgaatttggcttgctagtattttgctgaggacttttgtatccagttttcccagcaccatttattgatgagactttcctttccccgctttgttattgatgccttcgtcaaaaataaattggctgtagccaggcacagtggctcacacctgtaattccagcacttttggaggccgaggtgggtggatcacttgagttcaggagttcgagaccagcctggtgaacatggttctactaaaaatacaaaattagccaggtatagtggcacacgcctgtagtaccagctacttgggaggctgaggcaggacaatcacttgaaaccagagggtggatattgcagtgagttgagatcgtgccactgcactccagcctgggcaacagagtgagactccatctcaaaaaataaattaataagttaaaaataaataaataaataaataaataggctataaatgcatggatttatgtctgagttctctattctgttccattggtctatgtgtctgctttttacaccagtaccatgctaatttggttactatctctttgtagtacattttaaagtcaggtagtgtgatgcctctagctttgttctttttgcttatgattgctttgggtattcagggtctttgtggttttgtataaattttagcattgttttttctgtttctatgaagaatgtcattagtattttgataagcctttctttgaatctataaattgctttgggtattactgtcgttttaacgatattcttctaatgcatgaccatggattatctttccatttttgtatgtatgtgtcctcttcaattttttttatcagtgtgttttagttttcctaatataggtctttcatttctttggtgaaattgattcctaggtattttatattttttatagctattgtaaatgggattgctttcttgatctctttttcagattgtttactgttggtgataaaatactactgatttttgtattttagttttgtatcctgcaactttactgaatttatttattagttctgacagatttttggtggggtctttaggtttttctaagtataagatcacgttgtctgtgaacaaaacaaatttgacatcttccttttcaatttggatgccctttctttctcttgcctaattcttctgtccagaattcctagtattatgttgaataaaagtgatgaaagtgtgcatccttgtcttgttctagatcttagaggaaagtcttgcaactttttttcatttagtatgatgttagctgtgagtttgtcatatatggtcttcattattttgaggtatgtttctttctttctttctttctttctttctttctttctttctttctttctttcttttctttctttctgtctctctctctgtctttcttcttcttttttttttttttaaacagggtttcacccttgttgcccagactggagtgcaatggcatggtctcggttcactaacacctccacctcccaggttcaagcagttctcctgcttcagcctcccaagtagctgggattacaggtgcctgccaccactcctggctaatttttgtatttttagtagagatggggtttcaccatgttggccaggttggtctcgaactcctgacctcaggtgatctgcccgccttggcttcccaaagtgctgggattacaggtgtgaaccactgtgcccagtgttttgaggtatgttccttctgtactcattttgttgaaggtttttatcataaagggatgctgacttttattgcatgctttttcagcatctcttgaaatgatcacatagtttttgttcttggttttgttaatgggatgtatcacatttattgatttgtgtacattgaaccatccttgcatccctgaaatgaatcccatttgatcttggggaataatttttttttttttgagacagaattttgcaatgtttcccaggttggtcttgaactcttgagctcaagtgatccccctggctcagtctcccagtagctgatactgtaggtatgtaacattgtgcccgactggtgaatgatatctttaatgtgttatggaatttggtttgctagtgttttgttgaaatttttgtgtctatgttcttcagtggtattggcctgtagttttctttttttgttctgttcttatctggttttgatattacagtaatgctgtcctcatacaatgagtttagaagtattccctcctcttcaatttttttgaagagttacagtaaaattagtattcgttctttaaatgtttggtagaattcatagtgaaaccatcaggtcctgggcttttccttgatcgtagactttttattatggcttcgattttgttattcattattggtttgttgaagttttctatttctttgttgttcaatcttggtaggttgtatagtcaaggaatttatcaattttctctaggttttccaatttgttggtgtgtaattgttcataatattctcgaatgatcctttgtatttttgtggtcttagttgttatatttccttgtatgtttctgattttatttgagtcttttctctctttttcttagtctagctaaaggtttgtctatttttgtacctttcaaaaaccaatttttcattttgtctatcttctatattttttggtctcaatttcatttatttctactctgatctttgttttggctatgaagaaatgatttttttttaaacttttaagttcaggggtacatgtgtaggtttgttacataggtaaactcatgtcatgggggtttgttggacagcttatttcatcacccaggtattaagccagtacccatgagttatttttcctgatcccttccctccttttaccctccaccatccagtaggccccactgtctgttgttcccctgtatgtgtccatgtgttctcatcatttagctcccacttatgagtgagaacatggagtatttggttttctgttcctatgtttgtttggtaaggataacggcatccagctccatgttcctgcaaaggctgcatagtattccatggtgtatatgtatcacattgtctttatccagtctaccattgatgggcatttaggttgagtttatgtctttgcttttatgaatagtgcttcagtgaatatactgtgcatgtgtctttatgatagaacaatttatattcctttggttaaatactcagtaatgagatttttgctcccatctttatttcatttcttccactaattttgtgttttgtttgctcttgcttttctagtttcttgaggtacatcgttaagttgtttatttgaagacttcctacttttctgatgtgggcttttattgctatgaactttcctgttagtactgcttttgctgtatctcatggattttggtatgttgtatttccattttcatttgtttcaagaaatttttaaatttccatctgaatttcttcattgactcattgaaaatgattgtttaatttctatgttttgtgtattttttgaggtttctctttttattgatttctagttttattccattgtggtcagaagaaatacttgatatgatttctacttttttgaatttgttgagacttcttttgtggcctaagattctggagaatctattctggagaatgtttcatgtgctgttgaaaacaatgtgtattctgcagcagctggttgaaatgttctgtaaatgtcagttaggtctgtttggtcttgtgtgtagtttaaatctgctgtgtctttgttgattttctgtctagataatctgtctactactgagagtggagtgttgaagcccttactactattacgttgcagtctatctctcccttcacatttattaatatttgctttgtatactcgaatactctagtgttgagttcatagatatttataattgttatatcctgttgatggattgactcctttatcagtatatagtgatcttctttgtcttttttagaagtctttgtagtcaatttcatctgatattaatatagctactactgctcttttttggttttcagttgcatggaatatatttttccacttccattttcagtttatgtgtgtcttaataggtgaaataggtttcttgtaggcagcatatagttgggtcttgcttctttatctattcatttgctctatgtcttttatttttactttttttttttttttttttttgagacagggtctccctctgtcacccaggctggagtgcggtggcaccatctcggctcagtgtagctcgacctttcaggctcaagcaatcctcccacctcaacctcctgagtagctgggactacaggcacatgccactgcaactggctaattttttttttatttttagtagagatggggttttgccacattgtccaggctggtcttgagctcctgaacacaagcaatttgcctgagtcagcctcccaaagtgctgggattataggtgtgagctgccgtgctcaacactctatgtcttttaattagagaattgacttcatttaaattcattgttattaatgataagtaaggattttatttttagtttttaaaatttttaaatatatttttggagacagggtcttgctctgtcactcaggctggagtgcagtggttcaatcttggcacaccacaacctctacctgccaggttcaagtgattctcgtgcctcggcctcccgagtaactggaattacaggcacatgcccctgtgcccagctaatttttgtattttagttgagatggtgtttcgccatgttggccatgctggtcttgaacttctggcctcaagtgatctgcctgcttcagccttccaaaatgctgggattataggtacaagccactgcacctagctgataagtacaggctttcaactgccattttgttgcttattttctggtggttttgtgactcctcttttcctttcttcctttcttactgttgtcctttatggctaagtggttttctctggtagcatgtttgaattcattgcttcttttttttttttaactttttaaaaatttttccgtaagttattcgggtacaggtggtatttggctacatgagtaagttctttagtggtgatttgtgagattttgttgcacccatcacccaggcagtatacattgtactctatttgtagtcttttatccctcatccccctcccagctttccccccaagtccccaaagtccattgtgtcattcttttttgttgttgttgttgttgttgttgagacagagtctcactctgtcacccaggctggagcgcagtggcacaatcttggctcactgcaacctctgcctccctggttcaagtgattctcctgcctcagcctctcccgagcagctgggactacaggggtgcaccaccacacccagctaatttttgtattttttagcagagatggggtttcaccatattggccaggctggtcttgaactgctgacctcgtgatcttcccgcctcagcctcccaaagtgctgggattataggcataagctatcatgcctggcttgtgtcattcttatgcctttgtgttctcatagcttagctcccacatatcagtgaaaacatatgatatctggtttccattcctgagttacttcacttagaataatagtctctaatctcatccaggtagctgcaaatgctgttaattcattcctctttatggctgagtagtattccatcatatatatcacagtttctttttccactcgttgattgatggcaatttgggttggttccatgattttgcaattgcgaattgtgctgctataaacatgtatgtccaagtgtcttttttgtataatgactattttcctctgggtagatccccagtagtgggattgctggatcaaatggtagttctacttttagttcttcaagaaatgtccacaccgttttccatagaggttgtactagtttacattcccaccagcagtgtagaagtgttccctgatcaccacatccacgccaacatctactgttttttttaatatatttttttattatggccattcttgcaggagtaaggtggtgttgcattgtggttttgatttgcatttccctgatcattagtgatgttgagcattttttcatgtttgttggccaattgtatatcttcttttgagaattatctattcatgtccttagctcactttttgatgggattgtttgttttttttcttactgatttgtttgagttcgttgtagattctggatattagtcctttgtcagatgtacagattgtaaagactttctccctctctgtaggttgtctgtttattctgctaaccgttccttttgccatgcaaaagctctttagtttaattaagtcccaactatttatctttgtttttattgcatttgtttttgggtttttggtgatgaaatccttgcctaagccaatgtctagaagggtttttccagtgttatcttctagaatttttatggtttcaggtcttagatttaagagttggtttttccaaggtgagagatgaggatccagtttcattctcctacatgtggccaggcaattatcccagcaccatttgttgataagggtgtcctttccccactttatgtttttgttttgtcaaagatcagttggctgtatttgggtttatttctgggttctctattctgttccattggtctatgtgccgatttttataccagtatcatgctgttttggtgactctcatgctgttttggtggtgtgatgcctccagacttgttctttttgcttagtcttgctttggctatgcgggctcttttttggttccatatgaattttagaattgtattttctaattctgtgaagaatgatggtggtattttgatggggattgcattgaatctgtagattgcttttggcagcatggtcattttcacaaatattgattctacccatccatgagcatgggatgtgtttccatttgtttgtttcatctgtgatttctttcagcagtgttttgtagtttccttgtagaggccttttgccttcttggttatgtatattcctaagttttttttttttttttttttttgcatgctattataaaaggggttgagttcttaatttgattctccacttagttgctgttggtgtataggagagctactgattttgtacattaatcttgtatccagaaggtttgctgaattcttttatcagttctaggagctttttggaagagtctttagggttttcgaggtaaacaatcatctcattggtaaacagtgacagtttgacttcctctttactgatttggatgccctttatttctttctcttgtctgattgctctggttaggacttccagtgctatgttgaagaggagtggtgagagtgggcatccttgtcttgttccaattctcagagggaatgctttcaacttttccccattcaatatcatgttggctgtgggtttgtcatagatagcttttattacattgaggtatgttccttgtatgctgattttgctgacagttttaatcataaagcgatgctggatttcttcaaatgctttttctgcatctattgagatgattgtttgatttttgtttttaattctgtttatgtggtgtatcacatttattgacttgcatatgataagccatccctgcatccctggtatgaaacccactggatcatggtggattatctttttcatatgttgttggatttagttagctagttttttgttaaggattttggcatctatgttcatcaaggatatcagtctgtagttttcttttttggttatgtcctttcctggttcatccatagaatgaattagggagggttccttctttctctatcttgtggaatagtgtcagaaagattggtaccaattcttctttgaacgtctggaagaattctgctgtgaatctgtctggtcctggacttttttttgttggtaatttttaaattaccatttcaacctcactgcttattattggtctatttagggtatctaattcttcctgatttaagctaggagggttttatctttccaggaatttatctatctcttctaggttttctagtttgtgtgtataaaggtgttcatagtagccttgaatgatcttttgtatttcattggtgtcagctgtaatatctcctgtttcatttcttaatgagattatttgaatattctctcttcttttcttggttaatcttgctaatggtctgtcaattttatttatcttttcaaagaaccatcttattgtttcatttatcttttgtattttttttgtttcaatttcatttagttctgctctgttcttggttatttcctttcttctgctgggtttgggtttggtttgttcttctttctctagttccttgagatgtgaccttagaatgtcagtttgtgctctgtcagtctttttgatgtaggtgtttaaggctatgaacttcctcttagcaccacctttgctgtatctcagaggttttgataggttgtatcattattgtctttcagttcaaagaatttttaaatttccgtcttgatttcatttttgatgcaatgctcattcaggagcagtttatttaatttccacatacttgcatggttttgaaggttccttttggaattgatttacagttttattccactgtggtctgagaggctgcttgatgtaatattaattttcttaaatttattgaagcttgttttatggcctatcatggtctatcttggagaaaggtccatgtgctattgaatagaatgtgcattctgtagttgttggatgaaatgttctgtatgtatctgttaagtccatttgttctaagatataggttaaatccattgcttctttgttgactttttgtcttgatgacctgtccagtgctgtcagtggagaactgaagtcccccactattattgtgttgctgtctatctcattgcttaggtctattagtaattagtaaatttgggacctccagtgttaagtgcatatatgtttaggattgtgatatcttcctgctggacaaggccttttaccattatataatgtccctctttgtctcttttaactgctgttgctttaaagtttgttttgtctgatataagagtagctacccctgcttgcttttggtgtccatttgcatgaaatgccttttcccacccctttactttaggtttatgtgggtccttatgtgtgagtctcctgaaggtagcaggtggttggtgagttcttatcaattctccagttctatatgttttaagcggaacatttaggccatttacatttaatgttagtgttgagatgtgaggtaccattacattcgtaatgttatttgttgtctgtgttccttgtttttgtttttgctttttaacatgtatttttgtataggtcctgtgtgatttatactttaaagaggttctgttttgatgtgtttccagtatttgttttaagatttagatctccttttagcagatcttatagtggaggcttagtagtggcgaattctctcagcattcgtttgtctgaaaaagactgtatctttccttcatatctgatgcttagtttctctggatacgaaatccttggctgataattgttttgtttgaggaggctgaagatagggccccaatcccttctagcttatagggtttctgctgagaaatctgctgttagtctgataggttttcctttataggctatctggtacttttgtctcacagctcttaagattctttccttcatcttaactctagataacctgatgacagtttgcctaggcaatgatctttttgtgttgaatttctcaggtgttctttgtgcttcttgtatttggatgtccaggtctctagcaaggctggggaagttttcctcgatttttcccccaaatatgttttccaaacttttagatttctcttcttcctcaggaatactgattattcttaggtttggtcgtttaacataatcccagacttcttggaggctttgttcatattttattattcttttttctttgtttttgttggattgggttaattcgaagatgttgtctttgaactctgaatttctttcttctgcttgttcaattatgttgctgagacttaccagagcattttgcatttctataagtgtgtccaatttttcctgaatgttttattgttttttctttatgttatctatttccttgaatatttctcccttcacttcttgtatcgttttttggatttccttgcattgggcttcgcctttctctggtgcctccctgataagcttaataactaacctcctgaaatctgtttcaggtaaatcagggatttcttcttggtttggatccattgctggtgaactagtgtgattttttggggttgttaaagagccttgttttgtcatattaccagagttggttttctggttccttcttatttgggtaggctctgtcagagggaaagtctagggctgaaggctgttgttcagattctcttgtcccacagggtgttcctttgatatagtactctcccccttttcctatggatgtggcttcctgtgagctgaactacagtgattgttctctctcttctgggtctagccacccagcaagtctacccagctctgggctggtacggggggttgtctggatagagtcctatgatgtgaaccatctgtgggtctctcagccgtggataccagtgcctgttccggtggaggtgacggttggtggtggggtcggggtgggggttgaaatggactctgtgagagtttttagctttggtggtttaatgctctatttttgtgttggttggcctcctgccaggtggtggatggggccctagaactccccaaattatatgctctttgtcttcagctaccagggtgggtagggaaggaccatcaggtagggggcatggctaggcatgtctgagctcagactgtccttgggtgggtcttgctgcagctgctgtgggagatgggggtgaggttcccaggtaagtggagttgtgtacctaggaggattatggctgcctctggtgagtcatgcaggttgtcagggaagttggggaaagctggcagtcacaggcctcacccagctcccatgcaaaccaaagggccagtctcattcccactgtgccccacccagtagtctgtttccatgtgatgggcgagctaggcttgagaacttgccccaggctgcccacctcccagctgagaaagaaaagggcttggttcttcccccttctgtggagactgcacactggattcatgccctctgcccgagttctggccaggaggcttctcaccaccagttcaaattgttacaaacttcagctgaagatttccttctccccgtggtgtttttccccactcctctggccgcccttctgatggatccctgtggtgccaggcaggaatggcctgcctgggaacccagcgagttcccagggcctttcccactgcttcctctacccctatatttcgctcagctctctaaattgactcagctccaggtaaggtcagaaatttctcccacaaacagacctccagtttctgcagtgggggtatgtatttgggagaggaggatctccctttcccactttcacagttggggcactcacagtatttgggctgtctcccgggttctgcaggaggcagtctgcttccttcagagggtctgcgggtcctttcaagattgctggtttgtttttgccattgatctggagctaaaattcacaatgcaagcctctgcacgctgctttatccatccgagttgaagctgcaatctagtcctgcctcccgtccgccatgatgatccaaactattgcttacttttctgctttttatttttagtgtatctatgataggtttttgcattatagttgccatgaggcctatgaaaaacaccttacagaaataacacattatttttaaaagatgacagcttaccttcgatcacaaaaaataaaatcaaagaaaaatctagaaaaaagctctatactttaactccattccccaagattttgacttttggttatctcaatttacatatttttatactatctatctcttaacaagttgttataactattattataattgttataactattattataatagttataactattattgtttttgacagatttttcttttggacttcatactagagttatgaatagattgcactccccaaggacagtattagaatattttgggtttgtccatgtacttaattttaccagtatgttttataccttcagatgtcttctttttgtacaaatcattggtttcattttctttcagattgaagaactccctttcacatttcttgtaagatgggtctgtttgtcgtgaattctctcaagttttgtttatttgggaaagccttttatctttccttcatatttaaaggacaagtttgctggatacagtattctccaaaggaagttttttaatttcagcaattttgaaaatgtcatctcactcccacctgccctgtatggtttctgtgaagaagtctgttgccagatgaattggagctctgtacttgcttcttttcccttgctgcttttaggatcctctctttattcttgacttttgatcagtttattatatgccttgggggagtcttatttgagtcacatctgtttgatgctctctcatcttcctgtacctggatatttatctctttctcaaattttggaaagttttttttttttttaataaactttctacccctattcttgctcaactccttgaacaccaataattcttagatttgtttttttcaggtaattttctgtatcttatagacagtctttgttggttttcattcttttctcttttttgtcctctgattatgtattttcaaatagcctgtctttgagctcactgattctttcctctgcttgatccattctgctcttgagggcctccagtgaatttttcagtttatttgctacattttcagtagcaaatgtatttgtcagttccaagatagccacttgattttttaaattgttatttcaattattttgttaaatttatctgataaatttatgaattgctcttttgtgttatcttaaagatcactgagtagccgggcgcgatggcttacacctgtaatcacaacactttgggaggccaaggcgggcagatcatgaggtcaggagtttgagaccagcctggccaacatggtgaaaccccgtctctactaaagatacaaaaaattagccgggtgtggtggtacgtgcctgtaatcccagctactcaggaggctgaggcaggagaaccacttgaacctgggaggcagaggttgcagtgagctgagatcatgccattgtacttcagcctgggtgacagggcgagactctgtctcagaaataaaaaaaaaagatcactgagtttccttaaaactgctattttgaattcttgatcatagagctcacatattgccgtcttattagggtcagtcactggctccttgctttatcaatttgagaggaccatagttccatgtttcctgatgtttcttgtggtgtgtgtttatgtcttgcattgaaggacagttcaattgaaggacagttgaagttatttgttccattctccctctggcttgttttttattgggatatttgcttatagattctgtgtaatttacctgctgactttcttttttttccccctgctaggtagctgcctcctttttggcactagatggcactttaagcccaggtttgcatcaattctagcaaacagtcagagtgccacccatcctgaatggaggaggtcccaaagggatatcccagtagtgtgggaaggctagctaggggttcatgcccaggggacctgtggaacaaatctcctacagtgtggtgctgctgaactgccatgctaatttggagtctcctttggttgagttacagagcagaatttccatggctgaggatgatagtcccacctccccactttgtttctggctgtgtttagggatatttctttcttcaagtatacctgatgccttccatgagttgaggcaggaaccgatctcctgccagggaacccaagatagtagggaagctggttgtccacctcaatatcagtttgctgtgtagaaactgtgagttgagggaaattttccatacacttgtactgggcagattgggggaaagtgtgtcatagatacagaagtctgattctcttaccatctactcagtttttacacttctctgtggctctaggaactgtctctttctcatatttgagttctgggatattgctggtaataacctgggtgctgtgtatttgtttttgtttttttgtggatggggagggggagtaaagccagcttgcttctacactgccattttggaacctgaagtttttgtgggaaggtttttaattgcagtttataatttaaattgttatatacctatttgttatatttggtagttcataatttttatatgaatatatacattttctttacattttcaaacgcattaggataaagttgaagccattttcatttttctcttattcaacttttaatgttcaaagtagtaatgttgcctttttcagttttcatgatattgagtatttgtgttcattttctcttcttaaacagtcttactggtggtttatcaattttattagtcttttcaaaaaatcaacttttggcttgtttgatccttctctataatttgttaccaagtttatttcttttctttcctttattagttccccttttgtattcctgggcttatttgatgtttttttaatatatatatattttaagtagactcttaactcattgatttttcagcttttcttccatactaatataagtatttaaactataaatatccttctattcttggtcttagctgcaacccacaagttttggtatgtaactaatgtatgtattatcaatatgtttgaaatttcattttatatattctttgacttacgagttatttaaaatattatttatttattaacatgggaatgttcttgtttttttatttttaattgtggtactctttcaacaaatttttaagtgttcaatgcaaaattgttaactataggtagatgttgtacagcagatctctagaactaacttatcttgtgtaaatgaaaggttatacctatttaatagcaactccccattttcccctcttctcaggctcctagcaactaccattctactctctgcttctattaatttcactattttagataccttataaaagtggaattgtgtattatttgttctgtgcctggcttatttcacataacatagtgtcttcaaatttcatccatattgttatatattgcagattttccttccttttaaaagctgaataataatagtctgttgtatatatatatatgccacattttctttatccatccaggatatcctcgttttttgttttgttttgttttttactaggctttagtttaattgcattgcagtcagagaacctactctgtgtgtttttaattcttccaactttgttaagcatatgttccatttttgtaaggattccttgagtccatggaaatagtgtgaatcccataatttttaggttcagtgttctgtataaatcagtcatatttgctaataatgtcatattttatccttattaatattatcacttttttgagcagttcatgagaggtgtgttaaaatctcctgctttgattatggatttattgactcctactcataggctgtctatcatttttttcattatagattttaagtctatgttatttaaggcataatttttaaattattctatcttccttgaaattttgatcagttatgaagtttccttctttagtgatgtttttgtcttgaagtctactttttctgattttaatatggccacatcagctttctttgatttttacttacatgccatatttttttcctgtccttctatttttaccctttctattttcttatattttagatgtgttgcccataaacagcattgagtttggtaggctttgtttttaatctagtgtcataattattgtcttttaattagagtatttagtccatttacatttaatgttcttatgggtttttatctaccatcttactttctacatgtcctctatattcctgtgtttcatttatggtactatttattggtgttttattctttcttactatcaccagtgatatgttaatttaattggcattttcaaagaatcagcctcaagattttgttgattctattacttcttgcaactgcgtcaataatccgttgccacaataatgctactaacaaacagctacaaaactacagtggcataccacaataagcatgtattgttcatgcatttggtgtcaactaggcagctctgctgatcttggctgagtctactcacatgtcttggagtgttttggctgacaggtgatctagtcaggctttggctctgttgcatgtccctctcatcctttaggaggctatcttgtacaggttctcatggagagggcagaggcacaagagagcaaatggaaacatgcaagacctcagaaggtttaggctttgaactaacacatgccacttgtccaagcaggtcacatgattaaacccagaatcagagtgagagggggccacatgaagcaaagggcctaaatacagggaatatgaagaatcagagtcatcattgcaacccatgttcacacacaaaaagaagaatgctgatgacttttgtcatggtcttctttttcctgacctaaggagacacaaacttcagcttaagattggtctcctgatttgtgatacaatgagaatggggaaatggtatctgttttcctggaggaggctaagaccttatcccaagtctcatctcaagatggtgatttgggaattgtcaacgtattaagctcaagtttattgtactggttggcctggagtctacaccacatcccaggtaggaggagtttcactgaaaattttgagaaaagccctttgtcctttcatgcaacccgcctagtatctttctttgtatcactgtggactttattatcaacctcttgtcattcattcagtcattaaacaaatactgagtgcatcccatatactagactttaggaacatagtctagtatgtagtgagtccagtaccagccaatgacaagataaacatgcaagacaaacaactttacaataacatcattgtcttgaaggataaaagagtgtggtgggaccagagcagaattacacctaagtcatcttgagagcatccacatagacttcatagcctccacatagacttcatagacctcaaagcttttgagtaaaacttcaaagcaaattggagctttctaggtgaataagcagaaagattttcctagcagtgatatcaaagagtgtagaataaggagatattcaagaccatggcttattgggggaaagtacaagttcagtgttgctggagcatcaggtgagggagtggcaggagacaaagcaggacaggagaactgaggccaggcaatcaagaccttgcatgccttgcaagagagtttggattctattctattacatcggtcatatgtgatgatgaaccattggaaatatttaattagaatgcattacatgctcagtttctagttcacaggaagactttacaaaggccactatggcgtccaggaaggagatgaggagggattgaaccagaacaataactatggattagatctgggaggtattttagataattaatggaacttgatattttattggatatggggaaaggagattgtggaaaaggggactatcaaggatgatttcagaaactgggtagatggtggaaccattttgtgaggtgagattaataagagtgaatggattatttgatgaagatgctgagatggtaacaatcatttctgatttggacaggtagagagtttgactttcctagtaagcatttgggtaaatacactgcattcagtcagccacaggtgcctattaaagtagacagaaaaatggcctcactaaagacacccttgtataatctctggaacctgtaaatgtcaccttttttttttttgaaaggtctttgtagttgtgattaaagatcttgagataaggagattatcctggattatctaaggtgccctaaatgctatcacaggcatcctgtgataagggagagacagagggagattataaagacagaaaaggaaaaggcaatgtgattatggaatcagattggaatgatgtaacgagccaaggaatgccaaagccaacagaaactggaagaaacaaggaacagattctcccctagagcctctggagtgagcataggcctgctgacaccttgatttcagcccagggatactgatttccaacttcttatctctagaattgtgagagaataaattcctgttgttttaagccactaagtgagtggtaattttttacagcagcaacaggaaactaacacaattatgaagaagacaaaaggaaatgaggccaaccatggcacaaaaacatgtcaagaaataaggacttactcactcttcagaaagaactccttgaaagaattgtctgtgctcaatgttaattttttgctttttgtttttttgtgtatccattgtatgtttttagatttgagggatgaggcttgcaaataatataacccattattttaaactgatgacaacttaacactgattgcataaacaaacaacaactaacaagcaaaaagaaaactaaaaaactacactttatctcctggcttttttgttgtttctatttatatcttactgtactatgtcttgaaacattatagttattatttttgatcttttcatctttctacttatgagtagtttacataccataattacagtgttataatagtctgtgcttttctgtgtatttactgttaccaatgagttttgtatcttcagatgatttcttattgcttattaatgtccttttctctcagattgaagaactccctttaacatttcttgtaggactggtctggtgttgatgaaataccttttgtttgtctaggaaagtctttattactctttcatgtttgaaggatatttttgccagatatactattctagggtaagagtttttcttcttcagcactttaaatatgttatgccactctttcctggcctgcaaggtatccactgaaaagtctgctgccagacgtattggagctgctttgtgtattatttgtttttttttctcttgctgcttttagggtccctttttttacccttgacctttgggagtttgattattaaatgcctcgaggtagtcttctttgggttaaatctacttggtgtttatacttcttagacttgaatattgatatctttctctaggtttgggacgttctctgttactatccccttgaataaacttgtatccctatctctttctccacctcttctttaagggcaataactcttagatttttccctttgaggctattttctagaccctgtaagcatgcttcattcttttttattcttttttcttttgtctcctctgactgttaactttaaaatagcctgttttcaagctcactaattctttcttttgcttagtcaattctgctattaagagactgatacatttttcattatgtcagttgcatttttcaactccagaatttctgcattatttttaaaattatttcaaattatttgttaagtttatctgataggattcgaattccttctccatgctatctagaatttctttgagttttcctcaaatcagctattttgaattctccatctgaaaggtcctacatctctgtctctctgggattggtccctggtgccttatttagttagtctggcgaagtcatgtttttctggttggatctgatgcatgtggatgtttgtcagtgtctgggcactgaagagttagatatttattgtagtctttgcaatctggacttgtttgtacttttccttcttgggaaggctttccaggtattcaaaggaacttggatgttgtgaactaagtttttggtcactgcatctatatctgcattaggtgggtacacagagcccagtaacattttggttcttgcagacttgtagaggtgccaccttggtggtcttggataagatccagaagaatactctggattaccaggcagagactcttattctcttcctttactttctgtcaaacaaatgaagtctctctctctgtgttgagccacctgaagctgggggaggggtgacacaaagcacccttgtggccaccaccactgtgactgcaaagggtcaaaccttaaggcagcacagccatgggtcttgcccaaggcccactgtaaccactacctacattctctcaaggccctagggctctgcaatcagcaggtgatgaagccatccaggcctatgtccttcccttaagggcaacaagttcccctggccctacagaggtccagagatgctgtctgggagccagagccaggagtaggaaaccttagaaatctatctggtgctctgttctactgcagctggcctgactgtgacagcactaggcaaagtactttccgctcttccctccgtttttcccatgcaaaggagtctctccccatgtccaccaccaccacaggcccacagggagtactaccagggtactactgatgttcactaaaggcccaagggctcttctgtcagcttgtggtgaatgctttcaggcctgggactcatccttcagggcagtgggctcttccactggcctatagtaggtccagagatgccattcaagagccaaagcctggaactggggaccctaagagcctgtttggtgctcttccccactgtggccaagctgacacctaagctcaagacaaagtcccctttactctttcctctgcttttctgaagcagaagtggtctcttctcgtagccactacagctgagaatgtgccggtcacacctgaagtcagcacagctcttagtctcacccaaggcccatggcgagtactacctggctactgctgctgattattcagggcccaggggctctttagtcaccacatgatgaatcctactaggactgggtccttcatgtcaaggcagcagcttcccttccagtccagggtgtgtctaggaatgtcatccaggagccagggcctggaatagggaccttgtgactctgccaggtgccctatccaactgtggctgagctgggatccaagttacaagacaaagtcctcttcactcccctctcctcttttcaagtggaaggaaggagtcggagtctcttttggagctgtgagatgcggtgcctgggattaggggaggggtaacgcaagcactcttttagcagatccagctggtgttttactagctcgcatgtcccctaagtccggtagctcagtcctcgtggcctagacagcctttcaagtttatttaggaccccagagcacttttgcctgtggtggcacggcttgccagaactcaggttccaaccagcaggatgggtgattcccatctggctagggctgatgcaaatgctccctcttggggtgccagctgagttctgcctggtgttgacagcactgcattccattgcaaagtcccacagtcactgcactttctctccccaagtgtacagattttccacgccacgtggctactgccaggggaatggggaaaggttagtgttggcaattcaagactgtctttcctgccctcttcagtgcctctttcagtgatatgaagttaaaaccagatagtgtgatcactcccctgatttttggttcttatgaaggtgctttgttgtgtacataattgttaaattttgtgttcctgtggggaggatgattggtggaagcttctatttgatcattttgcttcacttcctctagcactatttattgtacagtttgttctttccccctaacttgaaatgccatcttcatcatatatcaacatttcataactgtctgtgtctatttctggccttcattctgttctattcttgccccagtaactctctgttttaataactatgtctttataatgtcttaatattcagttgggaatttggctctctttttgttcatctttcttaaatttttgtttactgtttctccatatttgctcttttagaatcaatttatttcatcacacaaaaattaagatttttgatggatatttaaaataaatgtaaaaagcacaaaattatattattatttattcctgaagccctcaacatgtattattttgcactccgtatgtattattcctattagataaagagcggggtagatccagagtcttgtgggacctaaagtctgacccattcaagagccctttttaaggagagtaatgcaaaatgatgaatgtggcattagatgctgtgccttggcggagcctgtgctgggaagatgcctgaacctctaagctttattagcttcatggtaaacccgcttcagataagcagtctcacttagagagaaagtcctgacaaattgtgcctttactcccactagagtaaaccaatagttcatgacttctaaactacttagatggtataagccataaaataacaattaaatcgcgcagcttcagttgtatttttagtcatgtgttacacaataccactgcctcagctttccccaggatagcacctcttatttgaggatctcaggggacattatgaacattaagtaattaaacctcgcaagaccccagagacactggagagagagatccagcttcaccttgcccagttctgaaatgcagtcacctctagggatgaacgtggcagctgcttagtaataaactgcaacacctcacgacagtttagtcaagcaattagtctttgtagttggtaactgtctcatgaacattagaccattgacagttaagtcaccaggattattagtttactgaaaatctaatccagtctttaagactttttacttttttgtaatattttcctaattataaaagaagcatgcacagtgaatgtctacttttagttgcattttttgtagttcttcaaacttaaaataggaaagaaatatctttgtaatacattaaaataggtagttactgataatgaggtttttttaattcacaagttttctgctgatcaaaagtaatcaatgatagtaaaagttggaagagtggatacctttgagaggagtattgactggacggggagatgaggggaacctctgggtgctggaaattttttttttttttttttttttttagtgctgtcttgttgcattttttaaaaaattttttattttttattttattattattatactttaagttttagggtacatgtgcacaatgtgcaggtttgttacatatgtatacatatgccatgctggtgtgctgcacccattaactcgtcatttagcattaggtatatctcctaatgctatccctcccacctccccccaccccacaacagtccccagagtgtgatgttccccttcctgtgtccatgtgttctcattgttcatttcccacctatgagtgagaacatgcggtgtttggtttttttgtccttgcgatagtttactgagaatgatgatttccaatttcatccatgtccctacaaaggacatgaactcatccttttttatggcaatcattaaaaagtcaggaaacaacaggtgctggagaggatgtggagaaatatgaacacttttacactgttgatgggactataaactagttcaaccattgtggaagtcagtgtggcaattcctcagggatctagaactagaaataccatttgacccagccatcccattactgggtatatacccaaaggactataatcatgctgctataaagacacatgcacacgtatgcttattgcggcactattcacaatagcaaagacttggaaccaacccaaatgtccaacaatgatagactggattaagaaaatgtggcacatatacaccatggaatactatgcagccataaaaaaggaaatgttttatatgttctttttttttcctttttttttttttgtttttggagatggagtctcactctgtcatctaggctatagtgcagtggcacaatcttgactcactgcaacctccgcctcccaggttcaagtgattctcctgcctctcctgagtagctgggattacaggtgtgcaccaccatgcccggctatgttttttgtattttaagtagagacgaagtttcatcatgttggtcaggctggtcttgaactcctgacctcaggtgatccaactcccttggcctcccaaagtgctgggattacaggtgtgagctactgtgacaagccagttttatatatttttataggcgttggttgttcaggaacagacatatgtagaaattccctgagctgtacacttttcatatgtgtgttaatctcaacaacaaggtcaataagcctaaaaagcatcctgctcttgtcatgatgagagtgctagaaaccccagatagtcttatttggaaaattctgcagggtgcaggacatatcgggagctagagatatgacagtttttattttcctcaaagcatctttcttcagaagagggattctaagtgatttaccctctcttctcaggacattttctcttcatgccaaaagagctacctttcatgctagaatgtgactctctgtctcattgtgccttcaacattatgtacctcttcgactatgccatttacacctccctaggcatctcatttttatcttagaatttcattcatttacctacatctttgccagaagtaagtataatgcattagtgacccagatatttggggttgagaggcatctgcaggggccattgttgtaactggcactagaagaataccatgggagaggaggaagcagaggaccctggctgctctggctctgcagtgtctgatgtgatgcttgaaaacaagaaggcagagcagcatgcccacactcacggagacagcagcagtctctggagccttcagcaggcccagggtccctcctacatctgtggcagcgcttctgaggaggggcagccatgagcagggtgtcctagggctgctctgagctgagtcccaaaggctgagagcagatgtcatggctgagaactcccagcagagcggacaccactgggtgaggcacaaaggagaggacatcctccaatgatgtcttctcccaggtctccctctttaggcatggagagattacaaaagagaaaaaaggaggggaggaggagggtgaaagacctttgtagacaaaatgggaaatttttagtaaaggttaaatacatgaagcctaagctaccctgattattgactttccagaacttactaaaaaaccaatgctcagctccagttcttcttgaaaataatttctattacgaaatagaaaagtgagcattgtgaccgctggcagagcatgagttcacagtatttccacacaaagagaaagcagcccttgtgctaagccttggcattcaggtaacactgatgtaactcactgtggccttttccaccttctgcctggagatcatttcaaagcccaccatcgaggaagctgataacccattgtttgtaaacttcaaaaggggctgctatgaaaggaacccattgcccagggactggcagaggttgagggcctcctgtggcccaggcctgggccaggtccgttgcccatcttcccatctccacaactcccctgggcagcatcatgtgaatgagggcaaagagaggtggagggagggaggaactagcccagaatccctcctcagtgtcaaaattcgggggggctgcggagacctgctcttcccacctcaaggtactgctctctagaataaaattctttagatccattgtagtctaaaaccatgtgaccatgctgtctaatttcctgtgattctgcagatatttatcatctattttctgtcattattctatcccttctctcaaagatgctgagctcaggagtagcagccaaggttcccaaaaaatagtcgaggagttgcaggaacctgtctctccagataccatggaaaacatccaggtgagagagactatccctccatgcctagggtggggggatgggcctgggggctacctgtgacatcaggggcatctctggtgctggcgtcactacggagaagttctaatgcctgatgcagaaaaggcctcactagcagtaagcacaccgcgagctgggggaaacagaggcctctgtgtttgtaacagacaaatcaaagcctcactggtgtgctccaaaattcaggtcagaacagagtgtcagcctttctctaccttcctccctgacttcaggaggctgagacagataaaactgctcatttaaactcactgggaaatacaggctttctgaagagactgacacactatctgcatactccaatgggacagcattttccttactgccctgactggtccctgcagacatggaaacacttgccccatctcccagcaaagtcccctcccagcaaagaggggactcgggagatgtgagtcttttaaagaagattatgtggcatggattagattgatggaaatgaagctgatttaatggaattagttttttttaagtgcagcattctttttacactaaggtgcagtaacggagactggatttactctcctgcctaaaataaccaaagtgtggctaaaatatagaaaacactgttcatcactgtaacaaaggccagcgatgcctgggagatgggaaacaagccaagcgaatcctgtggctgccccagttgtttgccttgacagaccttctaggtcacaacgcagggcaggaagagccagaagacttcccgagtctttaagtccatgcagactagagtgactaaagtctgaaggacagagtactagaaaggacagagtgcacagagagagacatcattgatcagcagatcagtcaggcagtcagctgagtgctgatcacaccaggcatgtgaggaaaccccttaaggccaggctgagaaaagaacctctgaaaaggatgaggattaatagtgcccatgcctgtacaaagttaggaatagtgcctgttctcaccagccagactggaaaagcttatgatttgcaagagagtacacaaaagagtcttgtggagaataattagttctagagagggcaccgctccagtcctgcttaacaaatctttaaagcaagaactaaaagaatcaaagtaacttaactgagtcccagaacaaagtacaagactatctgtaggaatacagaattacttggcacccaccaagatgaaattcacaatgtgtggaatccaataaagaattaccagcactcacaaaactggtaatatattatgcataaggtggagataaatcaatcagttgaaacctacatacatatgaaaacatgttagaattaatggacaaaaacattagaacagttatcataactgtatgttccaaaggttaaggagagacataaaagatataaaaatgccccaaatcaaacttctagagattaaaaactacaatcaatcaagatgaaaaatacaccagaaggattaactccaggttaggcattgcagatgaaagattagtgaacttgaaacaaatataaatgagatgttttttcaagatacgtatcagtgagtttggggacaacttcagagacctaatatatgtgtaatagaagtccacatgaagagagagagacgctaggacagaaaaaaaaaacacattcgaagaaataatgactgaaaaatgataaatttgatgaaaacaatatactcacagatacaagaagctcagcaaacacaagaacataaagaaaactataccaaagccagtggaaaaccagtgataaagagaaaatcttaaaagcagccaggagtagatttgggggaagtcaagttaggaacagagaaacaaagatatgaataacaggggatttcttattggaaataatacaagcagaaagatagtaggatcacatctttaaagaaatagaagaaaataaactccaccctagaattttatacccagtaaatatctttcattcaaaataaaatatgaaataaagagtttgccctacacagaaaaggtggaaaggtgcatcaccagcagacccacattacgagaaatgttaaagaaagccctttaggcagaaggaaaatggtatcagatggaaatttggctctacacaaagagttgaagagcactggaaatggtaacaaagtgggtaaatatataagattttatccttaatatttatatctttttaaaagatagtgacttcacaaacaaaaatagcgccgggtttataacatatgtaaaaataaaatgtatgacaagaatagcacaaagagcttgagaggagacccagaggggaaaagtatactattttaaggttcttatatctaaagtgctataatatcacctaatgacagtctgtgatcagttaaagatgtaccactaatgttataaatcagattcaaagagttatatctaataagcctatagttgagattaaatatcatcataaaaatacaaaattagaccaaaagaagacaaaaagagaggaaaaagggagcaaagactagatgggacaaattacaagatgacagacttaaacctaagtatacaataattacattaaatgtaaacgttccaaatgtcccgattaaagatcatgtatataaggcagatatagagtggataaaatgcaaaattcagttatatgtagactataaaaatgcactttaaatataaagatacaataggctaaatttaaagaatggaaaaggatacaccatgccaacactaatcaaaagttagctggaatggctttactaatttcagacaaagtagattccagaacacagaatactataagagataacaaaggccaagagaatgtaacaatcttaaatacttatgcacccaataacagtgcttcaaaacatacgaagcaaaaagttgtagaactgcaaagataaatcaataaaaattatagttagagatttcaatatgctcctctcaataattgatagaataagtaggcagaaaatcagtaaggataaagaagattttaatgacagtgttgaccagccttgccccacctcctggcctgggtagctgaagtgcagcacagtggccctcagcatcccatcaaatgtgacacactgtgaacaatgtggatcttgtgggctgcagccctggtggctgagggaagtgctctctggatgctgcatatggaaccactgtgttctcagtgtgtagattcacagatagacatgagtgaataataatagaaaatggcatggaacagtgggcatcaatgtcaagatgatactgggtaacaccctacaactggatgaactaatgagtgaagaagagtatgagaaatatgtaaaatccattgaggagtgagaatgggacctctcaataaactagaatgaaacaacttaattcagcatagttgtcttaaattagtaatagatggaagacataaaatagcaacttttggtattaccagtggataaagaaactactcccaacactgctgctggaagaaaataccccttttctaaagatttcagacaaacacaatatgcatctttttcacaatactctatgatttttaggctaggctctagttataatatttagaattcatgaagttttctgtggtgagaactagctgtaaaaattatatatcttgaggataacattatgtcttcagctttatataatattgtaacttgcttatatccattcctggatttgagtcaaaatacttaatgatctttgcattgaaaataatttgggagtggagaaaacttttgttagttgtacaatgtcagatgaagaacaatactgtctttttaagtttcaatagttttggggctaaagtggtttttggttacctggataagttctttagtggtgatttctgagattttagtgcatccgtcacctgtgcagtgtacactgtacccaatatgcagtcttttatccctcacccctaccggccaagtccccaaagtccattatatcactcttacgcctttgcatcctcatagcttatctcccacttatgaatgagaacatatgatatttgcttttccatacctgagttacttcacttagaataatggcctccagctctatccaagttgctgcaaaagacattatttcattcctttctatggttgaatagtatttcatactgtatataccatattttctttatctacttattggttgatggacacttagtttggctacatatctttgcaattgcagattgtcctgctgtaaacatgcatgtgcatgtgtctttttcatataatgacttcttttcctttgggtagacacctagtagtgggattactggatcaaatggtagttctactttacctctttaaggaatctccaaactgttgtccatagtggttgtactaatttacattcccactggcagtgtaaaagtgttcccttttcaccacatccacaccaacatctattgtttttgatgttttaattgtggccattcttgcaggagtaaggtggtatttcattgtggttttaatttgcattttcttgatgattagtgatgttaaacattttttcatgtttgttggctgtttgtacatcttttgaaaaatatctattcatgccctttgaccactttatgatgggattatttgtttttttcttgctgatctgttcgaattccttgtagattctggatactagtcctttgttgggtacatagtttgcaaatattttctcccactctgtgggttgtctgtttactttgctgattatttcttttgctgtgcagaaactttttagtttagttaggtccaatttatttgttggttttttgtttttttttttgcatttgcttttggggtcttagtcatgaattctttgcctaagcaaatgtccagaagagatttttttaatgttatcttctagaatttttatggtttcaggtcttagatttaagtctttaatccatattatgttgatttttgcataaggtgagagatgagtatccagtttcattcttctacatgtgacttgccagttttctcagcactatttgttgaatatggtgtccttttcccactttatatttttctttgctttgtcaaagactagttggctgttaagtatttggctttatttctgggttctctgttctgttctgttggtctacatgcctatttttataccagtattatgctgctttggcaactataaccttgtagtatagtttgaagtcaggtaatgagatgcctccagatttgttctttttgcttagtcttgctttggctatgcaggctcttttatggctccgtatgaattttcagattgttttttctagttctgtgaagaatgacgatagtattttcatgggaattgcattgaatctgtagattgcttttggcagtatggtcattttcacaatgttgattctacccatccatgagcatgggatgtatttccatttgtttgtgtcatcagtgatttctttcagcagtgttttgtaattttccttgtagatctttcacctccttggttaagtatattcctagggtttttttgttttgttttttgtttttgtatttgtgggttttgtttgtgtctgttgtaaaagggattgagttctctatttgattctcagcttggtcattgttggtatattgtagtgctactgatttgtgtacattaattttgtaacctgagactttactgaatttgcttatcagatctaagagctttttggatgttttagtgttttggatgttttgtgttttctaggtatgtgatcatatcatcaggaaacagcaacaatttgactttctcttttccaatttggatgccctttatttctttctcttgtttgatttctctggctatgacttccagcactatgttgaatagaagtggtgaaagtgggcatccttgtcttattccagttctcagaaggaatgctttcaacttttcctcattcaatatgatgttgacaatactttcttaattttgcaatacactgaatttgctggtgctatttatatacagtgaagcaaaagcttggcagtagaataagaaacaatatagtaataaaacaacttcattactcatgaaaaaacatgcagacaaaaccactactgaccgatttggcgtaattgacatatataaaatacttcactcaacaacagcagaatatacattcttttcaagtatacatagaacatggacagtttaccaagatagaccatattatgggctataaaacaagactcaataaatttaggattcaagtcatctgagatatggtctctcatgacaaaagacttaacaagaaaataaaactgcagatcagtatttctcatgaacattgatgaggaaattctaataaaaacttagcaaactggaagatggcagataggaaacagggctgacatgcagctcccacttggatggacaaaacagcatgtggagattcacaccatgaacttttgcttcggaaaccatcacaggagcatgccaggaaaaccaaaagaaaccacagatcctttgtaagaagcagcagactgctgcaattgccacaagacaggcgaaaacctgtgaattcccaaagtgtgaggggggaaacttgcttctgaacacacatccccactggcgaatctgaaaatccagattacaggagaaagatttaaccttacctgccactgaaatggatttagtgtgaaatataaaagtagaagcagcagtaggaagaaccttctaggcactcccattctccagctcaagcccagggaagccatccctgactatatctcacagacatcctcggggaaggcagtccagattttggaaggggtcacagggtgaaagaaacttccaactgaactttgtaataattttgactggccacaaaccctcttgagcagaatcctggggatgaatgggaaccactgcagaaaggagtgcaggagtcacagccagcagtgtggggagatgaggaggggcatggcctgaaagccatacttgcttcttcagtggagaaacttatagcatggggctgggtctgagtcctacacacaggctgcctgtagataaacttgtcgctcttagcagagcatggcaagagcgagactggcctcaccaactccatgggagtggggtgaaacctattgttactggctttcccccacttccctggtgacagaggcagccatgattccctctggaacataaccccatgcgcccaccacccccctacactccaaagtggcttcagtaagccctgctcaaggagggtctgagctcagacctgcctattcctacccacacctgatagtatttctctacccaccccagtagccaatcacaaaagacgtaaaagcttgggatctttatggccctgcccatcacctgagaaacccaaattcttatcctggccaacacagggcaagcttatatcccccttctactattgcagctggtgctctctcgaaagtgccacctcctggcttgaggccaaccaactcaggacattacagcaactcatgacagaacaaccctgctccaagaaaggagaaaacaaaaaccaattccactgcctgaaacatcctggataaccagtggtcctgagtctgtccacatgacagcttcactgctagcataactagcatttgagaaagccagcacactaagcatatctacaaccaaggactctcacagagcctacttcactcccctgccacctccaccagagcaggtgctggtattcatggttgggagacctgaagatagattgtatcacaggactccttgcagacattccacagcaataacccagagcctggtagccccactgggttaccagacccagaagagaaataacaatcactgcaatttggctctcaggaagtcccatctgtaggggaagagggaaggcaccacatcaagggattactttgtgggacaaaagaatctgaacagcagcccttgagttccagatttttccactgacatagtctacccaaatgagaaggaaccagaaaagaaattctggtaatatgacaaaacaaggttctgtaacacccccaaaagaccacactagctccccagcaatggatccaaaccaagaagaaatctctgaattgccagataaagaattcagaaagttataaagctcctcaaggagataccagagaaaggtgaaaaccaacttaaagaaattttttaaaaaaatacaagatatttatgaaaaatactccagagaaatagatgtcataaagaaagaaatatagcttctggaaatgcaagacacacttagagaaatacaaaatgcacttgaaagtttcaacagtagactagaacaagtagaagaaagaacttcagagcttaaagacaaggctttcaaattaacccaattagacaaaaaaaaaagaattattaaaaaatgaacaaagcctccaagaaatttgggattatgttaaacggccaaacctaaggataactggtattcctgaggaagaagagaaatctaagtttggaaaacatatatgagggaataatcaaggaaaacttccctggcctcactagagatctagacatccaaatataagaagctcaaagggccaggttcagtggctcatacctgtaatcccagcactttgggaggccgaggtgagcggatcacgaggtcaggagattgagaccatcctgactaacacagtgaaaccccgtctctactaaaaatacaaaaacaaaattagccaagtgtggtggtgggcacctgtagtcccagttactcgggaggccgtggtgggagaatggcgtgaacccaggaggtggagcctgcagtgagctgagatggcgccactgcactcctgtctgggcgacagagcaagactccgtctcaaaaaaaaaaaaaaaaaaagaagctcaaagaacatctgggaaattcactggaaaaagatcatcacccaggcacatagtcatcaggttatctaaagtcaaagtcaagacaaaggaaagaaaattaagacctgtaaggcggaaacatcaggcgacctataaaggaaaacgtatcagatttacagcaggtttctcagcagaaacactacaagccagaagggattgggtcctatctttagctcctcaaacaaaataattgccagccaagaattttgtatccagcaaaactagcttcataaatgaaggagagagaaagtgtttttcagacaaacaaatgctaagagaatttgccactaccaagccagcactacaagaaatactaaaaaaagttctaaatcttgaaacaaaacttcaaaatacatgaaaatagaacctccataagcataaatctcacagggcctataaaacaataacacaatgaaaaaaaaaacaccaaagtattcaggcaacaactagcatgttgaataaaacagtacctcatatctcagtactaacattgaatgtaaatggtgtaaatgttccacttaaaagacacagaatggcagaatggataaacattcaccaatcaagtatctgctgtcttgaagagactcacctaatgcataaggattcctataaacttgcagtcaatgggtggaaaaagttatttcatgcaaatggaaaccaaaaatgaggaagagtaactatttttatgtcagagaaaacatactttaaagcaacaacagttaaaaaaagtgggacattataaaatgatttttaaaaaatcagtcctacaggaaaataccccaatcctaaatatatatgcacctaacatggtagctcccaaatttataaaacaattattactagacataagaaatgagatagatggcaacacaataatagtgggggacttcaatactccattgacagcctgagacaggacatcatgacagaaagtcaacaaaaaaaatgcacttaaactataccctagaactaatggacttaacagatatttatagaacattcaatacccaacaactgcagaatatacattcttttcatcagcacatggaacattctccaagatatgccatatgatgggccacaaaacaagtctcaataaacttaagaaaattgaaattatatcaagtaccctctcagaccacagtagaataaaattggaaattaactccaaaaggaaccctcaaaactatacaaatacatggaaattaaataatctgaacttgaatgatctttgggtcaacagtgaaatcaagatggaaataaaaaattatttgaactgactgataatagtgacacaatttatcaaaacctctgggacacagcaaaagtggtgctaagaggaaagttcatggcattaaatgcctacatcgaaaagtctgaaagagcacagatagacagtctaaggtcacacctcaaggaactagagaaacaagaacaaatcaaacccaaacccaacagaagaaaagaaataaaaagatcagaacaggactaaatgaaacggtaacaaaaaaattcaaaagataaacgaaacaaaaagctggttctttgaaaagataaacaaaattgatagaccattaccaagattaaccaagaaaagaagagagaagatccaaatagcctcaattagaaatgaaatttctaattgatattacaaccaataccacagcaacattcaagactgctgtgaacacctttaggtgcacaaactagaaaatcttgaggagatagataaattcctggaaatatacaaccctcctagattaatcaggaagaaatagaaactctgaacagaccaataacaggtagtgagattgaaacaataattttaaaattgccaacaaaaaaagtccaggaccagatgaattcacagctgaattctatcaggcattcaaagaagaattggtaccaatcttactgatactgttccagaagataaagaaagaggtaatcctccttaaatcattttatgaagccagtatcacactaaaaccaaaaccgggaaaggacataaccaaaaaagaaaactatagactaataatcctgatgaacatagttgcaaaaatcctcaacaaaatgctagctaaccatatccaacatcatatcaaaaagataatacaccatgatcaagtgggtttcataccagggatgcagggtttaacatatacaagttaataaatgtgatatgtgacataaacagatttaaaaacaaaaatcatattatcatctcaaaagacacagagaaagcatttgataaaatccagcattcctgtaggattaaaaccctcagcaaaattggcataaaaaggacatacctcaagtaataaaagccatctatgagacacccacagctaacattatactgaacaaggaaaagttgaaatcattccccctgagaactggaacaagacgaggatgcacattttcaccacttttattcaacatagtacttaatgtcctagccagagcaattagacaaaagaaagcaacaaaagccatccaaattgataaagaagaggccaactgtcgctattcactgataatgtgattgtatacctagaaaaccctaaggactcatccaaaaagctcctagatctgatatattcagtaaagtctcaggttacaaaatcaatgtatacaaatcagtagcactgctatacaccaacagtgaccaagctgagaatcatatacagaactcaatcccttttacaacagctgccaaacaaaacaaaacagcaacaacaacaacacacaaacaaaaaaatcccaaaacaacaacaacaaaccttaaaaaaacaaacaaaaaacctaggaatatacttaaccaagaaggtgaaagacctctacaaggaaaactacaaaatactgctgaaagacatcactgatgacacaaacaaatggaaacacatcccatgctcatggatgggtagaatcaatattgtgaaaatgactatactgccaaaagcaatctacagattcaatgcacttcccataaaaataccatcatcattcttcacagaactagaaaaaacaatccaaaaattcatatggagccataaaagagcctgcatagccaaagcaagactaagcaaaaagaagaaatctggaggcatcacattacgtgacttcaagctgtactataaggctatagttaccaaaaaagcatggtactggtataaaataggcatgtagaccaacagaacagaatagagaacccagaaataaagccaaatacttaagagccaactaatcttcaacaaagcaaacaaaaacataaagtaggaaaaggacaccgtattcaacaaatagtgctgggaaaactggcgagccacatgtagaagaatgaagctggatcctcatctctcaccttatacaaagatcaactcaagatggatcaaagacttaaatctaagaggtaaagccgtaaaaattctagaagataacattggaaaaaactcttctagacattggcttaggcaaagaccaagaacccaaaagcaaatgcaacaaaaacaaagataaatagatgggacctaattaaactaaaaagcttctgcacagcagaagaaataaccagcagagtaaacagacagcccacagagtgggaggaaatatttgcaaactgtgtatctgacaaagaactagtatccagaatctacaaagaactcaaatgaatcagcaagaaagaaacaaataatcccatcaaaaagtgggcaaaggacatgaatagagaatcctcaaaagaagatttacaaacagccaacaaacatacgaaaaaatgctcaacaccactaattatcagggaaatgaaaatcaaaaccacaatggaatgtcaccttactcctacaagaatggctataatttaaaaataaaaaaacaacagatcttggcttggatgtggtgaaaagggaagagtttttcaatgctggtgggaatgtaaactagtacaagcactatcgaaaacagcatggagattccttaaagaattaaaagtagaactaccatttgatccagcagtcccactactgggtgtctaccgagtggaaaagaagtcattatatgaaaaatacacttgcacaagcatgtttataacagcacaatttgcaattgcaaaaatatggaaccagactaaatgccatcaacatagagtcttttatctgcacattgggtacagtatacactgcttggatgatgggtgcactaaaatctcagaaatcactaaggaacttttccatgcaaccaaacaccaactgttctcccaaaaatattgaaataaaaaaatttaaaaattagcaaactgagtcaatatacaaaaaggataatcatgactgagtagggtttattctaggaatgcaagtttggtttaacataagaaaatcggtgtaattcaccattttaacaaactaaaaaaaaaccatatgtttatctcataaatatataaaagacatttgaaaatctaacattaattcctcataaagactcttagcactttttcaatttgacaaaggttatttttgaaaaacttacagcaaacgtcacacataatggtgaaggactaattgtttcacccttaaagtcaggaacaagttaagaatgccttttctcaccacttctaatcaaaactgtactgaagatttgaaccagtgcaaaaagataggaaaagaaatgaaaggcatccagattaaaaaggaataattaagactatctttcactcacagacaacatgactacctatgaaaaaaaaatctgatggaatctacaaaacagctactataactaatatataaaaaattaatatgcaaaatttagttgtatctctgtataatagcaatgaacaatcagattgaaataccatctacaacagtacaaatatgttaaatacttatagattaaatctgacgaaagatattcaagacttctatggtgaaaactacaaaacatttctgagagaaattaaagaagacctaaatacatggagagatattctatgttcgtgggatattgaatctttaaatcagttctttgcaaatttggtaaaatcccaatcacattttcagcaggaatttttatagaagtttaattaattgattccaaaatttatatgaaaatggagataacctaaaacagccagagaaactttgaaaaataacaaagctgtaggataacactaactgatttcaagattaattattgtaagattcttttttttctctctctctattgcccaggctggagtgcagtggcatgatctcagctcagtgcaacctccgcctcccaggttcaagtgatactcatgcctcagccttccaagtagctggtacaggtgtgaaccaccacacctagatttttttgtatgtatttttagtagagatgggggtttgctatgttggccaggctggtcttgaactttcagcctcaagtgatccgcccaccttggcctcccaaagtactggaattacatgtgtgagccattatgcctggcctaattattataagattattgtaatgaagatagtgtaatataggtgctaaggtcaacagtaggttaatggaatagaattaaacaactcagaaataggctcaacatatagacaactgatttttgacaaaggcacatggcaatgtagtggagaaagaatagtcttttctctctgaaacaattttatatccatatacaaacttttaaaaaactcaatccatacctcacaccatatacaaaaattagctgcaaatgaatcatagacttgaatgtagaattcaaaccaatataacctctagagaaaacataacataggagaaaatgtttgtgaccttgggttaggtaagatttcttagaaacaacattaaaagcacaatacataaaagaagaaattgaccaattagatgtcatcaaaatttaaaaccttttctttttgaaaagtactttaagagaatgaaaagacaagctacagactgggagaaaatatttgcaaattacatatctgacagaggacttgtttctacaacatattttttaaaactctcaaaacacaataatacaaagtaaaaaagctaattaaaaataggcaaaagatcatcattctcagtaaactatcgcaagaacaaaaaaccaaacaccgcatattctcactcataggtgggaattgaacaatgagatcacatggacacaggaaggggaatatcacactctggggactgtggtggggtggggggaggggggagggatagcattgggagatatacctaatgctagatgacgagttagtgggtgcagcgcaccaccatggcacatgtatacatatgtaactaatctgcacaatgtgcacatgtaccctaaaacttaaagtatattaaaaaaaatagattaaaacaaatatcaaatgaaaaaaaaaatgtggccaaatactgttattgtggagaagcctgaatctggcattaaattacaccaagtggacctttgaaaaaaaaaaaaaaaaaaagatttgaactttccaaaataagacatcacatgaaatgacactcaatctcattagtcattagagaaatgcaaattaaaaccacaatcaaatacaactacacgtctattagaatgaccaaaactagaaagattaagcattccaagtgttggtgaggatgtgtaagtgcatccacaccaggatactattcagcaacaaagaggactaaaccactgatgcgtgcaacagcatggatgaatttcaaagtaaacatgctgagtgaaagaagccagatcaaaaaagaataaatactatttgatttcagtaatataaaattacagaaagtacaaactataatgacaaaaatcatatcagtatttgcctgtggttggcagagtagaaagggtgggagtgagaggcacatgggaacatggaagcttggggggcgatgtgtcatgttcattatcttgatcacagtgatatttttatgggtgtacacataaatcaaagcttttcaaaaaggatacttcaaatatatgtagcttattgtatgtcaattctattaggttggcacaaattacttttggtgcacaaataattgcagtttttgccattactttaatgcaattacttttgatataattacttttgcaccatcataatacctcaatacagtagttttttaaagaaaaaacttagtgcacctttcaagttaaacagaagaataggaataatggagtaataactaacatctccagagaatcaggaggcacctgcactatgcaaagcatctgtttctctatctgtctgtctttattttatcctcataacagccttatgaaatagatgctcttctcatccccttttcacagaggaggaaactgaggttacataattttcccaatgccacaaggccagtaagctgtagagccagggtctgaaccctggcagtttgctccagagcttggactctaaaccactgtaggtgtcgattaattttcatgttttgctgtcatcatttccagggaaatattgccagagaagctgcatccgaggaagctttaacagcagtccaaagtggaaatgttagtgaaccggaggtagggtttgacgagggcctttgcgtgccttctagccaccccatgggtttcacacctttctacctcagaggatttgtgccctttcctcctcccaatctccctgcctgtctccaccagttcacacctaccacctcctttaggacttgctgcaccaagcctcacctccttacctcttcccctgctgtgattaatcttttcttctgtatcctctgcatggcctggactgtaagttgcattttctacataaattatttgcaaaaattttagtaaatacagcttatctctccttcccattgcccaaaaagaaaacattttggagaggcaaaacatttgtaagagttttctctgtatcatatgcacatacatacacttctgtccgtgtctaggtgtgttattaatatatgtcatttacattcatctcaggattttggaagtcctccctcctgttacaaattcaggccaaggggcatagcatcttccaccagtgcagtggctatccctggggacttcaccatcctttgttggtttcccttcaccccacccatgcctttgcaggtggtccgttgaccactccattggagtgtcccttctgttccctgccagaagcctggtggttcaggaagagattggcagggtcctgtgaaccctgctcaggatctcagacttttcctaagaagcagaggagggtgttgtaggcttttgagtgggaggttggtacaataaagcattttcattccctgatgatgagcatagtcctggaatttcagtagtttcccaagagcctcttggtgatggatggactgactcagcaacagaagcctagagaacccttgagaagggaatggaacatggggcttggtcatatccatagaggcactgggacagattcactgaacactaagcccagacactgaagttctgccagaggaccaggttctccaacctgtctcctctccagattctgaccagtgaaggagtctacccagaagtcagctagggattgaagtacccctttctcatggctaacactgaaccagagaacaaagcttggaccgagaacacaaatgggcttcccatttctccttactgaattaagtgcccccatgtggttgtaggcaggcctcacctgtggggcagggtctccccactcccagctaattgcatggaggggaggagaaaacacacaacctgggagcaggatgtgctgtcagaaagagaaagcacgatgtaggcacagggtccagtttttgaatctcacattagcatatgctgttggagccccacccatatcctctagcacgtattcttcctgagcactctgtgaagacaaggactgcaagtgcctggtctttcttccatgccatgtttgcagcagggcaggctgtttggggaagcagccatcagccagtgactgaagggattggagaatcaatttgccagctccttcacctcttaggtgggaccactctgcactgtgttctctaggctttcggagatccaggtggggttgattcaccatagtcacccacatcttgaaacaccccatgctggcagcctccccttcctcacctcgcatgccactcctcttacagaatttcctggctttgctccccaagtaaactactgactctcagacacttaattcagggtgtgtttctggggcaacccacactaggagactcactgaccagttggtcactccctgtgccctagggaggaaagtcagggtgtagaagaggacagcagttttctctctaatattcctaagagggtagccgttccgttatgaacccaagcaaggatgtggttggagggacaggatgcctgcccccaccactgcatcaaacatggttggaaccccagaagacacctgagtcaacaaggtggattgatctcctatttttatctcctctccctaccggagaaaaacactgaaatgacagtaaagggataaaaagggcacaaatccacaaaggtgagatggagaggagatattggaagataagcactttaaaaatattgagaataaaaaaatcaatggaagagtttacattggcttagcacagctgaggaaggtgaaactcaggcatctttatgggaggagagactggtgaaaagtgtgtgaattctgcacaaggctgaagactggaggtttgcagaaggtggggtgaggaattgggctgaaaagctgggcagtctgatgtggagtgactggaacactggatccctgcagactccagttaggttgtcagccacaccccaagtgagaggataaaatgactattctctagagaaattgaacagaggctgctgctaattcagatttagcctgtgctgcatgggcgttgtaacggtgaggaatagagaacagacaagtaagtggaattctccacttcgaacagaggaatccacagcccctcctccagccacgccctctcaatgccaggagccaggccttgtattaagtttctattgctgctgttacacattaccccaaacttggtggcttataacaacacaaatttattattgtgcagttctggaggttagcattccaaaatgggtttgagtgtgctgagcttcaggtgtagacaggggcgtgttccttctggagactctaggggagaatctgttcccttgcctttgccagcttctagaagccacttgcattccatgccctgtgtccccttcctccatcttcagagctggcagcgcagcatcttcctccctctgactcagacctgctgcctccctcttagcagatccctatgattcctctgggcccacccggatcatctaggagcatctcctcatcatagaacccttcatgtgatgacatctgcgaaatccctgtgccctgaaagataacatatttacaggttgcagggactagtacctgtaacatctttggggaccacagtcctcaatacagaatattggagaacttaagtcccaaaaaactgacaggcccaaggaaaatgccttcagatgatgtcactgaaggtggccacccagtaataatgccagatctctgcctgatcaccccatgaagtgccccagttagccagtgtctgtggagttttgcctctcaagcatgttgcttttaggaagctaaaaatgtgctctaacgatatgagggcctaaatgatgaacaaaaaagacaaagaaaagacctggaacttacaaaataggagctgcaatacaggcaggacggcagagctgcaagtccagattagaggggagaaaaaaggaagctcatatattatctcaaacgcctgatcatttggaaaataatagtgaccaacacttggcaaatctgataaaggaagtgaaaaacttagcaaaccaagtgaataaaaactaagcacacagatgaaaacattgtcatattacactactttgctcagcaacaacagaacttacacattcatattagtgtaaatacttacggatttaaccctgaattgtgatgtaattttcctgggggataagatgtggggaagagggtagtatgagagggattaatctagccactgcatcaatattgaataggaaattctaaaaactaatgaatttagaaacagcaccataagcatattgttcagaaatatagaggtaaatatatacccaaataaatgaaaacgttgaaagttctgttcaatgggggtagagacttggaaggacagagaactactgattttcttaataaatgtttggtgctaatattattttaaatttttccatatgcatgtattactttgatttaaaagaactccatgagggatctcaaagggaatcatcttctgagttatgacacctttttaggtgcacctaaaccaagacagaacagcctcagccctgactttccaggtggctgtggtccactggaccttcctgggctccacctccccacgatagttactcccaggaccacctgagcagtcccaagattcaaaaattcttgtatcacaatgaaaacagctttggggacagagggattttgcttctggagttattataatatgtatataatactatcacgctctaatctctaccctgggatgcagttaaaatatggaccctatgtcaaaggccaactgaaactatttgtcttgtgtgagaccttcatgtgagaactagttttttttttctttattattattattttttaaattttattttacgttctgggatatgtgtgcagaacgtgcaggtttgttacctaggtatacatgtgccatggtggtttgcggcacctatcaacccgtcatctaggttttaagccctgcctgcattaggtgtttgtcttaatgctctccctccctttccccccgacccccctgacaggccccagtgtgtgttgttcccctccctgtgtccatgtgttctcattggagaactagtttttaaaaacattttatgaattttgagtatctcattaagaacctctccttaaaaccaggcctggcccaggatgagttgtttcgggtgacagtcacacctgtcctcagaacggtgtcatgtagagataatgcagccaccagcccactaaattacagggcattgacaggattctcattggctcctcctgtctccttgctctaggacatagaaaaactcagtgacatctccactggatatgcacagtatcaccatgtcagcagtaggagcttggcatcgctcgtactgcctgaagagcccgtccacttccgccccatctacaggggagcctcagctgctttttgtattcagctgttttgtattgatgagaaatatgaagcaaggcaagtactgaccttctggctggctgtcacagtgagaatcttttctggcattggtggcccaacattttaactttacagagccagtaatttccaaacctggcccacatcctaatctcctggggaattttttaaaacacaaattcctaagccccatccagagattctagtccatcaaattttaacaaggcctacagaagtgggctagaaatctggcctacctatgtaacaattgggaatctggaaaattatcacttacataaccacatgctgctcccattctgtaaagtttgcatctcttggataatttgaatttgggttactggttgtctagagtctttggttgcaagtaacaggaaatccaaccaaactggctttgaaaaaaaaattgaataattgcctcacataactaaggataactctggtggtgagactgttttaaatatggcttgatctaggatttatttagattaccaaatcaaggaccaagtttctctctctacctcttcaccctgtgtgttagtctgttttcatgctggtgataaagacatactcaagactgggtgatttataaagaaaaagaggtttaatgaactcacagttccacgtggctggggaggcctcacgatcataggggaagatgaaagccatgtcttacatggcggcaggcaaagagacaatgagagccaagtgaaaggggtttccccttataaaaccatgagatttcatgagacttattcaataccacaagaacagtatgggggaaccacccccatgattcagttatctcccacagggtccctcccacaacacgtgggaattatgggagctacaattcaagatgagatttgggtggggacacagccaaaccatatcaccctacttccctgctgttggaccccttctcagaggagtgccccatcctgggcctaagaccactgacattctcaggtctcaggtctgcatcagaatccagtgagaaggacttgccgggatgggcccagctttttccagccaaagtctcatgaggcctgacaggactgtgtgttcattcctgagccaacggctgtgacaagcccatgccacaaggagatggagaagatgggctccatcccttagctcatgctccatgccaaatctgcagctggagtctcagctacatggaatatctgagcaggggataagttgacacccaacagcaatccagggctacagcaaagaggaggcatgcatggtgctgggctttgtctaaagccccggcgcccaccagacctcacagccacccaccctgcccctccagaacacccacatgttcagtgcttgctgttctcctgtggtctggacactggacgctgccctcagtgcctggattccacatctccttagcacccacccctcatctgttcacagaaccatctcgaagaggaaataattggcccattttgatggagtggaaggctctagggtgtcttttagatgagcaagaatagctggacagttcctcttcagaggatctgtttaaacatgttcccagtctcccagcatcccctgttgtactttaacttttttcatctcgagtttttagcttctatggagatctgggacattgaaaagaaattctttttattctaattatgttgtagacatataaaaccttgtaaagcctttctatatttgttgctttatatttcttttatctgtacatttaaatatgattgtgcttagagtatactttttgaattttgaaacaggaatttgatgacccagtgtggtttgcctatgaatgtacatctacagctagtcagaaaatcttcaacagataaaagggaaacagatcagaagcaacctataatatttcccacctctcctcttaactcttccaaaacagaagggaaggatcggaggcacagaatgaccaattttgtgttggcttttcaaatgcacagagattgttaattgatgtgaaagtgccttcagttctgcagaatactttattactgacatacgaagcttgcgacttatgcaccccattagtgttcacctagacacacattctgactagtggttggctaatcgctgcccgaggggagggagctgtaaatctctgtaaacgtccactgatgttgcatttgcttgcagggcactgacagtgcttactgtcttgtttacaggtcgctggattttatgaattttgttttcagtcttttttctgtaagtacatgctgaattttgagaactgattttgtaagcttagagaacttatagaaaagtaaaatgccataaatttattatgctgtgaatgttgaggtttgtgttcggagaataaggtcaaatggcatgtcatgagctcataaaaatacaaaatattgtcattttcaagaatttttaagtcatgctattttagcagttctctttaaatgcaaaatttctgttacacatagctttaccagtgttttatcagaatcaaatcattcatagtaatacatgaaaatgttggaaattaaagtgaatgacactgttattttatagattatgttggctccaagtattctgaaaccatcatattgcttttctgagggtagcaaagtagggacttgttgattttgaggttggcatttctttccctactagttcctcaggcctgacttcatgcctggctggtagagggggctcaacccacattgatgaatgggcctgcaggctaatatccaagtacaaataagattctccatgccagggtgtcccgggcttctgcctacattcttgtctcattattttctagggatgaagatctaaccaaactcttacacttctttattgaaggaaagaaaatgaggaaggaagttttgagggacaaaatgcatttttataaagacaggcctgttaattaagtaaagtcaacaactgtacttctccagttgactgatttcaagaaaagtatctattgctttacttttcctggatactgtttctaatgaggcaaaaacaagtatagtttaattattttgtcttacaactatgtgatgttaggttttatttcctcatttgttattataatgaagctttataataaggcaatatgttctccatcataatttttaaaaattacttattaaggcactttccaaacaatgtagattaccctgaacataggatttacaaagtcggtttccctcaaaaactcctcaaataaatttcactaattttaattattttctactttaacgtccatgtaaacgtaaatatttaacattataaaagtaatgctggctttaaaaaggtaaaagagctgtttacatttcaattctatttgacttcggaacatggacgacaggaaaaaaaataaccttggttgcttcatccttaatccttcaaatccaagatgaagcaactcattatagttagtctctccctcccagaggaagcccacccagacttggcacccagtccttattttcaacttgagtatttcagcaacttgactctcaggttccccaaaaggagtcctactaatttgctaaaaagaaggaaggtaaggtcagacaatggttcactcctttgagttgcacaaatgtccccagggttttggattagcacaagtaatgccttcacagggttcaagaggaggcgagatcccaaagggacaaattagcttcgggaagagcaggctgcttctgcagggacctggcagaggatcaggcagctgcgtgaagctcagatagcctagagcagcactgtccagacatggagtgtgagccacattggtaattctgaatgttccaagagccacaaggaaaaaaaagaaaaaggaacagatgaagtttatatgataatatcttttatttaacttaatatgcccaatcctttttttaaagagatagggtctcactttgttgcatgcaatgtcacaatcatagctcactgctgcctcaaactccttggcccaagggatcttcctgcctcagcctcccaaatagctgggacatgccaccatgcccagctaattaaaaaaaaaattgtagaaatggggtcttgtcatcttgcccaggctgggctcgaactcctgggctcaagtgatcctcccatctcggcctcccaaagtactgggattacagaagtgagaactgtgcctgggcaaatttaatcatttcaacatataatcaatatgaaaacttattaatgagctatttacaatctttttctcgtactgagtctttgaaatctaatatatatttcacatttatagtacatcacaatacaagtactaaattttcatcagaaatagttcatctgtatttgtatgttataaaatttacagttggatacgtagattcacataatccaagcacacataaaacttttccagtaatggaattaagtatccatttttttaatttaaatgaatttaaatgaaataaaatttaaaatttagttcctccgccaatactagccacatttcattgtctactgtactgacagggcaggcctagaatagaatgaatggcagccctcaggacatgcaagacctcttatgtctgctaactaaacccactgcctgggtttaatcatgctcatggatctgttcacccaactgggatcacgtcatgataaaatacgtacacattggtttatggataatcacagaattttagagccaaaaaatgcctgaagtatcatcctcccatctcgcaagaggaagggaccactggtgtaaggtcacttagtaagcaaggggcctttgctaggacaccatgctacctcattgacttggtgacacaagtgaacttacctgtatgaattgtcttggtttaaaaactacttccacagaagagttatgctgaatgactgccattgtttataagattcatttattcaggtttcagtgagaaacaaagataccttttccctgctcttgtagttgcttatttcctgaattttatgtgattattttccaaattataggaaaggtaatttgaatatcctctccttaatcaacacattttgcttctatttttcttggtgttttttagaggaatttgttttttgattaattttttttattctttctctgtgtcctggtttttgatgatgttaggataagaacttctgtgtaatttctctgccccatctcacccccgagttcttcctcatccagaacttcgtgaaaatggtccctttcaacacctgcaccctcgagcaggacctctacgtcttccaccgggctggattgctcaagtgagtagacacatgtttggccacacaacaatccatgaaattacagaagagaagggaacaaggaactccctgctattataatttaataatttattttaaatatcatcttttattagaagaggtcttgagtaagtgattttaactaatacatttagagaaagaatggcacttgagaagagatttgtcctgtcagatattaaaacataatatagctccacaataatcaagacaatgccatgttgacagattctgtaggcagaacaatgtaacacaagaaacagatccagtatagtaggaactcagattgtgcagatctttgtatgtgagtgtgtgtatataatacattcacgacaaagtgtgtgtcacaacagtgggaaaaggaaggattcttctgtaaatcatgagacaaaatggaggtagaaactttttttatactctatcataaaatagattctcaggtgattaaagagttaaatgtaagtattgaaaacataaaaattagaaaatatatttacagtgctaagttctgtgccaagttctgggaacacaatggtgaacaacatgtagacatggtccctgccttttcaaggcttatggacacacagagtgtaaaactgcaactgtgatgggagtaaccagtcctgggcatgtggtactgagcatggaacattgggagagttggcccagccagaggaagctttcttgagaaagtaatacggagtgctggatgaggaaagtgagtgaagattgacctttatcctgtctcagaatgggaaagttctttttaaaacatgaaagaaaaagattaaggtgtcttatactataccaagttttttgaaccacctgattttattaaaatgtaactgaccaacagaaggatgttttaaacaaatatggcagacaaaaggtggatgtatttaatatataaagagctttaatgaatcaataaaaaaaatcacttaatacctaaatagaaaaattaataaaaggcatgaccagactgtttctacaggaaaaaacaaaaaacaaaaatcagtgtatatttaataccttctatcttatttttacaaaatgttctgaggctcatcaaactgcacccttgaaatgagtgcatttcattgtatgtaaattagacctcaataaagttgatgcacaatcttctgatgaaaagtttggtggaggagtgtcagagagctcactctataattgctgtgttaaccttttgagtgaaactttgagaaacatcctagatgttcacttcataattagggactggttaaatgaattttagcaaatgaatttagtacattatgatgacgacttgaagaaataaaaccagatttctatatcctatgtggaaagatagctaggatggtgagaaaagcagtcaaacaataatagtacaagtactaatagtaaggataattaacatttattgagggtttatagtgtgccaggcgctttcttaataatcactttccatgtgtcaacactcacagtgacctaattagttaggtatcattattatcctcatttcacaggtaagaaaactgagacacagagaggttgagtaactagtccacagtccacacagcagaaagtggcagaactgaaatcggaacccaggctgttagcttacagagccaactcatgaccaccccacatattgtttctcgacatggtgtggtcagtgtaatcccatttgattgttgtgaagtgttcacaggtagcagtcagcactaatactaaactgttgtatcagagtgacccctaaacacaactgccttgagccagttctgtctctgtcctgcagtagtccagacaagagcacgtggtctaaggagaataccagctttttctccatgaagttgtccaggaaccgaagttccttctcttattgcccctccattccatagagcaagggttacctaacatatccagagagaagcatgaggtgtgtgaatttggatggaaaggaaagctacatctttattccactaacctgtaagtgaagtttaatgtgtccttccattgtgactggagctagcaggtctcatagtgttagcagaaaccatgacttcatagccagtagaaatgacagatattttcgttcatgtttttgttgttgccgatgtctcaaaaatatcacataatatttaccctactttgaaatttcagtaattttattcttgaccataatttattatgtaatgcattaacaaagaggcacaggcattactgtaacacatttttaaaaacattttgctaactgtgtttcaatataatttataatcctttgtgttttatttaatgaatgtagaaacatttgtctgggaaggagttcatagcatcaccagagtgtcaaagggctctgtggcatgcaagagtttcagacccacggccagagtggacttttcttccttgtgctcagagctagctcggagcaccgtagccacattgcagcccacagggaagggtggaatgagaaatggaagaggggaagcactttcctcttaggggacatgaatcacctctgttcatattatgtgatcaggaacttggttgcatggccctacttagctgcaagggagcctggaagatatgttgctggtaggttgggcatgtgtccagtaaaaaactcagttgattccttaattaaaaagaagaggaaaaaggatactatgggaacattatatctagtttttatcttgtgtatgtatagaagttctaaaaagttacacaggatttcagtaaccttatatgcctctgggaaacaggactgggaattgtaggtgaagatggtgactgactttgcattatgtctatctgttatgtttgatttttttgttttaattaataaacttttttttttt

SEQ ID NO: 389 - DNA, 308190 bp, Homo sapiens
caccgtttccatggtgaccaggctgcgcgtcctccttgcggcagcgcgtggagtgcggcgtcctggagctgcggatgaggtgggtaacgccgtgctgactagcagcgacgcaaggactgcggtgcagggcgtccagggcgcatccccaggtcagcctccggaactgggatgaccaggcgaggacgagtggctctgtcgagccgtggcgccctgcaagggagtaagaacggagctccaatctggatgctcgagggcgggggaagaagggagagcgaggaaactaccattcccagcatgcgacggggcgagctgccgcccttttaggctgcaatgcctcgagcattgcattctagtagtctctgggtccacgccccctcgtttctggtttcgggacagttgtgcccaaataattctaaggtgcccaaataattaactctaaggcttggaattaaaaataacagaaggtactttgaagccagatattaggaaaaaatataaatagagtaactggaaaacaactcagtcttgtgataagaaacatgtttaaattctgtgtgtgccttaattactctagttaaattttcttagcctcaatgtcctcaactataaaacaaggctaataacatctgtttcactaggattaaagacaaatgctcagtagatgttagctgttataatacttaacctgccctcaaaaactgaaaagcaaaggttaagagaattttttttaatagacatttttagagaagttttaggttcacaacaaaattaagtggaagacacagagatttcctccctccacagcttcctgctatcaattattgtacctcttccctcctctaacagcctccaactcttaaaaatatcctccaccagagcagtacatttgttacaatcttgaacctacattgacacatcattatcacccaaagttcatagtttatattagggttcactcttggtgtacattctatgaggttggacaaatgtataatgacatgacttggcagctcatttgttaggataatttccacagttgcaaagctcttttggtgtttggggaaaatatatatttatgtatgtagtaatatcacgtctaccaatgcagatattactttcaacaaaagatttatgcagatttctagaactgcagtcagttataaccaacatcaatgtatttgccataactctttattaaccatattatttagatattttatctcacttttcaaaatttaaatagagaagattttatatcactttcataaagccacctaacaaaataaataaatattaaaaagatgtttctttgaagtgattttccttaaatgtgttactgtaaacaattgatttaccaaatgaatcattggtttaatcatctgttgcctttgctcaaaagtacaaacatgctagaatactttgcttctgatcaccatccttctctcttacatttctgttgtctggcaattcagttcatctctgtgtgtgttttttttgtttgtttttttttttttttttttttaggaaaaatgtattatccttcttactttttgccatcaatgcttttgtagatataccttcatgtttaccttcttatttcccagcatttaatcttgtattccacttctttctgattttattcttctcagaatataccatctcctagttctttctacaagattctttgaattctttcagtctttgtatgaaattgtctttattttatcttcattttaaagtgattgtttaggtttatcagtctaggttaatggttattttttccttttatatttttaaaacactattctagtagttagaaaactatgggccgtagactaaattcagcccattgactattttgtatggactgtgaatgagctagggatatatatatatatatatacacacacacatacatacacatatacacacacacattttacattaaactttatatgtagtttacattttaaacattttttaaaaattacatggcacatgaaaattatacataagtcaactttcagtgtatgtaagtaaaattttgtgggaatacattcatgctcatttgtgccgatattgtctctggttgttactgtgctacaatggcagagttgactagttgtgtagacaacatgtggctcataaagcttaatgtatttattctctggccttttacagaagtttgctaacccccgtgctactggcttctaatgttgctcatgagaaatattctgtcagtctaattattttttatagacagtctgtcttttgtcaggttcctttaaagttttctgtttgtctttagggttttgtagttttactatatatttggagtttatttgtattttttgctctgaactgaaggttcatgtctttcatccatgctaaaagtaattagccattattttcaaatgtttcatttattccttttggaattcccataagacagatgtttttcattctgtcttacatgtgtctttactgaattctgtattttctgtttctatgtgcttctttctagataatttgttcataagtatcttccagtttattttctttattcttctgtttttaacccatcctcttagtttaaattttaataaccacgtatttcattttttaagtttctgttcttttttaaataatgacctgttctcttctcatgacttttgtttctctttctatatttctttattataaacatacttagtttgtagtctgtttcagagtctatcatctaaagttcttggtgactcccataatacacagattgtgtggactagaatgccatacccactttagtctagaatttggacttctcagcagtatttttgctttattttctacctagagctttgtgtagagaaagcttgtcactttcttgggctggtgagtttaatttttctagccccctcacttaccgaggggcccatccaaagtcccaggtagatgcatggtttaatttttaattctctgtttggagtgaggtccattctatccccaaaacctgtgtcagatcggctcacatcattgccacctggttggagaatttccctcgctcgctttctttcttcttttcttgttttctttttaccaaagtcagttatctaattaattatacttccttattttattcagaatttttatatacttgtagcattagtttatgatatgtttcacaaacaagatgtctcattccaattttgctttcaatttaaaaccagaacaaggaatgacaatatttatggttagcttcgataggagtctagacattattaatttctccttcattgttttccctgttttgagctcactggctagtatataataaaatggctttccctatgaaggaaagaagggagggaaagagagaagagagacttacagaaattgagacaatgagagagaaattgaaatcattttgtgacctactgtttttgtcaacagcatttcccaaagtgtccttctggaacgttaggttctccactgttgccgtcattagagattctcttcccaaagagtgtcggaaaggctgggttatacaaagaaaacaagttgctttattatggaacctctcaaagatgttaatgggcctggtggcccttcaggaagcctattgcgagcatttcctacacttaaccacagaacttttttggtctcaaaatatgtctcaagactgctgaccttcagggctccagtttggagaactctattaagaacataggcagcagctgtcagtatttccccagtaactcttcaccacatgccatcgtggccgattaaatataagaggaccctgaatccgtaaataattcctttcaatgtttttccaattctattgttagaattttttaaagcagctttgttggaaacaaagaatatagttgcagaaacttctaaacaggccagttctcagaaacttcattctcctatggaggaacgtcagctggtttgcagtgacagttgtcacagactacacccaggggaaaacgtgtcacaccagtattctcacaccatgttcactctgaccacatggaaattgaattagtgttcagttttgtgtgtattataaccaaactggcttatcatatcagattaatagtggacttttttctctcttttggggacaggataaaaaatgtcagtactcacttctccaagaggaaaggtagaagttgttcattgccgaagaacagaatcacaggatgtttattgtatcaaaagccttattagaaaatttacctgcaagctgtttgggaagctaaatatcatctatcttctgtaagtagataactaagttcaagaatgttcatcaattttggttgggtgcagtagctcacacctgtaatctcagcactttgagaggccaaggcaggcagatcacctgaggccaggagttcaagaccagcctggccgacatggcaaaacctcatctctactaaaaatacaataatcagctgggcgtggtggcgcatgcctgtaatcccagctgctcgggaggctgaggcatgagaatcgcttgaacacaagaggcagaggctgcagtgagccaagacacgccactgcactccagcctggatgacagagcggacccctgtctcaattaaaaaaaaaaaaaaaaaaaaagaaggttcctcaattttatgacatgccagaaaaggatcctacctttttgtctttatggggcttattgtgagcaaatgggtagcttactgcacagtgaaaaaattgtagcaagaaatctctgggaacaacaaattcctatttcctataataatatgcaaatcaaaaaggtttctcatgggctttggattcaaacaaacttggttcaaatctcagctgcctcactcactagtggagtcacttaaaacaagttaataatattagctgccagattttgagaaattagtttatgtcaggctctgtgctatgccaacattatgttattgttctgatacttctctgaggtggccactatcatgtccatctcacagatgagaatgggaggctggcgcagggtcaaacagtacgttggaaacctggatttgttcacagccgctgctgttaaagtgttcttctgaactttaaagtatgcatagatttgtttcttaaaagatcttttttctctctgttttgtttgtttatagaccttctgtgggtgccaaaatataaatatccttgaatctgttcttcattatttaattaatttatttatttttgagacagaggtttgctctattgcccagatctggggtgcagtggtgcgatctcggctcactgcaatctccgcctcctgggttcaagagattctcctgcctcagcctccagagtagctgggactacaggtgcatgccaccatgcctagctgtttttgtttgtttgtttgttttttagtagagactaggtttcatcatgttggccaggctggtctcgaactcctggcctcaagtgatctgcctgccttggcctcccaaagtctttggattacaggcataagctactgtgctcgaccctgttccgcattatttttattgaaaatattaaatatcctagtattttggatttcataaagcttcatatcaaatacaattgaaatgtttaagctaaggccagcctaagacattaaagtttgtagtttctaattacccccctgatgaatgtaatataaattggcacaattttactagagggcagtagggcaatagttataaaatgcctaaaaaatagatataccaatgaaatgattttattttttggcattatggtggactcagtaccttaaagatgtccattggatggaaacaactaaaatactgatacacacaaaagctaaggactgtgtagggaacattatcaaattgaaatcagaaacttcattagataaacaggaaccaatgctagcttcatccttgaggatttttgccacattctattaatagcaacttcatatttctgttttgacagctttgcaaagaatggaagataactactccctccacctaaggaggaaagcatgtgacccctttgtataaaattgggatgttcattgtagggatgaacaagatataaacccactaaataaaaatggacagtgagggctcactcagccttagcatggaatagagggggataaagtctcttctgagaattcataagcacacactgatttgagatccatgttaattatttatgtggtccaaaaaatgttgaagtaaagaatttaattaaaaatagtcacaggccagtagtgtgtccaggaaactggctgacataaatgcaaatcaagtgtgaagggatgcagcttcagctcagactccaaataataaccccagataaagttgcaaggtatatgagctcacagtcaaaaatcgtaaacacacaaggaaacatgtatcattagaatcaacaagagaaattatataggataatcaactcccaaagacttcagatataaaattaaacaatgaatataaaataactatgtttactatgtctaaaataaaaaaggtaggtttaaaaagatgattaaagaaggccggacacagtggctcatgcctgtaatcccagcactttgggaggccgaggcaggaggatcacgaggtcaagagattaagaccatcctggccaacaggtgaaaccccatctctactaaaaatacaaaaattgactgaatgtggtagcgcgcactctgtagtcccactactcgggaggctgaggcaggagaatcgcttgaacccaggaggcggaggttgcaatgagccaagattgcactactgcacactccagcctggtgacagagagactctgtctcaaaaaaaaaaaaaaaaaaaaaaaaaaggattaaagactaaaaaaatctgggatgctgaggtgggcagatcatccgaggtcaggagtttgagaccaacctggcctatatggcaaaaccccatctctaccaaaaatacaaaaaattagccaggagtggtggcacacacatgtagtcccagctactcaggaggctgaggcaggagaatcgcttgaacctgggaggtggaggttgcagtgagccgagatcgcaccactgcgctccagcctgggtgacacagtgagactccatctaaaaaataaaataaaataaaaaataaaaaattataaaaatgaataatcatgtttaaacaaaagtgaaatagaccatctagaacttaaaatgtaattgaaattaaaagctctgtagatgaattaaacatccttcatagacacagttgaagacagaagtaatgagctggaggatcaataccagtaaattacccagagctcaacacaaagagaaaaaatatgaatgaagcatgagacctagtctagttagacttttagaagaagataataggaagccaaagggtaatatttgaagagagaatggctgagagtttttcagaattgttggaaagcactacttcttacatctggaaaactcagtggatcccaaaggggataaatacacagagaaatcccaactgtacccatcataatgaaacagcaaaacactccagttaaaaagatctgaaaaataacagagggggaaaaaaaaaaaaccaagttacctgcaaagaactaaagattagactaatagatttcttaggagccacaatagtagtcagaagatagtagaatatcttcaatagtggagagaaaaataacatcaatttagaattgtgacattgtttcacccagtgaaacaattcctaggggacctgggagaaaataaatgcattttctgacaaacaaaaacctaagtcatttgccaataaactctgaatggaggaaattcctcagaatatgtttttggaggaacagagaatacctcagctggaaagctcaaaacacaagaaggaatgtcaacaaaaatatggaaaatatataggtaaatctaagaaaaagtatgacttgcataaaacaataatattgataatgactgatttgtgaggtataaaccatatgttaaaactaagattcaggacaaaaacattatataaattgggaggagcatgattagaatgaaagaatccttcaggttttatttaagatggagggtgtggtaagtggtgtgcaaacaggctcccctggctccaatgagccacacatcctgtcacttacgcctttgtgtagtctgttctcacaaagaatcatggctcgccttatgcagccaatggaaagcagcagaagtgagactctatttgacttcaagtctaagtcataagaagtcttgcaacttccactgggtctccggaagtgctccttctcagaacccagtgccacactgatgaaagctccagtcacatgtttccctgtgggtgcttcatttgacagcctctgctgagctccccgctagcaactgccaccagctgccaaccatgcaagtaagccgtcttagacactgagtcttcagatggctttagccactgctgccatttgatagcctgagataccgtgcaaaaactgcttagttcaacccaggcagcccacagaaccatgagagataataattgctacttaaagccactgaggtttggggtggtttattacacatcagttgataactggaacagataataaagactgttaggaatatatattaacatggttaagatcatcattaaaagaacaggtgtagagatgataacttctgatctatagagggaaaaatggaatgagaaatttaaaatgaaccctgaatctaaaagaggacaagacaggaggaggaaaaaagaaacaaaaagcatagaatgtattaaaattacagaataagaaaataaattttactatatcagcaatcataataaatgcatctggacaaaaatcttccattaaaagattaagaatggcagattggctcaaaacaaaacagtcatattctatttgtgagacatacctcatatataaagtcacagaaatatttaaagtcaaagtatcaggaaaaaagatatgccacccaaaatctcacccaaaataagggctagtattgctatatcaacagcagacagtgtatagttcaggacaaaaagctccctacagataaagagggtcactatataatgataaaactgttgttgggagagctatgacagctttaaacttatatgcttctaacaacacagttctaaaatagataaaagtgaaaatcacaggtagagcactggagactctcccgcctccctgtgttccccatgcctttttgtgccattctccctgctgtagtccccatgttttctatctttgttgagcctgtgattcccctgacagaatgtaatggaagtggggctgtcctggtcccaggcccaagcgttaagatggcctggcagcagggctggcccaggagaggcacgcagggtatcctgggtactcactcccagctagggcccctgcatgaacctgagagtgaacacctccttccatttttgaaccctgggtccctctggcctcaccctagttcgagcctttgctgggagctttcagttttgtgatcttgggagccttgcactaccatgtaaaaagtctggctactctactggacataccacccagagaggccatatcgtaagagagaagtgtgtgcctacatggaggagaattgaggagcccagcctccagcaagaaggaaggccccatgtcactcttccaggcacaccccagcccctttgggccaccctcactgaggcacaagacacatgagggaaaaaaaccgtcttggaggttcttgccccaacagatacccctactgtaccctgtctgaatctctcacccatagaatcatgagcaaataaaacagagtagccactaaatttgggataatctgttatgcagaaatagttgaacaaaatagcaggtcttagagggaacttataaccttaaatgcttataacagaagagaagaaaggcctgaaataaagttcagagtttacctctaagagcaagaacagtcgaatcaactcaaggaaaacagaaaataaaggacaagagcgcatattaatgaaacaggaaacaagcatctggtagaggataaacaaagccaaaagtttgttctttaaaaagcctaaagaaaaaaaaaatctgacaagattaatcaggaaaaaaagaaaaactttcaaagtaatgtgaaaaggacataatcacaaatgttgctgaggttaagcaggtaataaaagggcattatagatccacaatcctttaactaaatccctcgtgactagttgtgtttcagaaagcagaatttaaaaaattagtttcttccattgatgaaatattattgaattccacccacaagggctggagagattttccataattacacacgttaggatatctgtggtaaaaatgtaagaatattttatatatgggatcaagactgtagagtaacctcctgtcacttcaagtccaattttgctgcttccagtttttagggctttatggatttaaagggattggggacctgtataaaaaaactgcatgccaataaatttgaaaatatggggtcccagaaaagtttcttaaaatcaacttaagaaatgatagaaacccattaaattgaatcgttagttttaaatcctcccgccaataaaatggtcggcacaagtgcctttataagcagtcctaccaaagattcagggattgggtatgtcccaaataaatacaagttcttggaagcagaaagatggagaatactttttagctcactttatgaggctagcataatgttgatatcaaaataagacaaagacagtacaagaaaggaaagttaacggccaatctcacatagaaagagaaatgaaattaatgttcatgccttgctcatgaacatggatgtaaaaattcaaaaaaaaattggaaaggaatctaatgatgaactaaaaagatatgattatgattaactgatcatggtattcatgattggcttaatactagaaaattgattagtctaattcatcaaattaacaaaggagaaaatctaataatctcaataaacagagacaaaatcattcgataaaatgcaatattcttagtaataattcttaacctaataagaatataagatgactctcatatgtatacaaacctttaacaaacaccatatgtaatgataaaatattaaaagaatccctgtatagtaaatgaggatgcctgttgtcatgagatcctagctattgcagtaagggaaagaaaaagcaataaaatgtactaggatttgaaaggaagaaacgaaattgtcattttttgcaggtaatatattctctacttagcaaatggaaaggaatgtgaattagaatgaatatagaagttcaaaattgctggctatgaagtcattgaataaaaacccattgcatttttatatactaacaatgaacagaaaacatttttctatttacacccatgccaaagaatataaagtacctagtataaaactgacaaaataactctaagctcattatggggtaaattgtcaactattgaaagacattaaggaaagcctaaatagagtaaccgccccccaccccgccttatctgaggggaatatattccaagacccccagtggatgtctgaaactgaggatggtaccacatccgattgttatcagtcagaacacatttttgttcatgccttccacccacaaatgtaacggcttttccatcgtaactaagcatttgctatgcactgtgaccataacttttgtagtttgaagtgcgacaggagaactaacaggaatttctttttccattttcacaatttcacggattaaagatttcttcttaccctagatcttagcaagctcagcatacaatttattttttcctcattaagttgagaattttcacctttttgtgtaaaggaagccttttacggcttcttttcagcatgtctgaattaccagcgtcactactcttgcactttgaaccaaagcactgtgatgcagtgacagtcgatctggtaacagaaggcagttaccagatctaatactaagtgactcatgggcagcagcatctacagtgtggatctgctggacagttcctgggcaggacgggctgggatggcacgtaatttcatcttgctactcagaatggcatgcaattataaatttatagattgtttatttctggaattttccatttagtattttctaactgctgttgactgcaattaactatgaaactgtgggccatgaaaccacggagaagtggggggactacggtatttcccaagaggtagaccacattttggacaggaagattcaaatcataaagttagtttctctccacccccgtcaaaatcctaacaagattatttgtcaagcttaatgagtctaaatttgtgtgggaaagcaaaggttcagggtaatctgaaggaagaaaaataaggtggagaggcttgccaactaaaggttcattgtaggtataataatcagggcagtgtggtaatttgcagggaattttgacaaaagacagatggaccaggatagagatcccagaaacagacgcatactatatgaaaatttgatgacggctttgtgaggaaaggatgtgccactcaataaatggtgctgggagtgttcgttattcacatgggaaagaaaataataaccaacctcatgtagtagaaaacttgtaaaaattaattctgggtgaatttatggtataaatgtgaaaaacatctgacatcgatgacagaaccttctggattccaaattcatttatccagcttcctggtgaatgccaacccttggatacctagtaggcacttggaacctagcatgatcttcacctgcattcaatccactcttcccacacttttcctatctcagtaattccagccttccccttgctcagaccccaaacatttaaaaaaaaaaaagttaaaatggaatctttataactgaaaaggttgcaacctatcttagaagccagcgtattttcagaagtaaaagcaaatttaaattttcattgatgtcctgaagcttccaaaacagctgctactaagcccacacagtgtttcattttttatattaggcaactcctgtcccctggccaagtcaactgcaaggcttaatgacttattttatagacattttgaaaaaaaaaaaaaaggtggttcttttgtggtctgtgtgtttggttttattttattgactgcctgttcagttacagaaatagaggaatgaataaaactgatctcacctaaaaatccagctaaattttagcagattgggcatggccgatgagtggggaaagggctgaaagaatcacctgcgtccagtgcaaatagcacagtggcgatcggggggacagaactgtgcccaggctgcagtttgtgagcaatggatgtgaggaaactctgaggtttctgggtgatggtgttgttaaatcaagcagaaaaagcgagtgctgtttctctatgatggaaatcttagaaaatcttttgtacaaagaacttaaacaaatttacaagaaaaaaaacaaccccatcaaaaagtgggcaaacagacacttctcaaaagaagacatttatgcagccaacagacatatgaaaaaatgctcatcatcactggtcattagagaaatgcaaatcaaaaccacaatgagataccatctcatgtcagtcagaatggcgatcattaaaaagtcaggaaacaacagatgctggagaggatgtggagaaataggaatgcttttacactgttggtgggactgtaaattagttcaaccattgtggaagacagtgtggtgattcctcaaggatctagaactagaaataccacttgacccagcaatcccattactgggtatatacccaaaggattataaatcattctactataaagacacatgcacacgtatgcttattgcagcaccattcacaatagcaaagacttggaaccaacccaaatgtccatcaataatagactggataaagaaaatgtggcacatatacaccatggaatactgtgcagccataaaaaaggatgagttcatgtcctttgcagggacatggatgacgctggaaaccatcattctcagcaaactatcacaagaacagaaaaccaaacaccacatgttctcactcataagtgggagttgtacaatgagaacacatggacacagggaggggaacatcacgcaccagggcctgtcggggtgggggctaggggagggataacattaggagaaatacctaatgtagatgacgggttgatgggtgcagcaaaccacaatggcacgtgtatatgtaacaaacctgtatgttctgcacatgtatcccagaacttaaagtgtaataaaaaataaaataaaataaaagttccagagcaggaaaactaatatgatttgatagtaacaagtccacattattttatgggttgtttactgggtgataaattaggaaactttttgtgatgatgtaaacattgacttctgtgtggagggggcggatgtgatacaaaggtgtatttattttctaaaattagttaaatgatacccacaaaatcatttcactgcatgtaaattataccacattaaaatattataaaaagttttataacatctgactcttaaaaaaaaaaaagaaaataagttttggctatactcggaaaatttcctgaagcagttgaataaatgaggcattgctctaatgaaaagagctctgatttggtgtgacatacgtgtgtatgtgtgtgtgtgttaatagggctccttcagtttggatttggcttattacaaagaacagtttaaaatccaacatttaaaaatatgccttctcagccgggcgtggtagctcacgcctgtaatcccagcagtttgggaggttgaggtgggtggatcacgaggtcaagagatccagaccacagagcgagactccgtctcaaaaaataaaaaaactaaaaaaagtaaaagagatcgagaccatcctggccaacatggtgaaaccttgtctctactaaaaatacaaaaattagctggacgttgtggcaggcatctgtagtcgcagctactcgggaggctgaggcaggagaatcacttgaaccctggatggggaggttgcagtgagctgagatcgcgccactgcactccaggctgggtgacacagcgagactccatctcaaaatatatatatatatatataatatatatatttatattatatataatttttttatatattcatattttatatataatatatattcatattattttatatataatatatatttatattattatatatgtatttattatatatatatatatacctaccttctccctctaccttttcctcctcttctttccctttgttcccatggtgatttttatctgtgctatgggggacctagtgactaaggggtaataagaagtgaaaattatatacataaaaggataatgctacaaaagttactttttacagtcagctatttgtaaactgtagtgcattttcccattgaaacaaagtaattcatggctggcttcccaggccaacccacaaaagcatactgaatctttaatgtctatgtggtatatagtattgtgctaattgtactgtaagacccaaccagcatcctgaggttcccatggataaatgcatttcgttagaattggattccaggaacacattgttctttgcttccctgaggggatggtggctgcgctgtcccaaattcttgcccacttcctcctccctaccatcaccactatcgtcagagctgacatgtacagcgtcttgtgcattttctcatctggtttagagggagcactctcagcttgagaccataggtcatgactctgggagtctggggcagaggagcccagaagaccaagagctggagggagatgacttacaggtagacggaagttaagggttcagtgagaagttgtggggctgcatccctgtgctaaagagccctgtgtggatactgtattctaggaacctgggacagtctactccctcctttccttgatagccagtgctcgtatggggcccctggaccaggagcagccctgcttcattcccctgtggctgaggagtgtgatcatatgtggctgctgtgacttcctttgagaagggacagtggctgcaggcactgagattgatatccccagcacaatgtttcccaaagacgcccgtacatccggtggtacccagggggatttcacttgctacatgcaggaaaaattttttgttttaaatgttacatctttatagttaccttcctttttatttcttttgagacggagtcttgctttgttgccaggctgcagtgcagtggtgccatcttggctcgctgcaacctctgcctcccaggttcaagccattctcctgcctcagcctcccaagtagctggaactacaggcatgtgccatcacgcccagctgatgtttgtatttttagtagaaacagggtttcaccatgttggccagaatggtctcgaactcttgaccttgtgatccgcctgccttggccttccaaagtgctgggattacaggcgtgagccaccgcgcccggcctttaccttctatatataccgagagatactggttttccatttatggtagtgatgtatatttcctattaaaattttaagcccaaagtaaattgatttaaagaaaaaaagtacaggaagcgcatgtgtgtgagagactgctgtttggtgaactgctcttgtaaaaggttacactgtcaagtgggaaaaagcaggctacaaatagtataggttgtgagattccatttttattttattgttatttattattattatgttttgagatggattctcgctctgttgtccaggctggagtacagtggtgcgatctcggctcactgcagcctctggctgctgggttcaagtgattctctgcctcagcctcccgagtagctgggattacaggcatgtaccaccacacccggctaatttttatatttttagtcaagatgggttttcaccatgttggccaggctgtctcaaactcctggcctcaagtaatctgtccaccttggcctcccaaaatgtgggattacaggtgtgagccaccgttcccggccagattctagttttaaaaacacacgatgtacatttcaacgtatagttacctcacgaaaagataagtctggagagacagaaaccaaagtgttgacagtggttggttatcaatggaaggtgggattaaaagtgattttccaaattatttattttttctcttcttgcttagattttctcgttcttgtctgcactgacagtgtattccttctgtgataaaaacataactggaaagcccatgtcactttctgtcctcctgtcatctcctctccgcctcttcctccagttacatgcttgcttcttcctgttctcctcaagaaggaacatgggtaactgctgccttctttgtgttttgagtgaatgtttaactatttcttcctccaacttaagatgccagtagatttcatttcactaagaaagtaaaaaatgcatttaaatttatgcacaaatggttcttggggtggtaaactatatgctgcctttaagtgcctttaagtcttgctgccttgatgggccacaagacagggtagcagttgggagggattgtcaagatagtccctctgagacaaccaccagaataagactggaaagcctgcttctcctctcttcgctttattaactcactgggttaccttagcttaagcaagacccctgggagtccccatttctgcagctgggtcagatgatattccagatgcccagattccatatgaatgaatcagtaagtccagggacatgaactcacagtttggaggaattgcttgagaatggtaactgagatggagctagactgttagctttactgctgttcataggtgacccattcatcctagtttgcccaggactttcatttttttaatgccatgaaagtcctatatcttgggcactcccagtcctgggcaaagagagacacttggccaccctaaccatagatgtttaggccaaacacagtggtactggcaacatggagaggataggggaaactgtgtagtcaaatatcttcctagtcagtctccaagggaaagatagtagatactcaatatcataaatgtaatacctttctaatgaaatgtcattttgaatacaagtttagttgacagcaccacttgtcctgaacgatgtaccccaaagtggctgcaatatcattctcaccttttccaaagattatctgacctcatgcagtggctgctgagctccagtagccagagggaaaaaaatggcatgtcctcacctcactttttgtaatcttattcatgtttgcaattgtaatcatttctgcagagaaaaggccaaccttgctgttaccctctgcaatgacaaggaggagatcatggcccaggccaccttcctggactaccccaactggaatgttgccaagcaggatgactgggtgtcagtgttccgggagctcgacagtgacatcccatgcacagtaagaaatcacatacagtgcttgttagaacaccctgaatcttgaggggaagtcctgtgtttgtgattatgtctttccaagttttgtactgagcagtatatgacatcatgacagttaaaagtgaagggagctggtggggaggaaaagagggctgagagtagtgccaggggggataggaaagggcagggagtagccaagttggctagccgctggcaaggcctggatcgtgcttcactaatgacggcgggggaggaattagtggaagtgtcaaacgtgtgcttccaggtctcacgttgttctccaggcgtcagtgtccaaggtcattgatatgttaggagagcacctgccgtctacacaattgcccttgtaatcatgacagcagagcctcagacttctgtcacattctataattttcaaagtgccctcatggaccttggcttatttgatgtcttctagctgctgacacatgacaacttgtcagccaacagaagctaggttagtggttcccaggagtctggcctgggtacctgatgccaagtctgagctttctctgcatgcaacctgccagagccaggccagagacaggccccagtttttgtggagtgccagaggctacaactctgggcagcaccctggccttgtggtggaattctgcagcatgtccccagagccctgatgtcagaagaaaagggaatgcccaatgagtgtgagtgaattcaccccccgtacatgtgtgtgaatgtgcacacatacacacacccgtaagcatattattcagcatttatttcactagatggtgccttcccctcatcttttgtgttctctcctaccctgccaccctgtatacctaaggactattgtcagaaaaattatcgcaaacttggaaatagaccaaaacgattatttcagtccaatgcttgcacctttggttgagtagcctgttttacaattctgtaggaatggtgattagcctgtagatttttgtccattaggatgtaaagaattcctgtctggatagagctaacctcaaaggttatggtttattgtcttacaggatgtgacctatttggtatctaatctagcaatctttttttttttttttttttttttttttttttttttttttttgagatggagtctcactctgtcgtccaggctggagtacagtggcacgatctcggcttactgcaagctctgcctcccagattcatgccattctcctgcctcagcctcccaagtagctgggactataggcgcctgccaccacgcccggctaatttttttgtatttttagtagagacagggtttcactatgttagccaggatggtctcgatctcctgacctcgtgatccacctgcctcggcctcccaaagtgctgggattacaggtgtgagccactgtgcctggcctaatccagcaatcttattctttccttttcctagtaaatcacctgaagtatccagctcttcaagtgcaaagaatcatttttatcatctcactggttgcctcattaattgatttgttgaagttgaataaacctctgatagatgtttattttatatttgcattagggttatgattttacctttctgaaaattataaattaacactcttattcataaacacatgccccttttgtttcttttcaagctgtcttctatgacagtatagtgctgggctgtccaatgtggtagccaccagccttatgtaactaacgagcgcttgaaatgtagctagtctgaattgaggtgttccataagtataaaatatgccagatttcaaatacttcgtaggaaaaaaagagtgtaaaatatctcattaataatttttataatgattacttgttaaaatgatataatttgaatatattaggttaaatattaacttaaatattaaacattaattcacctgtttatctttattcttttttaatgtgtctactagaaaatttgaaatgacatttgtggcttgcattacttttctgctggatgtaaccagtatagagcctttaaggcttaatgcagtatctatcccagggatatttgcagctgaagtaatgatttttatcttaaagctaaagaataaatcttgcattgtaatatttatgatggaagagagaatttgggagacaaatcaagcaagtaataagccatatgctcctgaggctagtcctattcaggatgtaaggcaaatgctgagtgagattattgtgggattaaatgagtgaatacacagcaagtacttgaaatcatgtcgtcgtcatcgttatctggacttttgggatttgtgttgtttgccttttgggagttttcaagctcatgaatcaaaacatggttttcctcttgcgcttttagtcaccgtacaattctttccgagtgcttctgagtcacacaccatccgacagaagtggggacaaggcacacagaagtgccactggtcccacaaagctgtccagaaaattattcaaaaaacaagaaacctaggcagcacctgtgctgtcctgatataggtaccagcaccaccctcaccagtcagccagtctacatctgcactgtttccagaatttgaagatttgttcataagcacaggggtaccgagttgagtggaccaatgtgtggatgtttgaaccatttactcattatttaggccactttaaaagtctcagaaggaggagacaaagctcttttaaaacttggaagatttaactggaaagtcttgctagaatcttgctactgtgagttttcagctcccaggttttttggatcccaagagtaatatttgattctgactctgggaatgttgaacaaaacaagccaatggattctgaacgtggcatctgccttccatttttcaaattcataagagcatctctccctcctgtcacatgaatagagcagcagctgctgactcaagagcgccgggaaaagggtgattgtctttcacttggcatagacacccctgaggacaagactactgagttaataatcgatttcactcccctgcaggctctcccgcagctcattcgtgagggcaggaggaagggcgggtgctctggactcatttacagtccctgtttccttaaataattgtgagtaaggaggacagaaggcggcaaacggagtcagtgagacagctcaaatgccgcctgggtgttgcatcacttagacataaaatatcaaccctaaatgccaggctgttctgtgtctgtggatgccccgaaaccctctttccaccctgtgctgacctagcccgaatactgactcagcctttaatccgtgttctctcttcttctgcagcccctgaatacgttgttcatgcacctctttgtggccgtggatgagtattctgttggctgttgcaaagagattcttcggtgagtggatatggccgtgcagtggtgaacatgaaagagactgtgtggatagttttgaaatattttttaaaagacatgaaattctttggggtgtttaatttgcttgtaatttgtggctatattaaaatatttactttgaatagcaatgatatttctgaaaggagatagttctttgaatctattgtccattctgcacgctgttatcatttgaggcaaacagatagtgcagtaatttaaagaaatggatttaggttgaggggagtaggagaagaattaagtgtcgcaagcttggacatttctaaaaactgcttttctttatcttatctttagaaatgtttattaacatgacagacttcaaagcatcctgaataataggatgcatggaaaatgaccagcagggctaccgagtcatggcgatgtgtctctgacagcctctgacagcctgcacagacatttgggggtggtggtcacagctttcaagtcactttgtaatgtcacaccagaccgtccagatgccaggtcaaaggttaatattagcagaaatctggtgtgccatatgaacatggcaccctttattctctctgcctccatgggacagatcgaaaaggggccctttagaacccaaggaaaagtagagaagaaaaagaaattgccttgaggctgttcttgccattgcaggtggggagcaaaggagcccatgtggatttaggaacacctcacctttttagtgacagcatttgtcttcatcaagtgccagctgatgggattgctttgttagtaacactgccccaccctctctttcctcaccagaaccgtgtataaggcagtgccagagctgcacttcatatttctcatcgtgccatcctacatgagcctaggtaaggcccgcccaaccacctctggtccccggtagcaaacattgaaaattcactcccagaatggtgctttggggaatgagaaataagagtggtctccaggtcctcaatgtaccatgtgcatattttattagaacaattaagcacaatttagaatggaaactacattttgttctgacatcccaaatttatttcttgataaataaggacatgtttctttatctctgtgatttaggctcaactctcataactgtttttgaccaagtggggaacatcccgtgtctgacgtatgaggaagactttgcagtgcatatatgtcacaggcacagccactatcctcagctgcacgttcgcaaagccaggtacagttggagtcatgccttgtgtgacctaagcttcactgggacagtcatcttcccaagactctttaaactaccaatgctaagtgactatagcttagatcaaaattttttacaatactcataagcattacttcatttggatatctttatagttccccttaatgacattatttgcaggactatctgatgatactcatttggttctatgtggctataacattattcattgactccttaggggtttctgaaaacacacaatcctaggtcccacaccagtaagataactttcaaataaaacaagcttaaaaatgaacctgcctattcagttttctcggtaaaacccacctattttctgacattcagtgaatgaggatgctgttgaccccaaagaggggttttccaaattgaaggtctctaccatcaggtgccccaagtccagcagtcttagggagatggctgtggcagtgttttccaaagatggctgccacactactttccaccccgcaggctactctttgatgtgactttgccactcctctcttcaagccttgggcgctccgtcctctcttcctgaagctgggtgggttgtgactgctttgaccagtagaccgtggccaaagggatgctctgggacttgtgaggctgggaagcttctgcctggctctctcaggatgcttgctctggaggaagccagccatatgtaagaagtctggagaagccacatgttcgcaaggggaggggtggttgacagccccagctgggctcccgctgacagttagcttccactgcctgtggtgtgaatgagccattgtggacacccagcccaggagagccccatatatctacagcacagctgacatctgatcgcagccacatgacagaccccaagtgaggatgcccagctgagccctgccagagttctgactcacaaaaccatgagcaatgtagagtggctgtttggaaataagagtgcattatgaaatcatctcacagaggtggttgcttggcttatcagtgaagaataaattgtatcttttgggatcagccattgctgtgtttgaggaatgctgactttctttagaaaagtattttaaaagttttaaaaactttataaaagtaagagcctatgatttaccaggcatgtagcagtggtatggcatcgttgttaagagtttgtaatgctggcatcggatagatctggattctgatcttggctctcctgctcacgaggtgggttaacttacaaaaggaacgtgacatctgcgggggtgtaagttccctctgtcagtgggtgtaagcgtattgtctacagcacaagattgtgatgattgtgagctaatgaacatcaagcacttagcacacttcctgccacatgtaagggcccaataaatattaaatattattatgacaaaggggcttagagttaagtggtggggagagactcatcttcagttaactgtcatgttggtagctgagaagcgggatgcacagacagagatgaagacagcttcattacaactgctcctccgcccaaaaaaacccctctaaatgtccatccaccagttaatgttgtttacccttataaactgtggtacatccatacagtggatgctactcagcaattcagtggaatgaaccatttacatatagtagcatgaatcaatctcagaaggtttatgctgagtgaaggcagacttagaaaagcatatacagtactgctgattacacttttgtgatatacaaaatgggtgaaaagcatccacagagataggaatcagatagagatagaaaccaagatcatggagatcatgacacaggctggaattctagcagcgacaggtcacagagatccaggttgttgacagcaagagtcagactctgtaaaatgtttgaagaggtttattctgagccaaatacaagtgaccagggctttgacacagccccaggaggtcctgagaacatgtgcctgaagtggttgggctacagcttggttttatacattttagggagatataagacacaaatcaataaatgtaagatgtgcattggttcagtctggaaagacaggacaactcaaagcagagaagagccttccaggtcataggcggattcaaagattttctgattggcagttgattgaaagggtttatctaaagacctggaatcaatatgagggagtgtctgggttaagataggggttgtggagacagaggttcttattgtgcagatgaggcctccaggtagcaggcttcagagagaatagattgtaaatcttttttatcagacttaaaaatatgcctgactcttagttaattctctcttggatcaggaaaaatgcctggaaaggaaggggattcaccacagaatgtagaattttctccgaagagacagttttgcagggtcatttcaaagtatgtcaaagaaatatattttggggtaaaaaacttcagtttatttcagggcctgccctgctgtcatgtttgtatcttattcctacaaagagtctgttctgtcattcttaagatctctgttttcatgttaatcctggtcaaatgttcctaaattccaaagggaaagtataatgaggcatgaccgaccacccaatcccatcatgcgctgaactggtatttcaggtttatgttagaatacccttggctgagaggaggagtccattccattggtttgggggagcttagaattttatttttggttacgtggtagggaaaggatcaggtcaggtgcatagatacagagagacatgttagagagtagcgcttggctaccagttggatggaggagttgagggatgaggagtttatggtaattcagggttttcaagtttaggggaaatggtgctttcattaactgaaagtagaaataatagatttaaatggacaggagaaggtaggaaatagaaacagagggagaagccaggtttgagatacacatttgtgagttgtcagtttgtcagtaagtggggagatcatgaaatgaaggagattgtcttgctgagggggagattgcacagtgaaaaagcacaggaccagggcagaactttgaaagatgaaaatgagctatgaataatgaaaactagaagagagggagaggaatacagaagaaattaagactcataaagtggcaaaagatgcagggaaatgaaattatttaagtaaaagagaagccattagatttggcaatttaaaaaggcacagataggatgaataaaactgatacttccagccaaactgaccaagaaaaaagacaaattgccagtatcaggaatgaaagaggtggtatcacttacagatcctacaggcattgaaagattaatatggggacattacagataactcaatgtcgataaatctaacaatttagataaaaatgggccaactactttaggaacacaaattaccaaaactcatttaagaaaaaataggtaacttggatgcttccgtatctattaaagaaaaatcagatgaactttgggtgagaggaagggggccctcctgcccagacattggcctctccccaacccacagcctgatttgctctttttctcctctttttctcttgttctcatgactctgaactctgccttcctcaggacctagtcctcagttttctctcaagctcatccctttgactcctctgtgccaaccttgccactcagtaaccagtgccctacttctgaactcttggtttggggtgtggtcttgtcactccttgaagggcagagtttcacaggagaggccaaattgcagtgagcggaataaatgggaggtaaggaaatgaaagcaaaggagtagtcagtgctattttttttttcctttttgctggagaaagtcactgctcttcagagaagttttgtgttgaagggaagcagagagagggaggccagaaacctacctgcagatgctgaacattatgcaaacagtgtaatgtgatcccgtttttcctatccacgtggagcattttatttgcattctgagagcggggcagcatgtctcttaacgaagttcaccaagaagcagatgaacttcagatacatattatctacctaatttagtttgagagaagaaaattcctcatataaaatgatctttcattactttctttttattaatagctaaataatcctctctttataaaaccctttgataatgatacaaatactaatgcaagccaaaggcagtctgaagaaatggaattttgtgtatgaaatgacatttttaattggttctctcatgtctttcaaatttttattcctgatttataaagtgtctcttgttagtgtcaggggaggcaaatagaccctcctgtccttcaggaaattatattttttaaagaaatattaccttcagtttttaaattacaagaatctccacaaattaattacttaggatcttgtaagtagtgtaacaattgttacacttttatattcattttaaaatctctcattttttatgccatttactaattttttggggagatgggtttatttaataaaatgaattctagtttcaaatcataaaacttaaaagtaaaagttattctttcatttttctgtgtatgtaactatacacacacaagtatagtggcatacatgcactctctctacatatatacctatatatatctccatgatcatatgttctgttaattatatttttcacttaacatagcatctcatcatttatcatctttagagatcaatttctttcttttctgatggtgcctggtccatgatggcctaaccatcatgtagctctaatacaattcatttagctcttgcttatttatggaaatttaatttaagttgtttcctgtaaaaaatttaccactttttctataaaaaataatactgtagtaaacagcattgtacatatatcatccagcattcatatatagtagtgtacaacagataactaaatgtggaatttggtgtaggaaatacccagatgtttgcaaattctaagatttaaaaatagatgccaccaaattattcaacgtaaatatcatatccatttatattctgaccaaatagagttgtttccttacatcttcatcagtgctgagtattttcagttattaaaactgtttcctggccgggcacagtggttcacacctgtaatcccagcactttgggaggctgaggcaggcagatcacgaggtcaagagattgagaccatcttggccaacatggtgaaaccccgtctcttctaaaaatacaaaaattaactgggcgtggtggcatgcatctgtagtcccagctactcgggaggctgaggcaggagaatctcttgaacctgggaggcggaggttgcagtgatccgagattgtgccattgtactccagcctggcgacagagcaagactccatctcaaaaaaaaaaagaaaagaaaaaaggttccctgttagaccaaaatagtattttgttgctttaaattgcatttgtctaaatctgtgagagtttgagtgccattttacaggttccattttaaatgaataaaatacttgaatttaaagtaacttccagttaagctatcatcctaccagatgattaaacatgttcctacaaagtaggcaattctagacaattccaaaggattgggcaggggatagatatgagttacttacaactgacaaaggcaaatttctaaaagtattttcttaagttttagtcaggatacccgatttgtatcttgggaattatcattttctggaggtatgtagggcttaattaaggactttcaacttagttattcagcaagggattattgtaatagaaaacttgtatataaatccaacactgaaaatgacatgtatagaagcagcccattcaaaaattccctattcctttcactttttagtaaggtattgtctgttaatttactcgctaatagcctacttgtcactcaggatgcagggtgcaggagaaaagatgtgggatgtgctcagcccagtgccaggctcccagtaagcatttggtaacagatggttatggtttggtctccctttctgcctcctttcctacaccccttccttcttttcttccatttttctcttgaaaacttgagtgctatggactataaccttcagtggacaaggttcacaaaacttgaaataaacctggataccttaacctgaggtcttgcacatacagcccctgatgtgcccatagaaaatctgaaagaagcaaaacacaagaggaatgatagcaaagaggtgacagtgggtactttgcagtgaggaagggatgtttattagaagataagtggacagtagtgaattcgtgtggaaatggtgacagtatggcagtcagtgcctttgcctgcagaaggtagagagtgtggcacattttagaaagccctctatccacatgttcagattcgagttttgatacttgcaggcacagaatttcatgtatctggagattgcagttgtgtggactacctccctccttaacaacgctagaaaaatggagactttacagaacatcaaatgggcgtggctgtgtgcctcttaggttgcctcctttctcttatttccctcacatgtattttttgacatccgtttcaacgatagttacttgcactgatagttaatggtgaagaacacaattcgtaagacactgaaccagtgaagggtttggggatgtaattatccttcagccatttggctagtgacacattcaaaaccaatgaattaacactgtaatcccctgtcctgtttctttgatttacccatgtggaaaattatgctgtaatctgcccatctacttagacagtaattagtgaagttactgttctgtacttttcatactatctgaaataaagcatagctacttctggacacacctctaaaatctacagtgggcttaattaatcatccatggtggatttgagatgtgttcagatttagaaactactggcatgctctttttctgggggaaaacctgtctttttcaagtcctcctggggctgggaggagacttggccaaggaaaggattatgtgctttcaaacaatgttgtgaaataactggtttccttagtggagtattgcttctttgttgataacaatggttgattaaattggctcaaccttgttgctttttaaaatagatgaaaaatctctaatcatcagggaaatgcaaattaaaccacagtgagatactactaccttactcctgcaaggatggccataatttaaaagtcaaaaaacagcagatgttggcatggatgtggtgaaaaagaacacttttacgctgctggtgggaatgtaaactagtacaaccactatggaaaacagtgtggagattccttaaagaactaaaagtagagctaccactcaatccagcaatcccactactgggaatctacacaaaggaaaataagttattatatgaaaaagatacatgtatacacacgtttatagcagcacaatttacaattgcaaggatatggaaccaacctaagtgcccatcgaccaatgagtggttaaaggaaatgtgatattcatacaccgtggaatactactcagccataaaaatgaacaaaataatgtcttttgttgcaccttggatgaagctggaggccattattctaagtgaagtaactcaggaatggaaaaccaaataccgtatgttctcacttgtaagtgggagctaagctatgaggacacaaaggcatacagagtgacatagtggaccgtgggggctggggagggggaggttcggagggggtgaggaataaaatccaacctattgggtacagtgtacactgctcaggtgatgggtgcactaaaatctcagaattcactactaaggaactcatccatttgactaaaaaccacctgtattcccaaaactattgaaattaaaagaaataaaatagatgaaaaaaacattctttaagatttaagatgggtggtttgtaattacaaacttttaactcttaaggcaatcattttaatgaaacatttgatagtcccatgtcatgctttttagaaatccacttaaacttgacttctgagcaatttcatatgaataattatgaatatcctaaagcattccaaaagaagggatagggcaattacagatttcccccaacaatcttcatgaataagactggtaagtgaccaccaagtctatggtggagccaagtccagctggagccatactagcccaggatggacgtttagatcagatgtgctttgaaaagcacatgacaaatttgagcttaaaacccttcataatttttaaaatcatgacattttccaaggactagaagctaaatgactccaaaacccatttggaagttctacagtggaatactatatggagtttagaaatgatagatttgattttcttaaagaagaccactagaggtcacaagagatcttgaaaagaaaaagggtgcttggttttgcatacctgaagtgaaagaaaaatctagttgacgccgatcttaggttctcctaccccatgttgagatggtgttcatggtaaaaagttggcttaactagaacacactgcattctctatcactaccactaaattagattttctatgacttgttttcttaattcactggtttcttaaaatacacacacacacaggtttgaagaaatatatttatggtgtttgaagtgacaacattcagttgtacattttacaactgtacattttaaagtccagctttaaatacaaatcctctctggatatggagaatatcatcagacaggaatgaggaggctgtgccaggattctggatgcggaggtggcctgctgctgctgctgctgctgctgctgctgctgctgctgtcactccagtccttaagtgtgagttttccatctgtgcatttgcagtggtttctgtgctggcagggaagtgatgcacacctctcagactcgagggaagcaggcctgcaggttttcctctggggccgtaatcatgtagtgcagcagccaggctgtggaggtgatgaagcaatgtcaggatctgcgtgtcacccagagacccatcaggctgcgagggagagttctgcatgttctggatgtcgcggtgctcctagcaagctcagctaaccgactggtggaagtgctgagggagtttgtcctcacttctccccaccttccaggaagccagtgagagctaccggctcatttctagctgtggacttagaagacacccatttcccaagtagggtgtcctgaaagggggttgatttccttaaggtgtgtgttcaactccatttcacatggcacagttttcagagtctgatggaaatctgggtgtctgagagattgataagtgtttatgaggtggaccttttgtttcctccagggaagttaaaataaaatattgtataattgatgacgttaacaagcacattgctgccccctccaagacacattcagaatggaagatataaagtaactttgcttttcgctcagagaattgtactatttccgttgcactctgtgctgatctataaactccgcatcttcatcgccactggaacactgtgcggcctgtcagtgccagggcatgtgacgctgcggtgccaaattcacagtggctctccttgcatcctgactttgacaggcagcgctcattgcctcagaacagtcacgttgaaacatttgactgcatgagttgttttccatagctggggtgttttgtttctgtggggctggactttgtcatatgccatttgagactatgtgaggctgatgtcatactttatcattagcactcgggctgatgcaagatcataaattatcaattaccccaaggaatgcatttagcagaacaagttcctctttatccattttgggaaagggcttaagagagagcctcttcagaactccaagatttggatgtttttctatttttcccagaagaattcgtgttgaggtatgattatggataactttgttaacgggctgctgaggttcatgagcaggcctagggctctgggtctttcggaacctttattcctgatgtttatagctacagagtaatatttctgtgtccatcgtatatttaaaagcctatggtgcacagttgattgtgtgtgattgctgtcttcattcacttaaatgattaggttattgaattatttttccattatttaaaatgtctgttaataaatattgatgcaaccttttatttttggcaaaacgtttgaaaatggatttgttgactactctctcctagaattttttacaaattattcttagccaatatcatcaaggactcttttttacagagaaaagccaccacctcttattagcaatgcccttttggcaggttaagtggggaagtgagttgttcctggaatgttctaggctttttctgccaaggttctgagggctcacgtggagaacaaacacttgctaaggacttagtgtgccccagagagcaggctttagtgcgtcatctgtgtcttgcagctattcttgtccctacctgttttttgtacatgagaaaaccaagtcttagcattgaagtgactttgccagtttcttttttttttttctttcaaattttattattattatactttaagttttagggtacatgtgcacaatgtgcaggtttgttacatgtgtgtacatgtgccatactggtgtgctgcacccattaactcatcatttagtattaggtatatctcctaatgctatccctcccccctccccccaccccacaacagtccctggagtgtgatgttccccttcctgtgtccatgtgttctcattgttcaattcccacctatgagtgagaacatgcagtgtttggtttttttgtccttgagatagtttgctgagaatgatggtttccagcttcatccatgtccctacaaaggacatgaactcatcattttttatggactttgccggtttcttagtcagtagagtcagaaggctaagtagaggggctgtgatgccaccagcatgggaccataggttcagactgcccagacgctgccccttgggcataaaaattctgcccttcactgctgtcagtgtaaatgggacccttggcaaggtctcagcacaaggtaagggcccagttcacgttggctattgctgctgggttacatgctaaagaactgctacagaattccttctgtgtccctaaagagcattttccgtggttgggaagatgccacaccttggccgtaagaattagcaccagaactggacaatatatatccagtgatgatcccatcattgggttcctgggaagggaagttgggagagaagagtcaccggagggtgtagggtggagatgagctttggaggatgctggaattggggataggcaaggggatcagagcactggctagaaatagaggtgggaaggagggaagatggtgaagtctccttctagagacaataagtaaatcaacttgtatcattattggtgactagggtggaaagatgcaggcaaagaattttgtgcccatcccagaaacagtggggagcttgcaaaagtggagttttaaaaaaataatttcaatttttattttagatttagggggtacatgtgcaggtttgttacccgggtatattgcatgatgctgagatttggggtacaattgatcccatcacccaggtactgagcatagtactcaacagtttttcaacccataccctgctccttctctcccctccctagaagtccccagtgtctatcgttaccatctttatgtccctgagtgcccattgtttagctcctacttataagtgaaaacatgcagtatttgtttttttgttcctgcattaattcacttagggtaatgaccttcagctgcaaccatgttgctgcaaaggacatgatttcattatttcttatggctgcatgtaaaagttttaaagtaagatgaagaaagcagggttttaagaagattagtgatggtggatggaatgacagagtttctccttacagtagtcaatgggaagtgagtgcagtgattcaagcttctgtagtaagaaactctcttattccacccactgactgtagaaattcttcagttctttttggtttctcctgcctaagtaataatgataataacaataacattgcacataacccttttttaacgtttgctatttttgtgacagatgcacacacggtaacatagagaggtaaagtacccaaggtcacagctgggcagaagcaggatccagacccaggcagcctggctcccccgctcaggctgtgaccactatgctgtatcatttttttttttctaatctcttcaagagcaccataagacttaatgcatttatggtggcgcctcagtccactgggccacaggtgaccaccgataatgctcagtgatcacatgcagaaatagatggacaagtggtcaaggccctaccttttgtaaattattgcagggctgaaatagcttgaaaaatgactgcagcatcagtagtacagtcatacccattcaaaaaatggttgacatttgtttctggcttcctgttttagcctcatcactagaaattcctgctgatgcccttgcatcatggaataagactgtttggtggtgatgacatcagggccaggttgacagttttaaaaaacaaaggatctggttgcctggttaaggaccctttgctgtctctccttccagagagttttgacaagaggtgtattagtccattctcacactactataaggacatacctgagactagactatttatgaaggaaagaggtttaattgactcacagttctgcagcgctggggaggcatcaggaaacttacaatcatggtggaaggggaagcaaacacatctttcttcacaaggcagcaagaaagaacaatgagagccgagtgaaaggggaggccccttataaaaccatcatatctcctgagaaccttctcactatcatgagaatagcatgggggcagtcacccccatgattcaattacctcccaccagcttcctcccatgacatgtggggattatgggaactacaattcaagatgagatttgggtggggacacagccaaaccatatcaagaggttaacaagaagattcaacctgtggagtcatggtgatggtccctcccatcccgagttgtcatcttctgtgtgtgttttttcctccttgtaccgtggtcttgttggctggctccctccttccctctgaagttttatagaccagagacctggcttttcaactgtgtagttcttccatcaagatacttactgtttttaatgaaaaaccagcatcatttcaaccgttacacttgtgtcagcagaggcaaaggtttcatcctgggagcagggtgaagattttcatccagagtgcatgcggtcattcagtttaaagcatttagacttaggaagtgcagctgtggcaggatcaggggattcgttcctgcagggcgcaggaggaatggtggcagggctggcaggacgataacctctggcccctagccaaggactcccctctcaactcttttgcttccagctacaaatgttcaaaagaagagtcaaaataaaggaagattttgaagtgcattgtcagcttagcagagtgtgaaggcagggcttaagtcactagaccagagctcatatcacggctctgctgccaactatttctgtcatctcaggcaaagcatttcctcatccccatgggccttgctctcctccctctgcaaagtgaaaatggcagtgccaccctcctgggatcactgtgagaaacacagtagcagaaatcatctggataaagccctgagctttatatatatatatatatactgatcactcagtagatggagctgctattaacgtcaaagagaacatactagaagataaaatgggatgatgaagatggtagcatagtaaagctagggggaggaaatagacattagtagccaaagcagatatactagaaaaaaataacacaatgctgaaacatttttacagaaagagtatcagagaaaaaaaaaaaaaagcaaagtataagaacatcccacacaggtaaaaaagagcactaaacttacccaagaatgtgctaaaaagaagaaaggagtgttaaatcctgcagcaagatggaacacaggagctagcctccccaagctgcaataaatctggtttttgttcccacctgccaccgccccctgtgccagactagttgtcaaggtctctgtagagggtcctgagaatggaagcggagtggatgtccccaggagggtgagcagtgctccatcacttcaccagccttcccctccatggcaagtgcagaggcatctcaggaataaaggatgccatgggccagtgtttgaaaaatgcataaacaaggttaaatattctttactgtagtgcttctcagagtctttaatatgtaactatgaaacaggaagggacttatagtggttactgtttttaggcattggaattctttgggctgagaggatgctcgggacaatatcatagtggtgtttcttagaacatccttgggaagtgctgcccctagtctcttgtcctttggcccatgacaagtgcttccctgcatcccacacccacacatgccaactgtgttccctctgcctgcaatgttccacttctaggtttcaacatagcttcttccctttctgttcattcagctctcagctcagatgaccctcctcatagaggtcctccctgaccacttgaccctctcactctctatcccaaagcatgtatcattatttgaaatgtttagaattgtctaaattggttacatctttattgtctgtttctcctattagaaggaaagttcaggccaggcgtggcagctcacatttgtaatcccagcactctgggaggccgaggcaggcagatcatgaggtcaagagatagaaaccatcctggccaacatggtgaaaccctatctctactaaaaatacaaaaattagctgggcgtggtggtgcatgcctatagtcccacctactcgggaggctgaggcaggagaatcgcttgaacccgggaagcagaggttgcaatgagccgagatcacgccactgcattccagtctggcaacagagtgagactccctctcaaaaaaaaaaaaaaaaaaaaaaaagaaggaaagttgatatcatgagtgttgctctagccccggcacttagaacagggtctggcacacagttggtgccctgttgaaggaaaaaaatgagtgaacgaacactgaacttcagcctttctattaaacagggtggaagaccatgacgatctcatgccaatatttatgcgctatgacacaattctgaaggaaacttacggtgaatacttcctggccgaactaatagaggcccaagatgaagagaatcatgctgttgtgtgtgaggtcagtgactgattcatgtgggaacacacttagtgagaggaaggagggatgtgagtggtgttgctcttgcgttgctgggcacccctggagctgccattgtctccctggccaccccggccctcccactgcccttccaggtggtgcaccaggccagcttcctcccctgggttactggctttaggttgtcttttgcgaggtccttccagatgcccacgatgctgtagattcttgccttgtccctagagtgagagggaatggaaaagaccccccaggggtgcgtagggggatttctgaggatccccaaatctcagacttcagaagtcacaaaccagcgttctgctggcagatggattttgtttgagttggaaaggtattttttttaactttttgttttgacatagtttcacacttaaagaaagtttataactacccagattccccaaatgttaacatccaaccccatttgttttatcattctcttgttcaacctttctaattccctctctctctctctttttctctcttgctggctctctctctctctctcatgtatattctgaaccatttgagagtaagttgcatacataatgcccctttacctgtaagtatttcaatgtatatttcctaaaaacaaggacactctcttagataactgcaatacaatgatcaaagccaagtaattatgattcctgtaattattattattattattattttttgagatggagccttgctctgtcacccagactggagtgcactgtcatgatctcggctcactgcaacctccgcctctcgggttcaagcaattctcctgcctcagcctccctagtagctgggattacaggtgtgcgccaccacgcccagctaacttttgtatttttagtagagacggggtttcaccatgttggccaggctgacctgaggtgaactcctgacctcaggtgatccgcccgccttggcctcccaaagtgctgggattacaggcgtgagccaccgtgcccagctagttcctgcaattcttttatctaatctacagacttcattcagatttttctgacagtcccaggaatgtcctttatggcagaggtaattccaggccattcattgcattcaggtgctctgtttcttcagcctttttaaatctggaacaattctccgatccgtctttatcttccatgacaattacagttttgaatagtacaggtcagttattttgtagaatgtctccatttggatttgtacaatgttttctcatgatttgattcaagttatatatgattaaatatttttgaattagcagctattgtaaaaattatgaaagtctatgtaaaaattggaatttctagcttttctaaacaaatcagaaggcccagcctattgggcccaaaaggcagcccacaccctctaattcatgattcttcatctactcatttctcattatttgttaaaactgtaagagctgtttaaagaatattacttttcttgaaacttggaatgaaaagttctcttacttggatgacatgagcagtttgaggctttgttctacatcagtggttctcaaacttggcatatatgcagatcacctgggaggcttttaactatccataccatgccaatgacttggatccagaatatatacaaagaactctcacaacaatagaaaaataatccacataaaatgtgggcaaatgattcgaatagacacttttaaaaaaaatgaataaataaaagatacaactggccaataagcacatgaaaagacattcaacatcattagtcattaaggaaaggcaaatcaaaaccacactaagataccactttacctctgctaggagggttataataaaaaagcaggacaatagcagatgttggcaaggatgtggagaaattggaagcctcatccattgctggtaggaatataaaatgctgtggccattttggaaaaagtctggtattttctccaaaagttaaacatttgacccagcaattccatacacagaattgaaaacacatgtccacacagagatgtgtacgcaaatgttcatagcagcattattcataatagccaaaaagtggagacagcccaaatgtctatctactgatgaatagataaacaagatgtggtatatccacacaagggaatagtaccaggaaataaaagagaacgaagcactgatacatgctacagcgtgtatgaaccttgaaaacatgatgctaaagaaaagaagtcagtcataaagaccacgtattgtatgatggcatttagatgaaagcctagaatagacacttctgtagagacagaaggtagattagtgactggagggaaaggggaaggagaagtgactaatattgggcatagtcgttggttggtggggggatgaaaatgttctgggattagacagtggtgatgggtgtacaattttgtgaatatattaaaaaccattgaattgtgtatttcttttttttttttttttttgagacagagtcttgctctgttgcccaggctggagtgcagtgatgtgatcttggctgactgcaacctccacctcccgggttcaagtgattctcctgcctcagcctcccaagtagctgggattacatgcatgtgccaccacaccaggctaatttttgtatttttagtagagatggggttttgccatgttgaccaggctggtctcaaactcttggcctcaagtgatctgcctcccaaagtgttggaattacaggtgtgagccactgcaccaggcatgaattgtgtacttcttgaagggttgtttttatggtaggtgaattatatcaattatatccatttttaaaaatcctgttgcaggggtacactcaggccaattaagtcaatcttttgggggtgagacacaatccatatatttatttttaattttggacactcactatgttgcccaggcttttcttaaactgcagtcctcctgcctcagcctcccaaagtgctacggttacaggcatgagccaccatgcctgacctcaatctggatttttaaagatctccccagatgattccaaggtgcagtccaggtggtgaaacactcatctacatgagggtaaaacatacctggtgagaatgacatgactttatagagatgtgggtattagtttctgaaggtgacaattggcccctggaaattagattctgaagtactacattgaaaggatttttatttattttttaaatgtttattttattttcttatatttaggttttggcatggtttctcaaagacccgctttcacgtattcttgtttagccattagccccaggctaccaggctagccatagaagggagggttggaagcatttgggcccagcagtaccatttggaaagcttgtctttacacaactagacagaaactcctgagaagtgaaatgattcatacagaccccaataaggattttcatgaccaaactttacttatcaggtttaatcagggtctttgtttttggaaggcttttaattatttggttccaaggtactagttttactctgaatcacttgagtcagtgctttgtagagaagctgcagtgacctcttcccccacgttctttctctctcttgccgtatgtttcacactttcagtgtgtgtaaacatcagagcaaagctgtaggctgaaaactgcagttccaaccctgcaagaatcctttggtgtctcgaaagaggcagagggcatccagccccatctccttccagaggccgtgctgcctcaagcatcagaggctttgtgttctgtggaggggagaccacagacctcgatcttaaaatggaagggcagaaacaagactgtgagccgggatctgggaggggacgtctaatctgaagtgagccatgtctgatgtctgaagccttttggggttcaagatcaatgctgttgctaccctttttcctgcctccctagggggcttttaggcaatggtgtgctggagccagcttgctctggctctcaagggctgattgttaaatcctcaggaactctgcaaactgcttgttaaacacagctattattaaaaattaaattatagaaacctacagtgtaataaattatattaaaacaaagttaataaatacttgaaattcatcaccttccatttttttttactattctccatgttcttgagggtttttttttaaatgtctgggtctctatacagtagatataagaaataatggctagctactgcgcattccctcccaactacatgtttagtgagatcacactgttcacttgacattgaccatgatgacagcgcttacacctcagaaatcggcaaatgctacagatctgggcttttcccccgcaaatgctgattaggcatttacaggcacacgttactttaaggcaaccactgtcaaccagaggaaacagaaagaagtccatcaagtttgtctttctgaacagccatggcagttccaggccaggcatgcagcatgcctgagggcaaggctgtgccctgtgggaaacccttactactgaaagggtttttagttacaaggactttctttggcttgatagctagtttggaggagtttggggccatcacttcatacaagttccttgtcataactgtaccctggcttaccttgacatctggtgtttactccaagctgaggttttagggaagggtagttggaggccagcggcggctcctagtgacagatgggcagagcgtctgctttggcatcatccagggtgtgggcagcagtggtccgagtaggcaccactgacctgcaggcagggaaagcctgccaggtcagccatgcgcttggcatcaggaggagaggatcagagccagcagtggtcacaatgagggcaaaaccctcacagtggaatattgtcacccaaaagggatgggtggctgtagggctttttggatggaagcataaatgagaaaatacacacgtttctgtaaatggacctgtttgggaagacaaggccacagtacacatagttttctagcaatctaaaccttatgtgtcatgatgtagatatttacaggacaagcaagaacaacaaaaccttcagttttgttctccagtataagataattgaagacacttgtggtgaaaagtacttctgtcaccaggaagatagataacagccagcaatcaatgcctttctgttgtacaagttaaaaagtccattaaatccatttttttttcagtgcatacacaagaatacatttggatactcctgcaaattcatatttaagaatagtgtttctcaaatcggttatttgaaagaaactcaaaggaaaaagcagacacttccacaatatgtccttgctctgttgtagtctgtaattgtgaacttttgtaaattgttacaaccctggatgaatgatgggaatataacaggttgtagaattggagaacgttaaatctttgttcctaatggcaaaacatgtttttctcattttcatcagaatgtgtgatccatgccatttgaaatcaaattccaaacacaatgagccattagtgtaatagctcattactaacagcggtcttataaataatacattcttatcatacacatgcagctcgctgtgaagccagcaaaaggtatttcaggccatcgaagttttgttgcgccagcgcggctgtagattagaaggacatctccatgtgaaccaagatggatgccaattttccctgccgagagtcaggctggccgtctctttctgcacatatggtagatggattggttaatcagcgtctgctgagtcttgggcctgaaattacagagaagctagacaactgcggctatgcagcctttgttcacgagtgcaaacaagacaaacaatcacttgttatttgggaaaaaaattaaaatgtttattttggacttttattaaagtgtcaatggctttataaaacagctgtgtaaatccaggctttttcagcaagtatcattttagggggcctgtaaagaaaggaatatacatgaaaaaattaatttttaaaaattcccctcatatttcagtattgagaagaaaatagaggaggtctcacttttattttgcaaacacgtttgagaacaaatgatttttaactgggagacatattcgagaacaaatagtagtttaatacctatttttttttttttttttggtgtcatttaaaaaactgagtattattgtagcccgattctctgttttaggagattaaagcattttctctgactgggcatttatggaaagatgctgcgttcttgggaatagagaatgcctgtgattattgagttctgctactttctgaatgcaatggttatctaaaagtctgaacacttgagagataggacccagtaaatgcaggtttctaataagagctatcagagtctaatcagtcaaccagaatttgcttaaaatctactaataattattttatgtgaaatttaaaggactatgtattttctctctctttttaaattttaaatactttccttgcagaaaacaatgaaatacagaattacttaagggatatattaaggagtttcagtcacagccgtctctccatgtggaatatgatagaattaaagtctgttgttaatttctaatgttttggtaccaatcaggtacctggtacccaaccaaggttcagatcagctagttactcatcttctcgcctatgtattactcatcaaagactgaaaatcatggggacgactgcaagagcttcagaaccaggcatttcagggtgatgggaagttcaacatttgcagatcagacccacctggtgaaccagcctagcctgactcaagtttacttcactggaacattttccaccaaacttccttccctcatatctcctccctatcagactatccagttaataaataagtgacttcaagacaaattgaagagtttctacctgataaggagctagggaccgtgaactttctctgtactgggggctgatcagatgggcactggaacaatgacctgtattcctgagaagtgtgcatggcagagggaaagaaagtagacaggagcgccaggcttatggtggggtacaaacacaagacaccaaatggcagaggatatggagcaggcaggagcatggtctgagcagagggcaagtgttccaatggttgaagggtcaagaactctggcaatttccctgttacttatgcaccactaggtgtgtccccagtggtcacttattgggacattttttgagcatgttttatgtactgaaggaagacacttattcctcccttaaatctcaaggtgactgccaaaccaccagccgaccacattctgagggctctggaggtttcctgatgagaatcatttgacctctgataaagtaatgaagtgttttggactgggtgtggtggctcatgcctgtaatcccagcactttgggaggccgaggtgggtggatcacttgaggtcaggagttcaagaccagcctggccaacatggtgaaactccgtctctactaaaaatgcaaaaattagctgggtgtggtggcgggcgcctgcagtcccagctctgcgggaggctggggagaagaattgcttgaactgaggaggcggaggttgcggtgagccaagatacaccactgcactccagcctgggtgacagagcgagactttgtctcaaaaaaaaaaaaaaaaaaagaataatgaggtgttttggatatttcaggtggaaggcacagctgttgggttcatgagtgtgtgctcaagagtgaacatgcaactgctgcatgagtgctttgacttgggccctttccacggactctgtttcccacatcctgatgacgttctggaatcaccacaagacctaagtgtccgaagaagtcaaggtacagtggctatcacagggacacactgggaaattaaatctatgctttatacacattgcgctcttcgctaagtgatggaactagataggatgctttatatttccttccccagttccccttaaggagtagttcccatggttggtcacatccttgtgaaatacctacaagcacagatagtcacagtgcaggggtggagttagacatagtggacttggggccttagggctcccacattcaggatgctcacttcttgaatgttcattgctagagtacatgtaagttatgatgaaataattactggtgtttcaggtttcacacacacacacacacacacacacacaaccaaatacaacaagtgaatttttcaaatcaagaactcaggaaattttttatgcttttaagttttaatcccaactttcagtgcttctgtttttgtctttgacaaatcattatgtagtataggtctgttgcaagtagtcatttttaacttgcttaagttacttctagttatatgaaataataccatcaattttaaaatattgtctgtatcaagattttcaccacgttcaattaggtaacctcaaactttgatgttttaatttagtgaggtcttactgtatccatgggtatctttgcggttacatatttgggttcttacagaagacagatgcagacaggcaagttaccatgggtacatcaattcacttctccaaagctggatttcttcatttgtaaaatgggcataatagtaatacctcccacacggggggggggttgtgaagtttcactgagataagccatgtagagtgctttgcacagtcaacactcaataaatgttgatcatcaccgttagcaattattttttctttgtgtcggccttccaccaacttgaatcttcctagggtaaaatcagggtatttcaaattgctatgctttctcctgtctgaaagattacaccaagattgttcagaaatggggaaaggagcacttggctggtggcaaaggacttgccaatctagacaacagaaggcagtgacttggctaagcttatcccctgaatgcataaaccccgtgcacagtgtctagacctcatctgaacatacacacttatcacagagaacctgcaaagccacagatagaggagtttcccttttgtgctgatgataacaacaccctccccaaaagagatttggggtccttattgtttaatagtgaagccttgcttgccatgcttcccagagaagaactctaccataggagagttctgagggaacttatcagtgtgagacagtctggaaccataagttgtcattgttattttccaatgcttaaattcttctttgaaagcagcactaaatggcctttttttttttttgagatggaatttaactcttgtcacccaggctggagtgcaatggtgtgatcttggctcactgcaacctctgcctccagggttcaagtgattctcctgtctcagcctctggagtagctgggattacaggtgtgcgccaccacgcccagctaatttttgtatttttagtagacacagggtttcaccatgttggccaggctggtcttgaactcctgacctcaggtgatttacctgcctcagcctcccaaagtgctgggattacaggtgtgagccactgcacttggccctaaatagcctttttatggctgaatattctcacatgtaaaatggagataaaaatagtatctaacccaaagaattgaggggacaattaaatgttagaatctatgtgttgtgcttagctcagcgccaaacacaaagtaagtcctgaacatttaaaaatattttttcccctgtggctgttgtaatgaagaacaagttgaaaagatgtagtcccttccagtgtgtttctgagtggctctgatgctactgtttcctacatagaatgaatggaaaattccttagaaactttatggggcagtgaaattcaaaatttaaactgaaccctggacttaaaaacatacgtaagctagtatatctctagcaagagcccacagagatatgggcactaaaagaagtcctacttctgtttacctccttcaatatttttacctaaaataagtcaatctaggacagatggtaagtaaaagaaataggaaaacttatcttctgtgccttgtttatttttgaaagtcagctttatgttcattgacacaaagatgattccttatgaaattttcaccagggagctggcattgtagacttccacataacttccagggattgagtcacaaatcatcaacagctcattatatctaagaaaagagtcatcagcacattttgctgccatcttcctatcaacaacaacaaagaatgaggctccagagaaaattctaaatgtactgtgatctgttactttcctttcctgatgaaagtctcaagttaaaggaaatataatttctctaaaatatgaactaaaattcttgtttcaaatgagcacacatcactgtgtctcatatcttgtattttgtttagtgcttttttccatttcaaaggatttttatatatgtaatctcatgttatcctataacttggtgtaggagagctagggaaggtgaggttctctccattttttacttgctaaagctcatccaagcttttaaagctcatcagtggctgacccagaaggcagacccagcctctctctgctttcgtgcatgatgatagtcttggcaaggtaacgtcttatcttggatggttttgacagaaaactccaatgacgggtctgctacacaagatacatgatgagttttttcactttatttttattttttatttttattattgttatttttttgagatgaaggcccccctctgtcacccaggttggagtacagtggtgcaatctcagctcattgcaacctctgcctcccgggttcaggtgagtctcctgcctcagcctccccagtagctgagattacatgtgtgtgccaccacacccagctaattttttttgtatttttagtagagacagagttcatcatgttggccaggctggtcttgaactccgggcctcaggtgatccgcccacctcggcttcccaaagtgctgggattacaggagtaagccaccatgcccggccagttttttcactttaataagttatttaatgaatgatcacttcagtgggtgatcagtgacctgcccatatccctccgacttttattttgtatgtgtgtgctccaaacaactcctatctgctggaatcttcacctctgtgtctgcaggcttttttaaaactgtgaaaggccactctgacctatgcaggggtcaggctggaagtgtcaggaaattatcactcaaggaatagactctgtttccctatgtcacatcccagcttccctgctggtgctttctccattgactcccaaataaatggttgtaactgaatctttaacttaagatttgcctctgaggcaagtgagaccaagacactactagttaggtcttttcctaccagctgtgaaagcatttatttatacacagctgacttgggtgagagtataaataccccagctccctcactcctcaggtgggaggactcagatatgtgagtattggctggtttcccagagttcccccaagggattaagtttcagttgtccataatagtaatctgggtgataacacatgtgttgttgttttttaacttttaagttcaggggtacatgagaaggtttgttacataggtaaacttgtgtcatgtgggtttgttgtacagattatggcatcacccaggtattaagcctagtacccattagttacttttcctgatcctctccctcctcccaccctccaccctcaaaaggccccagtgtgtgttgttcccctttatgtgtccatggacaacacacattttattagttgcctttccttccctgtctctttcctcactctcctactggtacatcctggaaccacctccaaaataaactgcttattctcaagctcttctctcaagatctgatctttccctgccagctgtgaaaacttgcaatttcacaccaacctcaaccctttcaagcagaataatgtcaagactcagcattcttaaatgaatccagaggccctcctttttctagctcctaatacacatggtaattagcttactgtccttcatcatctcagccttatcaaaagtttccctggaggtctggctggtgttaacagaaaggagggcagagctggtgtggctgaccatggagaaagctgacttggctggtgtggtgcagagaagccagcttgtttatgtgcttattccatgactgcttgtcctgagcagaaagtgcttttcaggatctatttttggaggtttattaagtatgttctcaattccaacagtttaatgaagatctaaataaaatgctaggttctaccttaaaaaaaaagtttccctgaatctaaaatgtttaactgtgtacaatcaatttgtgttttacctgaataatttgtgtatgttttcatagctacccattttgcatgtataacctattacatacttgtaaactttggtttttatgtactaaacattgggagtaaactgggaccaatgggaataggttctaaggatgtaaattttgtccaagcataaggaaaaactagtagaagtgtattttttttatttaatggaggacctagtgtggaagtagcaagttcccagaatattggaagaattcataaagaaacagtcatacacacttacaaagggctttctgcttgtgtggaagattatactgaatgagatgtaagatccccttaaatgctaaaaaaaacttattgaatacatatcaagatgttccatatgcctggcactttatgaatattttccttcagtgacaataaaatggttcaaaacaatattttttccagttggccgcagcactggccctgcctggtgtttgcaaatcaagctgtgtcttttgttagctgcatcacccaataaatattttggaatcaagcttgagctggcaattttcttgataatgcataaggcaaaatagggcacaacctgcatttccacagctgtactggcattgccgcatttaatagttaaaataaaaaaataaaaacaagcaaaaaacaaaacttttgttcctcatgtaggccgttgagatctgggcagcatgaatctctgttttaaaagactcctgcaaggttccgatttgtaaatctcattatatacccagggcccaccttacaaagtctctgcagaacttgatgtgctccttggcagggagagatttcactttacataatagagttatgggcattcaaaagaataactagtgtagccccttgtcaccaagtcatccaggaaaactgttgctcactatacatataaaagacccttcaaaatagaatttttgtaatgtctccacgtaaaacatcgcaatattgcctttaactttttttttttaaattactcctgctgtcaggaaatgtctttatatgtcttatttcaattttatgtcttgttttattgaactcacatttgcttcttatctcagattccctcatctcttgggttaggaaacacctagacccactctccctgtgtcggagctaaaaaacaatggctacattaagtcttattgattgtgtattaaatcatcccaggtcttttcgcctctcttcctaaggttccattttatattcctggattcccttctattttactttattcttcttttaacatggattccaaacaggactggagcacgtatctacagggtgtgttaggatttctgctgccgtctttacattacagatctcggaaccttgtttttaacagtcagttcattctgtagttaaccagtgacccaccaggacttagtctgccagggctgccataacaaagtgccacagactgggtggcttaaaaaacagaaattgattttctcacatttgtgaggccagaagtcaagatgttggaggggtcagtttcttttgaggcctccctccttgacttgtagacggccatcttctccccatgtcttcacagggtcttccctctgtgcccatcagtgtttttggtttttctttttataaggacaccagtcacaatgcattagggctcacctgtaactttaactcagttacctctttaaagactgtctgcaaatacagtcccattctgaggtactaggggttaagccttcagtgtacgagttttgggggtgggaggaggcacactacagcccaggagaggctctatggtatcgtactgccttcctctggtccctaataggggggcggtatgtgttcagggtggggaatgtttggatgtctacatcctctcataagcccatgttcttcccctggctggatgtaagccgcacccacccaaccttctgtgcccgaggaaagtccctgtgtcccaccaatgggcttctcattgttcctggcatgggtttcagatccccctaggagaggagttctgttcttacaggcttctgtgccctggtcacctccacttcccaggaggctagggtgagttctggggcccattatagctctcactcagtggccacacagcaatattactcacttggtagcagttgccaccaaatttgccattttctcattgtgatctgggctttgagcatctcagttctccctcctccccttttctttccttctcctagatcctgtggtgtggttctttgatgcctgtactcaaggctctgatagtaatgcagacagtggcagcaaagtcggctttacttaatgttcatacatagccctaatatactaacttatacttgttaaaatttgaattatttatttatttatttttattgttttgagacggagtctcgctctgtcgcccaggctggagtgcagtggtgcaatctcggctcactgaaagctccgcctcccaggttcacaccattctcctgcctcagcctcccgagtagctgggactacaggcgcctgccaccatgcccggctaatttttttgagttttttttttttagtagagatggggtttcactgtgttagccaggatggtctcgatctcctgaccttgtgatccgcccacctcagcctcccaaagtgctgggattacaggcatgatgaatttcatttttttaagccactgaatgtctttagcatatgaaggcaacatcttcgaaagctttagctactcttgcctatatatatatatatatatatatatatatatatatatatatatatatataaaatttgattttctagaatctactttgttaattctaaagctttgcaagagatgttgataaaacaaataaatcataccagacctatacccaggcatctccaatgttgagagtttagactctttcagggctttcagggcagagcccctggactggtaggataccaggaagactgtaatccagacctgaagcccagaacttgttgtcagggacatgaccccaaagccatcttggtgagccttttggttatttcataaaacctgttgtcaattctccatcttaattccaaagctgatttctaagccttttctaatgtcttcaaaaacaaccatagcatcaaaggatggcaaccacttaagaatctattattttgcagacagcaacatgactgagatctgcattcctcctttcctcttcagccctgggagcgacctgtgatatcacagccttgttctccaacagtcagattcatttcacaatggtggaaatacaagcgcatttttgtatggggcctggaggtcttcagaagaaaagtggctttatttatattcgttatgatcattatgtgctgggattattttctcagtaggggatgtctcttttgcccatatttatgaagcaggggagaaggcatttaatgaagttcaagagtgtatttgactgtaaaacacatctcagtacattcacatgtaaataacccttttatttgttctctctggtgacctttttcctgttggggtagatcacagtttgttgttgttttccattttcagatggaaggctgaaagataataacgaaagattatgcaaaaaaaatccgtgtttaaaataatgttgatatgccacttgtgttgcaggataattatagtaatttggctattacgctatatggagtcagcagttagttgctagaaaacacggtgataggggtgattcaagggattttcatcccaactgggtgtttgatcctgctgacttttctcttgaaaatcaattgcttgcactgaatactttgaattcccccttgattaaattggccatcagtgggtcacacccattgcactgaggtcactgtgagttctgtttacaaagagtttttgatgattcttaaaatatcatggaccaaatttaatctgagccaagcggctaaggaagcaattactgaaaagcacagtttttgcacatggcaacaaacaaaggaaaatttattaattctgaagctcaacatgaagccagttatttgactactgggtcagaggccttctctccactgcattttgcttggactttcggtattttcagacctccatggacagataggctcactcagtagaagacctggtagaggcatcttggaagcatctttgacaacttttccatttctcctcaaggtagttaatagattcaggttttctatttcctttgaatcaattttggaaataagattattctagaaaagcttaatttagtatatgaagatgaaaaattagcatacagtagtggagatatatataggagtatatgtataatatatgtgtgtatatatgtatccaactctgtggaaaaatacttaaaaaaattttttttctttttttcagagacaaggtctcattttgttgcccaggctggggtacagtggtgcaagtatggctcactgcagccttgaactctttctgggctcaagtgatcctcctacttcagcttcctgagtagctggactataggtatgtgccaccataccttgctaatttttacatttttttggagacagggtttcgttttgttgccaggctggtcttgaattcctggctttaagcaatcttcctgccttggcctcccaaagtgctggaattgcagggatgagcaaccacacccagcctgtcttttttattgagtactgatttaagtctacatgaaatattctaaaataaagagaaaagcaaatcacaaaagtagttatataaaaatattattcataataaatgtgggaaaatattaaacttccctaaaactgaaatgcacattaaaacccaagatctttttctcccccattttgcctactaaattgtaaatatgcattgtaattaaaacacttagctctgggcaagaagcactgtaatgagcactcagattttctgatgctctgaaggttgactgatataacattctggagtacaatttagtcatggttatcacagaatgcattagatgttcatgttctttgacttcaactatagcaaatttgaggaaataatactaatactataaaaagatccatatgcaagaatttcactaagcttaatcataatactaaaaatgaacaaacaaaaaatatccaaataaacaaatgtaaaaaccccaagtctcccacaaggagatggctaaacttgtgaatatcccttagatagatatgcagaagcctttaagaagaaggttacaaatagtgaggggaaatggttcagatataatctcaggtgaaaaaaaaatcaatgcaaaatgaattgcagtatcagtaaagtcacctaataaaacacatgttatgaagagtacagggaggcaatgaactaaaatgacaaaagggctggagtcatagaagtggcaatagagcaacgcttttatttcctccctatattttttaaaatgtggaaactattaaatctacagaaaagttgcagatacgtttttttcttcctaatccatgtcaacgtaagttgccaacatgaagttgttggagcaccttggaatacttttgtatgtatttgctataaagagggacattctcctttgcaacctcaaacatccactgatatcaggaaattaacatgaatatgttactacaatttaatccacaatccaaagacaccagttacatttcttcatttgtcctgaggatgtcctttgtggcaaaagaatccagtccaggataacaaactgcagttacttgtcatattgtctttcaatgtggaacagttgctcagtctttccctgctttttatgacctagcccataattttgtagaacgtaatttatttttgtttgtttgatgtttattcatggtgagagtcatgtcatgcatgtggaactctgggctctcagtccatcctatctggtgtgatacattttcagtctgccctgttactgatgatgatgtgtgtcactttgatcacttgactaaagtgactcttttaggtaaaaattaaaattattttcacttatcccagtctgtgcagaagtctgtaataatgtctttcttcctgaactctgtattagctctaccctgattttcacttggaatcaactgatcctgttttactccttgcttggggtttcatctttgcaccacccagcatcccaccacaggtacttgaggctgttgagctctccttgggtaaatgatgctcttggttgttccatacgtcagtccttctatgcttgagctggtgtcagcctctggtaattgctgtgcgtggtccatttcaggcagatggctcctgacttactttgtagccagaatagacttcagcaaggcagactcccttccccctctaactagggtgctcacaaacgacatggacccagctcccaagtgctcggtctaaagctttacctacaatttattctctcctgtagctgtgattatatctctttcttcttaaagtcatctttgctttttactctgtcttgtcttttaattaggttttcctgtttggtcttttcaaagagctagctcttaatctatcaagtctatgggtttctttttgaatttattaatatctgctttcattttgtgacctctttctcctgatttctttgaatgtgttttgttcttcctattctaattgtctaattgcctgattcattcttttttttttttttgagacggagtctcgctcttgttgcccaggctggagtgcaatggcgcaatctcggctcactgcaacctccgcctcccaggttcaagtgattctcctgtctcagcctccctagtagctgggatcgcaggcatgcactaccatgcctggctaatttttggtatttttagtagagacggggtttcaccgtgttggccaggctggtctcgaactcctaacctcaggtgatccacttgcctaggcttccttgttttaaaataaaagcacttcttgggaagacaaagttttgctctaccaacttaggtccaagcgggtgggggcctgcaaattgaccaacagattaacaggagaaaaaagtattatatataaaataatatataatactatgtataaactggtttggtggttgttaagctcttcatttcccccatttgaaacttctcaaaaacattcacaaacaaggagcagggttgattgctatggagagaagactagggctacaagttccaaggaaagaaatctgcaaaaggagacagcaacatagattagaatgcggaaacaaaaataaaaatcaagattaatatctggagcaactatcaacctagtttctgagaccaaagggcatccagtcaaaaagacttttaaacattgggtttgaagcgtttctagacaggggagtgagcatggtattggcaaactgacagatttcccagtttgcagtttgaaggttgttggtgatggcgtagatagcaaatcactataaccacggtcatggctgtttcctggagcgcagcatagaagatgagtgttatagtgagcttcctgagtggcccacacagcagcagctccaagcacgaggcccatactcacacttgatctattgtgatgatgactattttgaagttcatgtcaagccatctagcttcagctcacagggcttcttaagaccttggagggaaaggggcaaaacaagacaacctagagtctcaaggttccgggcagtcagatttttcagtgatgccaagtcaggaggatgggagaaaatttggaaacattaattactggcaacatgtgtaagatagcaggattcagtttacaaaaaggtagaaatggctcagaggtaatgagcaggattagaatctgataactcacatgagcagattatagttttccattgaaatatagaatttataatcaccccaattttgatcaaagataataaaattaatattattttgtttgtaaaataaatctagtttcattaaatttggtttgattatttatatgaatacttcaaaaatggtaacagaccacattaaagtttgctttgctgaactgagattaggaatctcaaactggacttttaaaagcctgctgggactaggaagtcaggccaagaacttgctaccggatttcacctataatgcctatagatttggatggattccttttctcaaggtcccccaaatatcctaagattcctgggcctgccgggaagtagccttactaactcacctccaaggctgggaaccctgaatgcaggcaccagtatgctttttccaagagggctttgtaagcataggctccataaagtcaaccttatttccttaaagctatcattctcaaatgacattccaatctaatccttggtcataaccagttatgtcttgttacaaggaggacagattctcattgaaactatgcaaacaactatattgccatgaaaatggggacactcaataagagttttggaactctggagggatcaggcagggagaaaaataagatatttcatttctgtttacaaaagcataatgtacgaaattgttgtaagttatagatagctcacaaagaaaagagagacgggttccttaaatccaggataaaattttaaacaaagccataattttattcatcagttcatttagtccaatgtaattaattcttgttctgcttgatctaaggttagtagttttttatgaatcccccagcttctccactagagttttggaatatatgatataatctcaaagttatttatgcaataccttcagaagcctgcaccctagagtacttggcatattccttttccatgggtttccttttgttgaaaacaagtattatagcttattatagcttctagaaaaacttcagaataaaacaataactatccaggataagaagagacttaaatggtgtgattaatgatctgatgagagttcactataaaaatagcaaaattgatgaggaaatttggttgtttctgtggcatagaacttctaaaataaaaactggaattatgactataatattatgctattgttgtctaatatcaggcaaagcaataccagcacacatcatagcgtgggcattgacaaatttctaggaacttcatatacttcctgaaatatttatattcataacatttacataaaatatgtgtaaaaatataaccttgggaaagttatctcttcttacttgacaaagcttttcatgcatttcaacatatctaattttattttattttattttttcatttttccatcactccctatcctaattaatttttgatatctctttttttaataaggtaaaataacaaatcctttgagattttccaggggctttctggaaagtcaggaatttatagcagctgaacttgaacttccaggataaaagggtcatcattcttctcccacactgtaaactcctttgtgggggtgagggagtcaatggaagccgtattttcaggaggctctgcttaagtttaatgtttctttctgtggctgctgattgttcgaatgttttcagtttaaaataatcttcaaccattttggtgggctgttcatcacttcacatttaaagccatgcatcttccactcagtattgccttgtctttatcccataagctattaccaagtgatattgatattaacatccttattctcattgtagttattttatgaatatctgtggttgtgattttaatcttctcttttatctgaaattttttagggaagtggtttgattttcattgggtgtgattattgtgtgtgcttgtcctcttgtctttaatttctaaatttttgcattgtggttagaaaatatgacctgtgtaatttctacttttgttttaaattaagatcttttattacagcctcatataggatcagtttcatagatgtccatggactttcaaagagaatgtgcattctctgtttataaggctcaaacttatgtatagtgtggttaaatatagcttactatgatattcaaatcttccataacttcattattgttgacatggtctatcttattctgagaaagtaaaatttcccagttcactgtggtcttatcttctccacttatcactgcatttgtaaaacttttgctttatgtatttagatactgtgctctttggtacctgcagtttcatgacaatgaggttatacttgtggatatcttttatcaatacaaaataagtatcttcgctccatctaatatgtttagctttgaattacatttaatctgatataatatttccattcctaggcccacactgtaccacaataaattttatagtgaagtgttctaagcaatgtcctccaagtcttgggcatagataattttgacatgggacaatgaagaatggatcttagacaactttactcaagtctcctgccccatgttgttttgccttttacatttagatctaccacccacacgtaatcgattttcacatatggtgtgatatagaaatcacattttatttttaaaaatatgaatatccaattgactaagtaccatttattgaaaaggtcattctttccccctattgcagtaccacctgtgtcacagattaaatgtccatatatgtgtacatttgttttgggattctctgttctatttgtcaacaatacactgtcttaattaccatagacttatgataaatcttgatactggcagagtaagtctttccaccttgttttttaagattatcctttttattcttagttgtctaatttttccacataaacatgagagctcaaaaaaaaaaaaaaaaaaaagcctgggtgccatggctcatgcctgtaattccagcactctgggaggccaaggcaggcagattgctagagctgaggagttcgagaccaccctgggcaacatggtgaaatcctgtctctacaaaaagtgcaaaaaattagccaggcatggtgacatgtgcctgtggtcccagctactcaggaggctgaggtgggaggatcacctaaccctgggaggtggaggttgcagtgagccaagatcacaccactgcactccagcctgagcagcagagtgaggccctgtctctaaaattaaattaaattttaaaataatcattttggggatcttgaatgggattgcttcaaatttatagatcagtttgctagtggggaaactgacatttttataatatattaagcctcctaatctctgaatgtggtatagcccacaatttatttattgaaggataattaagtgtcttagtttcctcctataatgttttatagatttttatagagaggcttcgcatatctgttgttagatttattcctagatatttgatatttttacactattgtaaatatcttttaaaaatcatttttcaaattgttcatggctgttatgttgtagtggaatgggcttttgtatattgattgaccttatgtctggcaacctttctacacagacttactaattctaagatttatctgtatattattttgtatttctctatataatgtaaatttttgttctttactttccaaactttataatttaaatttgtttatctactggctaataccttaaatagaaatggcattaacaggcatccttttgttgatctcagaattaactgaaaagttttcagtatttcatcattaaggataactttgtgaatactcattatcaggtcaaggaagtgtctgtatttctgatttgctaagagttttattaggaatggtttgtttgttttaattgaattgaattttataaaatgtttttttctgtgtttcctgaaatgatcatatgattcttctctattctgttgaagagatgaattacattgattgacttttttatgtatttattttgttaatttcaatttagtcttgatatacaattctttatatgcagtgctggattttgtttgctaatgttttgtttaggatttttgcacctatattcatgagtgagattggcctgcaactttcacttcttgaaatgtccttccttgccagactttggaaatgaagtcatgctggtctcataaaacaagttgaagagtattctctcttctattcatttcaagtttattactgagtttattttaaaagttagtttattacttccaaagaatagaagagaaatacttttaaagtacatgtgataatatattcatataatttctaaagatcaaatcagtgtaattgggatattcatcaccttaaatatttgtctcttctttgtgctggaaacattgaaattattctcttctagctattttgaaatatataatagattattataaactataggcaccctattgagctatcaaacactaggtcttatttcttctattaaattatatatttctacccattacaaattttcctctcctccccaccccactccactgttcttcctggtctctggtaaccaccaatctactctccaccttcatagatccatttttttagctcccatatatgagtgagaatatgtgatatttgtctttctatgcttagcttatttcacttagcataatgggggcatccaattctatccatgttgttgcaaatgacaggattttactttttaatggctgaacaatattcgattgtgtatatataccacatttgctttatccattcatccattgatggagacttagcttgattccatattttggctattgcgaatagtgctgcaataaacatggaagtgcagatagctcttcagtgtactgatttgatttcttttgaatatatacctagcactgagattgctggatcatatggtagttgtagttttttagttttttgaggaaactccatatagttttccatagtgattgtactaatttacattcctacaaacatatgtatatgtttgggttccccttctctacattctcaccatcatctgatacttttttgataagcaccattttaactgggatgagatgttatctcattgtggttttgatttgcatctctgtgatgattagtgatgttgagcattttttcatgtacctgttgtccattcatatgtcttcttttgagaaatgtctattcagatcttttgtccatttttaatgagtttttttgctattgaattatttgagctccttatattctggttattaaacccttgtcagatgggtagttagcaaataatttctcccatcctgtggattgtcttttcactttgttgattgtctcctttgccgcgcagaaactttttaactcgacgtaatgccgcttttgtctatttttgctttggttgcctgtgcttttgaggtcttacacaaaaaatccttgtccagaccaatgtcctggagtgtttccccaatgttttcttctagtagtttcattgtgtcaggtcttagatttaagattttcatccatttttattttatttttgtgtatggtgagaggtagggatctagtttcattcttctacatggttgtaaactgtagtcaccctactgatctatcaaacactgggtcatacttcttctattaaactgtatgtttgtacccatcaatcaacttctctttctctcccccacccctctactcttcctgacctctagtaaccagcagtctattctctatcttcatgagatccacttttttagtttccacatgtgagtgagaacatttgatacttgttttttttcacatttgttatactcctgggctgaagtgatatataggtatgtaacactgtgcccagatggtgaataatatttttaatgtgttgttgaatttggcttgctagtattttgctgaggacttttgtatccagttttcccagcaccatttattgatgagactttcctttccccgctttgttattgatgccttcgtcaaaaataaattggctgtagccaggcacagtggctcacacctgtaattccagcacttttggaggccgaggtgggtggatcacttgagttcaggagttcgagaccagcctggtgaacatggttctactaaaaatacaaaattagccaggtatagtggcacacgcctgtagtaccagctacttgggaggctgaggcaggacaatcacttgaaaccagagggtggatattgcagtgagttgagatcgtgccactgcactccagcctgggcaacagagtgagactccatctcaaaaaataaattaataagttaaaaataaataaataaataaataaataggctataaatgcatggatttatgtctgagttctctattctgttccattggtctatgtgtctgctttttacaccagtaccatgctaatttggttactatctctttgtagtacattttaaagtcaggtagtgtgatgcctctagctttgttctttttgcttatgattgctttgggtattcagggtctttgtggttttgtataaattttagcattgttttttctgtttctatgaagaatgtcattagtattttgataagcctttctttgaatctataaattgctttgggtattactgtcgttttaacgatattcttctaatgcatgaccatggattatctttccatttttgtatgtatgtgtcctcttcaattttttttatcagtgtgttttagttttcctaatataggtctttcatttctttggtgaaattgattcctaggtattttatattttttatagctattgtaaatgggattgctttcttgatctctttttcagattgtttactgttggtgataaaatactactgatttttgtattttagttttgtatcctgcaactttactgaatttatttattagttctgacagatttttggtggggtctttaggtttttctaagtataagatcacgttgtctgtgaacaaaacaaatttgacatcttccttttcaatttggatgccctttctttctcttgcctaattcttctgtccagaattcctagtattatgttgaataaaagtgatgaaagtgtgcatccttgtcttgttctagatcttagaggaaagtcttgcaactttttttcatttagtatgatgttagctgtgagtttgtcatatatggtcttcattattttgaggtatgtttctttctttctttctttctttctttctttctttctttctttctttctttcttttctttctttctgtctctctctctgtctttcttcttcttttttttttttttaaacagggtttcacccttgttgcccagactggagtgcaatggcatggtctcggttcactaacacctccacctcccaggttcaagcagttctcctgcttcagcctcccaagtagctgggattacaggtgcctgccaccactcctggctaatttttgtatttttagtagagatggggtttcaccatgttggccaggttggtctcgaactcctgacctcaggtgatctgcccgccttggcttcccaaagtgctgggattacaggtgtgaaccactgtgcccagtgttttgaggtatgttccttctgtactcattttgttgaaggtttttatcataaagggatgctgacttttattgcatgctttttcagcatctcttgaaatgatcacatagtttttgttcttggttttgttaatgggatgtatcacatttattgatttgtgtacattgaaccatccttgcatccctgaaatgaatcccatttgatcttggggaataatttttttttttttgagacagaattttgcaatgtttcccaggttggtcttgaactcttgagctcaagtgatccccctggctcagtctcccagtagctgatactgtaggtatgtaacattgtgcccgactggtgaatgatatctttaatgtgttatggaatttggtttgctagtgttttgttgaaatttttgtgtctatgttcttcagtggtattggcctgtagttttctttttttgttctgttcttatctggttttgatattacagtaatgctgtcctcatacaatgagtttagaagtattccctcctcttcaatttttttgaagagttacagtaaaattagtattcgttctttaaatgtttggtagaattcatagtgaaaccatcaggtcctgggcttttccttgatcgtagactttttattatggcttcgattttgttattcattattggtttgttgaagttttctatttctttgttgttcaatcttggtaggttgtatagtcaaggaatttatcaattttctctaggttttccaatttgttggtgtgtaattgttcataatattctcgaatgatcctttgtatttttgtggtcttagttgttatatttccttgtatgtttctgattttatttgagtcttttctctctttttcttagtctagctaaaggtttgtctatttttgtacctttcaaaaaccaatttttcattttgtctatcttctatattttttggtctcaatttcatttatttctactctgatctttgttttggctatgaagaaatgatttttttttaaacttttaagttcaggggtacatgtgtaggtttgttacataggtaaactcatgtcatgggggtttgttggacagcttatttcatcacccaggtattaagccagtacccatgagttatttttcctgatcccttccctccttttaccctccaccatccagtaggccccactgtctgttgttcccctgtatgtgtccatgtgttctcatcatttagctcccacttatgagtgagaacatggagtatttggttttctgttcctatgtttgtttggtaaggataacggcatccagctccatgttcctgcaaaggctgcatagtattccatggtgtatatgtatcacattgtctttatccagtctaccattgatgggcatttaggttgagtttatgtctttgcttttatgaatagtgcttcagtgaatatactgtgcatgtgtctttatgatagaacaatttatattcctttggttaaatactcagtaatgagatttttgctcccatctttatttcatttcttccactaattttgtgttttgtttgctcttgcttttctagtttcttgaggtacatcgttaagttgtttatttgaagacttcctacttttctgatgtgggcttttattgctatgaactttcctgttagtactgcttttgctgtatctcatggattttggtatgttgtatttccattttcatttgtttcaagaaatttttaaatttccatctgaatttcttcattgactcattgaaaatgattgtttaatttctatgttttgtgtattttttgaggtttctctttttattgatttctagttttattccattgtggtcagaagaaatacttgatatgatttctacttttttgaatttgttgagacttcttttgtggcctaagattctggagaatctattctggagaatgtttcatgtgctgttgaaaacaatgtgtattctgcagcagctggttgaaatgttctgtaaatgtcagttaggtctgtttggtcttgtgtgtagtttaaatctgctgtgtctttgttgattttctgtctagataatctgtctactactgagagtggagtgttgaagcccttactactattacgttgcagtctatctctcccttcacatttattaatatttgctttgtatactcgaatactctagtgttgagttcatagatatttataattgttatatcctgttgatggattgactcctttatcagtatatagtgatcttctttgtcttttttagaagtctttgtagtcaatttcatctgatattaatatagctactactgctcttttttggttttcagttgcatggaatatatttttccacttccattttcagtttatgtgtgtcttaataggtgaaataggtttcttgtaggcagcatatagttgggtcttgcttctttatctattcatttgctctatgtcttttatttttactttttttttttttttttttttgagacagggtctccctctgtcacccaggctggagtgcggtggcaccatctcggctcagtgtagctcgacctttcaggctcaagcaatcctcccacctcaacctcctgagtagctgggactacaggcacatgccactgcaactggctaattttttttttatttttagtagagatggggttttgccacattgtccaggctggtcttgagctcctgaacacaagcaatttgcctgagtcagcctcccaaagtgctgggattataggtgtgagctgccgtgctcaacactctatgtcttttaattagagaattgacttcatttaaattcattgttattaatgataagtaaggattttatttttagtttttaaaatttttaaatatatttttggagacagggtcttgctctgtcactcaggctggagtgcagtggttcaatcttggcacaccacaacctctacctgccaggttcaagtgattctcgtgcctcggcctcccgagtaactggaattacaggcacatgcccctgtgcccagctaatttttgtattttagttgagatggtgtttcgccatgttggccatgctggtcttgaacttctggcctcaagtgatctgcctgcttcagccttccaaaatgctgggattataggtacaagccactgcacctagctgataagtacaggctttcaactgccattttgttgcttattttctggtggttttgtgactcctcttttcctttcttcctttcttactgttgtcctttatggctaagtggttttctctggtagcatgtttgaattcattgcttcttttttttttttaactttttaaaaatttttccgtaagttattcgggtacaggtggtatttggctacatgagtaagttctttagtggtgatttgtgagattttgttgcacccatcacccaggcagtatacattgtactctatttgtagtcttttatccctcatccccctcccagctttccccccaagtccccaaagtccattgtgtcattcttttttgttgttgttgttgttgttgttgagacagagtctcactctgtcacccaggctggagcgcagtggcacaatcttggctcactgcaacctctgcctccctggttcaagtgattctcctgcctcagcctctcccgagcagctgggactacaggggtgcaccaccacacccagctaatttttgtattttttagcagagatggggtttcaccatattggccaggctggtcttgaactgctgacctcgtgatcttcccgcctcagcctcccaaagtgctgggattataggcataagctatcatgcctggcttgtgtcattcttatgcctttgtgttctcatagcttagctcccacatatcagtgaaaacatatgatatctggtttccattcctgagttacttcacttagaataatagtctctaatctcatccaggtagctgcaaatgctgttaattcattcctctttatggctgagtagtattccatcatatatatcacagtttctttttccactcgttgattgatggcaatttgggttggttccatgattttgcaattgcgaattgtgctgctataaacatgtatgtccaagtgtcttttttgtataatgactattttcctctgggtagatccccagtagtgggattgctggatcaaatggtagttctacttttagttcttcaagaaatgtccacaccgttttccatagaggttgtactagtttacattcccaccagcagtgtagaagtgttccctgatcaccacatccacgccaacatctactgttttttttaatatatttttttattatggccattcttgcaggagtaaggtggtgttgcattgtggttttgatttgcatttccctgatcattagtgatgttgagcattttttcatgtttgttggccaattgtatatcttcttttgagaattatctattcatgtccttagctcactttttgatgggattgtttgttttttttcttactgatttgtttgagttcgttgtagattctggatattagtcctttgtcagatgtacagattgtaaagactttctccctctctgtaggttgtctgtttattctgctaaccgttccttttgccatgcaaaagctctttagtttaattaagtcccaactatttatctttgtttttattgcatttgtttttgggtttttggtgatgaaatccttgcctaagccaatgtctagaagggtttttccagtgttatcttctagaatttttatggtttcaggtcttagatttaagagttggtttttccaaggtgagagatgaggatccagtttcattctcctacatgtggccaggcaattatcccagcaccatttgttgataagggtgtcctttccccactttatgtttttgttttgtcaaagatcagttggctgtatttgggtttatttctgggttctctattctgttccattggtctatgtgccgatttttataccagtatcatgctgttttggtgactctcatgctgttttggtggtgtgatgcctccagacttgttctttttgcttagtcttgctttggctatgcgggctcttttttggttccatatgaattttagaattgtattttctaattctgtgaagaatgatggtggtattttgatggggattgcattgaatctgtagattgcttttggcagcatggtcattttcacaaatattgattctacccatccatgagcatgggatgtgtttccatttgtttgtttcatctgtgatttctttcagcagtgttttgtagtttccttgtagaggccttttgccttcttggttatgtatattcctaagttttttttttttttttttttttgcatgctattataaaaggggttgagttcttaatttgattctccacttagttgctgttggtgtataggagagctactgattttgtacattaatcttgtatccagaaggtttgctgaattcttttatcagttctaggagctttttggaagagtctttagggttttcgaggtaaacaatcatctcattggtaaacagtgacagtttgacttcctctttactgatttggatgccctttatttctttctcttgtctgattgctctggttaggacttccagtgctatgttgaagaggagtggtgagagtgggcatccttgtcttgttccaattctcagagggaatgctttcaacttttccccattcaatatcatgttggctgtgggtttgtcatagatagcttttattacattgaggtatgttccttgtatgctgattttgctgacagttttaatcataaagcgatgctggatttcttcaaatgctttttctgcatctattgagatgattgtttgatttttgtttttaattctgtttatgtggtgtatcacatttattgacttgcatatgataagccatccctgcatccctggtatgaaacccactggatcatggtggattatctttttcatatgttgttggatttagttagctagttttttgttaaggattttggcatctatgttcatcaaggatatcagtctgtagttttcttttttggttatgtcctttcctggttcatccatagaatgaattagggagggttccttctttctctatcttgtggaatagtgtcagaaagattggtaccaattcttctttgaacgtctggaagaattctgctgtgaatctgtctggtcctggacttttttttgttggtaatttttaaattaccatttcaacctcactgcttattattggtctatttagggtatctaattcttcctgatttaagctaggagggttttatctttccaggaatttatctatctcttctaggttttctagtttgtgtgtataaaggtgttcatagtagccttgaatgatcttttgtatttcattggtgtcagctgtaatatctcctgtttcatttcttaatgagattatttgaatattctctcttcttttcttggttaatcttgctaatggtctgtcaattttatttatcttttcaaagaaccatcttattgtttcatttatcttttgtattttttttgtttcaatttcatttagttctgctctgttcttggttatttcctttcttctgctgggtttgggtttggtttgttcttctttctctagttccttgagatgtgaccttagaatgtcagtttgtgctctgtcagtctttttgatgtaggtgtttaaggctatgaacttcctcttagcaccacctttgctgtatctcagaggttttgataggttgtatcattattgtctttcagttcaaagaatttttaaatttccgtcttgatttcatttttgatgcaatgctcattcaggagcagtttatttaatttccacatacttgcatggttttgaaggttccttttggaattgatttacagttttattccactgtggtctgagaggctgcttgatgtaatattaattttcttaaatttattgaagcttgttttatggcctatcatggtctatcttggagaaaggtccatgtgctattgaatagaatgtgcattctgtagttgttggatgaaatgttctgtatgtatctgttaagtccatttgttctaagatataggttaaatccattgcttctttgttgactttttgtcttgatgacctgtccagtgctgtcagtggagaactgaagtcccccactattattgtgttgctgtctatctcattgcttaggtctattagtaattagtaaatttgggacctccagtgttaagtgcatatatgtttaggattgtgatatcttcctgctggacaaggccttttaccattatataatgtccctctttgtctcttttaactgctgttgctttaaagtttgttttgtctgatataagagtagctacccctgcttgcttttggtgtccatttgcatgaaatgccttttcccacccctttactttaggtttatgtgggtccttatgtgtgagtctcctgaaggtagcaggtggttggtgagttcttatcaattctccagttctatatgttttaagcggaacatttaggccatttacatttaatgttagtgttgagatgtgaggtaccattacattcgtaatgttatttgttgtctgtgttccttgtttttgtttttgctttttaacatgtatttttgtataggtcctgtgtgatttatactttaaagaggttctgttttgatgtgtttccagtatttgttttaagatttagatctccttttagcagatcttatagtggaggcttagtagtggcgaattctctcagcattcgtttgtctgaaaaagactgtatctttccttcatatctgatgcttagtttctctggatacgaaatccttggctgataattgttttgtttgaggaggctgaagatagggccccaatcccttctagcttatagggtttctgctgagaaatctgctgttagtctgataggttttcctttataggctatctggtacttttgtctcacagctcttaagattctttccttcatcttaactctagataacctgatgacagtttgcctaggcaatgatctttttgtgttgaatttctcaggtgttctttgtgcttcttgtatttggatgtccaggtctctagcaaggctggggaagttttcctcgatttttcccccaaatatgttttccaaacttttagatttctcttcttcctcaggaatactgattattcttaggtttggtcgtttaacataatcccagacttcttggaggctttgttcatattttattattcttttttctttgtttttgttggattgggttaattcgaagatgttgtctttgaactctgaatttctttcttctgcttgttcaattatgttgctgagacttaccagagcattttgcatttctataagtgtgtccaatttttcctgaatgttttattgttttttctttatgttatctatttccttgaatatttctcccttcacttcttgtatcgttttttggatttccttgcattgggcttcgcctttctctggtgcctccctgataagcttaataactaacctcctgaaatctgtttcaggtaaatcagggatttcttcttggtttggatccattgctggtgaactagtgtgattttttggggttgttaaagagccttgttttgtcatattaccagagttggttttctggttccttcttatttgggtaggctctgtcagagggaaagtctagggctgaaggctgttgttcagattctcttgtcccacagggtgttcctttgatatagtactctcccccttttcctatggatgtggcttcctgtgagctgaactacagtgattgttctctctcttctgggtctagccacccagcaagtctacccagctctgggctggtacggggggttgtctggatagagtcctatgatgtgaaccatctgtgggtctctcagccgtggataccagtgcctgttccggtggaggtgacggttggtggtggggtcggggtgggggttgaaatggactctgtgagagtttttagctttggtggtttaatgctctatttttgtgttggttggcctcctgccaggtggtggatggggccctagaactccccaaattatatgctctttgtcttcagctaccagggtgggtagggaaggaccatcaggtagggggcatggctaggcatgtctgagctcagactgtccttgggtgggtcttgctgcagctgctgtgggagatgggggtgaggttcccaggtaagtggagttgtgtacctaggaggattatggctgcctctggtgagtcatgcaggttgtcagggaagttggggaaagctggcagtcacaggcctcacccagctcccatgcaaaccaaagggccagtctcattcccactgtgccccacccagtagtctgtttccatgtgatgggcgagctaggcttgagaacttgccccaggctgcccacctcccagctgagaaagaaaagggcttggttcttcccccttctgtggagactgcacactggattcatgccctctgcccgagttctggccaggaggcttctcaccaccagttcaaattgttacaaacttcagctgaagatttccttctccccgtggtgtttttccccactcctctggccgcccttctgatggatccctgtggtgccaggcaggaatggcctgcctgggaacccagcgagttcccagggcctttcccactgcttcctctacccctatatttcgctcagctctctaaattgactcagctccaggtaaggtcagaaatttctcccacaaacagacctccagtttctgcagtgggggtatgtatttgggagaggaggatctccctttcccactttcacagttggggcactcacagtatttgggctgtctcccgggttctgcaggaggcagtctgcttccttcagagggtctgcgggtcctttcaagattgctggtttgtttttgccattgatctggagctaaaattcacaatgcaagcctctgcacgctgctttatccatccgagttgaagctgcaatctagtcctgcctcccgtccgccatgatgatccaaactattgcttacttttctgctttttatttttagtgtatctatgataggtttttgcattatagttgccatgaggcctatgaaaaacaccttacagaaataacacattatttttaaaagatgacagcttaccttcgatcacaaaaaataaaatcaaagaaaaatctagaaaaaagctctatactttaactccattccccaagattttgacttttggttatctcaatttacatatttttatactatctatctcttaacaagttgttataactattattataattgttataactattattataatagttataactattattgtttttgacagatttttcttttggacttcatactagagttatgaatagattgcactccccaaggacagtattagaatattttgggtttgtccatgtacttaattttaccagtatgttttataccttcagatgtcttctttttgtacaaatcattggtttcattttctttcagattgaagaactccctttcacatttcttgtaagatgggtctgtttgtcgtgaattctctcaagttttgtttatttgggaaagccttttatctttccttcatatttaaaggacaagtttgctggatacagtattctccaaaggaagttttttaatttcagcaattttgaaaatgtcatctcactcccacctgccctgtatggtttctgtgaagaagtctgttgccagatgaattggagctctgtacttgcttcttttcccttgctgcttttaggatcctctctttattcttgacttttgatcagtttattatatgccttgggggagtcttatttgagtcacatctgtttgatgctctctcatcttcctgtacctggatatttatctctttctcaaattttggaaagttttttttttttttaataaactttctacccctattcttgctcaactccttgaacaccaataattcttagatttgtttttttcaggtaattttctgtatcttatagacagtctttgttggttttcattcttttctcttttttgtcctctgattatgtattttcaaatagcctgtctttgagctcactgattctttcctctgcttgatccattctgctcttgagggcctccagtgaatttttcagtttatttgctacattttcagtagcaaatgtatttgtcagttccaagatagccacttgattttttaaattgttatttcaattattttgttaaatttatctgataaatttatgaattgctcttttgtgttatcttaaagatcactgagtagccgggcgcgatggcttacacctgtaatcacaacactttgggaggccaaggcgggcagatcatgaggtcaggagtttgagaccagcctggccaacatggtgaaaccccgtctctactaaagatacaaaaaattagccgggtgtggtggtacgtgcctgtaatcccagctactcaggaggctgaggcaggagaaccacttgaacctgggaggcagaggttgcagtgagctgagatcatgccattgtacttcagcctgggtgacagggcgagactctgtctcagaaataaaaaaaaaagatcactgagtttccttaaaactgctattttgaattcttgatcatagagctcacatattgccgtcttattagggtcagtcactggctccttgctttatcaatttgagaggaccatagttccatgtttcctgatgtttcttgtggtgtgtgtttatgtcttgcattgaaggacagttcaattgaaggacagttgaagttatttgttccattctccctctggcttgttttttattgggatatttgcttatagattctgtgtaatttacctgctgactttcttttttttccccctgctaggtagctgcctcctttttggcactagatggcactttaagcccaggtttgcatcaattctagcaaacagtcagagtgccacccatcctgaatggaggaggtcccaaagggatatcccagtagtgtgggaaggctagctaggggttcatgcccaggggacctgtggaacaaatctcctacagtgtggtgctgctgaactgccatgctaatttggagtctcctttggttgagttacagagcagaatttccatggctgaggatgatagtcccacctccccactttgtttctggctgtgtttagggatatttctttcttcaagtatacctgatgccttccatgagttgaggcaggaaccgatctcctgccagggaacccaagatagtagggaagctggttgtccacctcaatatcagtttgctgtgtagaaactgtgagttgagggaaattttccatacacttgtactgggcagattgggggaaagtgtgtcatagatacagaagtctgattctcttaccatctactcagtttttacacttctctgtggctctaggaactgtctctttctcatatttgagttctgggatattgctggtaataacctgggtgctgtgtatttgtttttgtttttttgtggatggggagggggagtaaagccagcttgcttctacactgccattttggaacctgaagtttttgtgggaaggtttttaattgcagtttataatttaaattgttatatacctatttgttatatttggtagttcataatttttatatgaatatatacattttctttacattttcaaacgcattaggataaagttgaagccattttcatttttctcttattcaacttttaatgttcaaagtagtaatgttgcctttttcagttttcatgatattgagtatttgtgttcattttctcttcttaaacagtcttactggtggtttatcaattttattagtcttttcaaaaaatcaacttttggcttgtttgatccttctctataatttgttaccaagtttatttcttttctttcctttattagttccccttttgtattcctgggcttatttgatgtttttttaatatatatatattttaagtagactcttaactcattgatttttcagcttttcttccatactaatataagtatttaaactataaatatccttctattcttggtcttagctgcaacccacaagttttggtatgtaactaatgtatgtattatcaatatgtttgaaatttcattttatatattctttgacttacgagttatttaaaatattatttatttattaacatgggaatgttcttgtttttttatttttaattgtggtactctttcaacaaatttttaagtgttcaatgcaaaattgttaactataggtagatgttgtacagcagatctctagaactaacttatcttgtgtaaatgaaaggttatacctatttaatagcaactccccattttcccctcttctcaggctcctagcaactaccattctactctctgcttctattaatttcactattttagataccttataaaagtggaattgtgtattatttgttctgtgcctggcttatttcacataacatagtgtcttcaaatttcatccatattgttatatattgcagattttccttccttttaaaagctgaataataatagtctgttgtatatatatatatgccacattttctttatccatccaggatatcctcgttttttgttttgttttgttttttactaggctttagtttaattgcattgcagtcagagaacctactctgtgtgtttttaattcttccaactttgttaagcatatgttccatttttgtaaggattccttgagtccatggaaatagtgtgaatcccataatttttaggttcagtgttctgtataaatcagtcatatttgctaataatgtcatattttatccttattaatattatcacttttttgagcagttcatgagaggtgtgttaaaatctcctgctttgattatggatttattgactcctactcataggctgtctatcatttttttcattatagattttaagtctatgttatttaaggcataatttttaaattattctatcttccttgaaattttgatcagttatgaagtttccttctttagtgatgtttttgtcttgaagtctactttttctgattttaatatggccacatcagctttctttgatttttacttacatgccatatttttttcctgtccttctatttttaccctttctattttcttatattttagatgtgttgcccataaacagcattgagtttggtaggctttgtttttaatctagtgtcataattattgtcttttaattagagtatttagtccatttacatttaatgttcttatgggtttttatctaccatcttactttctacatgtcctctatattcctgtgtttcatttatggtactatttattggtgttttattctttcttactatcaccagtgatatgttaatttaattggcattttcaaagaatcagcctcaagattttgttgattctattacttcttgcaactgcgtcaataatccgttgccacaataatgctactaacaaacagctacaaaactacagtggcataccacaataagcatgtattgttcatgcatttggtgtcaactaggcagctctgctgatcttggctgagtctactcacatgtcttggagtgttttggctgacaggtgatctagtcaggctttggctctgttgcatgtccctctcatcctttaggaggctatcttgtacaggttctcatggagagggcagaggcacaagagagcaaatggaaacatgcaagacctcagaaggtttaggctttgaactaacacatgccacttgtccaagcaggtcacatgattaaacccagaatcagagtgagagggggccacatgaagcaaagggcctaaatacagggaatatgaagaatcagagtcatcattgcaacccatgttcacacacaaaaagaagaatgctgatgacttttgtcatggtcttctttttcctgacctaaggagacacaaacttcagcttaagattggtctcctgatttgtgatacaatgagaatggggaaatggtatctgttttcctggaggaggctaagaccttatcccaagtctcatctcaagatggtgatttgggaattgtcaacgtattaagctcaagtttattgtactggttggcctggagtctacaccacatcccaggtaggaggagtttcactgaaaattttgagaaaagccctttgtcctttcatgcaacccgcctagtatctttctttgtatcactgtggactttattatcaacctcttgtcattcattcagtcattaaacaaatactgagtgcatcccatatactagactttaggaacatagtctagtatgtagtgagtccagtaccagccaatgacaagataaacatgcaagacaaacaactttacaataacatcattgtcttgaaggataaaagagtgtggtgggaccagagcagaattacacctaagtcatcttgagagcatccacatagacttcatagcctccacatagacttcatagacctcaaagcttttgagtaaaacttcaaagcaaattggagctttctaggtgaataagcagaaagattttcctagcagtgatatcaaagagtgtagaataaggagatattcaagaccatggcttattgggggaaagtacaagttcagtgttgctggagcatcaggtgagggagtggcaggagacaaagcaggacaggagaactgaggccaggcaatcaagaccttgcatgccttgcaagagagtttggattctattctattacatcggtcatatgtgatgatgaaccattggaaatatttaattagaatgcattacatgctcagtttctagttcacaggaagactttacaaaggccactatggcgtccaggaaggagatgaggagggattgaaccagaacaataactatggattagatctgggaggtattttagataattaatggaacttgatattttattggatatggggaaaggagattgtggaaaaggggactatcaaggatgatttcagaaactgggtagatggtggaaccattttgtgaggtgagattaataagagtgaatggattatttgatgaagatgctgagatggtaacaatcatttctgatttggacaggtagagagtttgactttcctagtaagcatttgggtaaatacactgcattcagtcagccacaggtgcctattaaagtagacagaaaaatggcctcactaaagacacccttgtataatctctggaacctgtaaatgtcaccttttttttttttgaaaggtctttgtagttgtgattaaagatcttgagataaggagattatcctggattatctaaggtgccctaaatgctatcacaggcatcctgtgataagggagagacagagggagattataaagacagaaaaggaaaaggcaatgtgattatggaatcagattggaatgatgtaacgagccaaggaatgccaaagccaacagaaactggaagaaacaaggaacagattctcccctagagcctctggagtgagcataggcctgctgacaccttgatttcagcccagggatactgatttccaacttcttatctctagaattgtgagagaataaattcctgttgttttaagccactaagtgagtggtaattttttacagcagcaacaggaaactaacacaattatgaagaagacaaaaggaaatgaggccaaccatggcacaaaaacatgtcaagaaataaggacttactcactcttcagaaagaactccttgaaagaattgtctgtgctcaatgttaattttttgctttttgtttttttgtgtatccattgtatgtttttagatttgagggatgaggcttgcaaataatataacccattattttaaactgatgacaacttaacactgattgcataaacaaacaacaactaacaagcaaaaagaaaactaaaaaactacactttatctcctggcttttttgttgtttctatttatatcttactgtactatgtcttgaaacattatagttattatttttgatcttttcatctttctacttatgagtagtttacataccataattacagtgttataatagtctgtgcttttctgtgtatttactgttaccaatgagttttgtatcttcagatgatttcttattgcttattaatgtccttttctctcagattgaagaactccctttaacatttcttgtaggactggtctggtgttgatgaaataccttttgtttgtctaggaaagtctttattactctttcatgtttgaaggatatttttgccagatatactattctagggtaagagtttttcttcttcagcactttaaatatgttatgccactctttcctggcctgcaaggtatccactgaaaagtctgctgccagacgtattggagctgctttgtgtattatttgtttttttttctcttgctgcttttagggtccctttttttacccttgacctttgggagtttgattattaaatgcctcgaggtagtcttctttgggttaaatctacttggtgtttatacttcttagacttgaatattgatatctttctctaggtttgggacgttctctgttactatccccttgaataaacttgtatccctatctctttctccacctcttctttaagggcaataactcttagatttttccctttgaggctattttctagaccctgtaagcatgcttcattcttttttattcttttttcttttgtctcctctgactgttaactttaaaatagcctgttttcaagctcactaattctttcttttgcttagtcaattctgctattaagagactgatacatttttcattatgtcagttgcatttttcaactccagaatttctgcattatttttaaaattatttcaaattatttgttaagtttatctgataggattcgaattccttctccatgctatctagaatttctttgagttttcctcaaatcagctattttgaattctccatctgaaaggtcctacatctctgtctctctgggattggtccctggtgccttatttagttagtctggcgaagtcatgtttttctggttggatctgatgcatgtggatgtttgtcagtgtctgggcactgaagagttagatatttattgtagtctttgcaatctggacttgtttgtacttttccttcttgggaaggctttccaggtattcaaaggaacttggatgttgtgaactaagtttttggtcactgcatctatatctgcattaggtgggtacacagagcccagtaacattttggttcttgcagacttgtagaggtgccaccttggtggtcttggataagatccagaagaatactctggattaccaggcagagactcttattctcttcctttactttctgtcaaacaaatgaagtctctctctctgtgttgagccacctgaagctgggggaggggtgacacaaagcacccttgtggccaccaccactgtgactgcaaagggtcaaaccttaaggcagcacagccatgggtcttgcccaaggcccactgtaaccactacctacattctctcaaggccctagggctctgcaatcagcaggtgatgaagccatccaggcctatgtccttcccttaagggcaacaagttcccctggccctacagaggtccagagatgctgtctgggagccagagccaggagtaggaaaccttagaaatctatctggtgctctgttctactgcagctggcctgactgtgacagcactaggcaaagtactttccgctcttccctccgtttttcccatgcaaaggagtctctccccatgtccaccaccaccacaggcccacagggagtactaccagggtactactgatgttcactaaaggcccaagggctcttctgtcagcttgtggtgaatgctttcaggcctgggactcatccttcagggcagtgggctcttccactggcctatagtaggtccagagatgccattcaagagccaaagcctggaactggggaccctaagagcctgtttggtgctcttccccactgtggccaagctgacacctaagctcaagacaaagtcccctttactctttcctctgcttttctgaagcagaagtggtctcttctcgtagccactacagctgagaatgtgccggtcacacctgaagtcagcacagctcttagtctcacccaaggcccatggcgagtactacctggctactgctgctgattattcagggcccaggggctctttagtcaccacatgatgaatcctactaggactgggtccttcatgtcaaggcagcagcttcccttccagtccagggtgtgtctaggaatgtcatccaggagccagggcctggaatagggaccttgtgactctgccaggtgccctatccaactgtggctgagctgggatccaagttacaagacaaagtcctcttcactcccctctcctcttttcaagtggaaggaaggagtcggagtctcttttggagctgtgagatgcggtgcctgggattaggggaggggtaacgcaagcactcttttagcagatccagctggtgttttactagctcgcatgtcccctaagtccggtagctcagtcctcgtggcctagacagcctttcaagtttatttaggaccccagagcacttttgcctgtggtggcacggcttgccagaactcaggttccaaccagcaggatgggtgattcccatctggctagggctgatgcaaatgctccctcttggggtgccagctgagttctgcctggtgttgacagcactgcattccattgcaaagtcccacagtcactgcactttctctccccaagtgtacagattttccacgccacgtggctactgccaggggaatggggaaaggttagtgttggcaattcaagactgtctttcctgccctcttcagtgcctctttcagtgatatgaagttaaaaccagatagtgtgatcactcccctgatttttggttcttatgaaggtgctttgttgtgtacataattgttaaattttgtgttcctgtggggaggatgattggtggaagcttctatttgatcattttgcttcacttcctctagcactatttattgtacagtttgttctttccccctaacttgaaatgccatcttcatcatatatcaacatttcataactgtctgtgtctatttctggccttcattctgttctattcttgccccagtaactctctgttttaataactatgtctttataatgtcttaatattcagttgggaatttggctctctttttgttcatctttcttaaatttttgtttactgtttctccatatttgctcttttagaatcaatttatttcatcacacaaaaattaagatttttgatggatatttaaaataaatgtaaaaagcacaaaattatattattatttattcctgaagccctcaacatgtattattttgcactccgtatgtattattcctattagataaagagcggggtagatccagagtcttgtgggacctaaagtctgacccattcaagagccctttttaaggagagtaatgcaaaatgatgaatgtggcattagatgctgtgccttggcggagcctgtgctgggaagatgcctgaacctctaagctttattagcttcatggtaaacccgcttcagataagcagtctcacttagagagaaagtcctgacaaattgtgcctttactcccactagagtaaaccaatagttcatgacttctaaactacttagatggtataagccataaaataacaattaaatcgcgcagcttcagttgtatttttagtcatgtgttacacaataccactgcctcagctttccccaggatagcacctcttatttgaggatctcaggggacattatgaacattaagtaattaaacctcgcaagaccccagagacactggagagagagatccagcttcaccttgcccagttctgaaatgcagtcacctctagggatgaacgtggcagctgcttagtaataaactgcaacacctcacgacagtttagtcaagcaattagtctttgtagttggtaactgtctcatgaacattagaccattgacagttaagtcaccaggattattagtttactgaaaatctaatccagtctttaagactttttacttttttgtaatattttcctaattataaaagaagcatgcacagtgaatgtctacttttagttgcattttttgtagttcttcaaacttaaaataggaaagaaatatctttgtaatacattaaaataggtagttactgataatgaggtttttttaattcacaagttttctgctgatcaaaagtaatcaatgatagtaaaagttggaagagtggatacctttgagaggagtattgactggacggggagatgaggggaacctctgggtgctggaaattttttttttttttttttttttttagtgctgtcttgttgcattttttaaaaaattttttattttttattttattattattatactttaagttttagggtacatgtgcacaatgtgcaggtttgttacatatgtatacatatgccatgctggtgtgctgcacccattaactcgtcatttagcattaggtatatctcctaatgctatccctcccacctccccccaccccacaacagtccccagagtgtgatgttccccttcctgtgtccatgtgttctcattgttcatttcccacctatgagtgagaacatgcggtgtttggtttttttgtccttgcgatagtttactgagaatgatgatttccaatttcatccatgtccctacaaaggacatgaactcatccttttttatggcaatcattaaaaagtcaggaaacaacaggtgctggagaggatgtggagaaatatgaacacttttacactgttgatgggactataaactagttcaaccattgtggaagtcagtgtggcaattcctcagggatctagaactagaaataccatttgacccagccatcccattactgggtatatacccaaaggactataatcatgctgctataaagacacatgcacacgtatgcttattgcggcactattcacaatagcaaagacttggaaccaacccaaatgtccaacaatgatagactggattaagaaaatgtggcacatatacaccatggaatactatgcagccataaaaaaggaaatgttttatatgttctttttttttcctttttttttttttgtttttggagatggagtctcactctgtcatctaggctatagtgcagtggcacaatcttgactcactgcaacctccgcctcccaggttcaagtgattctcctgcctctcctgagtagctgggattacaggtgtgcaccaccatgcccggctatgttttttgtattttaagtagagacgaagtttcatcatgttggtcaggctggtcttgaactcctgacctcaggtgatccaactcccttggcctcccaaagtgctgggattacaggtgtgagctactgtgacaagccagttttatatatttttataggcgttggttgttcaggaacagacatatgtagaaattccctgagctgtacacttttcatatgtgtgttaatctcaacaacaaggtcaataagcctaaaaagcatcctgctcttgtcatgatgagagtgctagaaaccccagatagtcttatttggaaaattctgcagggtgcaggacatatcgggagctagagatatgacagtttttattttcctcaaagcatctttcttcagaagagggattctaagtgatttaccctctcttctcaggacattttctcttcatgccaaaagagctacctttcatgctagaatgtgactctctgtctcattgtgccttcaacattatgtacctcttcgactatgccatttacacctccctaggcatctcatttttatcttagaatttcattcatttacctacatctttgccagaagtaagtataatgcattagtgacccagatatttggggttgagaggcatctgcaggggccattgttgtaactggcactagaagaataccatgggagaggaggaagcagaggaccctggctgctctggctctgcagtgtctgatgtgatgcttgaaaacaagaaggcagagcagcatgcccacactcacggagacagcagcagtctctggagccttcagcaggcccagggtccctcctacatctgtggcagcgcttctgaggaggggcagccatgagcagggtgtcctagggctgctctgagctgagtcccaaaggctgagagcagatgtcatggctgagaactcccagcagagcggacaccactgggtgaggcacaaaggagaggacatcctccaatgatgtcttctcccaggtctccctctttaggcatggagagattacaaaagagaaaaaaggaggggaggaggagggtgaaagacctttgtagacaaaatgggaaatttttagtaaaggttaaatacatgaagcctaagctaccctgattattgactttccagaacttactaaaaaaccaatgctcagctccagttcttcttgaaaataatttctattacgaaatagaaaagtgagcattgtgaccgctggcagagcatgagttcacagtatttccacacaaagagaaagcagcccttgtgctaagccttggcattcaggtaacactgatgtaactcactgtggccttttccaccttctgcctggagatcatttcaaagcccaccatcgaggaagctgataacccattgtttgtaaacttcaaaaggggctgctatgaaaggaacccattgcccagggactggcagaggttgagggcctcctgtggcccaggcctgggccaggtccgttgcccatcttcccatctccacaactcccctgggcagcatcatgtgaatgagggcaaagagaggtggagggagggaggaactagcccagaatccctcctcagtgtcaaaattcgggggggctgcggagacctgctcttcccacctcaaggtactgctctctagaataaaattctttagatccattgtagtctaaaaccatgtgaccatgctgtctaatttcctgtgattctgcagatatttatcatctattttctgtcattattctatcccttctctcaaagatgctgagctcaggagtagcagccaaggttcccaaaaaatagtcgaggagttgcaggaacctgtctctccagataccatggaaaacatccaggtgagagagactatccctccatgcctagggtggggggatgggcctgggggctacctgtgacatcaggggcatctctggtgctggcgtcactacggagaagttctaatgcctgatgcagaaaaggcctcactagcagtaagcacaccgcgagctgggggaaacagaggcctctgtgtttgtaacagacaaatcaaagcctcactggtgtgctccaaaattcaggtcagaacagagtgtcagcctttctctaccttcctccctgacttcaggaggctgagacagataaaactgctcatttaaactcactgggaaatacaggctttctgaagagactgacacactatctgcatactccaatgggacagcattttccttactgccctgactggtccctgcagacatggaaacacttgccccatctcccagcaaagtcccctcccagcaaagaggggactcgggagatgtgagtcttttaaagaagattatgtggcatggattagattgatggaaatgaagctgatttaatggaattagttttttttaagtgcagcattctttttacactaaggtgcagtaacggagactggatttactctcctgcctaaaataaccaaagtgtggctaaaatatagaaaacactgttcatcactgtaacaaaggccagcgatgcctgggagatgggaaacaagccaagcgaatcctgtggctgccccagttgtttgccttgacagaccttctaggtcacaacgcagggcaggaagagccagaagacttcccgagtctttaagtccatgcagactagagtgactaaagtctgaaggacagagtactagaaaggacagagtgcacagagagagacatcattgatcagcagatcagtcaggcagtcagctgagtgctgatcacaccaggcatgtgaggaaaccccttaaggccaggctgagaaaagaacctctgaaaaggatgaggattaatagtgcccatgcctgtacaaagttaggaatagtgcctgttctcaccagccagactggaaaagcttatgatttgcaagagagtacacaaaagagtcttgtggagaataattagttctagagagggcaccgctccagtcctgcttaacaaatctttaaagcaagaactaaaagaatcaaagtaacttaactgagtcccagaacaaagtacaagactatctgtaggaatacagaattacttggcacccaccaagatgaaattcacaatgtgtggaatccaataaagaattaccagcactcacaaaactggtaatatattatgcataaggtggagataaatcaatcagttgaaacctacatacatatgaaaacatgttagaattaatggacaaaaacattagaacagttatcataactgtatgttccaaaggttaaggagagacataaaagatataaaaatgccccaaatcaaacttctagagattaaaaactacaatcaatcaagatgaaaaatacaccagaaggattaactccaggttaggcattgcagatgaaagattagtgaacttgaaacaaatataaatgagatgttttttcaagatacgtatcagtgagtttggggacaacttcagagacctaatatatgtgtaatagaagtccacatgaagagagagagacgctaggacagaaaaaaaaaacacattcgaagaaataatgactgaaaaatgataaatttgatgaaaacaatatactcacagatacaagaagctcagcaaacacaagaacataaagaaaactataccaaagccagtggaaaaccagtgataaagagaaaatcttaaaagcagccaggagtagatttgggggaagtcaagttaggaacagagaaacaaagatatgaataacaggggatttcttattggaaataatacaagcagaaagatagtaggatcacatctttaaagaaatagaagaaaataaactccaccctagaattttatacccagtaaatatctttcattcaaaataaaatatgaaataaagagtttgccctacacagaaaaggtggaaaggtgcatcaccagcagacccacattacgagaaatgttaaagaaagccctttaggcagaaggaaaatggtatcagatggaaatttggctctacacaaagagttgaagagcactggaaatggtaacaaagtgggtaaatatataagattttatccttaatatttatatctttttaaaagatagtgacttcacaaacaaaaatagcgccgggtttataacatatgtaaaaataaaatgtatgacaagaatagcacaaagagcttgagaggagacccagaggggaaaagtatactattttaaggttcttatatctaaagtgctataatatcacctaatgacagtctgtgatcagttaaagatgtaccactaatgttataaatcagattcaaagagttatatctaataagcctatagttgagattaaatatcatcataaaaatacaaaattagaccaaaagaagacaaaaagagaggaaaaagggagcaaagactagatgggacaaattacaagatgacagacttaaacctaagtatacaataattacattaaatgtaaacgttccaaatgtcccgattaaagatcatgtatataaggcagatatagagtggataaaatgcaaaattcagttatatgtagactataaaaatgcactttaaatataaagatacaataggctaaatttaaagaatggaaaaggatacaccatgccaacactaatcaaaagttagctggaatggctttactaatttcagacaaagtagattccagaacacagaatactataagagataacaaaggccaagagaatgtaacaatcttaaatacttatgcacccaataacagtgcttcaaaacatacgaagcaaaaagttgtagaactgcaaagataaatcaataaaaattatagttagagatttcaatatgctcctctcaataattgatagaataagtaggcagaaaatcagtaaggataaagaagattttaatgacagtgttgaccagccttgccccacctcctggcctgggtagctgaagtgcagcacagtggccctcagcatcccatcaaatgtgacacactgtgaacaatgtggatcttgtgggctgcagccctggtggctgagggaagtgctctctggatgctgcatatggaaccactgtgttctcagtgtgtagattcacagatagacatgagtgaataataatagaaaatggcatggaacagtgggcatcaatgtcaagatgatactgggtaacaccctacaactggatgaactaatgagtgaagaagagtatgagaaatatgtaaaatccattgaggagtgagaatgggacctctcaataaactagaatgaaacaacttaattcagcatagttgtcttaaattagtaatagatggaagacataaaatagcaacttttggtattaccagtggataaagaaactactcccaacactgctgctggaagaaaataccccttttctaaagatttcagacaaacacaatatgcatctttttcacaatactctatgatttttaggctaggctctagttataatatttagaattcatgaagttttctgtggtgagaactagctgtaaaaattatatatcttgaggataacattatgtcttcagctttatataatattgtaacttgcttatatccattcctggatttgagtcaaaatacttaatgatctttgcattgaaaataatttgggagtggagaaaacttttgttagttgtacaatgtcagatgaagaacaatactgtctttttaagtttcaatagttttggggctaaagtggtttttggttacctggataagttctttagtggtgatttctgagattttagtgcatccgtcacctgtgcagtgtacactgtacccaatatgcagtcttttatccctcacccctaccggccaagtccccaaagtccattatatcactcttacgcctttgcatcctcatagcttatctcccacttatgaatgagaacatatgatatttgcttttccatacctgagttacttcacttagaataatggcctccagctctatccaagttgctgcaaaagacattatttcattcctttctatggttgaatagtatttcatactgtatataccatattttctttatctacttattggttgatggacacttagtttggctacatatctttgcaattgcagattgtcctgctgtaaacatgcatgtgcatgtgtctttttcatataatgacttcttttcctttgggtagacacctagtagtgggattactggatcaaatggtagttctactttacctctttaaggaatctccaaactgttgtccatagtggttgtactaatttacattcccactggcagtgtaaaagtgttcccttttcaccacatccacaccaacatctattgtttttgatgttttaattgtggccattcttgcaggagtaaggtggtatttcattgtggttttaatttgcattttcttgatgattagtgatgttaaacattttttcatgtttgttggctgtttgtacatcttttgaaaaatatctattcatgccctttgaccactttatgatgggattatttgtttttttcttgctgatctgttcgaattccttgtagattctggatactagtcctttgttgggtacatagtttgcaaatattttctcccactctgtgggttgtctgtttactttgctgattatttcttttgctgtgcagaaactttttagtttagttaggtccaatttatttgttggttttttgtttttttttttgcatttgcttttggggtcttagtcatgaattctttgcctaagcaaatgtccagaagagatttttttaatgttatcttctagaatttttatggtttcaggtcttagatttaagtctttaatccatattatgttgatttttgcataaggtgagagatgagtatccagtttcattcttctacatgtgacttgccagttttctcagcactatttgttgaatatggtgtccttttcccactttatatttttctttgctttgtcaaagactagttggctgttaagtatttggctttatttctgggttctctgttctgttctgttggtctacatgcctatttttataccagtattatgctgctttggcaactataaccttgtagtatagtttgaagtcaggtaatgagatgcctccagatttgttctttttgcttagtcttgctttggctatgcaggctcttttatggctccgtatgaattttcagattgttttttctagttctgtgaagaatgacgatagtattttcatgggaattgcattgaatctgtagattgcttttggcagtatggtcattttcacaatgttgattctacccatccatgagcatgggatgtatttccatttgtttgtgtcatcagtgatttctttcagcagtgttttgtaattttccttgtagatctttcacctccttggttaagtatattcctagggtttttttgttttgttttttgtttttgtatttgtgggttttgtttgtgtctgttgtaaaagggattgagttctctatttgattctcagcttggtcattgttggtatattgtagtgctactgatttgtgtacattaattttgtaacctgagactttactgaatttgcttatcagatctaagagctttttggatgttttagtgttttggatgttttgtgttttctaggtatgtgatcatatcatcaggaaacagcaacaatttgactttctcttttccaatttggatgccctttatttctttctcttgtttgatttctctggctatgacttccagcactatgttgaatagaagtggtgaaagtgggcatccttgtcttattccagttctcagaaggaatgctttcaacttttcctcattcaatatgatgttgacaatactttcttaattttgcaatacactgaatttgctggtgctatttatatacagtgaagcaaaagcttggcagtagaataagaaacaatatagtaataaaacaacttcattactcatgaaaaaacatgcagacaaaaccactactgaccgatttggcgtaattgacatatataaaatacttcactcaacaacagcagaatatacattcttttcaagtatacatagaacatggacagtttaccaagatagaccatattatgggctataaaacaagactcaataaatttaggattcaagtcatctgagatatggtctctcatgacaaaagacttaacaagaaaataaaactgcagatcagtatttctcatgaacattgatgaggaaattctaataaaaacttagcaaactggaagatggcagataggaaacagggctgacatgcagctcccacttggatggacaaaacagcatgtggagattcacaccatgaacttttgcttcggaaaccatcacaggagcatgccaggaaaaccaaaagaaaccacagatcctttgtaagaagcagcagactgctgcaattgccacaagacaggcgaaaacctgtgaattcccaaagtgtgaggggggaaacttgcttctgaacacacatccccactggcgaatctgaaaatccagattacaggagaaagatttaaccttacctgccactgaaatggatttagtgtgaaatataaaagtagaagcagcagtaggaagaaccttctaggcactcccattctccagctcaagcccagggaagccatccctgactatatctcacagacatcctcggggaaggcagtccagattttggaaggggtcacagggtgaaagaaacttccaactgaactttgtaataattttgactggccacaaaccctcttgagcagaatcctggggatgaatgggaaccactgcagaaaggagtgcaggagtcacagccagcagtgtggggagatgaggaggggcatggcctgaaagccatacttgcttcttcagtggagaaacttatagcatggggctgggtctgagtcctacacacaggctgcctgtagataaacttgtcgctcttagcagagcatggcaagagcgagactggcctcaccaactccatgggagtggggtgaaacctattgttactggctttcccccacttccctggtgacagaggcagccatgattccctctggaacataaccccatgcgcccaccacccccctacactccaaagtggcttcagtaagccctgctcaaggagggtctgagctcagacctgcctattcctacccacacctgatagtatttctctacccaccccagtagccaatcacaaaagacgtaaaagcttgggatctttatggccctgcccatcacctgagaaacccaaattcttatcctggccaacacagggcaagcttatatcccccttctactattgcagctggtgctctctcgaaagtgccacctcctggcttgaggccaaccaactcaggacattacagcaactcatgacagaacaaccctgctccaagaaaggagaaaacaaaaaccaattccactgcctgaaacatcctggataaccagtggtcctgagtctgtccacatgacagcttcactgctagcataactagcatttgagaaagccagcacactaagcatatctacaaccaaggactctcacagagcctacttcactcccctgccacctccaccagagcaggtgctggtattcatggttgggagacctgaagatagattgtatcacaggactccttgcagacattccacagcaataacccagagcctggtagccccactgggttaccagacccagaagagaaataacaatcactgcaatttggctctcaggaagtcccatctgtaggggaagagggaaggcaccacatcaagggattactttgtgggacaaaagaatctgaacagcagcccttgagttccagatttttccactgacatagtctacccaaatgagaaggaaccagaaaagaaattctggtaatatgacaaaacaaggttctgtaacacccccaaaagaccacactagctccccagcaatggatccaaaccaagaagaaatctctgaattgccagataaagaattcagaaagttataaagctcctcaaggagataccagagaaaggtgaaaaccaacttaaagaaattttttaaaaaaatacaagatatttatgaaaaatactccagagaaatagatgtcataaagaaagaaatatagcttctggaaatgcaagacacacttagagaaatacaaaatgcacttgaaagtttcaacagtagactagaacaagtagaagaaagaacttcagagcttaaagacaaggctttcaaattaacccaattagacaaaaaaaaaagaattattaaaaaatgaacaaagcctccaagaaatttgggattatgttaaacggccaaacctaaggataactggtattcctgaggaagaagagaaatctaagtttggaaaacatatatgagggaataatcaaggaaaacttccctggcctcactagagatctagacatccaaatataagaagctcaaagggccaggttcagtggctcatacctgtaatcccagcactttgggaggccgaggtgagcggatcacgaggtcaggagattgagaccatcctgactaacacagtgaaaccccgtctctactaaaaatacaaaaacaaaattagccaagtgtggtggtgggcacctgtagtcccagttactcgggaggccgtggtgggagaatggcgtgaacccaggaggtggagcctgcagtgagctgagatggcgccactgcactcctgtctgggcgacagagcaagactccgtctcaaaaaaaaaaaaaaaaaaagaagctcaaagaacatctgggaaattcactggaaaaagatcatcacccaggcacatagtcatcaggttatctaaagtcaaagtcaagacaaaggaaagaaaattaagacctgtaaggcggaaacatcaggcgacctataaaggaaaacgtatcagatttacagcaggtttctcagcagaaacactacaagccagaagggattgggtcctatctttagctcctcaaacaaaataattgccagccaagaattttgtatccagcaaaactagcttcataaatgaaggagagagaaagtgtttttcagacaaacaaatgctaagagaatttgccactaccaagccagcactacaagaaatactaaaaaaagttctaaatcttgaaacaaaacttcaaaatacatgaaaatagaacctccataagcataaatctcacagggcctataaaacaataacacaatgaaaaaaaaaacaccaaagtattcaggcaacaactagcatgttgaataaaacagtacctcatatctcagtactaacattgaatgtaaatggtgtaaatgttccacttaaaagacacagaatggcagaatggataaacattcaccaatcaagtatctgctgtcttgaagagactcacctaatgcataaggattcctataaacttgcagtcaatgggtggaaaaagttatttcatgcaaatggaaaccaaaaatgaggaagagtaactatttttatgtcagagaaaacatactttaaagcaacaacagttaaaaaaagtgggacattataaaatgatttttaaaaaatcagtcctacaggaaaataccccaatcctaaatatatatgcacctaacatggtagctcccaaatttataaaacaattattactagacataagaaatgagatagatggcaacacaataatagtgggggacttcaatactccattgacagcctgagacaggacatcatgacagaaagtcaacaaaaaaaatgcacttaaactataccctagaactaatggacttaacagatatttatagaacattcaatacccaacaactgcagaatatacattcttttcatcagcacatggaacattctccaagatatgccatatgatgggccacaaaacaagtctcaataaacttaagaaaattgaaattatatcaagtaccctctcagaccacagtagaataaaattggaaattaactccaaaaggaaccctcaaaactatacaaatacatggaaattaaataatctgaacttgaatgatctttgggtcaacagtgaaatcaagatggaaataaaaaattatttgaactgactgataatagtgacacaatttatcaaaacctctgggacacagcaaaagtggtgctaagaggaaagttcatggcattaaatgcctacatcgaaaagtctgaaagagcacagatagacagtctaaggtcacacctcaaggaactagagaaacaagaacaaatcaaacccaaacccaacagaagaaaagaaataaaaagatcagaacaggactaaatgaaacggtaacaaaaaaattcaaaagataaacgaaacaaaaagctggttctttgaaaagataaacaaaattgatagaccattaccaagattaaccaagaaaagaagagagaagatccaaatagcctcaattagaaatgaaatttctaattgatattacaaccaataccacagcaacattcaagactgctgtgaacacctttaggtgcacaaactagaaaatcttgaggagatagataaattcctggaaatatacaaccctcctagattaatcaggaagaaatagaaactctgaacagaccaataacaggtagtgagattgaaacaataattttaaaattgccaacaaaaaaagtccaggaccagatgaattcacagctgaattctatcaggcattcaaagaagaattggtaccaatcttactgatactgttccagaagataaagaaagaggtaatcctccttaaatcattttatgaagccagtatcacactaaaaccaaaaccgggaaaggacataaccaaaaaagaaaactatagactaataatcctgatgaacatagttgcaaaaatcctcaacaaaatgctagctaaccatatccaacatcatatcaaaaagataatacaccatgatcaagtgggtttcataccagggatgcagggtttaacatatacaagttaataaatgtgatatgtgacataaacagatttaaaaacaaaaatcatattatcatctcaaaagacacagagaaagcatttgataaaatccagcattcctgtaggattaaaaccctcagcaaaattggcataaaaaggacatacctcaagtaataaaagccatctatgagacacccacagctaacattatactgaacaaggaaaagttgaaatcattccccctgagaactggaacaagacgaggatgcacattttcaccacttttattcaacatagtacttaatgtcctagccagagcaattagacaaaagaaagcaacaaaagccatccaaattgataaagaagaggccaactgtcgctattcactgataatgtgattgtatacctagaaaaccctaaggactcatccaaaaagctcctagatctgatatattcagtaaagtctcaggttacaaaatcaatgtatacaaatcagtagcactgctatacaccaacagtgaccaagctgagaatcatatacagaactcaatcccttttacaacagctgccaaacaaaacaaaacagcaacaacaacaacacacaaacaaaaaaatcccaaaacaacaacaacaaaccttaaaaaaacaaacaaaaaacctaggaatatacttaaccaagaaggtgaaagacctctacaaggaaaactacaaaatactgctgaaagacatcactgatgacacaaacaaatggaaacacatcccatgctcatggatgggtagaatcaatattgtgaaaatgactatactgccaaaagcaatctacagattcaatgcacttcccataaaaataccatcatcattcttcacagaactagaaaaaacaatccaaaaattcatatggagccataaaagagcctgcatagccaaagcaagactaagcaaaaagaagaaatctggaggcatcacattacgtgacttcaagctgtactataaggctatagttaccaaaaaagcatggtactggtataaaataggcatgtagaccaacagaacagaatagagaacccagaaataaagccaaatacttaagagccaactaatcttcaacaaagcaaacaaaaacataaagtaggaaaaggacaccgtattcaacaaatagtgctgggaaaactggcgagccacatgtagaagaatgaagctggatcctcatctctcaccttatacaaagatcaactcaagatggatcaaagacttaaatctaagaggtaaagccgtaaaaattctagaagataacattggaaaaaactcttctagacattggcttaggcaaagaccaagaacccaaaagcaaatgcaacaaaaacaaagataaatagatgggacctaattaaactaaaaagcttctgcacagcagaagaaataaccagcagagtaaacagacagcccacagagtgggaggaaatatttgcaaactgtgtatctgacaaagaactagtatccagaatctacaaagaactcaaatgaatcagcaagaaagaaacaaataatcccatcaaaaagtgggcaaaggacatgaatagagaatcctcaaaagaagatttacaaacagccaacaaacatacgaaaaaatgctcaacaccactaattatcagggaaatgaaaatcaaaaccacaatggaatgtcaccttactcctacaagaatggctataatttaaaaataaaaaaacaacagatcttggcttggatgtggtgaaaagggaagagtttttcaatgctggtgggaatgtaaactagtacaagcactatcgaaaacagcatggagattccttaaagaattaaaagtagaactaccatttgatccagcagtcccactactgggtgtctaccgagtggaaaagaagtcattatatgaaaaatacacttgcacaagcatgtttataacagcacaatttgcaattgcaaaaatatggaaccagactaaatgccatcaacatagagtcttttatctgcacattgggtacagtatacactgcttggatgatgggtgcactaaaatctcagaaatcactaaggaacttttccatgcaaccaaacaccaactgttctcccaaaaatattgaaataaaaaaatttaaaaattagcaaactgagtcaatatacaaaaaggataatcatgactgagtagggtttattctaggaatgcaagtttggtttaacataagaaaatcggtgtaattcaccattttaacaaactaaaaaaaaaccatatgtttatctcataaatatataaaagacatttgaaaatctaacattaattcctcataaagactcttagcactttttcaatttgacaaaggttatttttgaaaaacttacagcaaacgtcacacataatggtgaaggactaattgtttcacccttaaagtcaggaacaagttaagaatgccttttctcaccacttctaatcaaaactgtactgaagatttgaaccagtgcaaaaagataggaaaagaaatgaaaggcatccagattaaaaaggaataattaagactatctttcactcacagacaacatgactacctatgaaaaaaaaatctgatggaatctacaaaacagctactataactaatatataaaaaattaatatgcaaaatttagttgtatctctgtataatagcaatgaacaatcagattgaaataccatctacaacagtacaaatatgttaaatacttatagattaaatctgacgaaagatattcaagacttctatggtgaaaactacaaaacatttctgagagaaattaaagaagacctaaatacatggagagatattctatgttcgtgggatattgaatctttaaatcagttctttgcaaatttggtaaaatcccaatcacattttcagcaggaatttttatagaagtttaattaattgattccaaaatttatatgaaaatggagataacctaaaacagccagagaaactttgaaaaataacaaagctgtaggataacactaactgatttcaagattaattattgtaagattcttttttttctctctctctattgcccaggctggagtgcagtggcatgatctcagctcagtgcaacctccgcctcccaggttcaagtgatactcatgcctcagccttccaagtagctggtacaggtgtgaaccaccacacctagatttttttgtatgtatttttagtagagatgggggtttgctatgttggccaggctggtcttgaactttcagcctcaagtgatccgcccaccttggcctcccaaagtactggaattacatgtgtgagccattatgcctggcctaattattataagattattgtaatgaagatagtgtaatataggtgctaaggtcaacagtaggttaatggaatagaattaaacaactcagaaataggctcaacatatagacaactgatttttgacaaaggcacatggcaatgtagtggagaaagaatagtcttttctctctgaaacaattttatatccatatacaaacttttaaaaaactcaatccatacctcacaccatatacaaaaattagctgcaaatgaatcatagacttgaatgtagaattcaaaccaatataacctctagagaaaacataacataggagaaaatgtttgtgaccttgggttaggtaagatttcttagaaacaacattaaaagcacaatacataaaagaagaaattgaccaattagatgtcatcaaaatttaaaaccttttctttttgaaaagtactttaagagaatgaaaagacaagctacagactgggagaaaatatttgcaaattacatatctgacagaggacttgtttctacaacatattttttaaaactctcaaaacacaataatacaaagtaaaaaagctaattaaaaataggcaaaagatcatcattctcagtaaactatcgcaagaacaaaaaaccaaacaccgcatattctcactcataggtgggaattgaacaatgagatcacatggacacaggaaggggaatatcacactctggggactgtggtggggtggggggaggggggagggatagcattgggagatatacctaatgctagatgacgagttagtgggtgcagcgcaccaccatggcacatgtatacatatgtaactaatctgcacaatgtgcacatgtaccctaaaacttaaagtatattaaaaaaaatagattaaaacaaatatcaaatgaaaaaaaaaatgtggccaaatactgttattgtggagaagcctgaatctggcattaaattacaccaagtggacctttgaaaaaaaaaaaaaaaaaaagatttgaactttccaaaataagacatcacatgaaatgacactcaatctcattagtcattagagaaatgcaaattaaaaccacaatcaaatacaactacacgtctattagaatgaccaaaactagaaagattaagcattccaagtgttggtgaggatgtgtaagtgcatccacaccaggatactattcagcaacaaagaggactaaaccactgatgcgtgcaacagcatggatgaatttcaaagtaaacatgctgagtgaaagaagccagatcaaaaaagaataaatactatttgatttcagtaatataaaattacagaaagtacaaactataatgacaaaaatcatatcagtatttgcctgtggttggcagagtagaaagggtgggagtgagaggcacatgggaacatggaagcttggggggcgatgtgtcatgttcattatcttgatcacagtgatatttttatgggtgtacacataaatcaaagcttttcaaaaaggatacttcaaatatatgtagcttattgtatgtcaattctattaggttggcacaaattacttttggtgcacaaataattgcagtttttgccattactttaatgcaattacttttgatataattacttttgcaccatcataatacctcaatacagtagttttttaaagaaaaaacttagtgcacctttcaagttaaacagaagaataggaataatggagtaataactaacatctccagagaatcaggaggcacctgcactatgcaaagcatctgtttctctatctgtctgtctttattttatcctcataacagccttatgaaatagatgctcttctcatccccttttcacagaggaggaaactgaggttacataattttcccaatgccacaaggccagtaagctgtagagccagggtctgaaccctggcagtttgctccagagcttggactctaaaccactgtaggtgtcgattaattttcatgttttgctgtcatcatttccagggaaatattgccagagaagctgcatccgaggaagctttaacagcagtccaaagtggaaatgttagtgaaccggaggtagggtttgacgagggcctttgcgtgccttctagccaccccatgggtttcacacctttctacctcagaggatttgtgccctttcctcctcccaatctccctgcctgtctccaccagttcacacctaccacctcctttaggacttgctgcaccaagcctcacctccttacctcttcccctgctgtgattaatcttttcttctgtatcctctgcatggcctggactgtaagttgcattttctacataaattatttgcaaaaattttagtaaatacagcttatctctccttcccattgcccaaaaagaaaacattttggagaggcaaaacatttgtaagagttttctctgtatcatatgcacatacatacacttctgtccgtgtctaggtgtgttattaatatatgtcatttacattcatctcaggattttggaagtcctccctcctgttacaaattcaggccaaggggcatagcatcttccaccagtgcagtggctatccctggggacttcaccatcctttgttggtttcccttcaccccacccatgcctttgcaggtggtccgttgaccactccattggagtgtcccttctgttccctgccagaagcctggtggttcaggaagagattggcagggtcctgtgaaccctgctcaggatctcagacttttcctaagaagcagaggagggtgttgtaggcttttgagtgggaggttggtacaataaagcattttcattccctgatgatgagcatagtcctggaatttcagtagtttcccaagagcctcttggtgatggatggactgactcagcaacagaagcctagagaacccttgagaagggaatggaacatggggcttggtcatatccatagaggcactgggacagattcactgaacactaagcccagacactgaagttctgccagaggaccaggttctccaacctgtctcctctccagattctgaccagtgaaggagtctacccagaagtcagctagggattgaagtacccctttctcatggctaacactgaaccagagaacaaagcttggaccgagaacacaaatgggcttcccatttctccttactgaattaagtgcccccatgtggttgtaggcaggcctcacctgtggggcagggtctccccactcccagctaattgcatggaggggaggagaaaacacacaacctgggagcaggatgtgctgtcagaaagagaaagcacgatgtaggcacagggtccagtttttgaatctcacattagcatatgctgttggagccccacccatatcctctagcacgtattcttcctgagcactctgtgaagacaaggactgcaagtgcctggtctttcttccatgccatgtttgcagcagggcaggctgtttggggaagcagccatcagccagtgactgaagggattggagaatcaatttgccagctccttcacctcttaggtgggaccactctgcactgtgttctctaggctttcggagatccaggtggggttgattcaccatagtcacccacatcttgaaacaccccatgctggcagcctccccttcctcacctcgcatgccactcctcttacagaatttcctggctttgctccccaagtaaactactgactctcagacacttaattcagggtgtgtttctggggcaacccacactaggagactcactgaccagttggtcactccctgtgccctagggaggaaagtcagggtgtagaagaggacagcagttttctctctaatattcctaagagggtagccgttccgttatgaacccaagcaaggatgtggttggagggacaggatgcctgcccccaccactgcatcaaacatggttggaaccccagaagacacctgagtcaacaaggtggattgatctcctatttttatctcctctccctaccggagaaaaacactgaaatgacagtaaagggataaaaagggcacaaatccacaaaggtgagatggagaggagatattggaagataagcactttaaaaatattgagaataaaaaaatcaatggaagagtttacattggcttagcacagctgaggaaggtgaaactcaggcatctttatgggaggagagactggtgaaaagtgtgtgaattctgcacaaggctgaagactggaggtttgcagaaggtggggtgaggaattgggctgaaaagctgggcagtctgatgtggagtgactggaacactggatccctgcagactccagttaggttgtcagccacaccccaagtgagaggataaaatgactattctctagagaaattgaacagaggctgctgctaattcagatttagcctgtgctgcatgggcgttgtaacggtgaggaatagagaacagacaagtaagtggaattctccacttcgaacagaggaatccacagcccctcctccagccacgccctctcaatgccaggagccaggccttgtattaagtttctattgctgctgttacacattaccccaaacttggtggcttataacaacacaaatttattattgtgcagttctggaggttagcattccaaaatgggtttgagtgtgctgagcttcaggtgtagacaggggcgtgttccttctggagactctaggggagaatctgttcccttgcctttgccagcttctagaagccacttgcattccatgccctgtgtccccttcctccatcttcagagctggcagcgcagcatcttcctccctctgactcagacctgctgcctccctcttagcagatccctatgattcctctgggcccacccggatcatctaggagcatctcctcatcatagaacccttcatgtgatgacatctgcgaaatccctgtgccctgaaagataacatatttacaggttgcagggactagtacctgtaacatctttggggaccacagtcctcaatacagaatattggagaacttaagtcccaaaaaactgacaggcccaaggaaaatgccttcagatgatgtcactgaaggtggccacccagtaataatgccagatctctgcctgatcaccccatgaagtgccccagttagccagtgtctgtggagttttgcctctcaagcatgttgcttttaggaagctaaaaatgtgctctaacgatatgagggcctaaatgatgaacaaaaaagacaaagaaaagacctggaacttacaaaataggagctgcaatacaggcaggacggcagagctgcaagtccagattagaggggagaaaaaaggaagctcatatattatctcaaacgcctgatcatttggaaaataatagtgaccaacacttggcaaatctgataaaggaagtgaaaaacttagcaaaccaagtgaataaaaactaagcacacagatgaaaacattgtcatattacactactttgctcagcaacaacagaacttacacattcatattagtgtaaatacttacggatttaaccctgaattgtgatgtaattttcctgggggataagatgtggggaagagggtagtatgagagggattaatctagccactgcatcaatattgaataggaaattctaaaaactaatgaatttagaaacagcaccataagcatattgttcagaaatatagaggtaaatatatacccaaataaatgaaaacgttgaaagttctgttcaatgggggtagagacttggaaggacagagaactactgattttcttaataaatgtttggtgctaatattattttaaatttttccatatgcatgtattactttgatttaaaagaactccatgagggatctcaaagggaatcatcttctgagttatgacacctttttaggtgcacctaaaccaagacagaacagcctcagccctgactttccaggtggctgtggtccactggaccttcctgggctccacctccccacgatagttactcccaggaccacctgagcagtcccaagattcaaaaattcttgtatcacaatgaaaacagctttggggacagagggattttgcttctggagttattataatatgtatataatactatcacgctctaatctctaccctgggatgcagttaaaatatggaccctatgtcaaaggccaactgaaactatttgtcttgtgtgagaccttcatgtgagaactagttttttttttctttattattattattttttaaattttattttacgttctgggatatgtgtgcagaacgtgcaggtttgttacctaggtatacatgtgccatggtggtttgcggcacctatcaacccgtcatctaggttttaagccctgcctgcattaggtgtttgtcttaatgctctccctccctttccccccgacccccctgacaggccccagtgtgtgttgttcccctccctgtgtccatgtgttctcattggagaactagtttttaaaaacattttatgaattttgagtatctcattaagaacctctccttaaaaccaggcctggcccaggatgagttgtttcgggtgacagtcacacctgtcctcagaacggtgtcatgtagagataatgcagccaccagcccactaaattacagggcattgacaggattctcattggctcctcctgtctccttgctctaggacatagaaaaactcagtgacatctccactggatatgcacagtatcaccatgtcagcagtaggagcttggcatcgctcgtactgcctgaagagcccgtccacttccgccccatctacaggggagcctcagctgctttttgtattcagctgttttgtattgatgagaaatatgaagcaaggcaagtactgaccttctggctggctgtcacagtgagaatcttttctggcattggtggcccaacattttaactttacagagccagtaatttccaaacctggcccacatcctaatctcctggggaattttttaaaacacaaattcctaagccccatccagagattctagtccatcaaattttaacaaggcctacagaagtgggctagaaatctggcctacctatgtaacaattgggaatctggaaaattatcacttacataaccacatgctgctcccattctgtaaagtttgcatctcttggataatttgaatttgggttactggttgtctagagtctttggttgcaagtaacaggaaatccaaccaaactggctttgaaaaaaaaattgaataattgcctcacataactaaggataactctggtggtgagactgttttaaatatggcttgatctaggatttatttagattaccaaatcaaggaccaagtttctctctctacctcttcaccctgtgtgttagtctgttttcatgctggtgataaagacatactcaagactgggtgatttataaagaaaaagaggtttaatgaactcacagttccacgtggctggggaggcctcacgatcataggggaagatgaaagccatgtcttacatggcggcaggcaaagagacaatgagagccaagtgaaaggggtttccccttataaaaccatgagatttcatgagacttattcaataccacaagaacagtatgggggaaccacccccatgattcagttatctcccacagggtccctcccacaacacgtgggaattatgggagctacaattcaagatgagatttgggtggggacacagccaaaccatatcaccctacttccctgctgttggaccccttctcagaggagtgccccatcctgggcctaagaccactgacattctcaggtctcaggtctgcatcagaatccagtgagaaggacttgccgggatgggcccagctttttccagccaaagtctcatgaggcctgacaggactgtgtgttcattcctgagccaacggctgtgacaagcccatgccacaaggagatggagaagatgggctccatcccttagctcatgctccatgccaaatctgcagctggagtctcagctacatggaatatctgagcaggggataagttgacacccaacagcaatccagggctacagcaaagaggaggcatgcatggtgctgggctttgtctaaagccccggcgcccaccagacctcacagccacccaccctgcccctccagaacacccacatgttcagtgcttgctgttctcctgtggtctggacactggacgctgccctcagtgcctggattccacatctccttagcacccacccctcatctgttcacagaaccatctcgaagaggaaataattggcccattttgatggagtggaaggctctagggtgtcttttagatgagcaagaatagctggacagttcctcttcagaggatctgtttaaacatgttcccagtctcccagcatcccctgttgtactttaacttttttcatctcgagtttttagcttctatggagatctgggacattgaaaagaaattctttttattctaattatgttgtagacatataaaaccttgtaaagcctttctatatttgttgctttatatttcttttatctgtacatttaaatatgattgtgcttagagtatactttttgaattttgaaacaggaatttgatgacccagtgtggtttgcctatgaatgtacatctacagctagtcagaaaatcttcaacagataaaagggaaacagatcagaagcaacctataatatttcccacctctcctcttaactcttccaaaacagaagggaaggatcggaggcacagaatgaccaattttgtgttggcttttcaaatgcacagagattgttaattgatgtgaaagtgccttcagttctgcagaatactttattactgacatacgaagcttgcgacttatgcaccccattagtgttcacctagacacacattctgactagtggttggctaatcgctgcccgaggggagggagctgtaaatctctgtaaacgtccactgatgttgcatttgcttgcagggcactgacagtgcttactgtcttgtttacaggtcgctggattttatgaattttgttttcagtcttttttctgtaagtacatgctgaattttgagaactgattttgtaagcttagagaacttatagaaaagtaaaatgccataaatttattatgctgtgaatgttgaggtttgtgttcggagaataaggtcaaatggcatgtcatgagctcataaaaatacaaaatattgtcattttcaagaatttttaagtcatgctattttagcagttctctttaaatgcaaaatttctgttacacatagctttaccagtgttttatcagaatcaaatcattcatagtaatacatgaaaatgttggaaattaaagtgaatgacactgttattttatagattatgttggctccaagtattctgaaaccatcatattgcttttctgagggtagcaaagtagggacttgttgattttgaggttggcatttctttccctactagttcctcaggcctgacttcatgcctggctggtagagggggctcaacccacattgatgaatgggcctgcaggctaatatccaagtacaaataagattctccatgccagggtgtcccgggcttctgcctacattcttgtctcattattttctagggatgaagatctaaccaaactcttacacttctttattgaaggaaagaaaatgaggaaggaagttttgagggacaaaatgcatttttataaagacaggcctgttaattaagtaaagtcaacaactgtacttctccagttgactgatttcaagaaaagtatctattgctttacttttcctggatactgtttctaatgaggcaaaaacaagtatagtttaattattttgtcttacaactatgtgatgttaggttttatttcctcatttgttattataatgaagctttataataaggcaatatgttctccatcataatttttaaaaattacttattaaggcactttccaaacaatgtagattaccctgaacataggatttacaaagtcggtttccctcaaaaactcctcaaataaatttcactaattttaattattttctactttaacgtccatgtaaacgtaaatatttaacattataaaagtaatgctggctttaaaaaggtaaaagagctgtttacatttcaattctatttgacttcggaacatggacgacaggaaaaaaaataaccttggttgcttcatccttaatccttcaaatccaagatgaagcaactcattatagttagtctctccctcccagaggaagcccacccagacttggcacccagtccttattttcaacttgagtatttcagcaacttgactctcaggttccccaaaaggagtcctactaatttgctaaaaagaaggaaggtaaggtcagacaatggttcactcctttgagttgcacaaatgtccccagggttttggattagcacaagtaatgccttcacagggttcaagaggaggcgagatcccaaagggacaaattagcttcgggaagagcaggctgcttctgcagggacctggcagaggatcaggcagctgcgtgaagctcagatagcctagagcagcactgtccagacatggagtgtgagccacattggtaattctgaatgttccaagagccacaaggaaaaaaaagaaaaaggaacagatgaagtttatatgataatatcttttatttaacttaatatgcccaatcctttttttaaagagatagggtctcactttgttgcatgcaatgtcacaatcatagctcactgctgcctcaaactccttggcccaagggatcttcctgcctcagcctcccaaatagctgggacatgccaccatgcccagctaattaaaaaaaaaattgtagaaatggggtcttgtcatcttgcccaggctgggctcgaactcctgggctcaagtgatcctcccatctcggcctcccaaagtactgggattacagaagtgagaactgtgcctgggcaaatttaatcatttcaacatataatcaatatgaaaacttattaatgagctatttacaatctttttctcgtactgagtctttgaaatctaatatatatttcacatttatagtacatcacaatacaagtactaaattttcatcagaaatagttcatctgtatttgtatgttataaaatttacagttggatacgtagattcacataatccaagcacacataaaacttttccagtaatggaattaagtatccatttttttaatttaaatgaatttaaatgaaataaaatttaaaatttagttcctccgccaatactagccacatttcattgtctactgtactgacagggcaggcctagaatagaatgaatggcagccctcaggacatgcaagacctcttatgtctgctaactaaacccactgcctgggtttaatcatgctcatggatctgttcacccaactgggatcacgtcatgataaaatacgtacacattggtttatggataatcacagaattttagagccaaaaaatgcctgaagtatcatcctcccatctcgcaagaggaagggaccactggtgtaaggtcacttagtaagcaaggggcctttgctaggacaccatgctacctcattgacttggtgacacaagtgaacttacctgtatgaattgtcttggtttaaaaactacttccacagaagagttatgctgaatgactgccattgtttataagattcatttattcaggtttcagtgagaaacaaagataccttttccctgctcttgtagttgcttatttcctgaattttatgtgattattttccaaattataggaaaggtaatttgaatatcctctccttaatcaacacattttgcttctatttttcttggtgttttttagaggaatttgttttttgattaattttttttattctttctctgtgtcctggtttttgatgatgttaggataagaacttctgtgtaatttctctgccccatctcacccccgagttcttcctcatccagaacttcgtgaaaatggtccctttcaacacctgcaccctcgagcaggacctctacgtcttccaccgggctggattgctcaagtgagtagacacatgtttggccacacaacaatccatgaaattacagaagagaagggaacaaggaactccctgctattataatttaataatttattttaaatatcatcttttattagaagaggtcttgagtaagtgattttaactaatacatttagagaaagaatggcacttgagaagagatttgtcctgtcagatattaaaacataatatagctccacaataatcaagacaatgccatgttgacagattctgtaggcagaacaatgtaacacaagaaacagatccagtatagtaggaactcagattgtgcagatctttgtatgtgagtgtgtgtatataatacattcacgacaaagtgtgtgtcacaacagtgggaaaaggaaggattcttctgtaaatcatgagacaaaatggaggtagaaactttttttatactctatcataaaatagattctcaggtgattaaagagttaaatgtaagtattgaaaacataaaaattagaaaatatatttacagtgctaagttctgtgccaagttctgggaacacaatggtgaacaacatgtagacatggtccctgccttttcaaggcttatggacacacagagtgtaaaactgcaactgtgatgggagtaaccagtcctgggcatgtggtactgagcatggaacattgggagagttggcccagccagaggaagctttcttgagaaagtaatacggagtgctggatgaggaaagtgagtgaagattgacctttatcctgtctcagaatgggaaagttctttttaaaacatgaaagaaaaagattaaggtgtcttatactataccaagttttttgaaccacctgattttattaaaatgtaactgaccaacagaaggatgttttaaacaaatatggcagacaaaaggtggatgtatttaatatataaagagctttaatgaatcaataaaaaaaatcacttaatacctaaatagaaaaattaataaaaggcatgaccagactgtttctacaggaaaaaacaaaaaacaaaaatcagtgtatatttaataccttctatcttatttttacaaaatgttctgaggctcatcaaactgcacccttgaaatgagtgcatttcattgtatgtaaattagacctcaataaagttgatgcacaatcttctgatgaaaagtttggtggaggagtgtcagagagctcactctataattgctgtgttaaccttttgagtgaaactttgagaaacatcctagatgttcacttcataattagggactggttaaatgaattttagcaaatgaatttagtacattatgatgacgacttgaagaaataaaaccagatttctatatcctatgtggaaagatagctaggatggtgagaaaagcagtcaaacaataatagtacaagtactaatagtaaggataattaacatttattgagggtttatagtgtgccaggcgctttcttaataatcactttccatgtgtcaacactcacagtgacctaattagttaggtatcattattatcctcatttcacaggtaagaaaactgagacacagagaggttgagtaactagtccacagtccacacagcagaaagtggcagaactgaaatcggaacccaggctgttagcttacagagccaactcatgaccaccccacatattgtttctcgacatggtgtggtcagtgtaatcccatttgattgttgtgaagtgttcacaggtagcagtcagcactaatactaaactgttgtatcagagtgacccctaaacacaactgccttgagccagttctgtctctgtcctgcagtagtccagacaagagcacgtggtctaaggagaataccagctttttctccatgaagttgtccaggaaccgaagttccttctcttattgcccctccattccatagagcaagggttacctaacatatccagagagaagcatgaggtgtgtgaatttggatggaaaggaaagctacatctttattccactaacctgtaagtgaagtttaatgtgtccttccattgtgactggagctagcaggtctcatagtgttagcagaaaccatgacttcatagccagtagaaatgacagatattttcgttcatgtttttgttgttgccgatgtctcaaaaatatcacataatatttaccctactttgaaatttcagtaattttattcttgaccataatttattatgtaatgcattaacaaagaggcacaggcattactgtaacacatttttaaaaacattttgctaactgtgtttcaatataatttataatcctttgtgttttatttaatgaatgtagaaacatttgtctgggaaggagttcatagcatcaccagagtgtcaaagggctctgtggcatgcaagagtttcagacccacggccagagtggacttttcttccttgtgctcagagctagctcggagcaccgtagccacattgcagcccacagggaagggtggaatgagaaatggaagaggggaagcactttcctcttaggggacatgaatcacctctgttcatattatgtgatcaggaacttggttgcatggccctacttagctgcaagggagcctggaagatatgttgctggtaggttgggcatgtgtccagtaaaaaactcagttgattccttaattaaaaagaagaggaaaaaggatactatgggaacattatatctagtttttatcttgtgtatgtatagaagttctaaaaagttacacaggatttcagtaaccttatatgcctctgggaaacaggactgggaattgtaggtgaagatggtgactgactttgcattatgtctatctgttatgtttgatttttttgttttaattaataaacttttttttttttgagacggcatctcactctgttgcccaggctggaatgcaatggcacaatcatggctcgctggagcctcaacctcccaagctcaggtgatcctcccatctcagcctcccaagtagctgggactacaggcatatgccacaacacctggctaatttttgtatttttttgtacagacagggtttcatcatgttgcccaggcttatcttgaactctcctgggctcaagcagttcacccaccttggcctcccagtgttgcaattacaggtgtgaggcaccacacctggccaataaactttttttccaaaaagtagttttaggtttacagcaaaattgagcagaaagtgcagagagttctcacaagccccttctccaccaccatacacagactctcgcatcatgaacatccagcactagattggaacatttgttgtaatcagtgaaccaccactgacatatcattatcacccaatgtccatagttcacattagggttcgctgttggtgttgtacatcctatggctttggacaaacgtataatgacatgtatccactgttatgatagcacacagaatagttttactctgctgaacatcctctgtgctctgtctgttcgtccctcgtttcccacaacactgtcaaccactgatctttttactgtcgccataattttacatttacagaatgtcacaaagttggaatcctgttagtagccttttcaaatttgcttttttttcacggattagtatgtttttccatgtcttttcatgactggctagctcatttctttgtagccctggataatattctgttctctggatgtaccacagtgtgtctacccatttacctacttgaaaaacctcttgtttgctttcaagtttgagcagttatgaataaagctgctataaacattcatgtgtaggtttttatgtgggtgaaagttttcagctcatttagataactaccaaagagtgcaattgctggatcctatgaccagaatatgtttagttttacaagaaactgtcaaactatctgacagagtggctgagccattttgcattcccaccagcagtgaatgagagttcccgctgctacacacccttgccagcatttggtgtcatcagtgttttggattttggccattctaatcagtatgttagtgttacctcactgttttaatgacatgtggtgttgagcatgtcttcatatgcttatttgccaactgtatatcttctttggtgaggtgtctgtttaggtcttttgcctatttttaaatgggttatttctgttgaatttttaaaaatcagtgggtgtgcagtacttttgtgatagaaaaatgtagttaattttttctacactgagattttaaatagtattatgattcaagtagaatttttaaaaatgtactttatactccgcattcctaaatgcattggtgactttttttcttggagttttcactctgaataaatacaattgaataaagacactggagatggagagcaatgagatgatacggatctaggaaggagacatcgatctgactgtagtagcggccttgttcttagtagctttaattacataatttacattcatattcttttctttcacactcttttactgtgtccatgcactacttttcttaataataaaatctaaatcttttaaatgatgagtctttccacacttgtctgggaattagtttggttgcagtggggccctggcttttcttcgtaacctttttcagtgccagcttcattttcttgaatcacttgcatttaaaattggagcacatgatgtatacctgggttcttttctgaaatattaaagactcagaagctgaactagtttttgtgtctttaacaagtcatgtgttgtcgcagttgccacctgagccctcatcaggaaccctccttcacagcctcctccagtttgtcgccagcgcacccgccagcccacaccagtttccctgcctgtgcacctctgtagcttctctgagtgccatggttgtgtccatcgcctttttccattcaagaagccatgcacggtcccataggggaagacatccctcgaaacccacatgcttatcaccattaggggtgcacatgcagtgggcagttgttttcaacagaaagcatagatctcctctttaattctttaaaccttattataagcataaaaagctttttagtgaaaccacacatttaatgttaaaaatggtagctttacctgtcaatattgctcagttcctgtagggaggacaatattgttcttccctttgctcttttaaagtccgcactcctgcaccctcttcaggcagctgatcgtggctgcaggagtggaggagagaaaggagggtggccaacctgaagaggcttctacacagatgagaagggagagcaacccccacccttacaccccagcaatgtttgtattaaaaaaaaatgagtgtgctaacaaatgaatttgatggaatttcatgtcacacaaaatgcagttcggaaatgtgagagtgggagtgaccttaaagaagactccatcaccttgctgggttcctggcatcagttagcccgaggtggcagtgcctgcacagggccttccctttctgtccccgcgtccccatggcattctctttaagtgccgagatgtttccagtcagtcccctgcacctgcaagtcagccaggggtgcaagaggagtccaggtgcaacagccagggtcctttgtaagtcagggcactatccagtgatgctcagtgacattgcaccctttgtatctgtgaggactcacacctggcttttagaaagtgaggctttacaagagcttgtttgtcccttaaagaaggccatcagggtgggctggatgtacggccaccatggaccgtggaatattcctccttcttgctccttagcacctggcttcccttctcaagtttacctcattttactcaaggacagttctttcttcatatgctcttcagttccactgcaagtgtggtccagggatcggcagcagcagcatctgctgagactttgctaaaatacagaatccaaggccctgccccaggttttctgaatctgtgttgctaacaagtgcaccagttgactttcatgcacgttaaaagtttaagaagcactgtaggggcttctggttttttttttgtttttgttttgttttgttttgttttgttttgttttgttttgttttgttttgttttgagacagagtctcactctgtcacccaggctggagtgcagtggtgcagtcttggctcactgcaagctctgactcccaggtttcacgccattctcctgcctcagcctcccgagtagctgggactacaggtgcccaccatgacacctgactaaattttttttttttatttttagtagagacagggtttcaccgtgttagccaggatggtctcaatctcctgacctcatgatccactcacctcggcctcccaaaatgctgggattacaggcgtgagccactgcgcctggctggggcttctgcttttttaatgggtacgtcatctggtagaaaataattgtgatttattacaaaagaaactatcatcagagtgagcagacaacctacagaatgcgagaaaatttttgcaatctatccatctgacaaaggtctgatatccagaatctatgaggaacttaaacaaatttgcaagaaaaaaacaaccccattaaaaagtgggcaaaggaccatgaacagacacttctcaaaagaagacattcatgcagccaacaaacatgaaaaaaagctcaaaatcactgatcattagtgaaatgcaaatcaaaaaccacaaagaaatagcatctcatgccaatcagaatggcgattattaaaaagtcaagcaacaacagatgctggcgagactatggagaaataggaacaattttacactgttggtgggtgtgtaaattagtccaaccattgtggaagacagtgtgctgattcctcaaaaacctagaaccagagataccatttgacccagcaattccatttctgggtatatacccaaaggaatataaatcattctattttacatgcacgcatatgttcattgcgcaccgttcatacttgcaaagacatggaattaacccaaatgcccatcactgatagactggataaagaaaatgtgataccatagaatactatgataccatggaatactatgtagccatagaaagaaataagatcatgtcctttgcagggacatggatggagctggaagccattatcctcagcaaactaacacaggaacagaaaaccaaacaccgcacgttctcacttataagtgggagctgaatgatgagaacacatgaacacatgcgggggccgggagcggggaacaacacacattggggcctgtcagtgggggtccgaggggagagagagcatcaggataagtagctaatgcatgctgggcttaatacctaggtgatgggttgacaggtgcaacaaaccaccgtggcacactatgtaacgtatatttgtcctgcacatgtatcccagaacttaaaatagaattaaattaattttttaaaaagaactgtgattatctgtcttccaaatacagattttctataaaacatataagccatacctacttcactttttattattttattttattttatatttatttctttttctagacaattttagaagtttaaaggccacacctactttaaaccttttatgatctagtaattttttggtactgctgagttattcatttcttctgtatataaatataaccttttggttagatttgtacgaatatgtggactataacagttttacatattttttttctatttataccaagtaatgctttaatttctcttgcttgtttctagttcctggccctttcttttttcatacacactttccacctgtggttttctaaaaccattttttgcatttcaaaatttaggttaacgatgagaatgctttcatttggaaaggaaagaaaaaccaactcagaatggcttccactgtaggacatgtactggctcacataagcaggaggtctggagataggcagggctttagggtttgtatctccagggtcttggtttctttcctttcttccaccctccctccatcctgaaattgacgtcgatcacattgacaaaatggccactgggttccggggtgcaggaggagagtgctggctgatgtcttgttttccttcccagagaccccagcaaagccccctcattcatccagtaaaatccacagcactgactgcatacatgtgccagctttatcccaggtgctggggaaacagaaatgatgcaaacagatagaaattcttgccctcacggggggcctgcattctagatggtggagaaagatgtaaaggaaagagatcaaatgcacagtatataggcactaagggcgaacgtgaagagtatagcaggtgtggagaggggataggaactgctgagtgggagaggggctgccatttattgcctagggtgacaggaagggtggccatgagtaaagacctgaaggaggtgaggaggagccacttgggcatggtgagggcacaggtcctccacacctactctttaaaaatgtatcatgttcttctattttttgcttcacttctctttacatttgggatgaattgtttctgctcttaagtttggttactttaaatttcatgaccttgtgttctggtcctccacctaatttcattcttcttcccttgggaaattatatttgtgtctgtcatctgccctctggctgtgctggtgagcactgggacaaattattcattctgtcattagtgatggctacctcttctgtcaacacattccacacccaggttccctctccttttgtttagtgactacaggcctttgagatgagaacatttcctaatgtttatgttaacttgcactttaattgtggataaattaaatgcttcctttatgatacattttcttcatatattaacctctaagacacttccaaacttaatatgggatgagtgtgtgctatagatgattcttctatttccgctgcttgctcattcttgacctacccactggcttttctgtcctcttgtttattcattagcagagaacatattcaggtgaactggttgcccactccatcttgccaccctttcacatgatgcttttctgaaatttgacattttaaatgtggggaaacgtttcagatgtatttggctaaccaatatttattgtgctaggaattattttttataaataaatatttactgctgagttagatcatacagccattaacttggctcagtaaataaaatgcatttagctagttgtcctttaatcgattctcccccccaccatttctgttttctttgcttttctgtgagtggctcacacagaaaattaccattgttcctatttcaggcccgtgttattgtggagagtgttttaacatcgtcagtccttggccccttctgcttttaatcagcctccttgaacagaacccgatagaaacttcatttttaattttgtgggttttattttctttctttatttatttttgatttaaactgaaatactaatggctatcaaattgtttcatgattctattacaaagatcacttctttggaatccagaaagactcagatcactttttcttctccctgttatttcatttttatttactggtattaaaaaatttccctattttctgcaagacataaagggcatccagataggaagagaggaagtcaaactattcctgtttgcagatgacatgatcccatgtcttgaaaatctcatagtctctgccccgaagctccttaagctgagaaacaacttcagcaaagtctcaggatacaaaatcaatgtgcaaaaatcactaatattcctatacaccaaccacagtcaagcctagagtcaaatcaagagtgcaatcccattcacaattgccacaaaaaataaataatatacctaggaatacacctaaccagtgagagatgaaagatctctacaaggagaactacaaaacactgctcaaagaaatcagagatgacccagacaaatgaaaaacattccatggtcatggatagaaagaatcaatatcattaaaatgaccatactgcccaaagcaatttatagattcaatactattcctgttaaactactattgacattcttcacagaactagaaaaaactgttttgatattcatatggacccgagaaagagccagaatagccaaggcaatcctaagcaaaaagaacaaagctggaggcatcaccctacctgacttcaaactatactgcagtgctacagtaaccaaaacagcatggtactggtacaaaaacagacacatagaccaatggaagagaatagagaacccagaaataagcctgtacacctacaactatctaatcttcagcagacctgataaagcagtggaaaaaggattccctattcaataaatcgtgctgggataactgggtagccatgtgcagaagactgaaactggacaccttacttacaccatatacaaaaattaactcaaggattaaagacttaaatgtaaaacacaaaactataaaaaccctggaagacaacctaggcagtaccattctggacataggaatgggcaaaggtgtcatgatgaagatgccaaaagcaattacaacaaaagaaaaaattgacacatggtatctaattaaagagcttctgcacagcaaaggaaactgtccacagagtgaacagacaacctatagaatggaagaaaagttttgcaaactatgcatctgacaaaggtctaatatccagcatctatagggaacttaaacaaatttacaagggaaaaacaaccccattaaaaactgggcacctgtagtcccagctactgaggaggctgaggcaggagaatggcgtgaacccgcaaggtggagcttgcagtgagccgagatcacgccactgcactccagcctgggcaacagagtgagactctgtctcaaaaagaaaaaaaaaaaactgggcacagaacgtgaatagacacttttcaaaagaagacatacatgcagccaacaatcataagaaaaaaagctctacctcactgatcattagagaaatgcagatcaaaaccaccaagagataccatctcacaccagtcagaatggctattacaaaaaagtcaataacagatggagaggttgcagaaaagcaggaatgcttatactctatttgtgggagtgtaaattagttcaaccattgtggaagacagtgtgacgactcctcaaagacgtaaaagcagaaataacattccacccagcaaccccactactgagtatatatccaaaggaatataaatcattctaaggacacatacacacacatgttcattgcagcactattcacaatagcaaagacatggaatcaatctaaatgcccgtcagtgttaaagtggataaagaaaatgtggtacagatacaccatggaatactatgcagccataaaaaagaatgagatcttgtcctttgcaggaacatggatggagctggaggccattatccttagcatactaatgcaggaacagaaaaccaaataccacacattctcacttataggtgggagctaaattatgagaacacatggacacatagaggggaaaaacagacactggggcaaatcagagggtggagggtgggaggagggagaggatcaggaaacataattaatggatactaggctcaatacctgggtgataaataatctctacaacaaaccccaatgacacaagtttgtctatataaccaaccttcacgcgtacccctgaatttaaagtaaaagttatatatatacacatatatatgcatatatatgtatatatatgtatatatacatatgtgtatatatataacttttatgtgtatatatataacttttatatgtatgtgtatgtatacacacacacacacacacacacacataaccttgtgtctaaaacaattcatccactcaatttgggattgaaaatcccaatctttttccttccactttcatatatgatattctactttattgtgtgtgtgacctgattaaatactagaaaccctgatccttgaggtcaaagtcagccaaaaacaggaagaagcaaacctcttgtgaagcaggtgacccagactgcaagactctgaggactcaagaaggggccactttgggtggggcttcatcacttcttcaccgagaggtgtcatttcctgaggactaatagattcgggcattcaagtacatcagagagagaaagcataagagagaggtgacctggagaggtaaagccttgggaagccctccggagaccttgctttttctgtggatggaagaagccatgtggatgggtaatgaaaaacatagctaatctccctcactgattcaaggtagctttagaactatgcttgcacccttgggaaaagaacactaaacccttctggttactgagtacacattcacttctgggaagatcaggcaaggtgatatgtggaacaggtagagggaggtgggaatgttctccttcctggctataggccatgggactgaaagatgggagccaccataatggctaaaatgaaagaagcaacttcctattgaaaacttgcagagagatgaaagtagggccacgtttaggtgcatccaatgagccaccatcttctgaagtcctgccaggcctaagtcggtacataatcattgaagcggactttgttttattggatatttatttagcagatttaaagttcattccacagaaggtcttggtatcattttataaaccctcaatgaatactctaaatctctatgatttatctgagaatagggtaagaaataaagatagctgcttgataatttgacaacagtattctgttggtacggatgacataatatatatttttagatccatgtcattttaattaaggattttaattagtgttttttgttgagaataaaatagtatgcatccttacaactttgtcttaaagtcattgtatttttcaaggggctttctctagcaaaaacacagatgaaggtctccataacaattggtccgcttctaacctcatgtgccttatttaaaattttaaagaattgcagaattatttctcaaaatatggtctggagtcaatagcagttcagcttcacgagagcagaaattgtggactgtctggttccctgatgtatccccagcacccaaaacacgggcacacagcagatgtttaataaatatttgtgatggagtgaatgaatgattcttaatccattttaatcattgattttaaggaaatatgtcttaattgagagtttatttcttacatttattcatttttcactttttcctgccaattgctatgtagaagcaattaaaagcaatttcctttgtaaaggaaatacccttgtagcaacaagtatgtgtcccatttttgtttgtttgtttgtttgctatgagaatgctttattaggcaaaaccacatactgtgaaaatgctttaaaatgcaacaggaggagatgtgaagacacaaagaacaagtgcatagtgacacatggctatcagaacacactaagtaaagaatccacacctcttccaccctttatccagaaaaggaaggagctagatcacctcctcctcaggttccccacatctcattctagttaaagcgaaaacaaacaggctgctgttctcagcacccagtgtggaaggaatagtatatatagagccaccttgcctcagagtctgccaaaaaaaggtcacatgtggaataagacttaccttctgatttttttttcttttcttttctttttttttttttttagatagagtctcactgttttgcccaggctggagtgcagtggcacgacttcgactcactgcaacctctgcctcctgggttctgggttcaagtgattctagtgccttggccaaccaagtagctgggattacaggcatgagccaccatgcacggctaatttttgtatttttagtagagatggagtttcaccatgtcagctgggctggtcttgaactcctggtctcaagtgatcctcctgccttggcctcccaaagtgctgggattacaggtgtgagccacctcacccagccagcctacattctgctttttgagctgagtaaaaaccttttgggaaatagttctcagaggcaaatacagacatagagagcagccccattcagtaggaatacgctgtgagccacatgtgtaattttagatttttgaatagccacattaatttaaaaatcaaaaagtaggtgaaattaattgtaacatttatttcttatttaacccattatatccaaaatattattgtttcagcgtgtaatcaatatttaaaaagcacgaatgagatactttatgttacttttttgtaccaagtccacaattcagtggatattttattcttacagcacatctcaattctgagtaccacatttcaagtgtacaggctcttgtactggacagtgtcattttagaggagggcacaaacatacagccatagcccgttcctccccctgaaattctaggaacaaaggaaagctctgaaatattcctctttggtgaatatgaatagcagagatgaatgcaaaatggttgtgacccctgatcaacagtagatttccatggacagactggtgaaacgatgtttgcagttttgtgctactttgcaggaagataaccccatgtcctactgaacatttattgggcaccactgtaggctacaaaaagccctggtcttttagagtggaccatgatatggtctgagcttcaagccttgctgggggaagatgtccacttattctcactttccagtccagtatccaacaacactctttataactcagttgtagtatttattatatgtaaaaaaacatgtaataagcatggggaagctctctggctatctccatgcaagcttcatgattagttcacttgacagctgtttattgagcatctaccatgtgccaggcattgctctagccatgaggtggcagcagtgagcaaatagaccaacactgccatctttgtcaaattttattctagtgggaggagacaaacagtgaaaaacaaaataaagagaaagtaggaagtgctgtggagaaaaatagaacagggaatgaggatggaaggtcagggtccaaattttaaatagggggtcagggtcagggagggcgtcactgagagggtgaagtttcagcaaagactcaatgttgaggtgatggaacaggctcatagatttgctggaggagaattacaggtaggaacttctgatgaggtaacttctgatgaggtaggaacttcctcaggtaggaacttctgatgaggtaagaacttctgatgaggcaggaacttctgatgaggtaggaacttcctcaggtagggaattctgataaggtagcaccttctgatgagataggaacttctgatgacataagaacttctgatgaagtaggaccttctgatgaggtaggaacttcctcaagtgggaacctctgatgagggactatgtctggcatgtttgaggaacagcatagtggcctgtgcagcagagcagggaaaccaagaagccaactatttggagatgagtcagagcaagcagcaatcccagagggagggcacggggaaggaggctgtggtcatggagagttggagagggggctctcagccactgtagaactttggcttttactgggagtgcaagcttatgctcgtaaatgtagcaaaattatggtaattattagactccctgctgaatcatgtttgtttaatgaagctcgtatattgtaatcttatgtatcttactttatgcatttaaaaatattctgagaggggccatacacataaaagaggttaagaacacctctattactgggaatttgagtataagagtcttgtgatctgacttaacatttgataagcattgctctggcaaattggtggaggatggcttgtcaggaacaatggcagaaatgtggagagacactagtatgctgttccagcaacccaggagagaggtggtggaggctggactagcactggaggtcttgagaagtcgttccattcttagatgcattttgaaagcagagccagcccaaagttaggctgaaagagaggtgtgcaagaaaacagatgaggccaaaggtctgggcctgaaccactggaaggatggagttgccattacctaagacaggaaagacagctgggtggagggctttggaatggaaacagtgagacgactcttagatggccatgtctttttcatttgggggatgtagtgtactttagcttaagtttatccatatcttccacagtatcttaaatgtgttgtctgacaccagtttctgagagaggcatattaaactctaccaatatgatggtgaatttcaaactcttctcataaccctgtccatttttacttcagtatcctggagctttattgttagacacctatacatatggtattgttatatcttcctagtgaacttttattatcaaataaagacctttttctcatgatttttgccttaagatctggtttagctgatatttatatagctatgccagcttatttttttgctattagttgccattcccttttcctttcaattattttggcattacatatatttttgtaacagctttattgagatgtaattcacatgccatacaatttgtccacttcaagtgtacaattcaatggtttgtagtagagttacagcattgtgcagttaccacgtctatctggttctaaaacatttgcatcacccagaggacaccctgtacctgtcaagctgtcactcccattctcttctcccctcagcccccaacaatcactaacccactttctatcattgtaaatttgcctattctggacatttcatataaatggaattacacaacacgtggccttttgtatatggtttctctcacttcgcacaatgtttttaaagttcatgcatgttggagtatgcatcagtactttattttcttttatggctgaatagtgttctgttgtatgtatcaatcatactctgtttatccattcatcaattgatgggcatttgggttgttttttcttgggctattgtgaataatgctgctatgaaaattcatgtacaggttttgtgtggacatatgtttttaattcgcttgagtatttttctagtgcttttgtggtcttgtttgttacatttacatctgtaatccactgaactagattttggtgtaaggtggtcatataacaaccaagttcttatctttcacttaaaattgctcataaacattaagatggtattaattgttcatctttttattagttaattatagatacagatattgttctttgcaaatatgatactttgttcataatatggaagcatgtattaaaatttaagcacagatgttccctacagttaaaagttaaatagattaggatattttattgtatcagcacgaggaggaatggcattgtcccattgagtaataataccctagtaactgcagagaattcactgcaaggctagctacataatatacaggacccattacaaaatgaaaatgtgaggctctggcctggtgtggggcagtcagtctctccttcccatgggctccaacccatggcaaacaggcatccaactaagggcttgcaacctctgcaccaggatgcactgaacacctgggtgggggatgggtaggaggtccacactgagttgctagccgaacacgccatggcactgcctgcccaaggtggggacagccacccccttggtctgaccagagactccatgtgtcatgtagctgactcatgagcctctctatacccttgtccaggaaccccactgggtgttggctgaacacgggcttcccccaaccaaagcaaccaatgtcgctcctggcagaaggaggaggcagctgtcatgaggcaggaatggggaggctgtctagggcccagggtgccaggggcagggagcaggtaggagaaaaccatcatggagagactgtggggatcacacgtgagcagaggctccaaggcccctgacgtgctccattgtgtcacttaacttcacttaaaagcatgaagtcaaagataaaattattaagaatttttgaacggtggcctcagagcaataaactctgagtgtgaggctctaaaaagcacacagcactgtgctgctccctgggtcccacactcatgaagccagccctggtgcaatgtgacttctttgtaacataatttaaaaattggaaggattttgactctgtttatgaaataaatcatagtgctattttaaattaaatgtatttaaagtatctctgtgttgtctttggttaatggcattatcagtgatatttaccttattcttcacacttttttgtgtttcaggttttctataatgaaatgagttacttttataattactcaaaccccagtgttatataaacatactttactggatattattttatataagtgtgatatattacaattctgtctccatttggggggaatacatatttagtactttaacttaaaaatatattcctctccttacccaggtccattaatataagatttgccactctcttggatactcctggtgtggaaaatcttgtcagcaccctcatgttgaataaaagcatattggaggacttagaccgttacaacaaggctcgcaaagaccctgtaagtacctgttgtgaccagacctcaggatatgggaccattatgatgacccatgtagattcagccctgaaacttccttggatctgagttggaaaatcatatggcagggggcagtggaggtagagttagaagatgggagcaagaagagaaaactgtggagactggggcttgaggaagtgagaccattctcagtggggatcccccagagggatcagatacccaaaatccttctcaggaagatagaaaatttggacttgatccaaacaatcatatcaaaatgagatggatcctagtctttgggataggtagatacagtatgaccatggttagggaagggtagcttaggaatccatgggtatctggtgcccacctcagcagcactgggtaccagattgagggtagtgggaccctgtttgagcctatgagatgatgagtctgaccagacccttttgttgagctggctgcatcccccaggattacatgggctgggaaagatcctgcatgataaatgttgggttctctttctagtgtagtaatgcatgtatgtgctatggcaaaagtcaggcttgtggcagtctgtaaattaatactgctgtcttagggccatgacagttaatctgactacacatggaaagatgaaagaatattgtgcatagtcacttttttgatacattttattttgaaaaaaaatttattgaggtataaccaataaacagtgtgatggatttcacaatttgcatacaccatgtaaccagcacatgttttaagaaacagacttaaccacagcctgctggaagtcccctgatgcctctactcaggcctttccctaagttaataccaccttgcttctaagatcagagattggctatgcctgtttttgaactctacataaatggaatcacaccgtttgttttctgatatcaagtttcttttgctcagcaatgtttgtaagagtcatccatattatagcatgaggtatttcatggcatgaatataccaccatttatttcttcattctactgttgaggtctttcagggagttccagttatttgctcttttggaaaaaaaccttttagttaatttttaagtcatcaggagggagacgccaaacacctaaacataatgtcatatacacaaatgtttactatttataaaggcatcagagtaaattgaaataaaacttcccttcagcacatggtttgctttggtttgtcttgcactcttttagttcttcattttttgctccttccctcctggccctctaagtggtatgaggtcaagtcctggttctcaaagtatggtctaaggaaccttgggggtctctgaaacatgaattttctgggagtctgcaaggtaaaaactgttttattccttttccactgtgttgagatctgtacttacgacgcataagtacatatgtacttatgatctgtacttatgtacttatggcattgggtgaaaccaatgccacctcagagtaggtcacggaagtgtcagcaaacgtcctagtggtcctggtgttcttcaccgtcatcccagtaactgcagaaagagcaaaccacagtggaatatccctgcacacctatcagaatgactaaaacaaaatagcgatgccactagccgctaaatgctggcaaggatgtggggaaactggatctctagtgttgctggtgggaaagtagaatggtgtggccactctggaaaatattttggctgtttatttttttatttttatttatttatttgtttattttgagacagagtctcactcttgttgcccaggctggagtgcgatggcgcgaccttggctcactgcaacctccgcctcccgggttcaagggattctcctgcctcagcctcctgagtagctgggattacacgtgcctgcctgtaatttttgaatttttagtagagatggggtttcaccatattggccaggctggtctcgaactcctggcctcaggtgatctgcctgcctcagcctctcaaagtgctgggattacaggcgtgagccaccgtgcccagcattgactgtttatttaaaaactaaaactgcaactatcttatggcctaacatttgcacttgtgggcatttgatccagagaaatgaagagtttacactaatgttcatagcagctattgtcagcaaagatatccttcaacagatgaatggttaaacacactgtggcacatcatgtcatggaatactactcagcagtgaaaggaatgaactcttgatacatgccttggcttggataaatctccagagtattatactgagtggggaaaaaagccaacccctacaggttgtatcctctagcgttccatttgtatgatactttgaagtgacaagattttagaaatggagaacaggttatctgatgccagaggttaaggatgcggggagggtggggacagagggggcaactcaagggatgttgtggtattagaactgttcaatattctgactatagtggtggatacataaacctatagaggtgatgaaatcatgtgaaacttcatacaccacacacacacacacccccacaattgtatcaatgttggtttcctgcttgtagtattagactatggttttgcaaaatgttattattaagggatactgaacaaagtgtacaagaaatttctgttttatttcttacactgcatgtaaatctacaagtatgtcaattaaagagaaagaaaaggaaaagccagtttcactaaggaatatccttgatgaagcagtaaaattattaagtttattaagtctcaaccctgaggccaggtatggtggctcacgcgtgcaatcctagcactctgggagcccaaggcaggtggattccttgaggccaggagttcaagaccatcctgggcaacatggtgtaacctcatctctactaaaaatacaaaaattagctgagcatgatggggcacgcctgtagtcccagttgcttgggaggctgaggcgcaagaattccttgaacccaggaggctgcagtgagccgagatcatgccattgcactccagcctgggcaacaagagcaaaactccatctcaaaaaaaataataataataacaataataataataatatctcatagggttggtgtgaggatccggtggacatagggaaggcgtttaacttactacctggccaaaagtaggtgttgatagatgtttgttctgttgttatgtgaacgtggttaagacccactgttgcctgcttacaaaaacattcatagccatatttttaagggtcttaaaatatatgcttatcttttcaggatggaacactgctgcaggcatttgtagctgaagttgcagaacaaatagttggtattgcagtgatcagaaatgaaatggtaaattgtgaagtggatataaatttctttgattgtgccttgctatatcatgaattagcccacagtgccccttttggagttgtacttttacttatttaatgtgaatgcctcctttttctgatggatatcatcatcatctgcctctatcccacttgaaggacttgcaattctccatttttttgcagttcagaatatttaatatattacaaagaccacatgaaaacattctcaccctaaaaactcagatagctttccaccacctatacatatattaatatattccatatattaatatgttctaagtattactactgtagtgatgcatttataccttccagcattcttctttgcactttattacatatatcgtgtgtgtgtgtgtgtcaaatggaaatgccattttattttttcccagtgcacagccagctatttcaaagcatttattactgaataatccattcgttcccttttgattttaaaatgctgcttttacatttattaagtttctatatgcctatgtctatttttaaactctgttctgttccgtggatttatctgttgatacctattgcattatcatgtgcttttatatctaataggggagtgttctctcatttggtgtcttctaaattttcttgttttttgttcttggttatttcctctcccaaaccttgtaatatttattattaatataattgtacctacgtggattctatagaacaatttagggagaattgacattaaaatatagagacttccctattaggatcatggatcatggctttctatgttgttgttgttgttgaactttttgggttcttcaaaaacgtcttgtggcttctttcatgtggttttctttgcatcgtattttgtgccatatgagtttttgtttgtcctgtgggtccactctccacctttctccaccctgttctgtctcagggagcctgactgatgggcacagcattatgggtacctttgccttttggctgcccgttgggtttggtggatggagagccctgacagaaggaggaggggtcagtgatgtcaggtgcctcagcaggctgattgccactgagttccctgacatttcaaggcagcctcttcatgatactcttttggattcctgtaaccagccctcctcccgcgccaccctcttagagtgggagtagcttgtagttgctgctgcacagtccctacttatctccttacacctgccccatccttgtaaatattacctttgttaaaccgccctccaattatcctaatctgatcatactgtttcctgatgagaccctgacctgacacagttctagacgttgatcacttatttctacgtgttttgtgatttctcttggtattctgagtatacactttttctcatattttctaaatgtttgtcttgtgtatggaaaagctactagtgtttgtattttgatcttgtattcaatcacctttatgaaatatctttgagcttggagagtttttcagctgattctcttttctgccacagccatcacctccaccctattctactggtcagaccagttagagggcacgctcagacacaaggggtggaggcagacttctctcgatgggggtgtggcagagtcactttgcagaagagcatgagggatgtgggatgacaggtactgtcctggtggtcatcttaggattctttggataagagaacctgctacaccttccttttcactatttatacctttagtctttttccagttttagtgtatggatagaacaacattgagtagtagtgttaataatagctggctttctggtgttcctgattttaatggaatgattctacactttccttcatttagtgtaatcgtggctgtaggtttctgatagatatcccttatcaagtaagggaaattttcttctctttctatcttattaaaagtttttattatgaatgagtgttgaattttatcaaatgtgtttttgacatcgagatgttcacatggctttatttctttaatatattacacacttttctctttcttagatttattgcactttttgatccaatatttcttggagttagttaatcttttagagatggtgttgggtagtaaggtccctgagtctacacaaatatgataagttttcattggtcctcatacttgtatactcatttggctgtgtgtagaattctattcaaattattataataattattattattattttggaaatggagtcttgctctatcccctaggctggagttcagtgatgtgatcttggctcactgcagcctctgcctcccgggttcaagcgattctcctgcctcagcctcctgagtagctggaattacaggtgtgcaccaccacgcacggctaatttttgtatttttagtagagatggggtttcaccatgttggccagtctggtcttgaactcctgacttcagatgatctgcccccctcaacctcccaaagtgctgggattacaggcatcagccccctgcgccagcctcattctaattatttctcatcagaatgttgtcttccagtatccaatgtcattgataaaatataatctgataccaacctgattcttgatcctttatgaataaatgtgtgtttctttgctctccttcttgagaattaaattttctttttgtatctggaattctgaaattttgccaagaaatatcatgtctcttttggcagtttgtcttctatgatttcattaattatttcttctcctccattttctccattcttcttttcttaaattcttttttagatggatattagatcttttgaattgattcttcagtgtctctaaacatatatatgttacattttactcatcattttagatttcctcaattttgtcttccaaatctctaattcttcagttgtgtttattctattacccaagtattctattggaatctttatttcagagttcacctatttaacttccgagtctctttcttgttctcttattgttcctttttggtatcagcttgtttattacatgtaagatcctttttgatctctctgagtatactctgtagaatttttttaaaaattctctgctatttccttaataatttgtcttctctgcagtaagttgtatgtttctctatgctggtctttttttatttgtcagttttcctcaaaagtctgtccatgtcatgagtgaaagattaaatgatcaatttgggtggctggcatgggtatccttgacagttgtgcttgtatgtttctccatggcatctcccctgtcactggtaatgccaccgcccctctttttgattgggagggatggcagtatctggcttccccttgtgtgcttgaatggagtaccagccggcaggcagggactccaggtgacccaaggtaagaaggtttcacctagtggtagggtttccttccagtgtaaaactgccttacttttttgtcctccattatgctctcattacaccaaaaataatttttgttgttgttattttaagggatttgggatgggaagaaaattagatgcacatggcccatctgctgttttgagctaataacctctgttggctctttgctttttgtttttcagtgatttctcagccctatacttatcactcattttattttataatgagagatgcctccttggtaattaaagaaaagtcttatagtataaaggccattacagggtcaatgcagattgaaaggttgccagaactgccctagggttccgccactggcccggttaccctgagctctgtttcctctgtgctttgtgacagaagctggaaaggcaggggacctcgaggagcttggccacagatgccacagttttcatggatttgctggtgccagccttgctgatcacagaacacatcaggggccttgcattctccaatttctgttcttgaaagtaggcttttaaaacaattttactgtggaaaacaaggagaaatataagttggtgttttgcaacctgcatatatgatttgatttttcctgcattttgggtgcgtttactgctgctgtcatcagagagtcacactcaccttggagtgctcccctccccccacgctcctgacagcatacactgctgggaggtgacacaggacaggctggcccagggcacagttagcatggagacctgggatcccagtgcagtgtggggacagaggggggaccagaactgggcctgtggaaacgagcagtgtgcctgatatttcctttacatgggaagacactcatcagtcctttaaattaccttcctctgtaaaaatattacacatcaagggggatagaaggtttaagaagtgcacagggataaggcccaattacgcagttttatagcaggccagccagccatacatgtaatcaaaatgtatgatatggggccaggcatggtggctcacacctgtaattccatcatttgggaggccgagacaggcagatcacttgaggccaggagttcaagacctgcctggccaacatggtgaaaccctatctctactagaattacaaaaaaattagccaggcgtgatggtgggcgcctgaaatcccagctacttgggaggctgaggtgggaggatctcttgaacccaggaggtgaaggttgcagtgagcgaagatcgcgccagtgtattccagcctgggtgacagagtgatactgtctcaaactaaacaaaacaaaacaaagtgtgtaacttgggggtgacacatttccacactaacaggtgaatagtaatgcatcagagaacaccagtggctctgtttgcccgactcctgaatttcccacaggctccgtctcttgtgctgactggcttgtgctcacatcgcctggcagtgtcacggagctgctgtcctgccgcttggccaatggcacagactcggggctctctgagttgatagcagccatgggtatggaaggagcacattacaagctgtgctgccatcccccaaagacaatccatcagaacaactagcactcaggaaacgtaatttctaatttaaagaatttaccatggagatgaggtggcaaatatggaagagaaaaatacgtttcttactatcatacctaaagtaatttttaaaagatatttatcacaaaatgcatgccgtttgtttaaaatgcttgtagaaaccatcccttctgtctcttctgtaggacattgagtacatacggtcccattacaacattgaagatttcatctacttcagtcaccaccagcgcgaagaacacgggcacatgcatcactttgccctcaaccccattttccggcactacaccaagttctttctgaaggagatcctgcgtttaggctttaaatcctgtctctactaccgtgtttacccaaaatccagagaaggcaaggtaagagaatggtgcaattcactttcccagcaggtcaacgttcacagtgttgttggtgttgtacgccgcattctattcattcctctcatgatgggttttgatgataacatgggtctgaatttccaatggccatatttagtttggcctttttcataaactacagtgacattctgtaggcttcgaatttctgacacaatcacaactaatataattggtagtacaatatgttggcttttctatattgacaaaatagagactgaaaactgtgcagaaatgctctaagagcatgaagatctaataatttcttatgatacgtgagtacaatgccaacatgatcctattctgttccttcaagccaagaacatttcagtgatgaatccatagaataaattaattctattttagaagactggcatgctatcccagcattccaaataagcactatacacacccctactaggtgatggagagaaagtgcggagatgcctgatgccgatgtaaccccatgtaacacttgccacatttgcatggagtaatactgtggtaatagacgcgaatctgatgtgtatacatggtgtgtatgtgcatgcacagatagcaagtcctccatcttacttgcatacctcccatcccactttagtgttcctcatagcactcaccaccaactgaagttatctattttaccatgaacgcagccatgcttttatctgtcttgttcaaagctgtatccccattgcctagaagagtcacaaacacacacacacacagagacaccccacacactctcatgcattcatgcacatataccacactctcacacacactcatgagttcacacatatactcacccccctcccccacacgcacacactcacacactcatataaggtgtctggttgttccacaggaaaaggcctattcaagatagattcccaagggttttttttcctgaaaattggtctctcagtcactgacaacattggtcctcaacttgatgtagacttgggggtgaagggattcaaccactagaacaggtagaagttgtcccgtaagattccactcatgaactcaaactttcccatgttctgcctagagtctttgacattgtctcatcagcacaagggagctaagggatcttaaaatgccttattattaatatgtctatttattaaacaatctaaagtgtgttagtacatatacacataacaataattttgccagtgtattttatttaacgaaaaccttttggagaagtccagaaaaccttttggagaagtccagagggaatggggaagaaagaagaaaaacagaaaaggttttgagtgagatgtagactctgctctagttttttttagtttttgttttttcctgtcaaaatgcagcaccatggcaatgaaatggcccagctttgaactcactgagatgggaaggtaacagttctgctggaaaatcctggtcctgcacagttttcttttactttgcacttggccaaatgccagttttgtgaccttcaggatgtgatattaaattcttgtttttattcatgaagttgcctggatgttctgggttagagaaagtccatttgcatccataataaaaataataccttgggcatttcattaaatgtttatacatttacctcaatagtatgaaattaggaatatgttccacactgttgtatgtagcctctaaaaacatgcttggaaacagatttcttctcagtctgcccttccagttgatttcacatattcatttaaaacaagtgtatgaagcagttccaaataatttgggtaagaattcccaaattctgctataaatctccagttgactacagtaaagttgagctttttggctcacattatggggatggttttctctgtatccctctggtcagggcatgtattaagagctcttccaggcataaaaacagggtgctggctagggttctgtttttcagtttgcgaagtcacggtctgaagtccagtggtgaaggattttagaaaaccattttagaagctcttagaagggccggggctatttttagaactgcaaaaaagtcataggtaaaccatctatttattaaaatgcatctacagttgtttttctgtctttgctttccagtctaaattcaataaatgtatcattaaaagttttgattttacagtctaactcttcagatttaaatggttacgatgtccttagttcatttcaccaaaacccctaagatttcataaatgtgacagaaataaagatcaccatgtttggttttctctgctaagtttttaaaactggataaaatcaatatttaaagcattcccctaagacatgatttatcatagttcatttcaataagtataaatccaactcataatttagtattagtctagatgtaaataatatgatctacttctcccacacccacccccacttcctagttttatctttttgttctaaaacagtttttgttgttgttgttgttgttgttgttgttgaacaaaggtctggttgaagtcactgtgagtgacttacaaacaggaggattttcacatccctgctaagttaccccttggatgacatttttatctatgtgtcttcttaaagcagcttgtgccaaacatgcaaaggttaacaggatgcagataacacagcttaatggggtcagatcaagctgatgcatgatcactatggagaagaatatcctcccggggaaaatacttgtactgaaaaatcccataaaccaaaccacttgtttatctgtcattcccacagagatagtaatgtaattactctcgtaattatcttcattagtgtcaggcattatctacaattcattcctctgctcgaagagtatgtttgtttatttgctgatttttttttttcctctctgacttggccgagttaagagttttgtatttgtaaagctgtacgcagacatctgtgctgagcctctctgacattctctcccctaaaatatagattgctgtctttcagttccagaacccctacgcccactccctgacatctgcccttcattacttggttcccgtgcgaccacgacgacagattgtctatcctctggaaaagcttggcataaacgctccatcaaaggcggtctccaaggatccggtgggtagcagggcggcaggcagggcggcgcggtgccagctcccgcgggcctggcagatggggtggcagtgctgtcttcacaggagcaggctgcttcttaattacagggaacctggtgctcatacccttacaggcggagccccgcgaaggctcccctgcagccctttccctcaagtcgttatttcccgggaagcctaaagcagtagccacaggaccctgcagggtcatgccatgaggatacctctcaggctgctgtgtcccaggacaaaaggcctagagtcatcctccagcatattttcattttctttccctgtcctcaaaagcagattccccctttcaatgatgttttgctttcaatgcattaagtggtcattcgctgttaggacaaagctgacagagaaaacagagctggctgcattcgagatgtttgggccccgggtcctaagctggtttgtttaactccctcctccatttgaatcaagatgattaacagaagcatatgagctgccctggggcagcaggagtttctgaccttaaaatgaatggccaggggccacttttattgggagaacaggaaaaaggactgaaatcaaacctagatattctttataaatggaaatgtacctgtatacatacacacagttttttcaataacttaattggaaaacataattttctcatgttgactgatatgggcttgtagtgtttgtatactctttcacttaagtaagtaaaaaaaaaaaaaatccctcagtgggctaacatttgtcctttgtgagacaggaaaaaaggaaagtgtaagtttaaactctccaaacacttacccaaggagctgcccctcagagctggagacgatgctgaaataaacacctcgcaatacgctcggcgctgcaggaaggacatcacccgacccagagcctgtcttacttgtgcgtgcactgagggatggggcgtacctccatcagaccaactcagaggcagctttgcgggtgcactgagggatggggagggcacctccatcagaccaactcagaggcagctttgtgtcttacattcatctttatatttgtaaaataacaaaaaatttatatcattgtaaatttatatgtgagtagagactgttcatataaagcaggacttctcaatctatctgtcctttttttaattaatgtgcaattagtcatggactgatagttttgtaaaaagtgaattcctgggaaaacaagattagaaagcaaagacagacaaaattcttttattattagatttaacagacatagcattactctgctggtttgctataaaagcttctgaatgcttctctcggtctctcttactcatatcttcatagacttgtaatagtttgcacatgggcacctgttccagaacacagattgagtggcactggaatgcccacgcactcagcacccagctgcaatgatttgcaactccttagctaattttggatgatctgtgcccccaccacttcccctttctcctatatcattttgaagcaaactccagattcatatcattttatctgaaggtcacaggcatattcttaagtagcagggtccacagcactggagatgagacgtgcctagcccacctggaagacatttgggatgggccaccatgtggtctgtttgcatgtgaagatcctgggaacagactgctttggaaagagagccaacacccagaagtttggtgcaaagacagtgtcttggggtcagagacagtggctacatgctgtctccaccactgaaacacagtttccacagaggcaaactgatctctggagaaggcgctgggcatagaagtacatggatgtgccaggcgtacaaccttgcagcttccgtatcagatcagggtcaggatgagagatgctgaccttctgcagtcagtgctgacacttatacttcagtggcagcccacggctcctgcaccttcagccagccctctggcagcgtgggtggcctggctggagctggagggaggagtccagagctgctgcgtggatatcaggaagcatcgtttttatgaatatgaagcagttccacacctgccccctccctcccaccctactgtgagaattttcagttaggtgactttgaggtgagttggagctctaggtggggagaaagccagagagaacattttatttcatttaaaattatcttattactgcttcccaggttgctatgatccgaaaccattgcttacattgagtaaccttttccatgtttatctcagtatgctgtgcccctcacccctgagccctggtgtatttcagcacaaagccaagatgtattgttgaaacccagggtccaggaagacagccacttagcaaatgggtgggaggattctaacacagatgcctgctacctgctgctcgtgctattgtgcttatttcacaggtgaattctgactgtttaagaagcacttttattgctactcattgtactcaagcttcagaaaattgtaatggagatttagatttagtaaacaagattcagtgaaaaattttagacatattaaaagtttaatcacaggattatttatcgagaccataatccccatggaatgggcctcggtattaaaaagttaaaatgctaaattatattattaaaattatttttctctttttaacattttagacagttttaatgttttagagtgattatctgacacaagttgagccaagtagaatatttttaggaggaatctcagtatagccctcaagacattgttttcttagtagagcaatagcattgcagtagcaaactgtgcaaggctgagcaactgtcattaccaaatgaatgaattttccctttaggtttcacatctcccaccgcccccccgccacaacccctcccagtgcatcaagctttatatgagaccctcagctccctcaccatgtccatatcatttctcttgctggccactcgtctttcataccttttatcctatttaaagcatcttagagtgaccatccagtccctacctttcacctaggaagccaatcttcaagggaacagatcactccaggcatgagtaatgggatagaaagcatttcatctcggtaggttgccaatttgaatctggcacaaggaagcagtgattgaaattcatcactgcatggcagggaaatatgccctcgctcccaccccaaggccttcctaattcctgcctggtttggacgatcagtgtcccggccacaacaccttccccgtcgtttctattaattgacagcctaccccgcagcaggtcataaaaaagagcctagaaaacataaatgattttcatcacacatttcagaatcaggcctcaaagattcatagtaatgtctccacagtcaaccagtgtgaatgcatgggtaagagagagggctttttcctgaccaagaccgtaattgacatcatagacctgaaagattcttttctgagcttgaatgagccatcttggcctgtgcttttacattaggagagttactctcatggaagtttttattagatgactcgtcagggcctgcctgcataagaattattattttttacaaaattattttatttctttaatttttagtttttgttggtacacagtaggtatcgatgtttatagggtacatgagatattttgatacaggcatgcaatgagtaataatcacatcatgtaaaatggggtatccatccatcccctcaagtatttatcctgaatgagtattatgatcaggaaaacactcaaaattgggctgaattaatttagtggttatattgattaaagacagccgaacaagctgccttacacttattttgagggtgggtctacatacaaacctgttttctttcctttctgccttttatagggattcagatatgactgtgtcaccatccatgcctgcatggagcttccagtctagtttcagtattaaatgggggtagatgagggcttgtactggcctcctaggtgacacgagcccaaactcaggagaaatagccacactgggctcagacctgtttctgcagaattcctggagagggaatgtgtttgagaaaaaggcactgcttcctttccaggaatgggagtttacacaactgttatttgtcatattacactccagaaaacctgctttgaacttaaagagcccctcccattgcctcaatgtcaatagttgctccccatcatccacttcagtcacttcagctcttcatcttggtttattgtgttcatagaattgtagcgtgaactcacctctctctcagttattttcagaactaaatcaacccttcatccttcctgagcaatcatactttcagagtgatcttgtttttttctggttgcttattaatgatggtctgattaaatctcaactaatgaattctttggaggcctccatttggattctgtgcattcatttctccacattttttctttgtccttctacaaagaaaaatgacggcttatggagcccctccccctcagagctaagtgatggccctgctttttcctggtatgtgatctctcaggaagatgtcactcactggcattcagttaccctttgaattgccccttttcatctggctgttcttcccagtccagctataattaccatctgatggactgttactggatactgtttcacttgtgcatctgctgccctaggaaattgcattattctcccagcacctgctagattttccccagctttattgtttcccagccccttccttaaacttggtaactttcaccgccagtggttagacttcccttggttatatttgtggtcggggtatgtggtgtgtttttagctctttggccatcaccttggtagaggtttctaaaaaggcagacctgtattttttcagcatcatatatgctctaatcattattaatgtgacgatgggaggcatattttcttgaaatgaaattaacccactttaaatcatcgccatgagtccagtttgctgcttcaagccacttcccagccagttcctatgtgtttacactatctatgagaagtgcatttccttctacttatagtgaactcttttctctcagattcttgggatcatttacataagttcctttatgggctttcttctttctacaatacaagttctgtggccatttctttccaattctctgaacattgtctagtttaatataatatgttatatattatataagtgtctattatatgaatagtatataaatattcaccagaaggacttataaaccagtgtttattctcattactgtcctaatttttcgctcttagaaaggttacaaggtaataaaaacaactactgttgcattactgttacttcctgagctcttgcttaaagaattcccatggagtttctcatctagtcctctcatcagcacatgtaaacagttactgcaattaccatcctcagtgtacctaaagcaaacaggcttgccaggagagcaggtaaataacttgtccaaaggcaaattaattgacagagtttcaaacccaggcagttggttgccaaaactcctgtctttaactactacagatatactttcctacctaaaggctgaagtactaatatgactcatgataggaaaaccaaactacagaaaaggaatatggcttgatacagatcttgttgaacctcacaagtccttggcaccaggtacttaacaaaaaggtgacccacagacgattgcatttctcccagtgcagtttgaattttcctcttggctgaatcatccactcttgggtttgatctggtaccagcctgaccctgtctgacctgggctaggaaggaacagacatgggtccaggttggtgtgctggcaggttttggacacctgctgattcaggctgtctgcagttagctctctgctgtatgggtttgttgttgcaaacctttgtaatttttgttgttacaaaaaacctttgttgttacaaaattatggtggcagctgctgggaaaggaagaaaaaaattatgatcccatatggaggctacattatacatttcccaagattcagttccatgttggatgtggtttcagaacccaagtaagtgcccatcagatgagtaactacaggtttattttttggggtgggggttgggtggagggaagagacaggatgtgaattactggcatgatcaacaagctgtggaaattgttgagtaactgggcagtggtcaggtggcaagatgaggctgtaaggatatgatagagaagaaactgggaagagtaacttcttaacatcttagtgttgtcaggaatcgatgctacatcttatcctcattttctaggacagatatttataggacagtctctctcttcccacagccatgtctttaacagcttcacattgagatataaatcatacatatacaccatacaattcacccacttaaaccatacaattcaaaggtttttagtatattctcagagttgaacaaccatcaccactatctaattttagaacattttcatcacctgcaaaaggaacctgtacccattggcagtcacttcctctctttcccagccctctgctctcagccctagacaaccagtagtctacttaatctctctatgaacttacctactctggacatttcatacaagttgcaacatatactatgcggtattttgtaattggcttcttagcatgtttcatccacgttgtagcgtgtgtatctgtactttatctcttttttattgttgactatcctattgtgtggataatactatattttattttttcatgcatgagttgatgacatttgagttatttccactatttggctatgatggaaatgttgctatgaaaatttgcacacaggtttttgggtatatatatataccatatatatatatatgttttcatttggggggcggtgtctatacctacaagtgggactgctgggtcacatggtaactctatgtttaatattttgaggaactgccaaactattttccaaagtgactgcattattttgcattctttcattcttagatcagattcggcattctggctaataattgatgaagtgctggtcaaatcaaggccattgaagggcaatgtctcaactgttctttcagtttcagaagtagagtttccaccactccaagagagcttcatacacacatttgagactacactggtaatactgtttcagttcttttgaaagcagagatttttctaaaataaaacctctgttagctttcctgcttcaccctctctaactcagcagcctcttgtggtcctgtgtggacatctaagagagctcaggtagcaaacaagatgcccatccaaatgcaggaggaaaatgggggactttctgtttttttaaagccaccagcaggttctttgtttgacccacctttagtaatattattgctgttaaaaagagctgccactgcttccaacagaaaagaaaaaattctaaggatttcctggatgctgatcgggttcttgccacaacccagtagggggaaaaaaaatgcattctcctccctgcagagccagggtaatgaatgccacagaggtccagaagtgcctccggacgcatcagctgcctgctgcagagctctggaagcctgcagcctagcaaggctccgggtggagctgagctcccaggcagaaactggccgtggcagctaagtggcttcttcagaatctgcctttagggaagaaaggaatggcagctccaacgtgaggctttgctttgtgtattttaaagtagctggggatataaaatgacaaagaggacaattagagctgcagatactgactagagaagtgacatcttttccccttgattaaaaataaatatgttattacaaaagcaatctatgtttttggtagaaattttaggaaaaaacaatagagaaaatcagtaaaaccttcactcctcctatcttttgattacctttgttaatattctggggtttcaacttctggattattttctgtgaaaaagactgcatatatgctattagatatggggttatagtgtttgaaacatgcctcttcacttaatatgttatgactgtatttacttgttactaagtattgtaaagtgtgattttcgtggccacacagttttctgttaagctgcaagccccgctgctcagtgagtcctttcctcctgcccggccctgcattacatcctgtcccggatgatctcctttcattctcacagatgtttcagagtcatcgtctccattttgcagtggggaaaactgaggttagtagaggtttggtaatgcaaatgagcgttaagccagtaggacttgtgtgaagtcataaagccacttgagttctgtatctcatcgtcctgtaaatatgttctatgtggctgagttttctcctgcacccagatggaaagtgagcaagttctgggaccttctggtcaattctaggtcattaaagctgtatgggtcacttccaatcacaatatatgatcttaattccataaaatgtccaatttcattttatgtaataatcaaaattcaattttcctccaagggttagactcccctgacccgctgctgaagcctgcagcacataggaagcctgtggctggagaaggcaggatggggagggcctcttgtctcttcctaactctcgtgccccttccacttagcatctatatagcttttcagtatttagtgttttctctttctttagcctattagtgtcttcttattattgagttgaatttctagtctttctgaaattggggtcagggcagggaggaacagttggaggaggaggcaactccatgatgcaggagatgccatcctctagctttgacactgagtctcatttgcccctggaggtgccccataggaaggacctgcgagaagagctcttgcctctgtgggtcagcaggttctgcccgtgcaggccacctgcccttcagctcacccagcacatccatccactgtgtctaggggactcacatgaagctcttggagggctcccaaaccctttctgtgacttaaagcaaaggacaaggcaccccctccatctgtcctctttggggtgggggggcatgggactcacagcacgtcaacagttctcctggaagaaatcttcaaaaaagccccttctgcatgtactcatctaaccctttcatgtcttcattataagttaggagttaaaaggcatttaatcggtgcttgccactgactttggcatttttataagggggctcctttggaatgtagcatctattttcttcatgccgaggccacacagctgctaagtcacggtttggggactaaacagtgtgatgtcagagcccacgattcaccattgctgtgtgtaggccagttccctcatgttggttaagtttttatcccaatttttatcacgatgaacagtgctaccatatctgcccttattatttttcagcacatttgttttgatttcctttgaacaaattcctggaaatggtattgctcagtcaaaggtaaagttactatctctttaatcaaaaagcataaagttttagaatttgaaaatgaaaacttgtgattcctgaattgaaaaagatgatttctcttggcaatatgttgctttatctaagcaacatacagagtacagagatatacaacaaaccctcttttttatgtcagatacagatttttaagacaagtaaccaggtgtgcaaaaggatacatcttttattttcctatttttttctaattgagctgagtctctgctttgagcctttattccacctgatgggagtaaaagtaacctccatcaattctgggtaaatttaatcatttaatgtttacattgagtccatttgggagatttcttctttcatgtttttaggcaggtaggaaagacatccaagttctcaggagctcatggacatggaatgtcatggcatcgtggcaggcggggaggaggctgggaggggaggtacctgctgcttgggtagtgcctgtcctcacaggaatcctgagttcagaacatcagcttttgtcctcaggcaaagtcaccccttgtcctggcatccaggcccccgcagccctcactgcttgctgcagaagaatcccatcctcacagccttgaggccagtctgagtgtggccttgtgttccctggagctacgtgctctcttcctctccgctttccttgctttgggctttcagaagctcattgctgcctcatttccttcctcatccaggaagttccctcagccatctccactggactcttcccaggacaaggtggcagtagagtctcccttgtgaggcagtctccttcctgtattctccaaaatctttgtagggatcctgcccccttccttccactttcctggccttagccagaggaaggagagggctgcgctgcactgatttctccttcttcccctctggctttcctcctcctggtcctcagacagtgggctcgctgtccccatgtgttcttctgcatctgtcattggaagcatcaactttgacttttgatgcataacagtcaggcttttcagactcaaaaaaccttcttgcaacccgttatctgcctggaaacaaaacagcacagaattgacgcatttgttctctggggctgggtctgcccaaaggcctggtgtcccctggctgttgcctgcagcatcaggaggggtcatgagtcagcagggattggcagaaatgaaacacatctgctagtacaaaaacaacaccccactaggatgacagcagcgacagacacatgaaacacagaccacgaatgcccctctggggctggccgactccctctggctcatggaagaattataaaaatgtgattccattcattatgaagtgattggaggtcagtagatgcatatagaataaagtacagtgtcataagcctaactttcaggcctttttattaaaactttcacttgttacatcccgttaataaattctagttttacaaatgggatatgggccaggcacagtggctcatacctgtcatcccacactttgggaggctgaaataggaggatcacttgaagccaggagtttgagaccagcctagtaacacagtgagacccctacctctacaaaaaataaactatttaaaaaatgggttttgccttcctggaagatgtgaaagatcaggaaaaacaaccgagaacctagagaggttttacattcaaattaaactgagatggattaaaagccttccacagtttagtaattttcctaaagcaatttgagtttggttatctttatttgcacactcatcaaatccagagggaaaatggcatttgagttcatcagaggcagaggattaaatgggccttggaaagtgcagtacctggttagccgggggcgcggtcctcccaaagggctgccccacgtggccttggtcgagtgggcagggactgcctttcacctctgtgttccattagagaagcagcttgaagcccacagtcctcagttctcaatctgctctcattctccagggttgagccactttaagtatcaaaacttttagtctgaatgttgcctcaagaccattaagcttagtcaagatgactgatgtcatgatctccatagtaaccaacttaataagcaagaagaaaatacaaaagatgacttaaaaacaggggaaaaaaacagaataaataaggtatgaaaatagcatgggagccataaagattttttttactgccactttgagatatcaaacatgactcagctacagtgcaggcaggcatgagccatttggtccgtcgaaacccatggcaataaacataaattacagactgtgccacattcctacttcttgtgctgttcaattgtgtcccaggttttgtttgttttattttttcatataattcagtgcattgaaattatcaccatggtagtcactgtaattgtggtttttatggtagtttatgtatttaaccaaaaagagctgtgcttccagggaacaggtctcaggcagcactttccagtcaccttagcagagctcctctctcatgcaaaccacccctcccaccgcccttcacggatctgtggggacagcacttttcatgaaactggagttgacggttgatttaaaaaatggatttgagtattatctgtcacaaatcacagttgagcaggtcccaaagatgggctgacaatgtcccatagaattatatatcacaagtcttttgatttgtttgcagacaacatcgatccccacacactgggtctttggtcaccgtgtgttggtaggaccgaggctggcaggcccctttcagaccatgtgacttctaacagctcagtacttccaccaccccattcaagagcggaaggcggccatagttcacagagcccaaattccaaaacgatctccaggcccctgaggactcagatgcttctcatgactctctctctctgtccctctctccctccagccatctctctcacacacacaccaggcatacgtaaatacatacacacagagtacacacaatcctcatccaagtttggccccggggaagtgcttaaacttccaattccaagcacgtctacatgtcgtcacttcctggtgcggtgggagacaacagcctgattctggagttctgtgacccacccctgcctcaccaagagccaggtgtgcaccagaagccaggtgggtttgtctctccctgagcctgtttctctacccccaccaaaccatgtttctaggtgtcctgctttttgtccatgagcccgataaacaccatggcttttgtacctgcttttcaactgagagaggaacccctgctatcctccacccccacctgccactgagaagtccccttgttggtcactccctgctcctgcctggataggcttttctgttgaaaccgcaagcacagggcctgttctgcttcgctggttaggaggcttggtggtggagagttaattgatgtcattcattcagtcagtattgttgtgtactgatcatgtggtgggcccagctctgtgctctgtggggacagccataaataggcacatccctgccacatagcacttgtgttctagttggagcagcagacagtacacaaacagaccaggaggcaccgtgtccggtggcagcaagtgccatcaggaggagagcccgggaggggagggtgggaacagggcaggtacaactcctctgatcaggatcatttaagcagagccctgactccatagaacacagaggtggcatgtgggccacaaggaagcagctaatgccacttcttccctcagaccctccagaaggctctgctgcctgtgagcccctcctctgaaagacacgcctccacacacactcagcccgtgcagctttggtgcttttgacttagtttcataattattttgaaagaatttcatgcaagaagcccatcagatgcaattaaaacatgtcaaatatgttctcaaggcaaaccctcccatttttaaccttgtccagcttgtgaaagtataaccagtgctacatgtgattgtaactccccttgaaaccaccgttgctatttctcaaaacgggaggggaaaagcaagccagtgggctcagaacatgaatttagaatttcaggaatccaaattttggaaaaggtgaaatattttacctccatggcagttggcctcccaggaattcccagggaggacactgtatctgtttaagaaaaaaaaaaaaatgacaaagtaacccattttgaaggctctactcaacagatgtgtagagtatagaaatctatgtattattaaataattctttttaatatgctcaagaataagcaatttgtaagcctgtttacgttctcaccatctgggtgcattctgtcacccatctgtttcatgtaattatgtaattatcaatataaggaaagaataggtgatataattaacaagaaaaactgatccacactgaagagtaaaaatgacatgcatctgttgaatagctttttgtttctctccccttcgttgttaactgttttttcacacccttcaggagagctgttttcgccatggtgtgcaatctctctctctctctctctccaccccctccccgccccctcatatgaaggcagagtgtttcatcaggtattatggaagcgacacaactttgaaagaaatgagcaaaggcttcttggagttattcattgattctttacctctgtgagggccctgatagtcacttccagaagatgtaaggtagcagctagaaccctaggaaatatttgaattaattagtgacagatggaaggacagggcagtgtggggccctctcaggatactggacagagaagctgtttgagaaaaattcccatactcggtgcttttgttttgatatccaggctcaggcaatctgtgttgttccataacagtaccaccatcccagtggattgtgttcgtttccacataatcccacttaagttagtcgctggagtagctcctttgtgtaacagagctttgtgtatgtgggcacacagatggaattcaggcaacttcctcaccctgcaaacagaaatggcaggagaatggtcaccccctcctcagtctgaccaggccaggctccaaaattctccctccatgacttggaacgagcaatacgtatgtattcagggaggggcatcgcagtgatctcttagtttctgtgaccccccaccccaagcccttctgttgagtcctaaattcagttctccaaagatgaacactgtccacagggattctccccaacaatggaggaagccatccctgaagatgcatggtcttgacaaaaccttgaatttcaaccccaagtcacacaaagaagactcacagccccctggaccgctgtaaacagcagtcactattagagatgaaggcctaaaatctcaacacttctttccactgatggaaaatttgggagcagggctcccctcctggcctcctcagtattctgcagacatcctgccctctgtcccaacagggatcttgcctgcagagcgctgcacctgcttcctgtttagggcgcagggcaggcagaaggagagtggagagagagaagcatccacagggagcagactcataaaactacaggggctttctaagcaatagctctcaccaaggaattaaaccccactcagacactgacagagaaatctcttattcagtcacttcttaacttttttttcttcaaacagtgccactcacttactctagggctcactctgtttcctcttgcttggtgatcattttgcatgttgagattgtgttgttttggagacgcgtgctcatcttggcatctcgtgacagagcctcttgatggcacagtctccgtccaggcttggcttctggttcacctcccacacgggaagcctcatgtcaaagcagccactggcttctctgccttcattgttccatgtccagcaagcaaataaataattagttcccacgcaggtttctctttgtttctttgagtcaaaaattattctttgataagtcctccataaagccttcctctaatcctccacgaaaccttcctctaatctatctgtattttgaattgttattgctaaggattttgttcttaaaacaacggatacccatagaacaagcatattggagaaatcactggcatgccatggggagagtatttggaaggaataagtagtagggacaaacatggctgggatactcaggggattttgttggttttgactttatgtttccttaaatccaaagttaaaatagtttaattgcaatcatcactgactaatccattaaggattttaaagaaaataataccacgtgactcctaaagacccttttgtttgccatttctagttttgaaaggttttaaccatgatttctttttcaagaaacatttcaattgtattttttagtatttaaccaaagaacatagagtgattcttcctcaagaggaaattattatagaagacctatttatatatatatatatcatattcaactaaaaataaaaataaaaaaacttcatattctgtactgaaccacattaaaaatcattaaggcttagactatatggttttcatttaaccctcaaaagtggcattaatttttcaagtggtaactgttgcttaagatgctattgtgcctgtttgataaatgtttaatgatttggtagtacatgcatggcttaaaatccattatttattgcacctttgcttgcctggcaaaggtgacgattttatagccccagcagtcatgcaaacacatttataccaaaccgatgactgataataaatttccttactgtaaatgtcagtgggtttcatgtgttgctgccattacatcttgtttggaagctgaatgctacacagttatgggaggcgccagatggtgtcattaacacgaacactgggactgtttaccgctgacgtgcgtgtgagaaattaaaagtacgtgacctatctttacactgacgtgtgatgtcagtggtgaacgggtgttaattacagtgcaatatgcttgcctagtcccttccatcccactcagaggggttttagggaattttttgaaaatagtttgtgtttgaatatacacagagtgagcaaaagggagaatttcccgaggactcctgtttggttttgtatttggagtctcagacaccctgcaagtcacagctgtcatcacataggtgtcactctcatgagcagcaacccacatccctgccaggacttctgggcatggggaagccttttgtgctgattaattacagcagtattgttattgctgtttgcttggttgggggttttatttttattttcgtaactacttcagatattttgaatactgttttggaaaagtttccattgagagcatggaattaacatttttttaaactgctgtcaaaatcatcaggaattgattcaaagaatgagaagaaaaacagtggaaattttctataccaattttttttttttcatgggatgggatcttcatttcctaagaattagcggtaaagacttagatctttattttccctgatctgatgtgaagtatctgagtgactgaaattagccttgtgtgttttattaaaatgtttctctaacttgtgttcagcagtggccactcccatttattgtatttcagcttccttcctgttgacgtttctgcttagctctcttttcatttctatttaaaaagaaggtggatttgttttattcctccctccaagtccttcacttgaaccaagaggctattccattgaatctgaccaaattcctttgaactttgtagccttagcatactctgtaggaattttcagaaaggcttattctttcaaaacaatcattgtgcattgcttttacaaaagcccagcgagccttttggtgtacagaattttcaagtcatgtgaaagagaatacaaaccattgtttgcattgagatgaaagagatatgcttaatttcttcagactaagtcagagatacaattggatgtcaacagaaatagtgagcctagctgaaagactaaaattgtgcatggaggcacacattagaaatttaaaatagagtcgcgcatgttagcttgctcacaggacacatgtgtgttgaaaatatccaggagtgaaaataaatatgaaataaatatccaggagtgaaaatggtggcaagatagcaagattgaaaagttgtatctgtggaacagcactcacttggaccaaacttctcagaaaaatgagttttctgccactgctatcgttgttctagcaaatgaaccagaggcctaagccagcagagcaaatagccacttaagttactgggcctgagcaaacagcatattccctgggggaacagaagttctcatcttattctgtgtgcagagatttaccaaataatgttgcctgaagggaggtcgtggtgtggacacaattggccatcagctttccctcccagccttttgtcccaactccttctcctccctttgtgtctccctctgtgtctgcttcttgtattgcctctgcatgaccatgcagccttctcctttcaaaggttgctctcagaacataatctgcaaatccattcatgtagactgacctatgggtcagtgggtgtgtcatccttccaaatccttgccctggcttttccctctcatccagaaacttgttccctcttgttcacctggaaatatcccattgattctgctaaatttagctccactgtcactttctccaagctgccttatgtgacttttcctgctgtcctagaacagttaaacttcagctgattccatggcttcccagctgatatggtttggctgtgtccccacccaaatctcaacttgaattatgtctcccagaattcccacatcttgtgggagggacccagggagaggtaattgaatcatggggactggtctttcctgtgctattctcgtggtaatgaataagtctcacgagatctcatgagcttatcaggggtttctacttttgcttcttcctcattttgtcttgccaccaccatgtaagaagtgcctttcaccctccaccatgattgtgagaccttccccagccacgtggaactgtaagtccaattaaacctctttcttttataagttacccagtctcgggtatgtctttatcagcagcatgaaaacagattaatacaccagctgagtccagaaaaacttcctaggtgagcacagcctaaactactgacctacagaaccatgagccaaatgaatacgtactcttttaacccactgtattttggcttggtttgttacacaacagtagcttcctgatacactaccattgtcacatgtactgcattttatttgtttacttgtctgtcccccaacctaatgagaattccttaaagacaagaaccatgcctcattcacacctcagcatttagaccaattgttggcatctggtagatccttgatatgtatctgtcaaattgaaattgttgaattaagctctgctaaagttttggtggtagaatttcagacatcaggatactgaataggttatctcaatgccctcagaattgcttcacacattcagttgccttccccactaacaagttagactgtccttgttgctagtgttaaagatagtgggccccagatggagtcacttgtgctaaagttccactttaccaatctgaaactaggttatttgcttgaaatatctgaccttctgagaaaccaggagagaggtgatattcaaatcccattaagccaacaagattttgcttacatctctctaaggaaagtaatatcgaaatgaccaatccactacttgttcattgttcctgtattccttcacttttttactgccgataaaacttacccactctgtctagctcatcagagctcctttctgttttgtaggttggatgctgcccagttcatgaattgctaataaaagtcaatcagatctgtgaaactcaatttgttgaaattttgttctttgactctagaatattgattttatcccaaaattttttttccagagttgcttttctagttggagaaatgactctttggcatagtaactctttgctgtatagtttaagttgtttctataggaataagggcagattccagcctacttccaggatagtaagtacaaaatattttaaagtctatggctaaatagcaactgttaatgcatctctgatatatcatatgtcccaccatttatgatatggattggaaagagaaaaatgacctgaaattctctttcctttaagcaaatagtacttagatgatgccccatacattctccaaaaaccttccccttactgtttttaggatgggaaaacaaccaacaatataaatttttttcatttcacaaaaatctgagaataaatttaccacagattagttcatatatttctttgatttcttaactcattattaagacattcataatcaaaatgtgtattataaacttatatatgctatgatattgtgataaaataaatatacatttggtctctgtccccagctcctggtcagagctcctgaaacacttgtaccttcctaaatgataaaagcaacagaaacatcttttgttaccatattttgttttcattccccacccctgacaaaactctggtgcaataaaggtgagaggagcatcttttgttattgattacaagctccttacaacaacacctgagtctgtatattgacaaaatgatttttggaaagtctctaaggaagggggctggttgccaggagaaccaaccatgtcattagagggttggaactttcaggcctaccccccagcctccgcggagaggagaggagccagaagttgagttcaaccaccagtggccaatgatttcatcaaccatgcctacacgatgaagcctccataaaaccctaaccaaagcggttaggagaacttctgggtggtaaacactggaggtgctgggagggtggcatgtctggaaagcacatggaagctctgtgcttttccccctgccatgccctgtgcagctggctatttctgagccccacccttttataatggccagtaatacagttagcaaactgtttctccaagttctgtgagccatcctagcaaattatcgaacctaagcaggggtcatgggaacctccagttgatagccagccggtcagaagtacaggtggcaacatggacttgcgattggcatgtgaagtgggggtacagggagcagccttgtgggactaagcctaggtagacagtgtcagaatggaattgaatcataggacagacaccctgctggtgtcagagaattggtcagtgtgggaaaaaaactcacacatttggcatcacaagtgttctgagagaatgtaaaagaagtaagggtttgtttggttttccttttaatgtagtttaatacatggaagacaatttttgttctctaagaactatccatcatttcagaagggtactgtttaataggaagaatgccttccatcacttttgaatgtgtttcccgaacctttcagctcatgtcctcattttattccagtacaagtagttctttcatggggatatagagcttgagaatgattaggtagctggatgttaagtagtttgttaaagacatatatctgtaaggtagtactaattattacttgtagaacaatgcaagtcaggtaattggttctgtacatcatttttctgccatggatttactttattcctgcctttccttgtgtgttcacccccagagaagtcatttctccagtttgtggctgaccctgtattgagaatgatacctggagtgccagctagctgacacatgtcagataggattcgagtagaatgttgcagaaacccggaggccatttctgaacactttacactactcaaggtggcaaaggagagacatggagccatttgaggttatcttggttcatgtgctaatgtgccttatattaagaattaatgaatttcagtgtctcagagaagccaacagtggatctcccttgccgatgtttgtgtattgcataaaggcaatcatattttaatgatcatatgagctacttgtttgggggctattatttaattggaaacaagtgaattaaccacctaattcatcaaatctaagttgctatcaattataagatgtacctttattttatgtactattaagaaaaaaaatgcagccaattaaattgtaacacaacgtctaaatgagagtcctgaacagcatgtgaatcagtcatataagtcttagtgctttgaaatttctttcatctattcagagaggggaggcaatttacgtgcccttcaattgcattatttgctgggtgatgtggaaaaatttttttgcatgtgtctcagtaacaaaatgtaacacagcttcatctccttgtcatcttttatttgctcctgaaaggcactcaatcgttgcattgcaagaaaacatggaattacatccattcctccaatgactaatatttgcttcactaatatcaaatttgcaccttgctgctcagtttctgggcctttatgggaacacaacaataagcattcatttcaatgccaaatcatgctgtaatctttttgaagacattgtcagaagcacttaaactcaacacatattgtgcgtataatgcacatgactctcttgaagtgatgacaatgaacagccatggccaagcacccatgcacaggtaaggacaactatgccactgctactgcctggctgactgctactgttgaaatgctgttgactgtaaggctgatttcaggaataccagcttaaaaaaatgtgcacactagaattgatgaaatccggtaaaatccctcaacttagcttccaaatcatttttctaatataaatgtttaagaatggccacaagtgaatgtcatagggtggcaataattttagcttttaaaaacatgcaaaataatgataatgcccaaatagggaatatgggtatatgagggattgagacagatggagttgaaaagagaaatataagaaaaatggaagtgaaagaaatttactcattgaatcatagaggctaccatggcccactctttgacccctgctacatgattttgagtatgctctatccagtgttaagaaaaaagccagtgtcctagaatcaccgttaccctcagtggataccacagacacaacagtttacactttttccgaagtgctggagctaccaaattgttctgagcttcccagtacccccaaccgagaggaaagttaagtgaatccttcataaagcaagtctcaaaaccacagcatgacctcaacagacttatgctctgcgggacagaggtgttggtattcatatcatacttttgaaactttttaattattttagtagaaaggctttttgaattgcattttatgcctgtggaagagattccaactgattggttctatttaaaatgtctatacccccctaccctttatttatttgtaatattgcaatactttgcctcaaagaggtcaacttgaactttgagccgcaccactgtaaatctgtcataatttgttttgctcaaattgggaaaacgagagtttctcaaggagaaaagagagatagagaagcatcagaaaaattacatttataaagcaaaagtaggcttattacggatttcagaaattttattcctaatgggtttgaatctttccatctttcatttccttgtatggacagagctccctttgaagtgtttggaagctttctgtaagaaaagatatatatacacatgggtgtgagctgaaaattgagctcattgttttgcccttttcaaacgtgtttttcaaagatttgcctttcatattgcagatgggagagaggatctgcaattttaccttgtgtaacatctttgcctgaaaagctcaaagtatttgcagacatttttaaaagactggttcccatgtttgcctgctgaggaaagcagaggttcatgtaatttactaccattttatacccgaggaaactgatatttaggaaaaagaggctcagaatttcaaccagtggcaaaattaagaaaacaagcctaaaccttgccaccaagctaatgacacccaggctaatgatcccaaaggttgaatgtaacctccaaaagaaatgctataataagaaaaaattcaccatagatagacagcatcatgatccattttagtatgaaccttgtatgtattatgtaggatcatttgtatttatttttattgctctctagtgtatcagcctatttattgttttagtaactcccgattttgaatctaacattgaaattgagtttcagtaatgcttttgtagtcattctaattcattctaagtgcagaagagaaaccaaaccacatgcggaaacacggaacttgggtctatgtatatccaatgaaattatattttgaccaatttttttctatacacacagaacagttaacaaatgtgcctaaaactcaaaactgtgtatttcagttctcttgacaaatgtatctgaatcatgacataaactcaactgagtgtgcacatcaacatcatctttactaaaaagatcaaatttaatcctaagtagttataattacatccagattattcatttggccatttaagcaaatggaaatgaaccaactaaaataatttgcaatacagaaattatgtcaacaccctttaaaaagggtccatgaaacacaaagttgatgtatctattcttttaccacttaccaagtgccccaaaatgcatggcagaaattgttcagctaaaatacagcaaatgctcaaaacgcaaagacatagttcctgacctctaggagttaatagtctagttgtagggtggcaggcaaccaaataaatggataaaagcaaccacaaactcctccagtagtgactcagctactcacatgtacagtcttatttcagaagctcatagggaattataggtaaagaggttaaaacattaacatttgctcatttctcttccctattttctcatctcagccggtctcccctcccatctgacctccgaatcttccacattcctccccgccccgcaacccccaagctcaactctagaatttcctaacaggagtatcaaatactatcattccttcctttcctacctaagcaatggaatctatggtttgtattttaaagtcattatgagagttgacatcaactttaaggaatttttttttagccttaaaaggttagcttatacaccatgctgtatggtttgttttatcttgctgggttactgttgatctctacacttaaaatcatccctttgtcaagaatcacttgaaaccgggaggcggaggttgcagtagctgagatcgcgccattgcactccagcctgggcaacaagagtaaaactccatctcgaaaaacaaataataataataatctctttgtctaaaatgctaacctaatgccattagaaaaatagaaatgtcttgaaaggatgtggaggtaagaattggatttcccatccatattattcttggtatggtaggtaggtaaatagcttacaattcgccctgtttaatctttgaaataattttccattatgaggatcatttaattctgtctataaaatgtgagtcaagaactagggcttttatttttactttctatgaaggaaataagacccaaaacagaatctccaatgcatgggacattttttggcagatgttcagagggagaaaaggaaaagctggcttgactcataggatcttgcatgtctgtttttctttcccatgaaaacttgtagtttgaaggaacataaaggaagaaaatattctgctttcattaaaaaataacctgtgcttcctgcttctgtgcaaaataaacccttcataaagcagcagaagccatcttcatttacagttgtcactgaaggatgtttccaggctgggaagaatttttttcaaggcatttaaaaaccgtctgtactaataaaagaaaaacacgattttttcaggtcagaagacttcatcatacctggcgatggatatgtttttaattaaaacctgggcacaaaattgggttgactgtgaatcattgtgatgcctgatcactctcctgagacacccaccatcattggtactggttgcctgctcttgacaccggaggccactttgtgtacttagcagttagaaaggtgatgtgtgaggcccggcagctgttggtgttacagctattgtgtgggaaacaaaagccattctgttctgttccccagcctgcctttgtatcacggatagaggagctgtttcataaatgaggtataattctttactggagaatttcattactgcccatgtttcaatgttagcttacacttccaacagcagaggggaatgtctgaacatatctccttttgaaaagaatcttggcttctgacctctgtcaagatgcttgcattttaaatctgttaactagacctgcgattagatgccatcattacaacacatatgcttcccaccttccttgctctagaccacccaacctaaggctggctagagtgtatttgctgtcagcctgcctgtcttggaaattaagcagagtacagtacacactggcacccaggtgaaccagtaggaactagatttctcgcacaattcctcatggatctgtgctaggaaattctcatagagcaaatcagaactgacgtttatttgaagaacatgcactttttcacccaaatggtatatttattattttcatttagaaactatatcaatctaggaagttttcagtagcatataaaaaacaaactggcctaaacaatcaaggaagtgcagtgggctgtgtggttcttcccagccttcatccctccctgggctgtgtcatttgctgtgtgattttgaggttcctccttctaaaggtgagtatatttccctaactcatggatgttaggctcagctacatgacttgctttggccagattttaaaagtattcctattttcacttacctttcacttttctgccattgccgtgagaagaacatgctctggctctcttgcatcaaataagagaaatgtgaggcaggtttggaatctgcaaattggagccagacccacctgagtccaacctagatcagcctacttccagctgacctagaattgcatgagccagaataagtgacagttgttttaagccaatgcattttgaagtggtttcacagccctattgtggcaatatctgactgatatgtattgcttatataactgaagagtccaaaggtagtatgggtttcgggtagggtttgaaaagaattcctgttctatttctgtgtgattctcttggggcttcaacctgggatggtttccctcttggcatgatgaccatagccatttcaggtttcacgtttacaccacgtgccatctagaaaacaagaaggcttctcttcttcaactatcatgcaaaagtcctgggcttcactctgatgaggtcaacttaggtcacatgtgtatcctgacccagtcactgaggaaagagagtgggagtatgccacgtggtttacgtgaatcagagtccctcttgaaaatgggagtgagtccaatctcttccgaaatctgtgttgtgccaaattaaaggtgggagttgtagggtggaacagatgttgagaggtacaagcaatgttaattatggagtctgaatctcccacttttgttttaaatttctatcaatatattgtttggctcaagccattttccttcctccatgttgctaggctatctagagacagagaaatgggatttaagctctagatctgagatgttacctttaaatggcaaagcgcatggccacacccatacccctacagtactggaaagtgggtgggaacccaaataagactttaccattattctgtcagacttccaactcctggtatcccagggttttaagaaaatccaaagcaggtttgacctatcagaatgcggagatttctgatgtagaggatgaagttaatgctgatgtaattaacagcatgggatgaggtgataagaatatctttccactgacttctggtcaccattgtttccaatgagaagtcagctgtaatctttgtcactgtccagacacatagtaagcaccaaaaaatgtgtgttgaatcaatggattaaaaatagaaccaagatcttttggcacatatcccaatgttcttccaagactactctatcacttctttgtaaaactttactttgcacatttaatgtaccccttgcagcttctgcagggaagtaaatgaaatcaatgactaattcaggtaatttttgtaaacatggacattaacatgatcaccagttactttctgtgcttctgagaggcctcctgactctgaagtatctgaaaggttgaacaaccctaataattgaatgcatttttgccatttaataaatgtttgccattttacaaatattattgagcatctactgtccacaagacaccgcgttaagtaacgtgagggacagagaattgaacatgagctaaaacttgtcttcaagtacccaactaatataatttgtcactcaaggtttcagggaaactgtggacagaagaaaagacttgggacctttcatggaactacagattctcagggagtagcttgcctgtctccttgtagtgttacttactagttgtctctaatcattaaggatctcagttctgtatgaaacatctgtcagcattaagacaacatcttgaaaaccagcattttgatgtgacctagctgggatgtcaggcatatccacatgttcttacattaatttcttaaaaacatcttcccatgcattttatggtggctgtacatgggcactattaggtttgttttggtggtaatgtcctggttagataattctacatagttgcaaatttgagggtatgaacactgctacgttttctttgactccttctttgtcttcgtattttttttccagatgagttatgctttaaaccatacaaacagaaaactaacattggaacctaaaattactgtcaatgccaagatcattgtggttggtgcatccagtgttggaatttccttcctagagacattggtattttggtgagttgtttcactctattgattgattggtttttaaataataaaaattatcttcctacatctgaagagaacaccatcagagaacagacctgagattgtttggtactccacacaccctgcctatgtggatggatgaatcagtagaagaatattctagatcaggggttagcaaactatagccctgaggccaggcctggcttgccaactgcttttgtaaataaagctttattggaacacagccacactcatttatgtgttgtctgtggccatttttgtgctacaatagcagattagatggcagactcctctgctgagtagttggaacagagaccatatggccttcagtgcctaaaatatgtacagtctcacccttcccagaaacagcctactgaccccttttctaaaggaatgttttccttactggcccgatcacaaaaaccacctgcagcatttgttaaagatgtagattccaagatcctgcacccaacttacagaatctggactcctggggaatggtctaggaatctgtatgtcaatagacactccacataatcaggcaggtttggcaatgagttttgacttcatacattacaaatacactttcagaaatggcatgtgggccaggacctttcttccagcccttgaattttggatcccctggaacaggtaaaacccttcagggaatatggaggcctgtgcatctcttctgatgctgttttctcatccccctcaaagcactaaacaaggtttcctttcagagcccatttttctgatgggtgatgctcagggatttccagcatccccagtctctctctccatgtgctcacttgagcacctctttaatagaaaacaccctggattagggtctgagagctcgggatcatggcctggcatcatcagcacctaacatggagccctcagtgtattgtctagcttctctcaaactcgctatcttcatttattttttaaaaagtttcatagatgttttaaaaccctgactttgggaaccacagaaccctgaattaagagtccagtttttccaaatcttttgctcaggatcacatgaaaaactttagctaccattcaaaactacaggtgctgagaggtaagcaggagatgggaaaatgcagcctaccatcactcttctggaagccagcagagttcttagctcaggacaggtggggccttgtgaagggctgggtaagcaaatggatggaggaaatgaccctcaaaaggtgtatgtgcctggttaacgtggagacgagctaatcccaagtggttattttgctcatttaacatcacattaaccagataaaaaaagaattgattttttcactttctagccagtttgttcagttctccagaacatactcttaggtaactagaaataaattatgagtcattactgaagttagtaacagagttcatgtgctttgaataatgtggtcagtctgcagcaatatttcactgcaagcatgaaatgatgagaagcacctaggaatattccattcccagggtatgccacgttatagtctgagtgctttacttgttctgatgggtctcttcctcgaaaacttttgaacagcaagttttatgcaaccattttcgaatgatgaattattaaggtggagctgtgaaattatagcagttaagaagttataaacaggtcttaaatcttaattcagctatatacttagtcataatgttttatttaaatgattacattgagacatatacaagtaattttctttttgtggagtcaacttagatctaataaagacaagtataaattttgatgtaagtattgggtcgattaaatttcccaatcaaacagagctttttaaagcattctaaaatactcataattctctatcatcattacacagattacgtacactaaaaatagactggtatcagtttacagatctctaatccttaagagaggaaatagttttctcattattttctctaattattttaagtcagcaatcaccatggtaacctactgcgtattttactttcccagtttaactgccatttgaacttaattttatacatgatttgagctgaaatgaagaaatacagttttcacccaacactgaccaccaatgaggattgaatctacattttggaagcaaaatttaggagaatcagcctccttgtagtcttttttggtttgtttttgtttttgttttgagacagagtctcactctgttgcccaggctggagtgtatggagcaatctcggttcactacaacctccgcctccccccaggttcaagcgattctcttgcctcagcctcccaagtagctggtactacaggtgcaagccaccatgcccgactcatttttgtattttcagtagagattgggtttcaccatgttggccgggctggtctcgaactcctggcctcaagtgacctgcccgccttggcctcccaaagtgctaggattacgggcaggggccacagcgccctgctgcctccttgtagtcttgagctgcattgtcagactcagcaggggcatcatcattcctggaaaatccactcgaggctcaggacagtaacctctttctccagaaaatctggtaattctgtcatctgacaacaaaacaaacacaactttgttcttgtattatttccatgcaagaaattataaaacacatttggtctcctcttcaaaggacaccaaaagcagtttgtgtaaattcctatcctttcttccccaagtgctgaggtgctactgggagagctgaagtgctttgcccaaactcactccctgatattccctaggatgtaagctccatgtgatgaggcaatactgtggtggtgttctgactttttatttttttaagtatgctattttatctgctagctgtgtgcagttaatctgcacagacacatctccttgtctgtggttgtcaggcctgagtcctgcgtcttgtccttcctaggaggagcctgttgggccctccagcaccgggagacatgcatggcaggcattttcctggggtgtcccaggatcccagtcttttacttcccctgctgtcctccgtgccctcctgctcctggccctggtgatccccagcagagccgaggagccagtggccctgctctcagaggcttctacagtctccctcagccctgcgggagacctccaggggtggagatgggcaggggcgtagcgtcatccagggtggggtgggctcagctaattggttccctccccccttgtctggtgcacttggcctctgaggggagcccaggaggaaaggacccagccttctttcctgtcacctgcccagccagcgcaggagcatgcgtgtttgtggcaaggatcaggagctgggcagggcaaggctagggctgtggggtggtgctcttgcattgcagggcattgaggaagaaaacaccagcttgtactatggggtagagggccgtgaattggaggggaaagaacagatcttaagactgtgtgttcttcataatgcccaagacatttaagtgatagatttggattatttttaaatgactgttcttgtgattggtgggttgtgttcatttggccaccccgttctttgggactgaaagttcctggctcggacactatgatgtcacatgtgcattttccttctcggtgcttccattaataagactatttaaaacctccaaccactggagaaagcagaaagagcttggcctcagccgttagcccacctctgctgccaagcagtgttgcagccctgagggaggaactgtcctcatctgtgctgaaggagagtcccagcaggggcccccaggtcctgccagcctgaaggcgccaccacggtagaaactccacaaaccctctcagggtgagatctgtaaagtgaactcactataaagtgaactcccaccaagtctagcattgctgaactcctcaactgcagtgctttgactctttcaggtttccacaaagatattccagaatcctttttttttaattatataaatgctatagcaaaatagaaaaaaaaaagaagaagaagaagaagagaaggagccggaaccaggtgtatgcacctctcttctgtttctgcatcctttcactcctggtgtggcgcgtggaccagcagcattgatatcacctgtgagttcgttagaaatgcacaacctcaggccctgccccagtgtcccaaacaggtttttttccagaattatgcagaacagcatcttgactgtctcctgggcctgcgttcatagagctgaggcagttgctgtccccttctgtttcagcacgagtctctatgcttcagtgttttatagtatttactcctaattatgggaaagttcctttttaatccattatttttaactctttcctaatttaatcccgacgtaaagaatcttttgaagagcctgtaatggcactagaaaaatgcttactggagtcatggatgacagtgactgaaagcagcccagctggtgtccccgcgaccctccgtgtgactagagagaaacactgattcataggaagcaccggtgggcactggaaagcccgggttccccttgtcttccacttccaccactcagaagagttttctcgaaaactgaccaaatcatccagcaaaagatgcagcctcagactttcagcctagacactgatcccctcatctggttgaatgtgtcgaggtaactaagaatagcttggaccaagcagggcatgtttctaaagctgcaattgtggcaatgaccacaactcctgttatcgggccgtgcagttccgcacaatatccggcacagctgtgggctctggcagcagccagcctagcgctggcggcttaattaggctttttatctttacatttgtctgaggacatctgaaaccttcagtgtggcctgtcactaattaggtgactaattaaatagtcagtgcttccttgctgatctcagagctcaaccgcaatggacaggtttgtgattgtgactccccgtcctgtcggtctctgcacgtgtgcgcctcgcaattgccctgttcattgcgctgtgcaaaaacggcatgggagcgaggcccagggcatgtgcagggccgtcctccgatgtgcccaagcagcaggcagcacggacatccacaggggggcatatgggagatggacatccacagggcatacgggacatcagttctggtgcagaggctggtctggtggccagagcagaggggacggtggaaggagctttacctgccaggctcagagtctcagtctccccaggcagcaagagttgacattctgccaccagagaataaggatccagaactcaccctggtgtcactaatcacaatggggtttcctattcgactccaatatttaaatgtaattaatgttaaataaaagcaccttcatttactgaaattattcacccctgctcgtttcagtataacttatctcctcatacccacattagagactcccagaacaaaagcaaagcaatccactttgagcaacattaggccttttcgacgggggaagatcagcttattgtcctttttttgtgggtgctttgtgattctttggcattaaaggtaagtaggaaatgcatttttcatgatcacacaaagcacaaaccatgtacccggatctgagtcgtacacccgcctcctcagtcttcatcatttgttattggatgattttcaaataatgacattggtacctgtcttggtttgcattctttcaaaccaagctgaaaacaaagcatttggatacaagtagtttatttgggagtgatcctagggaactgcctgagagcagggccgtgtgacagggaagtgaggatagccacaaagccaaaagacacccttgtcagtgggtccccactgtggacatctgaggtcagagaatggccgtgggcagagagaggcagacaggagaccccttgcaggtgagcaggtgggtcagggtgaggtgagtaggccccagcactatctctggagtgcccttatggtcccttagtttgcttagtttgttctgttcttccttgttaatattcttgaagttgccttttactgaaactttggcatagacgatgatggagaagaagcaagggttaggtaagaaggctgtggggagaggattttgtgggtttcttgcagttctgaagaggacacaggtgtactatcagaaagttttgctggaaaagagatggcatttaaggaccttgtcttagcaaatactttatttctactttgggatggagataaggttagaatcagtagttttcgaaacatagtctgtggcccagcaccatcagcattacctgggaagctgtcagaggtggggatacttaggccccactctccagggactgaatctgaaacctgggggtagggccaggctctgctttcccagccctccagggaaggcggcaggtcaaggaagtcagaagcgacggtggagtggagagggcccaggagagtgattccaaaacgcagaacttcagtctcctcacctgtgctgcagggaaggcacccagaatccctcctcacacaccagcctgagcatacagtcaggtagcaaatgtcaagcatctgtccaaaggcctagtgctgacacttgttagacggacacctccccactaattaaatttgcatgtctagatccccatggaagcctgcattgactttcaaaggcgggaagtggctggggagctggagtctcctccacgtggaggatgccctcttccccgaggactgggggagccggaggtgcttcccacccgcagctgcatctgactcctggtgagacgttccctggagtctgcagaacatcctcctaagagactcatgtctctcagatatttaatgggatcataaacttccttcatagaaacttacattaaactctcccctcctttcttgagactcccaaactctcaggagcctctcagttttctctcctccttgaacagaggctctcaaagtgccgtccctggcccagcagtatggacatcacttgggaactgttagaaatgcagattttcaggccccacccagacctcctgcatcagaaacactctgggaatcaggcccagcaatgtgtgtcttcacgagacctgcagggacacactcggccaatgccaccaggccgatgtggtgtttacccttcctgcaccatcctcccatccccacttttctcatgggcagcctcactcccaaaaaagcaaaggcatcatacaccctcagctgtgcaccctttcccacttcctcagctctgcacctgccagccactttatttcctccctgcggagggaggattagggccataattcttttatcttggcgcacataaaatgatgcacaagaggattgagggaataaggacatatcaaactgccccccaacttacagcatttgatgttgggtggaaatttggaagggaagcccagaaacagccccgcctgaaaacacaggcatgagggccctccagtagaggtgacaggtggtcctcgttgctggggagtgggaagaccgtgagcctctgtgtgagacccagagcaggcaaagccatctatgcagcagatggcttctggagaccaggtttctctctaagtgtacttctctgaagataatgcctttcaaacagataatccaacacttaccagtatagtaagacataggcttgaaaaaaatggtttgaattctcctttttattttaagaacttgtggtggaggaaaatgttgtgaatcaccttttgagattttagggttaatattaagtaactgtttctataagcaacagattgcaaaagttccaggctctacaattctgcacatcacagccacttggatagggatggggagggttgtacaaatacagtgtcctgggaccctgttcctggagttacaattcagtaggcctggggtgggtttcaggaatatgtacagtatttttaatagaatccccaggtaattccaacatgcaggtgggtttaggagccatttttatagacatttgctcaaaattggcagtctcatctataaggaaacctatttccccctgtaattgctcattgtaactaactcatttttatgggcttgttttccaaaccacattttctaattcttagtgaatcatataacttctaagtcacatcattactttggggcttaccaggcctaatttttaagttattattaacattatatagctgaacccatattcatagtattaacatgctaaattggacctagcagaaagcatttcacgaagtctcatgcttaaactatcaccattaagaaggaaggcccaagaaaaaacctgcccatgtggtgttattaaagccttgctaatagccagcatttgcccaaaacacaaagctcttcttcatcctccccaaccagaagtgatcccactggattttgaattcccataatgttccatgattccatccttaaggaacaaattgatttgtgtcttgtattttgccatctctcatgtgcaagggctttctggcttgtctttgatagctaccatcttggtatttacatctggtatgtgctcagtatatataaacatatgcttaaagtataaatgtataatgtttttacttcctagacatagataaaaacatcattaatcatttcccctaaattataaaggaaagctcaatttcattttcatctgttttgccagaactcccaaattttattcttatcttttcaattgacatttcaagaatggcatgcattttcattttttcagtaaggatttatgtgtttattttgtgatacataagttttttatctgagatcctgaacttctacctagccccttatcctggccaccatgcccctcccctgccaggtccccgaggactccagagagcacccagggccctccaggcagacacttctaccttagtgtcgggtccagggttgagtcacacccagactcagggtaccttacgagacttgctccttgccccgtttctccaggtcgcatcctcattcctacaggagctccaggaccagggagctctgagccacccaaggtggagctgggcaagatggcacccaagagaagagagaagtagggtcagggagagagcttgtaacctctgtctcaccccacgaactgcccactcccttctagatgtgttcagaatcctccatcccacacctcctctgtggatctctctcttcggtctccccctggaggtcagagtgtgtcatgaccaacaactttgtggccatggatgcagctgccgtttaatttttactaacaacaaaaatggattgagtactattaacacactcgaacaaataccccataactccttaatatcatctaataccagtccgtgctcagttttcccagtggtcttaaaattgttcttttacagttagttggtttggataaggatgcaaaccaggtccaactactgcatttggttaatgtgcccctgaaatctctttaatacttaacagtttcctgcaccttccccgttttctgaaattcattttcttgttaggttcttgcatgttagagaatttaagatgaaataatacaatgtgtggtgtttactccaaccactacagtgttggtgagtattttcaaagcagcacaatattagtcattgctaagcttttttcacctcgtgtatatttaaaatcctccaaaataaaaatttttttaaaataaacaaattaaattaatggctcaggaccttgtccaaaagtctcttatgatttaaacagaaaaaaatattgctaaagaaagttaaatttttttcagggaaaaactggtagattctcttactctgctgtgtacttaacaataaatattttgtgtggatttgttttgcctctgatattggaagttcacagagctcccaacttctaaactccacctatagtattttatggcatgtgttgttgttaagactgaattaaatctgagttattttttaactagtagaatatgtagataggttaaatatctatcacgagctaggatttattttcattggcaaatatttttgtcactgttttgaaccattcagaaagcagaggttttagtaaattaaattgaaacatttagatcgatgtgggataataattttttctctacattatctatttgttcaaataacagcattaattaaagcagttaattaaatcacttgctttggttgcgtttgctatgcctgcaccctgcagacacgcacagcacacacaaaatcagctagaaaataactagcgatcgcctagcaggccgacatgtatctactgcccagaagggtaagcaccatgaaaagttttatgtttcttttatcatgttcacaataaatgggcaatgtgaccctctttatttgaaggataaggatgtttagacctaattttgtagctgtcctcctgaagcatggaatgaaacacaataccttttacttatttccctggataccctaatccctccctgctttacaagtatctttgagctgttcctccctttgtatccacagcaacgtgaaatccccactggaattatttgctgtgaaaatgcaggtgcccttgtttaatgtttcattggcttgagcacttaacttgaaactttttttttttttcatgatatggtgacctttgattttggagctgagggctcacggtgatgttagatattgtttatatacattaagccaacaccattagatctgagctttatctgtggttctgctgttcctgccatttcatcaaatgcatgcccaaatgcaagctgtactccgtgacccactgttctatttgaaggaactttttgaatattcataggcaatcaaattaaaaatcagtctattagacttatgtattataaacttcatgactttagaccaatactcttacatagttatagatttaagaaattaaatatttagacactgctaaatcggattatagagagaaccatcacagcaaaaatatgaggttggagaaagaaatgaaaatgctggtgatattttcatataaagtcatgaaagggcagggaaccttctctgaatagcaaggaggttgatgttacaaagaatgtcggggaagtttgcttaggcccagccagaaggacctttatgccacactagggaatttgggctgaacagtttggtaataaaaacacttaccatttattgaaaatgtactatgcagaggcgatattttaagcattttacagacaatgatgcatttaatcttcacagaactcctaagaagcattaggttctagagccacagagaggtcaaataacttgcaaaggtcaaaaagctagaagtgctagagctgggagtggcactgaggcagtccgacttctgagaccgggatcttaatgagtctgatctgcagctaccttggtaaaatctctaccaagaacaaaggtagggattttaaaaccggaaaccgttgagattttatttaatttaaaaagaggtttccagtagctgtgtggaagatgggcagaagagagagactcaagccagagagacaaaccctctagacaagatggtgaactaaggcagtgtgttataggaggggagggttgtgggggcattcaagagatgtggacaaggtcaaagtgattggacatggtggccaaagtgtgtagtgggaaggagcctgagactggctgccaaattcctagctctagaggtggttagttggccaaagctttgatggagatagaggaggagtgggatgaggcgaccaagagctttgtttgggcacatattaaatttgacacccccctggagcatgccagttagggctgataggcatttagaaattagatttagagctcagaagaatcactgtagtatagtacattgtagtaaatgtgcaagaggaagtcctggtggtggataacatcacccagggaaataggcatgcagcttgggaagcttggctagggagaaatggacaaaggaggaggagctggtaaaacagtcatgaaagacagcctcaagacagtgttgtcccagacaggaggttctgtggcaacagctcctgggggaggcctcctgcatggccccagctctcagtgtttcctccacccctgctcctttaggcccaggatcagtgatggcacccactgctgctagaccctgggtactctccttccctctttgtccctgtaaccctgcatacacagctgccttcattcagtaagaccttgtggagtccgccatcttttttttttttgcctggatcctgattaataaggatcttctcatatccccagctcatccttcctccatgagtcaatgaaaatagagacttctaattgcctcccagtattcattctgcacttggtgacaaaaccctggggactgtggttctttgaaacatcactgtgttttctttgaaaaactacattttccagactccctgcttctccctggccatgtcactgagttctggctaggtaagcagaaatgtgggactttcaggaagtctccttaataggcagcactctctgcccatttctccttcctctgcctgtaatgtggctgtgatggctggagctccaggagctaccttgaacctgaggtgaccctgaaaatggaaatcacacatggagaagcagagaagcaggtcatgggcccagctgcctagctgactctgtggatccgtcctatcagcacgaaactggtgatgtccaggtgtcttaagtatagttttaagagaaatttgctctcagagggattgagagagatcaaagaggaacttgaagagaagataggtttaatggggagacatgtctcttctgactcaggggaatggaagaacgctctagacatggtaagaaggaaacataaaaatgcctggtgaccagtccccattttctttatgacataggagatgtgctcacccgagtatgaggaagggggatagtaaggataacaagaggggttacagtagagaacttgaaggttggagaaaggcccagaacagcaacaatgaagaatgtaaaaagatttcaacttgggctaaagaaaaagagtggaaacctgttttttaatgtattaaaattcaaaaaatgcctctatcccccaaaaaatctttgtactatatcattataggttaggttttttaaaaaactactttgttgttttggggaaattttaaattgtacaacagcataatttaggataatgcaatgtggtagtttggtaatttataaatcatctgatccatgttgttcgataattcaaatgattcaaaaccaaatggacagtctttgtagtgaaagatgtagctggataattattaagccttctacttacatagagatgtaaaaaaggcctatatataactattattggtgtaacataaaccacatatctatcatatagcacccaaagctggggtaaattttaactgcttgtgagtataaacacattattattattattattagcatttttcattaaatggtaataaataagagacaagtaatcagtgtgtacttgcagactgtcagccataagtagctgggttaattgtgacctttatgttatttgaagatattaaaattttttattcttattattagaggataagatgtgctcagttttcttcttatcaaataagaatattcattcttaaatgacactcatccttagagactttagagcaaaacctctcataatattgagctatttttaaatgtcaggttcagttgagtttattgcatttctggcctgcgccatcaccaaaagtctcctgcttttagtgctactcaacagattgtcagtaaattgatagcagttccacatttggaacatttccaatcttctcatgggaaaggagggcaggtgtttctctctgacttggtgaaggcttcttttttggcatttggttgattgaaggggaggtgtgaactaagaagagattttagaaaaaaaaatctcatcagcatgaaccctatgaaaagatcagctcacccatgaaattttactgactttaaccagggggtggatttgcagcaagagcatcttaaatcctgatgggcaaacacggagtgagccttgagcatgtgagttcttcagaagtctctacttaggtgcactttacctgtaggactagttagagggagtattgtgggtgcctggagcagggcgctgcctagggccagcaggcctggctttctttcatagctggcactgcttatgagctttgtaaccttgaacaaattacttaccatttccaaccttgattttcttacctatgaaatgtggatcagaaaaaccggtctcttccctatccctagcataaattgtgtagaagattaatctctatgtgaatgcctatgaatgtgccttgggctctggaaagcctgatgcaaatataaagcagttttgctcttaaaaaggaatcctctagaatttcctcgcagatgacactttttggtatcctgatttgagtaactgtgtgtatctgaatgtaataaagctaatgtcagccaatgggaattagatgacctttggatccctctgaacaatttgagatctacaggacagtacaggcagaggtaaggtgagaggatgctggagccaggcatcctgggttcaaaccctgcctccagacttactagctatatggttgtattagtctgttctcacgctgctgataaagacatacctgagactgggccatttacaaaagaaagaggtttaatggacttacagttccacatggctggggaggcctcacaatcatggtggaaggcaaggaggaacaactcatgtcttacatggacggcagcaggcaaagagagagctcgtgcagggaaattcctatttttaaaaccatcagatctcgtgagactaattcactatcacaagaacagcatgggaaagacctgctcccatgattcaattacctcccaacaggtccctcccacaacacatgggaattatgggagctacaagatgagatttgggtggagacacagagccaaaccatatcattctgcccctggcccctcccaaatcttatgccttcacatttcaaaacccatcatgccttctcaacagtcccccaagtctttttttttttcttttttttgagatggagtttcactcttgttgcccaggctggagtgcaatggtgtgatcttgactcactgcaacctccacctccccagttcaagtgattcttctgcctcagcctgccaagtagctgggattacaggcatgtgccaccacacctggctaattttgtatttttagtggagacagggtttcaccatgttggtcaggctggtctcaaactcctgacctcacgtgatccacctgcctcggcctcccaaagtgctgggattacaggtatgagccaccatgcctggccccccaaagtcttaaatcattatagcattaactcaaaagtccacagcctaaagtctcatctgagacagggcaagtcccttctgcctatgaccatgtaaaatcaaaagcaagttagctacctcctagatacagtgggggtacaggcattgggtaaatacagccattccaaattggagaaattggccaaaacaaaggggttacaggctccatgcaagtccgaaatccagtggggcagtcaaatcctaaagcttcaaaatgatctcctttggctccatgtctcatatccaggtcatgctgatgcaagaggtgggttcctatggtcttgggcagctccacccctgtggctttgcagggtacagcctccctcctggctgttttcatgggctggcattgagtgactgtggcttttccagacatacagtgcaagctgctggtagatctaccattctggggtctggaggagggtggccctcttctcacagctccactagaagtgccccagtagggactctgtgtgggcgccctgactccacatttcccttccacactgccctagcagaagttttccatgagagccctgcccctgcggcaaacttctgcctggacatccaggcatatccatacatcctccgacatctaagtggaggttctcaaacctcaattcttgacttctgtgtactcacaggttcaacaccacatggaggctgccaaggtttgaggcttgtatccactgaagccatagcctgagctctacattagcctctttcagccatggctggagtgtctggaatgcagggcaccaagtccctacactgcacccagcatggggaccctgggctcaacccacaaaaccactttttcctcctgggcctccaggcctatgatgggaggggctgctgtctctgacatgccctggagacattttttccattgtcttggggattaacattcggctccttgttacttatgcacatttctgcagctggcttgaacttctcctcagaaaatgggattttcttttctattgcattgtcaagctgcaaattttccaaacttttatgctctgcttcccttataaaactgaatgcctttaacagcacacacatcacctcttgaatgctttgctgcttagaaatttcttctgccagataccctaaattatctctctcaagttcaaagttccacaaatctctagggcaggggcaaaatgccaccaatctctttgctaaaacataacaagtgccacctttactccagttcccaacaagttcctcatttccatctgagaccacctcagcctggactttattgtccatatcgctatcagcattttggccaaagccattcaacaagtctctagggagttccaaactttcccacattttctcatcttcttctgagccctccaaactgttccaacctctgcctgttacccagttccaaagtcgcttctgcatttttgggtatcttttcagcagcgccccactctactggtaccaatttactgtattagtccattctcatgctgctgataaacataagcatacccaagactgggcaatttacaaaagaaagacgtttaatggactttcagttccacgtggctggggaggcctcacaatcatggtggaaggcaaagaggaacaagtcacgtcttatatggatggcagcaggcaaagagagagcttgtgcagggaaactcctatttttaaaaccatcagatctggtgagacttactcactatcatgagaacagcataggaaagacctgttcccatgattcggttacctctcaccaggtccctcccacaacacgtgggaattatgggagctacacgatgagatttgagtggggacacagagccaaactatatcaatggtcttcgcaaattacttgcttcagttccacctaaaaaaaatagggataatagtattactgacctgactggattcctgtaaggactagatggggtaatgagccatgcaaaaggcttgactggaagcagtcatcagggttaagctgcgattgttatgcttccaagcagtttattattaatagaagtagtctaaaatttaaacttcatactaaatttacctccctcccaatttgttttagttttactttgaaaagcacattttaaaaacctgtctcattactaatgtgtagctttttggaagattctatagttagcagctccagcgccatcttccttttttccttgaaatggttggttctatctgaaggttcgtgcaaagaattagtagctccaaaagcaattcaacagttggatgacacgtgatataaagttaaattgaattatgataaacttttgctaaattgcacttaactgcttgttctttttcatttttctttttctttagctctcacatgaagtttaataatcttaccctgatttcaactcatggactcccaggaaaaaaacttctggacactgaacaaaggaaatttttagccagcgagtatgaattgtatttgctttttcattctgaggcctaaatgtcctactctgtgtgcagtctatttaatgctaaatagtagatttcagattggaaaaggagaagtggtggggcttttctactggagttcagacatcacttaggagatacaagtaccagtgtgttcacaagccagtggccaagagtggcaggccagggccaccagtttctatccgtgggaagacatctgccctgttccaaacaattggggtggagcctacggacccagccagccctgcctttgggctctgagtgacactacagggcaatgaaggttggtgactacatttgcatctgacagggcgcctggctgggatatgggtcccacagctaccctggccatttgtactcagcagctgatcaggcaaagaacttccatgccagtctgggtgagctttattgtcttcatcccagtagaatcactatttgacaacatctgttctggaaaataccatgtctttatcacatagctttcattcattttaatttcctgtagcaaaacatggctacaagaaatattagtttctctgcctctagaaacaagctcctaatttttccaataaggaggaaggaaattgttccctcccaggggattcattttagattccatgatgaagggaccctctttcctctgtgaaaaagactcattttgccttcgaacaatgagaaaaaacacaacttccttgccagcagaacgggttcgtttccactttataattttatcagactataaacttttttttgaaggatgtccttatgatacaaaaaagggcatgggtttgagccaggaggatgtggattcagatcctgcccctgccacgaagggcctgggcaaggaatttcatttctctgagctttgctttttttgatcacgagcagtacacgagaagccaagcttgctggattttttgttaaaattaacataacaccaacttctggccaagaacacattctctccatttccctctttctaaattacacgattcccaggaaatgctggttttattggcaaatgtcttaagaggaacttaattccatcagcgtagtgaaagtttccctcaatcccatgttgcgtgtgtttcaggagaaaacagctaccgagggggctttctgcaggtgtgacgctgcgtgggcagactgagtgggtggaagccactggcgtccctgctgctgtccctgcctccacagtctcagcacagcagccagagcaaggctgcggaaagctggctcagatcacatcgcctcctcaccgcccagaactgcactatccaatatggtggccactagccacgtgtatttacatttaaattattaaatgagatgaaaaagtcggctcctcacattagccacatgtagccagtggctaccacattggatagaacagataagaacattttcatcatcgtagaacgtgctgtgatgctccagcctaaactctgtctccatctacttaattctccagcctcaccttttattatttttgccctttttctccccatttgagccacaccagcctcctcgatgttcctcagatgcaacgggcaagtccccaccttgaggtctctgctttttgctcttgaatgttaccttttctatgaggtctatcctgaccacaccattcatttgaagccaacaccccaacacactccagtccctcatactctgctctgtttttttcttgctacttaaatcctcctaaatattgtattatttgccttttgaaataatgtttattcttcatatttatatccagaatccttcaactataatataaacaccacaagggcggaaatttttgcctttttattcattgattcattgatgtatactcaatacctgggtcagtccttggcacatagcagatgcccagtaaataatgtggaacagaggaaagttacctccagaaatacctgcaaaactcctctcaagcaagtgttagggtctaaataacacagccagacccctttgcatgggtaactgcatgtcatcacatttcttagaaaccacatatttcagtaagattgaaccataaataggagatgtctttcaaatggtcctcataaccccaataaaggaaattatctctgatcatggggtttcaaaataacaggtgcaaatgacattcataaatttagtaatttaaatccctgattccaaatactaattttgaacttgtcgttaaccattgttttaatttattattgttagaatttttgaaccatttctgtcttctttcccaccgcccccatccagcctcttgtggaggtgctaatggcatgtctgggatgcagccgaaaggaaggcagtgggagaggagaaggaacaggaggcaggagaaatccactaattggacaatcagcactgattaattgaaagttaattgtgatagtcctttttctaggagtgtcacaattaatcttttatgagaatttctaaggttctttccagctcggaagagtcatgattccacgaggtgcaggtctccactgactcatctgtggcccccagagcttgcttctaactgcacacctggagctttggactaggcttttgaccacaaggttgggggcactataacctagagcaagctgctactcatctatgccctcttccaggaatttccccgtcctccatttttgctttttgtttttctcctccttattatctgtcttcagaactttctatgaagacagtctttcacattagttttgagtcacggtcaagctcacttgaggaacaggaagtttcactgatgtgcctcctttggttccttctctgttttcggatgaagcctagtggaggtatttctctcaccaccaggccatgagtcaggccctgctatgttagaatattaaagcttattcattctacttaaaaaataattttggaaaaatatcacttacagtcttcgatatatagtttcactcaactggtgaggaaattaaggaaggtccagaatggatagtaatatccagaatgggtagcaatcacttatacaatgatattttaaactgagaaatggccaggtaatcccagcactttgggaggccaaggtgagaagattgcttgtgcccaggagttgaagaccagcctgggcaacgtagggagagtcccatttctacaaaaaaaaaaattaaattagccaggtatggtagcttgcacctatggtcccagctgctcgagagtctgagcggggaggatagcttgggcccaggaggtcaaggctacagtgagccatgattgtaccactgtgctctaggctgggtgacagagtgagatcttgtctcaagtaaataaaatcattcaatgtagtaacatattgtaacagcaatcaccccacattcttcaacacttccttttgtgacttagtaaagtttcctaaaaatcagtggtccccagtgccattcccactggacagagcttcacattttaactctcaaatatgcattctgatgtgatcaatgctactgtcctgctgtcattaaaaatatcattgtctttgccttccacaaatttcccctgagagcctttatctttgggcacagcctcataaaatgaatccctgtgcactaactgtatttaacttttcctcatcgtggatggcttagagtagggatctggagcagataaaaaacaatctttcatgggtctctcacaaatgtgggaagccatgacatttcctgtattcctataaagctaatgaaatggtttttacaagagaatttcctctcactatccattattttcctgtgataggccagtccccgattttcttttcttattaagaagaaattttcttgtttttaagttgtttcacagagccctttcacaggtcctgtaacaaggtctaatatgcccccatgactagaattctctttgtgtggtaagaccaggcttatgcgcagatcaaaaggaagaaatgttccctcattaccacttcagaatcttgtttgcctccaaagagagtaaacagggttctgtctcattaatattatttagaataatactcttcacatacgcatcctgcctaacaaagcagcctgtcttacattctcacggtcactccttatagcggtcagcagtggaggaacgtagggagagctcattaccctgtgttaagaggtgaggaaactgaagacagcaggaggatgcagagtccaggcttgtcagcagcacagaccatggcagggttctttttgaagaggactgtgctgccaagcatagaagtggcgcgtgcctccagtcccagctactcaggaggctgaggcaggaggatcacttgagctcaggagtttgagaccagcttgggcaacatagtgagatcctgtttctaaaaataaataataaatagatgaataaataaaaatgttagtgtttttatgttaagagaaaaaaggaagaaaagaatcatacagcctaaattaaaagaagcacttaatgtcctattaccttagactctcagtattcagaacagaatcactaaaaggtggtttacctgaggtcaatcctttcagaaaattctggaaacaaccctcacaaaactgtttaaataaacccaaagccacaagaaacccactcttatcatactacgtgaaagcgctcaaactccaagagagcccagaaaatggaagccagtgcagccacagcacgctgaagccatggcatgaatggccgccctgggcctgctggcggtcgaagtctccgttcctagaaaatcacctctgccctgaagggtgaatcccaaagtctccagggagtgtacttgctgcgaacctaactccctaattgctatattcttgaagtaaaatgggttttgttgttttggcaggaagccatacgctaattctcagaatgagtgattactgaaaagtattagcgaataggaagggttctcggtattcaaagattctgacccctggctttgggaatcctcaacaatgtcactttcttccttctcattcccattgaggctgtggtcaatacaccaatttaacagctaaagtaaatttacaaccactctgaagtagaagcagaagaaaggtatagtatgagtgatttcacacacacacacatacagataaacacacacacacacacacacccctcccaccctcccagttgtgggctgacctaagccaggtggaacaatttagctttaatgggaagatgtcaatttgtaactaagtgtttcataacgaaaaatctcctagtatcagtcctggtaaactcacagcaagagcacggactcagcccactaggggacttgaaccagctcaccagatgtctaattaatgcccgctgtcagctgctcagatgtcacttacggagcttctctctttgcagccactgttttaatgataaagattatgcactgatgtcactgtgctcctgggttaatgtcgtggtgggtagaatgaccggcatagaccgagcagccaagcacgttgtgctttccacggacgagatcgtgccctacgaccacctcatcctctgcaccgggcagcagtaccaggtaaggccgggcacagggggcgcaagccacgtgtctggagagctccatgaaagccattcatatgtttactggggcacacacactctgggtaaagagcatccctctgcctggacagctgctgctctaaattcataaaagcacccttcagggcccgcacacataaccagaattatgtccgcaaaccctcccagaaacccattccaagaaaaacattctgctcgaggataaaaatcacagcaagttggagaaatgtcattctttaagctgttgtccaaaagtctaacacatactgctcgccctagcagaatccagacgcaaccaggcatgcatttgtggtaaattaatttatgcctcaagaggctaacatttggctgtggcaatgggctctcgcaaaagtattgcaaacacgtgcaccttctgtcgacccttattttattttgtctctcagttatgaaaataggaaatctgattgattggtttcccagtgtccatgctttccttttagttaaactctccatccacatttgagtaaagcattgctggataacactgaagctgttcaatgtcttagggcagcagattttaatattccactttgtaatatgcatgagtgtttcatgtagtttacagcagtaaggtatttctccagtgacaagaggcttactctaactcaaggatgaagtcttagaccaagtttgtgaaacccatggcccatgggcccaaggtggctttgaatgtggctcaacacaaatttgtaaactttcttaaaacattatgacttttttttttgcagttttttttcttcagcttatcagctatctttagtgtttgtatattttatgtgtggtccaagatgattcttcttgtttcagtgtggctcagggaagccaaaagattagacaccccacttagaccatcttgtgaatagttgtgggattcgatgcgagcctgtgtatgacagttttccttcacgtcgccaagcgcagaggaggcagcgcatgaaggagacagggtctccacctgggtgttgccacagaatgtgctcagcagctctaagcatcacttaccctatattttctgccttggccgcacattgagatgacctgggtgctttgaaaacacatccatgcctaggctccgcccccagaggttgttttaattattctagggtgggacccagtcatcagtatttttcaggtgccccacatgcttctaagctaaagctgagaaccacaagcttgcactttcttgactaagaattcctcatctataccttagaatagcacctctcaaactgctgtgcacatgaatcccctgagcttcttgttaaaatgcagattaggagcaggaggccatgggatggggagcctgagatgctacattttcttttcttttcttttctttccttttcttccttccttcttttttccttccttccttccgtcctttcttccttccttctttctgtccttccttccttccttctttctttccttccttccttcctgtacttttaattccatttattgttggatgagtctattcctgtgccgtaagtttccatttcttcagtttcttctgggctatctttttcttctgcgcagcctcttctggtttaggaacaatttgttccttttcaataaggctcatctcactgtggcaggcagagctcacacatgggttaacctgaccctgagctctgtgagtctggccacacatcttgggtactttgttcacctggctatgctcaatgaccagagaatctacatgtaaacccttacgttcagcatgactctgcatttttaagcatgtgcagcaaacattcagcactctttttgggccactgaccctgtgtccagtcccactgtttggcctggacgcacctaccaactccacctttgtaacgtcagaatggtacacactgtctctgtcaagtgacatctttcagatactgggtggctcttgatatatgcataccctgacggcctgagcagtttcacaggtgttcttcaatgaacacgaagatttgaacctctcgatttgcctgagttcacatttccacagattgtcaggccacttaggggaacaggaagatgttacatttctaacaagctcccgggtgaggccagtgctgccagtgaatgaacaaccctttcagtagcttggatcaacctctgaagaatctctctcctcccctcccctcccctcccctcccctcccctcctctcctctccattcctctccccttccctcctctcccctttcctcccctccactcccctcccctcctctcccctttcctcccctccactcccctcccctcctctcccctttcctcccctccactcccctcccctcccctcttctatcccctcccctcctctccattcttctcccctcccctcccctcccctcccctcctctcctctcctctcctctcctctcaattctcaaagggtataaaaggatatttttatggttaaaggataaatatttactgcagggatacttcgttttgatatttaagtattcctctgacttgttaaaacattaaacccgacagaaatgccatatgcacccccttagcttgtcttcctgtcacctgcctgccaggttccagctgctgccacgactgcgtactttggaaactgagtggaagacccagccagctgcccagagcctcgggcatctgcccatgtgtgcccagctgcccctgcagctttactctgtggcacattaagctcttgccctttttacaacggaaaaaaaatgaaatgaagaagtgataaagggagttccaatttaatttttccagaaggacataaaatcaaagtacatagagtggtacagaaagggcagctgaattcactggggagcttttctcccccttcccccattgtcttcaactctctcctggttttgtcccaattttgtgattttctaaaaaacaaattaaaataatgaaaacagagcttaaacccaaagcaagaagacaaccctctataaaatgtaatgacaaaccgcaacctctaatcagaccttttaaatggcacgcctcactctaaattgttgtgtaatgtttttaatatccaaatgcacatcgctatttcttattacaaaatccatgcacaaggtaaaatactacattgcactgcacggctaagcatgaggagagctggtctctcccagcccactcttcctcccagctctctttccagaggcaaccagtttgaagcatttctgttcttagtttttcagtggctacctgcataactccaaatacagtaatatgtttatagaatgtccttccttgctctgtcaacttcagacattatctacaacctctccattttcgaagatgaagatttagctggctcactttccagactctataactccttctccagccctccaatcaatgttgatcatttttgttggcaaacacactctggttttgaaaacccctctgagatcacagggccactctccatgactcatggacggtcatggagcagcagagagatgccttccccaggcctggatttgaggaacctcataaagaggaagaacaaaaatgtaccaactgaaatcaaatgagcttggtgttgagcatgagaagactgtggtatggactgttcatgggtcgggggtcactagcagctgacaggtagggcaggtacttccaagcaagcaagaagaagagctgagactgtagtatacagtgagcttgatgtgggtcggcaatgttacattgtctccaaaggggttaatcatgtcttagactgggtcagtaatagtgtggcatccagaatggtgcagcccaggtgacagccttctacacacagcagggaggaaagacccatctacaccagtgctgtacctcccagtaagagacctgagaaagacactcccccgtgtcatttgacagcacctactatatagagatctcactctgagaatgattacaggggaaaataaaagcatgcagtcaaagaaaactggctgttttaaaaatggctgcaaattctttgatgcctcttccatctaagaggtagagtctatgtctcctctccttgaatctgggcagccttgtgactgcctcggccaacaaagtgcaaaggttgtgacatggtgtgacttctgaggccaagtcacagaggccatacagtgcctcctggattgtggcagcagtcgctcctggagtcctgaggtgccacgtgagaagttctgatgccctggggttgccacgctggagacgctgtaggtgagctctctgcctcccaggccccactgatcccagcccttcagccagccttgcaaggcactgggcatgtgagtgaaacaatctcagatcctccagatcagtccatccaccagctgaaagttgccaagtgactcctgtccacagcacacagaataaaagaattgctcatccaaatgctacccaaatttctgaccaacaaaatcatggaaagttaagaaagtaggtatttaagctactaagttttagtgtgagtttgctgaacagcaaaggacaactagaataaaaagataacacagtaagagaaagagaacaatacaatatttggaaaaatcagaggaagaacatagttgtgaaaatgttgaaaaatttaggccacacacacacacacacacacacacacacacacattgtaggcaactatttatcatcctttatacaatttgatcacctggcctctgaaatgggagctgaagccattgaaagagcagaggcaaagctgagaaggccacacataaaaaaggagatgggtgaataagaaaaaattaaaatgaaatctccatcagagacagaactgctgctaaacagttagtgatgctgaagacaaagcactcctggagggcagaagcagaggacaaagggatatgcttggttcaggagaaaacagggtctgataggcatggaggcagcatagaaataattggttttcctgaagaagagactcaagggacaataattgaagatattctagaagaaaacttttttacccgaaaaacatattgtccagctgaccacattctaggcaaaatcaaagaaaaattttctcagttatgttctgacagaatttcaattctttcttagtcacccatctccctttttgtctaaccctgtggccttcttagcttagcctctgctcttccgatgcttcagctgccatttcaggggctgggtgatcaaattgcattgaggatgataaatagtttctcatagaatggcaggaaaaaattgaacaaacttcaaaagaaaaataacagattacaacctttctccctaaaaaagaataaaaataaaacagatatcaaaatttttatctccagcattaaatagcaaaagaaaatgaaactaatcccacagaattttgacgaaaagtggtgattcagtaattatgtgtccacctaaatctctcatatttgaaaatagcaggtagccattcttttatatacaaggcctcagaaaaaattatcttccgtgttctttgcttaatgtgcactcaaaataattgagatagaaaagaaaaattagaacttcagccaggcgtggtggctcacatctgtaatcccagcattttgggaggccaaggcaggtggatcacttgaggtcaggagttcgagaccagcctgaccaacatggtgaaaccccatctctactaaaaatacaaaaattagccaggtgtggtggcagggtcttgtaatcccagctacttggaaggctgaggcaaaagaatcacttgaaccaggaggcagaggttgcagtgagccgagattgtgccactgcactccagcctgggcaacagagcaagactgtctcaaaaaaaacaaaaaaacaaaaaaaaaaaagaaaaagaaagaaagaaaatatagaatttcatagtagtacaaaaggacaggtggcaagcaccacaaacaatttaaaaatgtaatctaaataattgttgtaaatctgagaataaatgcaaaatagaaaatgactcttaagctaaattaatctaataaagaccaagaagttgttgaaaattgggagggaggtggcaagggaggaatatgcattgtcttaaggggagaaacccaagagtactatttcagtgttgactcttatatttagaagaaataagattaaagaatcctttgaaacagcatgaaggaattcaccttcccaacactgcagaagataaaagggagaaaacaaaggaaaacagacacaatggttaaaagtgaaggtgtaaaccagaatgacataaggagaaaaattcagtgagtgtcatgggtggattagggttagggcttcaaaccaccctgttataagaaccaagactctgtttttacacttaattcaaaatataagagaaatacccaatcaaagggcaacaaaagcttaaaaataagaagatggttcaaagtgcaccagcaaaagactgtcaggcaaatttcacacagctattagaaacagcaataatattagtgcccaagaaagtgaattggagaaagaaaagcattaatcttgatcaagggtaaaatccatgatgagaatatagaggtcatgaactttttacctgccgaacatggttgtatcagaggatggccacaaaaacagaagtgtacttgcaatatgaccttcgttccttggagtcccactgaagaagggaaggaacaagctgaagcacagcgagggaggggctccgtcactccagatgcgcagccagaggagtgaagattcagggtgtgcaggatggccagccagtcttcaaatacttgaagacttttcatatggagagcgaaattagtcttgcacatgatggctctgggaaacagatctagacaggccccaaaagtgatgggaatgcagtgtttattcatcccgaggaacagctttccgatagagtgaaagtctactccaaagaaaacggtcaaccctaggagacaggagcctgctgccaggcagcctcaaagcgggagagcacctgactgccgttgaatgtttaccgcgagacagacacatggtaacagatggaactctcaccatacactgaggtcactgccattggcatccccatgttgtaggttagagaaccgagggtgctgtgaagcttaggtagtttgcccagggtcagttagtagggaggtgatagactagggtccaaactcaggtggtctggccctggatcaagcactgtctctgtttcgttctctttccctctcctttccctttcttgttgcttccctttatctctcattgacatggtgcagggcttatacttgatggcttttaaaagtcattaccacagagattctagagctttgtatttacagctacagtcaaataagcagttcaaaaagaaaaagtttatttccttctctcattaaaaataaaaatatctggagaaaagcaacccaggcccggtaaggtggctccctgatgtcaacaggaacccaggcccttccatctttttttttttttttttttttttttttgacaagttctgactcctgtcacccaggctggagtgcagtggtgcaatcacagctcactgcaaccttgacctccccggctcaggtgattctcctacttcagcctcccgagtagctgggactatacaggtacatgccgccaaacccagctaatttttttttttttttttgtatttgtatttgtagtagagatgagatctcccatgtttcccaggctggtctcaaacttctaggctcaagggatccgcctgcctcagcctcccaaagtgctgggactacaggtgtgagtcaccatgcctggccctctttctatttttaatgtgtggtttccattctcagcatctcaagatggctgctgtgttccagtcattccatttgcaagaggcaagaaagaggaaggactagagcatgatgacttttctcattacctcatccaaggactcctgcttgtatctcctgaccacctcttaggtcttgagttgggaaatgcagtttttcagccgagcatatttcccaagagtctgttactaagaaaggaaggaagacagaatattgggttaggcagccagcagtcctagccaccgtgagttattgctgagtgatggtggcactgtgctatggcaaatcagtgtggttgaaaagttatctgctgctctccactcagaagttagtggcactttagttagtggcagagaaccctcagtttggataaccagtccttgtggcacttcattaaatataaccaagcccttatattaaagactgttctctcccttgcctcttttaccttttcagggctagtgacctctcttgaccaacaggaatgtatgggtgtaagaaacttctgctagcttcttctaaatgtctgcctacaaactcctcttagtgtttaaatctgctgttcaatgaaagaaaacagtatgtgatgaaccattcagaaaggaagcttctttttacttttcaggctggatagctctgtgtccccataagcacacatggaagaaggaaatttcttgtactggcttcttctcaatgtctccatacaaattctttttctgctagaagcttccattcaatgaaagaacacagtaaatgatgaactgatcacaaagcaagcttctttttccatagatcgttttctaattaattgatgtctcctaaactctgtgcagacaaatttatttggctttggaatttataattctagcttcagttttgcctgctttgtgaaaatgccataatcccattagtttttctttaattgctcttattctttatagtagagaagtatgcaaaacaactctacacatttaagtgcacacaagaattatgtggattatcagaatgcaattacatttcaagattgtagtgagctaattttcaatttggaccttattcttttttctcctcttcctttttatttttgcctaaacaccactacttgaaatgataactcattgaaacttttataaatgaagtagctctcaatttgttctttagcactgccactttccgccaaggctttttcacttgttaaatcatgacttattaaactgatgtaatgttacccagattttattttcttttatgctacaatgctccttgtagttccagtgaggtttcaaaagcccgaagcacagtattcagtattgtgcacgtcagacttttcgccaaagccttcagtgggctgctttataataactatgaatataatgctatcaacattttagtggggtattactaaacgagctatattactaataagaaaactttacctctgcaattttggttacagtaaatgaccattatttatttagttgttcccttttgctaaatacaatttcactgcagcctcttaatggagagagaatatccagctttaaacattggttctgttttgctgtttcattttaatttaatctagtttgaaattgcattaaatacatcacggcaatgtactaaggctttacaatttctattgaggaagtgtataaccaaaagtttcctgtcagctggaggttagtcaagccccatgagtttaagcaccagccagcatttgcctgcttgtcaaaggagaaagaacttcctctgccccaacatccctcttgactgcaagtaaacttattgcctgtcataactctaggagtattcttgcctcacagccctgaggtcttagaccctgagtgcagcaagccagtgggtatctgccaaaggcctcaggctccctctaggctgcccctctgcttgccccctttttctcctcataactgccacctggcagccaattaaaagtcagagggaccaagtggtggcccatttggggaacctcaggtcactatgctgttttatttggtttttgcaatgacacttctttgtctgattttaatttgaacgaatataataaaaaatcaggagtctacatgaaaacccaagggcctggcatttcttgggaagtcagatctggccatactggatccatactctacactggcagcaactagatggaactcagtcatggctgaaatctctggcccaagcacaaaccctccagtttgccacagtatccttgacaaagaagacgagtatcagctatcatccgttattgtgtttttactgttactttccttacagtagaggaaagtttctgttcccacacacatctgcatcaaaaatgagagaaagatggaggggaataaagagaaggagaatatttctctgacaagacaaggaataatcctatacttttcaaaagtaaataataatctgtttctttccttttcttttctgcctagcccctctatatccttaaatttcaaccccagatacaatttctgtggcagattatttttgccaaaaatggccaccacatccaatgcattcccatgtcctcttccagagccttgcccctcctacatgaagaggtggagtctaggttccctcccctggtcctgggcaggcctttatggctatctccatgaatcgaatatggtggaagaggcactgctcaacttccaagactaggttggaaaagaatatggacctctctctattggctctctctttctcagaacactttcccttggaacccagccaccacgttatgaggaagcccaagctacatggagaggccacatgtaggtgttctggccaacaaccccagctcagatccagcccttagccaacatcaactgcaaggcaaatcatgacaatttgttgtcacatttgaatacccagcatattttccaggggaaagaaaaaggattgagatagtttaattatcttcagatgatttcagcccccagcccctgagtcacccctagcctttgagtcttcctagctgaggccccagacatggtggaacagagacaagtcattccccaccttgccctgtctgaattactgtcctgcataagctgggagcctaatggttgatttttaccactgagttttgaaacaatttgttacacagcattacataactagagcaactccctctgagaattgtttctaggtgctctttccacctgtttttgtgttttttttttttttcaattaaaatctgattgattgtatctcgggacagaaaaagacatactgaatattgctatgtctacttttttttttttaaccactgtcaccactttatctattatcactgaaataagcatttctctaacatgcttcaggtcccatgccctacagaggctgatattagtcaacacctgacaaacagggaggttcccaacagcagtcagcggcggtacacggggaaagttccttgcaaccatttcactctcaacgaggaagaggattgctttaaggcactgatttggataaggaataactccatcaccacagaaggtaaggatgtcggtaactgtgcatctcttcagaatagcgttttatttttataatgagtctcattcttcatctagttccagtatataattagtgcctaattaattccaaccaaatcattcatctgtcatgctttgttttccagattaatttacaacttgttgtcatttttggatacccagcatgtttgctgggggaaagaaaaaagcttgagatagtttaattatctataattattttattatacaaaatgaatatccgaagagcaaagcatggctaaaatcattaactagttaaagaataatttaataagcaaacatgtttagcaattatatggaaaatatgtcttcttttgtgaaactgaaaagacctaggaagaaaaaggcctgtattggaagggccttttcttcttttcacaacccattgttctctttcttggtgttgcctgaacagttcttcccacaaatacacagactcgagttgcatgccactttttaaatcgaaatgaaaaagggaaacatttgtgcaaatgcctctgccactcaaaagtgtattctcaagcatctttctattgcttgaatttcattgaaatcattcagctagtgaaacaaccagaagagagcctggctacctttgtgtctttaattgaaacctaggagtcaaggtttggagataacttagagcagcccctttcttttgcctaaaagtgagaagatggttagtgacctggttgagttccacagccacctgtggtttagagttcagtccagggatgtaaaaccactaagtgcccagaaagtgagcatcactgtgtaaaattaaacatgctaatttatttaatacatgtatataaatataatctaattatatttgttaatacattaaaattaaatataatttattctgatttttggtggaccatttaggtattaacttttgccaagttataacatttactgcattaagaagttactaatttactacattcaacattttaaaatgagtatcaaagggcattcagtgcgttgctggattcaatttgctgatactatttataggctatttgcctctaaattcataaatgagattgacctgtagttctctcttttatgcattgcttgtcaggtttttggaatcaagggtatgctagtctcacaaagcatttttggaagctccccatattctttggggatctgaaatacaaagtaacttaagggttgcacagaaattacccataaaaccaactgagtctggaacctttgggtagaggtgggatatatagatagattataccggcaacccagattttttaaatgtcataaagtatttcatactttcatccaagcttggaattattttcagttttgcatctatgtatgtttaaacctgttttagccttttagtcattctgtagtaatcaccccatgatctatgtagactcagagtattttcttatcagggaaaattctctaatccatgggttggtgaatttttactgtaaaataccagtaaatatcactctggggggccaaggtgagaggatcacttgagcccaggagtttgagaccagcctgggaaacacgggaaaaccccacctctacaaaaaatacaaaaattagctgggcatggtggtgtacacctgtagtcccagctacctgggaggctgaggtgggaggatcaattgagcttgggaggtcaaggctgcagagaggcatgattatgccactgcactccagcctgggtgacagagcaagaccttatcttaaaaattttttttcttttagactttgcaggccatatggtctctgttgcaactcttcaactctgctcatttagtgagcaagcaactatagacaatatgtaaatgaatgggcaggtttgtgttctgataaaatttatttattaaaccagacatgagctgtagtttgtagtaaccagcttttagccataacatttttgacaaatcattaccatttcatgaagtccagacctccaaatgtaccataagttccccaaaagcagaaaagccagtggttcaagacaaaatgcacagttcatctttaagactgcacccaatcctgtcagcctgcagtgctgtgctttaactttgaacctttgtgtgttttggttgtttgggctagggagcatttgaccaagaaaagagccttcgaaagtggcactgcaaggtcttaaggtggaatattgatagcagagaatttagaaaccccaaagcaagaagcgctgtagtctctttcatgtgcctttgtattgtcctcttggttctcagatggaggaagagcatcagtgttattctgctgacttgcccagttgtcagggatggtgatgctgtggtgcccccttaaagggaaatgttttttcaagatttaagactgactcccagcagccagtgcataaagccatttggagtgcctgcttttgtccaccaaatagccaggataagaagtatgtggaaattagtttcctgtcttacatgtaggtgattttctccaggtctggtgcttaatgactcccccaggcacctctcaggtaggtgctcttaacactgaaatgctaggaccaagctctgggagccttcagggaaacctgacctggccaagttcatttaactctgtgtagaggcccttttcaagtaaattctcaagtaaaaaaagttaagaaaaaatgttaacatcttgccttaaaaaaactttctcctctttgtatcttttctgtaatccaggtcatactcagacataactttagtcccattcagaccttattcttgccattattattcttgcagcatcactggatcacagtccaaatctcagagcagaggaggcctaggacagaaagcccgtccccacctgagccaagaaccaacaaccacagacagaattatacccacagaggctcccaggaaatgcagcaaagagtaggatccagtgtgagaggaggcctcgaggtagagcctcctaaataaaccattggcttctctggcaggctgaaatacatttagctgggagggcattccatatagaaatacaaattcatgccaaatcacttcagtcaccttgtgacctctatttcttaactgagactttgggtatatgatacttgagtttcattgctgggctttcaaatcccttttcatactgcagaaagcctagtgatctttccagaactgcattttgaaaagaatatagctgttgcagcattgcttctgagacatctacagtaccatacttggctgaagctccaagccatttctttgataatttcagctctactctatctcagtgtcacttgtatccagcatagtgcctggcacatagtaaatgcaaaataaatgttttactgaatgtaagtgaagacagttcaggatgtaactcttttccttacctcccacatggtgagttttatcaaaactttttgcattcggcctacctggaaatagatggtcaattgagatgaagacaagagaacccttgaatgaaattgaagctattctttaaaaattcatccttagtaatgagagtaataacatgctggctacacaggatgagttaagctcctcctcacgaataacagacatttataaagtcagtctagctcaggttctggagtcacgtgacttgggttcaaatcttgggtctgccgtttccctgggcaagttacttaactgctttgtgtctcagattctagataatatctacctcacatgggttgctgagagggtgaaaagagataaatgagattacatgccatactcaggacagtctctcatacatagaaagagtttcatagaggctgccattagcattgctcttacttctatgtgtgatggaattaaaggtaccctagagtagaagtctcagcccttgccaccagggccctgatgaagttgaggatatcagtctctatttaaagacagggatccgtgtacaccaggtgccagtcagctatagaggcactgtggccttcaggagagccctggaggctgtgaagtttggagaaggcctccccgagaaaggaggatttgagctcagtcttgaagagggacaggataagaagagagagaggctgggggagtttggattgtgtccaaaagacactgggccaacaacgtgggctgggcagagtctgtgaagggcagcagcaggagatgaagccagaggcatgggcagggacagacactggcgggccgcaagcacccagccacgtccaagtttaactggttaccttttagggatgggagctgaccaggcgggtgccgctgtacacacatagcactttgggaaaatggcctttccatctgtagtacccatgccagcagagagaaggtgaccacgggagaatggcttaccatggatggcagtagccaataggggcgaggcagctgtggatgcaggagctagctggaagtggccacccttgctgcatgtggtggtcttgctgacacagccactgctagcttatttccaagtcagcgatgagatggtggtgttgcagggcttttccgtagttcagctaaagatggggtccttgtccgtcccgtggccacgaaaacgtagcctcgcagacggtttgaagggtgagttaaacagggttttactgggtgaaaggaaaaaaatggggtggaggagggggaagcaggatcctccgcaaggcaagccggctacttgattcccaggttccacacaggaagaggaggggccaggctcctccccactgcagatggcatgcatttccggaggctccaccccaatgtgcaggctggttggagtttttctagggactccctcccacctgcctgtctcattggcatttgaagccagaagctagaagtctggcacatgatggaaagcaaggagcagggctgtgcttatgcacgtttgaaaagtcgcatggagccatccgtgaccgtcctggacatttcagtccttgctttttcttcatgtcaccctaataacaccaggaggaatgtggacagttttcatcatagtttatttttactccctcagtgctaatttccccttttttaaatactttagcatgtgagttggggcaagggagccaaggacagtgaaaaatagtttcatcgtgtcccactggctgtggttgggtgacatgtccctccgggaaccacaccctgaatcctaacaaacaccagtgctgatgttactgaagcccagggatgtgaggggagaatggtggatggattgttctagaacagtggatattgggcatcaagaacaagagatactcccaggaggaagtcggctctcctttgaacttctacccattgcagacgcacacagataccaccccagagagtagctccttcccacagtcactgttgtatttcacatcttctgcttccaaaggagaacacagtggttctgtgatggaattagtccatccagaggacatggttttccgggctctagagttggatggatttatagaagtaaattaccctaaactattagaactgctctagtgccatggagaagagctgacatcacaggctcaaatgctgctttcaactgcaaacaaaacctggagtgttctgctggggggtttctgatagaacccagcaacccgatacattataacaatttatggcactaattgaaactaattgaaattcatctgctattacctctgtactttccatgaaaatgaaaagtaggatgaaagtaaagtaaaaaaaataaactaccttaatggctcaaaatggatcaattattttcatctttagctaaatacagtttactgccttattaaaagcatgtttgtaggaaaagtataacattaaaattccactgcatgcatcatcgaacagaggctttgttatgttatatctaatatattcttccctttttattcagcagagcagaacgggacaggtcacgttttgggcatagaaatcttatgctttggcttctaaaaagtaaaaagcgcattgtctggttctattcgtgggctatatatatatatatatatatatatatatacacacacacacacacacatacatatatgtatatacacacacatatatacatatatgtatatatacacatatatacatatatgtatatatatacacgtatatgtgcatatatacatatatatttcattaaaatacaaaagaataggtaaatatgcatagacataatttaaaatatataaactataaaatgtaacatacacatatatgtatatgtgtacatatatatatatacacacacatatatagacagaatcttgctctgccatccaggctggagtgcagtggtgcaatctaggctcactgcaacctctgcctctcaggctcaagtgattctcctgcctcagcctcctgagaagctcagattacaggcatgcaccaccatacccggctaatttttgtatttttagtagagatggggtttcaccatgttggccaggctggactcaaactcctaacctcaagtgatcctcccgccttcgcctcccgaagtgctgggattacaggcatgagccaccactcctggcctgttttttaatgagtgtttatttcacaatttattaataatctgtgattgctacttaaaaatatttcattatctagttatttgctgaagatatttacccatataaaatgccagttggagtatattttagtaacgtgttacatatccatctgcaagtgtactgcagtgctatgagacctgattttgaaatagactcacagggtttgagtcctggtgacccacctgcttgccatgtgacctgaccttgagctcaagatttaacctctctgtaccttattttctggataaaatgataaaccctgtctcacaggcctgttgtgaggatgaatgagtcatatgtaaccactgtatgtctgttttgaagcagaaaaaggaaacataattattcattaaaatacaaaagaataggtaaatatgcatagacataatttaaaatatataaactataaaatgtaacatataattcttgtttctctggccttaaaaatataataactatgaagaaaacttcatgttaatattgtgtgcataaatcctgaatttatttcttatactcttgagatctaacttcatggccagaccaccagaccagcaaatctttccctccaagtcccgattctctccatggagaagcttcatctttatagcattgagcgtgaccatgaaatgacagcagagcacaatttccagatgttttaaagtcaagcactcagttcaaaagaataaaatgactttttagcatctactaaaaataatttctttaaaagttgtcccattacttttagggtacatctatgactaaaagaattagcactttattttacttcttgaacttaatagggaaatcaacttagttttcctttcctgcgaagtcattttacctttaattacttgttttctaactcctgaaactcttacatactgcctttaggaaccaggatgatgaaactggcatttttcccccttgattaacataaattgaagaacttcttgcatcttggtgcattattctttttttttttttttttaagacagagcctgtctctgtcaccccccagtggcacaattgtggctcatgcaacctctgtgccctgggttcaaatgatcctcctacctcagcctcccgagtagctgggactacaggcatgatccactatgcccaactaatttttgtgtgtttttagtagagatggggtttcaccattttggtcaggctggtttcaaactcctgacctcaagtgatctgccagcctcaacctttcgaattgctgggattagaggcgtgagccaccgcacccagccccaggttgaaactttaaaatgtgatcgctttatgtgcatggtcactgtcaaagttgctgatttgttcatttacaccttgagaggccaaggtgagaggatcacttgaagccaggattttggaaccagcctggtcaacatagcaagaccccatctctacaaaagttttttttaaaaactagccaggcatagtggcacgtggctgtagtcccaactactcaagaggctgaggcaggaggattgctggagcccaggagtttgagactgcagtgagctatggttgtgcactacactccagcctgagtgacagcaagaccccatcttaaaacaaaacaaaaacaaaaacaaaaaggtcatctctacatttctaccaacattttaattggcaagtgctagttcccttcagtctgaagtggggaattgacagctcactcagatattgactgcatcatcactttccgtctctctctcccctgttgggctgttgacgctgacaccctccttcctctaggaagcacccttgcacattctgtttcaaaggctgccactggttagcagtgcgagaatgacttcgggctccttcttgcttgccagctttaattttcggagcttccacacagtcgcctttttacgggtgctctgcctggaccctactgcccgtctcagatctgcaatcagagtaatgcacgatttattcgctaaaaggagcaacaaagattggtcttccatgaaaactgccatggttatattcccttatcctttatggggaatccacccagagtgttcttatcatttgttatttgccatttgaaagtggggcagcccatcctttacctctgtcacctgttaaatcgagagcaaaagctggtcatttctcatctgttaggtaagctgatctgggaaggaaacagtgactaaatcttttagcataaaactgatatccaggggaaatcatcagtttttccactctacttcttttatatgtgtctagaaacttcaaaaacagtgtatgtgatattccggtaatgtgaaggaaggttccatgagttataaagtacacaatggtaggtatacatgaattaaattcatctttaatatggacatactatatatccagaaaattaaaatttaaataaataaattcatatttaattaactgaagttttccggcttattaaaagcatgctgtaggccagtgtggtggctcatgcctataatcttagcactttgggaggccaagataggcagatcacttgaggcccagagttcactaccagcctggccaacatggtgaaaccccatctctattaaaaatataaaaattagccgtgtgtggtggtgggtgcctgtagttccagctactcaggaggctgaagcatgccaggaggcagaagttgcagtgagccgagatggtgccactgcactccagcctgggctacagagtgagactctgtcttgaaataaataaattaattaattataaaataaaagcatgctatcaaagaacatatgtcataggccccccataactggggctatcttacctgtctatacagctatcacgctgttctgtgccagtggaggcccagacaccccctgcacatactgggacacataactgtcagccccaacacctccctcaggcacagccaacagagtgtcccccggctccggtcattattcacttgccctcggtttgtcccgcccagcagctgctttctctcacatacttttaaacactttcttccttccagctcttacccagggattcaggaagatctgtttctctgaggcacctactgtttgactgtgtctctgcccccctttctttctctctccatttccttccttccccatatctccttcttgattcagcccaaaattgacttaaccgttgcaaaatgagttacccaactgctacttccatataaaatataagaaagcctggtcatccaacgtcacgtttacatctaaaagaaaaccaggggtggaaatctctcaaacttctacaaattcccagaagttatatcagcctcctgagtaactaggactagaggtgcgtgccatgcttaattttttttttttttttttttgtagagacagggctatgatgtgtttcccaggctggcctcgaactcctggcctcaagcagtcctcctgtcttggcctcccaaagtgcttggattacaggcatgagccactacattcagccctgtctttctttaaatagcacattaaagacgtaatttcttgtttccctgagcttaaatgccaccaatatgacaggagtattattttatatctatcatttgttgtaggcacacacaattttggttacattagggactatgtgggattttatgagcctacactggaaacctaataaccagatctaacatcgttaaggggaacatatttctatcttacatatctcaggtgtatagcccattctgtgactggatagttcttatagtgccaacttagtagtgaataccaagcagaaatatgtgctgggaaaatctggctacagtgagtcattttgtgctaaatatttacaggatccaaaagtatgatccagctagcaggaagaaagtcttaggatcagcaatctaataaatatctgacatatatccatgtatctggtcaggaaatagtactgtggtgataattacagtcacatctagtgtaggccacaggcactgtgctaggctccagggataacatgatgggtagggcaaacatggaccttacagtccaaacaagtcatctcgctgcgaagcctggctgtagcctggctgcgtaggccatggtgagtgctgggaaggaaaggtggagaccgcccacaggcctgctggggcctcacctgcctggaggctggacagtctgtggggcccagatatagctgtgggcagcctgaggccttgacatgggctcttcagaagcactggttccagctcatccatattagtaaattactctgataaatgtaagtaatcatatttttaaaccagtttgatttgtcccaaaatgaataatcaaagtttttgtctactaggcttttttctggagggggccccaaaatataagactttggttattctaagagttagcaccatgcttatattttgctgtatgacaacattatatatgggcatttgagtgaaacccatgttattgttcacagttctaaatgctattgttatcaataatgataacaatatgagggattatgtataaaagtacctaactttgtgcctggcatagaggagtacagagataaacatgaactggatctaaaaatcctttacaaagtaaatgtgagcagtgttgcagaaagaactcacaactgcacaaagattatgaaaagaataacctcccacagaatggagacatttaaaggcaagaaattgggccagatgcagaggctcacgtctataatcccagcactttgggaagccaaggtggggagatcacttgaggtcaagagttcaagaccagcttggtgaacatgtcaaaacttcgtctctactaaaaatacaaaaattagcctggcatagtggtgcgggcctgtaattccagctactcaggaggctgaggtgggagaatggcttgaacctgaaaggtggaggtttcactgagctgagatcgcgccactgcactccagcctgggcaacaggcgagactctgtctcgaaaaataaaaatgaaaataaaaaaaaggcaagaggtggacctggtcaagaatagtaggccatcttacatattaataactagtttttatcatgttttattctatttgtggaaggatgtgatttgacctgtaacatgttttatttatttaatataacattatattatcacggcattctactatattttatgggaaatgaaagaactataactagtcttagaaagcctgtttaaatgaaaagtttgagatgaaatcactcaggcagtcatctcccatatgaccatgctggtttgcactgctggtcagtaaatattcatccttctctccctcctgtgtgggcagagtggacgtcctcactcccgtgctcatgggcatgaccatgacacttgctttggtcaatgggatgttagtggatatgatgtgggcagaggcttgacatgtgcctgggcccttgtgcttgcctttctgtgcacctgcatttccccatagatagcaaatgcctcaggtagctgtcaatccaagcaggatgaaacacacatggtgcaaacaaacccagccacaacctagagccagatcagctgacatcagtccacccacaggtgtgtagaccacccacaacgtgcttcttgtttgacattgagttttgacgtggtttgctatgcagcattattatgatgataactgactcttaagataaccgaagtctcatatttttgttaaacataaaggtagccaaaactgtttagaagtcacattatctagaaataaacctgtaattttgaaatcagatattttacaaaatgtattacctttggaattgaaaagtatcgtcctctccagctgcctgcagtccgtggaccacccttgctggatcagacacctctccaaaccccagcagcaccacaggcccagttttccatgagcctgtgaagaataagcccagctcacagtagagctgctaacagccatcatgaaagagaccagaaaatacaaaatccttagctgtgtgagacctaaacacacttaaattcgttcaactgaaaatgaatattgttttggcttgcctatttcaaaaggacagaagacctaaaaccttttatagttttcggttcaagttttgcctttccttgcaggctgattctttgttgtgccagacagccaagattcatgtttcgtagcagctgggagcctcaataatttaagcaaaatgttgcctctttcagccaaggaaaatgcagctcaccaaggaatgttgcattgtagcatctgaacagagtgggggtcatagccataaaactctcctagcgtcctagcgagggcaggaatggagagaccccactccctcacttcagtgccttcttggctttccatagatgaagagcagggagtatgggagaattttctagatgctgttagcttccaagaagccatctgaaagttactgtagtttatttttcctaagcaaacaagacaagccatcacacttcctttcaactttggattgaaaacaatttgggcatgatttcctcaaccaaatcaaattaatacacttgccatttattttggcttgtaaaattccttttcatattatttcatgaacaggagaaaaacagagagacattcaatgaagtgtacattttgtggtaaaattggtatatcttacctggaaaatgagtctacagcagtttatttgtgaaaatgtgaaaatgccaattcaatgtcaaaaatagcatatactacatttcattaatttaatagtgtcattgaccttaaaactgctaaaatagtagaatagcatatgtaattgcttctgtagtctttttgagaaatgtaaatagtatagactatttatcatcaaaatgctcttacacaagggaaatctgtcaagattattttgtgattttatttttgctaacaaaaatactgtctttcagtccctctagctaggtcttgacacattatattctaaaaatcagggttgaatctttgtaaaattatctggtgaaaagcagaatgttctggcctttaattctcaaaaaagggaaaacttccttgaaatcaatccagttcaacatttaaatattaaaatatcagtaacatcatgagcatgaatattttttaccattgcctttttgtctgtaaggaagaactagtatacattgccaacattagtaatttggtttccttaataagtatagcaaattgggaacaaaagcaagataaaaggtttttttctagacagtttctttcagcctaatttcaacttcaaattagaggaacataaatgaatgtcctacttctgcattaaaagtacttgactactttgtgggatgttttgtgctgattctttactaaatgatcttggtcgccgttgctaggtaacaccgctggcttcctgcagctgaaaaatgagagggttatacggagcaattcggcattattagcatttgactaaggttttttggttttctgaactgtatatcttagcgttttcccttctttcctagggaatatcattgtctatgggaatacaattgatacttacaccaccgtggagacgctcttaaaccttggcgtgagcggcagccgcatccacctcgtgcagcccccgcccgcctccaccatcacctgcatcaacaactactcggtggagagcgccgtggcggacgcgctaggagccgccggagtcactatgtaccgggatgcgatcctggcccagtggaatgacggcctgcacccagaccccatctacagcgcctccttcaccacacccaccaagcctttcagactccagtgctctgtaagtgggtccctgcaaacctcactcaccagccagggacagaggacatctccaagggatttgggggtctggaagattgcgggcagtgaatttgtagtaccagatgttggattttgttttctgtgtgttcagattacctcttgctgggtaacaacccaccccagactcagtggcataaagcaacaacaaccgtttattattcttatctctcctggttttttattattattttattatccttatctcttctggctttggccagactcagctgggaagttctcacttgaggtcgctcatgcggctgaagtcagcagtgggtgggctggaattgtctcaaaagcatagtcactcacatgtctggctgttgatcctgaatcaactttagttgagattttcaccagaacacttagaagtggccccttcatgggactggcttcctcacaacatggtggtttgggtctgagggtagagtggagagagaggcagtgtcagctgtgtcaccctggatgacctggcctctgaaatcaagcagcattcctcccaccacattctatttgctagaggcaagttgccaggaccagcccatattcaaggagtgggaaattaaaccctgcctgttcatggaggtcaaagatttgaatggagagcgcttctctttacggagagcttgccatgccccaggacattctgtcaactcatcaggacagctctgtaaagggaagtatccccagtttacagagaacgctgtggctctaagtcagtggcactgctggttccctgcccagcccaaggtctatgctgccattaacctcttaagattctggcaacagcagtggtgagtctttccccatgacacacaacttctggcaatgtgtatagagagagcactttcctttccaggtgggtgacaccccaccttccagcctgcaccctcagagtttacagcttaggaggttagtagaagccctcagggagggaaggagggaaggggccggtccatctcactgagaagcaggggaaccttgctcgaaagggaagctgaggtcggtatgaggataatggttgtgtaggtcaagggtgtgtgttaacggttgtgataaagaatgcctgctaacatccagtgggcaagccatttaggggcaggcattcacagcaggcccttacctaggagtggggggtgatcagcctaagtcagggcttctcactcaggtgctgctaaggattgagaatggtggctctcacccccaccccaacccagaactcaaaggacaggggctcaaagcagaccactgaaaaagactaaaaaggaagattttttttagaatctctcattttatcctgagatccatggaaattgtgtattctactctgtagttcattcatttattcattcattccataaatatttattgaacacctgctaggtcccaggctctgtcctcgatgttagggatgtaacagtgaaaaagacaggacaagtccactttattttaaaaagtgatactgtctatacatgtatgtcatgacacctatttaagacaggaaatatcaaaatatttttgcacaaattttccctcaaaaatggcaaacctggaagattgccacgtttattctggagcacctctagaggtgagtgtgtgccttgttcaggaagcagaggcctgagaaaacctccccaaacatcccattggatagcagctcttctgaccttcactttcctattcagattagaatcaaactcctgacaaaaacatctggcaaattaaattgacccttgaacacatgaggagtaagggcagcaaccctcctcacaaagttgaaaacccacatagagcttttgactctccaaaaacttagctactaaaagcctactgttgaccagaagcctaactggtcacataaacagttgattatatgaaaatgtattttgtattttatatgtattgtatactctatcctcaccataaagtaaactagagaaaagaaaatgttattaagacaatcataaggaagagaaaatatatttattcttcattaggtggaagtggatcatcataaagatcttcgtcctcattgtcttcacgttgagtaggctgaggaagagaaggaagaggaggggtgggtcttgctgtctcagggatggcagaggcagaaaaaaaatctatgcataagtgacacacagttcaaatccatgttgcccaagggtcagctgtaacctcaactgtcttgatccaaggcaccttcctgctacattttcatcctaacaccgtctgagtcagacattggcttgtttgctgttatattctttctcctaccttccctggtctgcttggtctcacaaagaatggcccctgcagatgacatttcccaggttccattattctctgattttcatctctatttgaacaatagtttgtacctgtgggagattaaacatgggaagcggggagtcagggtaggtatctctcatactgtctgctttgggcagcatctgtcagggcattaagcactttttggtggggatgaatatgtccatcctcttcactatggtcttggtgtcatgagttgaattacatcccctagaaagatatgttgatgtcctgacccccagtaccagtgaacatgaccttatttggaaataaagcctttgtcgatgtaagcaagtaaagagaaagtcatcctggatcaaggttggccctaaatccaatggctggtgtccttaaatagagagatttgatggcatacagggacacgcaatgaagaaaacctcacgacagtggaggcagaggttggtgtgatggcagctgcaagtcatggaatggcaggaattgctagcaaccgtcaggaagtaggaagaggcagggaagccttcttccctagagcctctggagggagcatgttcctgacaatacttggattctccagaactgtgagagaataaatttctcttgtcttgagctacccagtttgtggtacttcattacagcagccctaggaaacgaaagcagatgatgtcacagtgtatgtacctactaaaactatgatgttgataaccagaatcatacattatatactatttttctatttggcttcatttactcagcatggtgattttgagattccatatagttccatgtatcaatagttcattcttttttatggctaagtagtattccattgtatggatatatctcattttgtttatttatttgcctgctatgcacattctggtacatgcctttgtgtggataatatttttatttctcttagctataaacctagagattgtctaagtcatatggtaggtgaatgttgacctttttaagaagttgccatgttgctctccaaagtagctataccattttacatttccatcagcaatgtatgagagttccagatactccacgttcttgtcagcacttggtgttgtcaaattttagtcactcttgtgggtgtggcatggtgtgtcattgtgttttttttaatttgtgctttcctgacaattaattatgtttggtatcttttcgtttttttagtagccattagtatttctcctttttgtgaaatgttcaagctattataaatgtatttaaaattttgaaatttccagttgatcactgcaggtttacaaaatgcaatttattttctgtataaacattgtaacttgaaaatgctaaattctcttattagcttttgtagttgttttttaggtccataaacatgtcatgcaaatagaggcagttttactacttcttttctgatatttaggtcttttatttcagttacttgctttattctactcactaggacctacagtgcaatgtttaataaaagtgggggaaatagacatccttgccttgttccatatcccagagagaactttcaggctttcactgttaaatatgagataatttggctgtggatttttctttggtgctttttatcagactgaagaagtaaccttccattcctagtttgtttagaggtttttatcatgaacggctgttgaattttgttaagtgaattttccatatttcttaaaaagaaatatggaaattttcttcttaattctttaatacagtgaattacgttgatcgatttttgaaaatgttcagccagccttatatctctggaatgaaacctaattggtcataatgcgttatctttctatatattcctaaattttatttgccaatatgttttaagaatttttgaaactattttgcaactatattcatgagggatgttgatatagaattttctgtttcagtaatgtccttgtaaggttttggtgttcgagctgtgttggccttataaaaaaattcgggcaatgttccctccttgtttattttctgaaaaagtttgtgcaagattggtattttttctttcttggacgtttgacagaattaaccagtgaaacaatctgggcatggagtttatattgttgaaaggcttttgataacaaattcatttttttaactagatataaggctactcaaattttctgcttcttctataaatttttgtaagttgtaatttttaagaaatttgtccatttcatttacatttgtcaaatttgttggcattaagtttttcacatattattttgttatctatttgatgtctaggatctgtagtaataacccctcatttatttctgatattggtgaattgtgttcagtctctctgaccctctctctgtttgctgccagtctctctgtctctgactctctctctttctctctctctcccagtgtagataggggtttgtcaattttattgatctttttcaattaaccagcttttgagtttgttaattttctctattatctgtcagttttctcctctattgatttctgctcttaattattttcttccttcttcttgctttggatttactttacccttcttttttctagttccttaaggtagagccttaagtcgttgatttatataagcatttcagcataagttttccattatgtttgagctgcatcccataaactcatatgttaacttttaattatcacttaattcaaaatattttctaatctccctgtgattttttattcaaccttggattatttagaactggattctctaatattcaaatatttaaggttttcctaaatattatatttttaattgatttctagtgtaatgctgttgtgatcagagaacagtgttttaagatttagagccagggacggtaactcacacctgtaatcccagcacattgggagacctaagtgggcagatcacttgaggtcaggagttcaagaccaacctgcccaacatggtgaaaccctgtctccactaaacatatgaaaattagccaggcatggtggtacatgcctgaaatcccagttactcgggaggctgaagcaggagaatctcttgaacctaggaggtggaggttgcagtgagcccagatggcgccattgcactctagcctgggcgacagagcaagaccctgtctcaaaaaaaaaaaaaaaaaattattgagacttgttttatgtccaagcatatggactaactttgtgaacatataaggaatatgtattacgtattatgtgcttgttgagtttaatgttagttcaatatggttgacggtgatgttcgacgctcataagtctttactgatatttttatctcattctattaattgctgagagaagggtattaaaatctgttactattattgtggaagtctctgtttttccttttaattcttttgatttttgctttatctttttgggggctctgttattaagcccatgagcatttatagttgttatatctgccttgtgaattgtgccttttatcattatgaaatgttcctctttatctctgatatttaataatatcccttatcttaaggtccagattatctgatactaatatgaccattccattcttcttatgcttactgtttacatgatatatttcccatccatttactttctacttatctgtgtctttgtgtctaaagtgtgtctcttgtaggcatcataaagattatattaatgtttttagtgctgcatgacaaactgccacaaatttagcagcttaaaataacatccatttactagtttatagctctagtcagaaatgcaggcaaggtgtggctggcttctctgcttagggactcttaaggctaaaatcaaggtgccaatcaggctgcattctatctggagcttgaagtcctcttccagacttgtgtgatagtaatagaagttaattccttgcagctgaggacagaggtccccacttccttgctggcccagccaggggctactctcagctcctagaagccattcatatttcttgcctcatggccccttccatcttaaatccagcaacagagaatcttactcatgtcaaattcccttcatatttcaaatccttcttcagaaaaagcctggtcccttttaaggtttacctgatcaggtcagacccactgagcatgatctccctgtcttaaagtcacatgtgccatataacatcaccttacacattcacagttcatgcttgtacttaaggaagaggtggaatcttgggaaccaccttagacttctgcctaccacatgctttttatcctttctatctctgcattttatttaaagtacttagaccattaatatttaatgtaattactgatatggttagatttaggtctaccattttattatttgtttactgtttgttccctcttctttcttttctgttcccccttgcctgctttctttaggattattagagtattttttagtagtctatttcaattggctctttattttattttattttattttattttattttattttattttattttattttgagatggagtctcgctttgttgcccaggctggagtacagtggctcgatctcagctcactgcaaactcctcctcccaggttcacgccattctcctgcctcagcttcccgagtagctgggactacaggcggctgccaccacacccggctatttttttgtatttttagtagagacggggtttcaccgtgttatccaggatggtctcgatctcctgacttcgtgatccgcctgcctcagcctcccaaagtgttgggattacaggcatgagccaccgcgcccggccttcaattggctttttaactatatcttatcttttagtaattgctctatggattataatacacatcagcaatctttcatgttcaatagagttaatattgtaccatttcacataaaatgtaaaaaccttgcagctatgcagttccttctccccatattctggatgtctattttgttaacagccatcctatatcttacatctacaaacactgcaaaatcagtaaggcaatattgtaatctttgttttaaggtcatatgtattttgaagaattaaaaagaatagtcttttatagatactcagatatttactaattttcttgttctatcttcctttttgaaaatccaagtcttccttcagcctaaatgagcttcagagcatttattgtattgtaggtctgctaaaaagtaattctttagttttgctccatctgaaaatatatgttgctttcattcttaacgcttattttcactgaatatagaattctgggcttataggttattttttcccagcactttgaagatgcttttccaccatcttccaacatccatgcatttttgtttaaaaatctacaatcatttaaaacattcctctatatgtcattttccattggctgctttcaaggtttgctctttatccttggtttttagcaatttgatgctgtgggtattctgtgtttattatgtctctaagcatggtttgttttttttgtttttaatttgtcttgtttggcgttcactgaacttctcgaatccataaatttatgattttcactaaattttaacaagttattggccattctttcttaccctattcttctctcttctcttcctgggattccaattacatatctgttaagagttttttatattgttccctggggctctaaggctctgttttttcagtctcttttttctctttctcactattcttcaaattggacagtttctattcatataacttcaagttcactgactctttcctctatcatctctatttttctattagggcataagatgactgcagctcacccttttataaaaaacctctaaattgaggccagacacagtggctcacgcctataaacctagcactttgggaggccaaggtaggtggatggcttgagctcaggaattcaagaccagcctgggcaacatggtgaaggccatctctacaaaaaaataccaaaaaattagccgggtatggtggcaagcacctgtagttccagctacatgggggggctgaggcagaaggattccttgaacccgggaggtcaaggctgcagtaagctgagatcttgccactgccctccagcctgggtgacaaagtgagaccctgtctcaaaaaaaaaaaaaaacaaaaacaaacaaacaaaaagactctaaattgaatacctgtatgtggaaatggagagaaaaggtaattgaaaaagcaaacttaaaaaaaaaaaaaacacctctaaaataagggaaattatccccatcctggtcatttctccaagtttttactgtaatacacaagctacccaaacttttaaatactaataagaatcctcttatatcagagtttatagttattatcagtgggattcatctcaggaggttataccaccaaggcagaagcagaactctcttgaaattgatgttttgtccccacatcaaagcctctccacatcctgcctgatagtggcgcctcctgggctcttagcaggtggtccagcctccagccaggttaggatgcagtgacactggctctcaaggcagactttcccatcttgttggcattcatctttccaattagatcatgcgctccatgcttatgtttttcaccaagatgttctggagaccttgcacagtgcctgggacaagaagtgtttgtctgaatgcatgaatgaatgaagtttatcagactactgactcccacccttctccctagctaaccaaggagttttgctctccttaatcagaattatcaatataagtagtcttgaaatatgtactcagaacatcagtgtggccagccattacctcttcctatttgtacccaatatgtagtattccactggcgttacagaagcacataggttgtatttgcaaggtctgtaacttgtaacacatgttcttattaacaatgttggatttgcttattcagttttcactccagtctacaaactcctatgaaaccccaaatgtagccaaaattgtgaatgcctacaccaaaagtgtataagtaaacattactgcaatactggtaacctttaaaacccagaaaaacaagaactagtatatttaatgtactacttaacaaaaagtaggcttaattagagaaagaaaattgggtaggtagaagaacttctgtgaggatgctgaaggagacttctaaacattttcaagggctcaagaggttgatagcactgtttttatttataatttaaattcaaatcagatatctttctatatatttatctgggtaggaaatctattttttatagagatggggaaagagaatgagaaagcaaaaaaggagtgtagggagacagaaagattcagaatcagagagagactcagagaaatatattttcctgtggccactgggtaagagttataagacagaaaaaaaaagaaaaagacttgaaagaaagaagcatcctgggatgggattagacaactaggtgaataaagacaggacaagggcacagagtgtatctccctgagggaggaccaaggacatcatagagatgatggatctgagtgctgctgtccaatagaaccttcttcaagatggaaataggctgtatctgcactgcccaatatggcagccagtagccacctatagctaactgagcacttaaaatgggctattgcaactgaggaaccgaatttttcattgtatttaatttaaattaatttagatgtaaatatttatagccttgtatgactagtggctaccacagaatcagaaagctccctgaaccattcatgggtgtggggcaggaatactgaaggggctggctacctcttgcccaaggacagctgatgtctatacagaatgaaacagttgaggggggtaaagcaggaatgtgatggaagtggggagatgaccatcagtatggttgggacccatgtcttatgttcattttttagcatgcttttaataaagtggcagactattttagggaaagataaaatcaattgagcgtgtttcaattggtccaacaactaaagacaaaaacaactaacttgcactgcttcagtgactttcaacatcagtgtggaagacgatgtccagatgagcatgagaaagcattgaaatttgagcacagaatggagagggcatacaaataatttctaaggagcatgcaaaggggttggtggcccctctgcttatggcaccctcacacagtgcctggcatatggtaggtatgccatcagtatttcttgaatgactctgtgtcgtatgagagcaggaagcaacaaggcaggaacccagacctagtagatacagagactgatgaagcatccatcttctctggagcatcatatagggacaagcttactgagttttaaaagctagcaatgggcagtctgaaaactgaagactggatgagatcaacccaagaaggaacctgcagagacccgagtgtcagacacaggaaggggaagaggatggaggctgcgctagagctgttcaaaatgtaggagcatgaggggaaggcagggtctgtacaaatgtaaaccctcttccgccgaaaaccactcacacttttgtgggagatatttcatcacctggcatccttctctccactggatgagtgaattgagtgaataagagtgacatttggggatcttaatgggttcttcatgcccaaggcaatctatctctcatacgcacacaaacaacatgatagcaaacttttagtatgtgtatttttgtgccccgaataataaaatgccctggagactagtcacacttttgggaaggtaaaatgaagagtgataactgaatattgctgtaattgttcacttcgtagatgttcttcagcttctgtgagaagaatgtggattatgaaacgtttaaagccctcaatgatgcatgtcttgtgtatgacagtcgacttgtgattgataccaacttccacaccaacgacatagccatcagagctgctggctccctcaccaaattctccaatagatactactcaaatgagtggactcacagcaacttcagttccaaagaaattggctttcagctggcagcagctatgctacatctctttgatccaacccttgagcctgtgaccgagccaccagctaatcttgaccggctcatccccatgtacaagggagccaagattcaaggtatacgagtaggcttccttctccttgatgaagccacagattaggtatggctcagcagtcaggccagtcctccaggtttctcttaggcttggggaaaaggctcctccgtacctcaatgggttgccacagagacagagaaagggtctataatttctgaagcatttattacaaacctggaattattgttattacggttctttgcatttgagcatttactatggaccacatcctaaatggggttcccactttacagataagaaaacagacaagggaatgattattaacttgtctggatgtctcacagctggaaaatgatggtttgccctgacatcttacccaaaacttccattctctctgtaagttcagagataaggagacccttccaggcagccaggcctcagcctgctctggggatggataagcttaaccatttgcagctgtaaagcagtgcacttttatcccataaacccttctgacccctaaggaggagatgatttcatgagtaatgcagggttccttcacgtttagggtatgagaaatacctttgaaaatggtgtttctgaatgttgtggaccttttaccagaaaaatgcacatatttacaaaattacgtgttcccttcctggaggtttatagatgaacccacaaagctgtacatagacccccagggtgtccatgaagcccagtccagtcaatggaatgtcagattacagagacgaaagccccacattccatccttgtcttcctcttcctaactaggcagccccacaaggtcttgctctgcttctcactctgggtgagacctgaggaaaggtggtggccgtaggcaggcaagagaagggagggctgtcagaagccagagctggcacaggcccagacctcaggaacaaaccaaaatattaagaattcgataatgacagtttctaaaacattgaacaaagaactttgttgatagtcctaattaaattcaattttttaatattttggctacattttggagaagtgatgaggaataggaatgctgtttgcaacatttaaggcttctaaaggtcttgatctggttttggcagatacaggttaaagggcggggagctccggataatcacaggatacacaagatcggcttggcacatcctggagcaatggcggctacattatgggatatcatatcacattcacatcaatttggttaaataaacgtcaaccaccccagggagttccttgttgttagtggtactttagtgtgaaagtttgaggagcatacgccactgcaggcatctgtttgtcctgtgatgaaaatatgagctctgttactcacctcattaacaattaattttaaatggaaaacttgccatctcttctagggggcattcttcctgggtcttaccattatctgcatattgccaagcctgccattccaactcccttggaggtacaaatggcacagcctaattatgtaagtattatttctgaatttcattttactttcaaatacaaaactttgtttataagaggatgaaattctttacttggagtctttactgtaatgtgttggttcacacatcagaagcccactggagtaatcgtcccccaagatggcccttagtgactctcgcaccttggtcttcatgcccttgtgtggctcctcccacactgagtagggctgacctgtgtagccaacaggatattggggaaatgactgtgtgacttccaaggtcaggtcaggtcaagaaagatacgacagcttccagcttgcacacttctagatgacttgctgccatgctgtagggacgcctttagagaggtccatgtggcaaggaattgaggactcctgcaccagtcatgatcagtttgccaggcagacgagtgtgccaccttgaagtggatcctgcagcctccttcatgccttcaggtgactgcagccccagccaacatcttgactgaaaacttatgaaaggccttgagccagaactccctagctaagccattttcagcttctgactcccagagaccgtgagataataaaaatttattattgttttatgccattacttttttcaatagactttattttttagagctgttttggtttcataacaaaattgagcagaggtacaaagatttcccatgtaaccccaacccttcaaaagacatatagcctcccccactatcaacatcccccaccagtgatatatttcttacaattaataaacctacactgacacattattatcaactaaagcccatagttgacattagcgttcattcttggttgtgtacattctgtgggtttggacaaatgtataatgacacatatccaccattacaggattatacagagcagcttcactgccctaagaaccctctgtgcactgcctgtttgtccctccctctgtcctaaggcctagcaactactgatcttcatactgtctcagtcactttgccttttccagaatgtgatatagttgcagtcatacagcctatcgtcttttcaggttggcttctttcacttagtaatatccatttaagcttcctctatatctcttcatggcttgatagctcatttctttttggcactgaatgatcctctattgtctggttgtatcggtttatttatccattcacctactgaaggacattaagcctctacattttgaggcaacctgtgatgcatcgatagataactgaaatatccactttcatgtcaatggagcaagtagattgcttagcatctggaatggccatggagaccccactgttttcctcccctccaggaaaagcagaagctgtgcagttgggaattctgctgtttaaaggacacaggtggttggtcagttgaagagctcctctaataagattctctgacccatagtcccagcccggtgtgtgttgtcatctgggggcttccttttggatatgtcacgtttgatttttaatcaatgaggcagattggaagctgtctacttaacttccattcccattttcttctcttgaatatttttgagggtaaacaatatgaccaacctaaaataaacacatttcccagatttcctcaaggacagggtcagccatgtggcaggttctggccaatgagatgtaagcagaagctcttggaaaaatccttaaatgggggcctactcaaatggcacaggctatgggttcttcacccttcaggaaatctcaatcctattccatttccttcccatggaccttgaacaagttcttcagcatctgcatttctgggattgctggggagcatacataaagtaacattgtcaggaacaaaacaggtagccagtaagtggtgaagatggctgttttaatcattattccagataaataatgaaacccagttcttccaggaaaagggtagatgctgtatgtttaaaacttatttcccttagccctttcccagattcttttagttgccctgtacacatgatctgatgcaacattttcttataataaaggaaaccataagatcatcatagtgttccagtttctattgctgtataaaaaacacctagtggcataaaacagccatttgatcctgcttacagatcctgtgagtcaggaatttggacagggcacagtgggcacagattgtctctgctccacactattcacagccttagatgggaagactagagggttagatcaatggtccagatcatctgaaggcttgtttactaaatccgaaagcttgttactcagctgggctgggatgactcaaggaccggaagtgttcaccacagcctccccacctgggctgtcctcaagtgcctgggcttcctcacagtatggtggcctcagagtagccagactgctcacgcagtggctctgggctccaagtgcaagtgttgttactagcaagctggaagctgcgttgccttttatgacccaccctcaaaagtcccacagcatcacttctcccactctctctgttggagcagtcacagcaaccaccgagattcaaggggtggggaatagagaatccatctctcaaggcagagagtgtcagggtcatattgcgggacggtgtgtgggatagggacactgtcgtggccatctttagaaagtaaatctgccaccagtgaggtggggcatgaggtaaataggataaagcccagagtattcacaggctaagcactttgatcatcacagataaataactcgagtctaatatgcacaagagctagaacatattggacttggtttcagccagaaccagattcttcaaggacagtgcatgatttcctacatgcggcatcgtttatttatgagccaccgactctctctaaataaagtcagaggaggagccaaaaggggtttttagataatgagagttttaataagagtgcaacttaaatagattctttggctggtgctatgacagtatgtgaacaggacccctgactttaattaaccattttgccaggtgggcctcctttttaattagtacagaagatctaaacagattttttttccattttattatccaagaaagaaaaatgtaggatggctccatggcaatcttttggggttggaattaatttgattaagtgaaatcgttgccaaaatggtcaggcagtcacctaaatatagccaattgatcaagaatggagcccattgaacaatatttcgccagagaaattgaattactattcatacactagatatagcacagacaaatcttatcagacttttatagtgctcactaattggaatatttaagtcggaagatactgtagtaattcatgagctctttgagaggtaacctgacaaaaggaagaaaggggaccccaagtcgtctacataataaactaatttacagattccagtccacatgctttgttggcgtatataccatggaagaaagaaatttgtcacaacaaattctgccttggataccatcaaatttaaaattgtgtgttcatcatgagagctgggaacttgatttcttgaacaccaagtctgatgaatcctgtgtcttccatttggcatgaattccagaaccattttccaacctttgtcaaaatcataaaggacctcaaaaggataattatattcagggaaaaaaagaagaagaaaaaccacatcagaatcagtgactccatcaaaatcttaaatttaatatccaaatttttaaacaatttgctcgtatacttaaaataggggaagacaccagatataccctaccaaaccggaaggttgcaaaataatcgtcctgaccccagaaccctgcaccatgtgggcagggctgggaggtgccctacggcatcacttagtggagcagctttctatgagcaattgcagcaagagttctgggcttcactgggttatcctgttctgtcagcgactgtgaataggagtggcctgcactacaagggtaatttgtgtctgagaaacccctgtttgagtgaattgtatttaacatgaatacaacatattttgatgcactctcagttcccagatggacccctccagtgatgctaatgtggtgccaaatctccttcaaatggacactgctccttccaaagttaagatcagccatcagtgcaacctcctcatcgctttctctagtgtagctgcttctggactctaagccctcatttctgtaaggccctgtatgccaggattatgcggacaaaacttacagaggaggccaaaatatgataatgcagtctttacgtttaaaaataataccaaaaggtcgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggctggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaataataataataataataataataataataataataataccaaaaaatgcaacaagtccataacaaaaaaaatcactaaaagtgatgctgatgacagactctcaaggaacaggatgacatttaaggccacaaaacgctcagactctcactgctctcagcctgcagcctgcagggctcctcaaggacttgacaagtcaccaccaactaagtgactgtgaccctcgtcttgaggtgcacagcctcggccacgtacatggaatccaagtcagccctcctaaacacaaagaagtccttgtaagctgaaggtgggggatttagtgagactcttggcaaagtcaagatttgttaaccacatgggtggatctcaaggtgtgcccccttgacacctgggctccctttcttaatcacttccaacaatgaaacctaaaaggaggaggaggcctggggaagcctggcagataaaactgtgccagagtctgtggtgcgtcctctcccagacagcagccttactgccgtggtgcaggagccacccctcctcagaactcgcctgcagttttccagctttttcaccaatcatcccttactgtgacggggacatgtacccctgggttcagaagccaaacctaaagctgctgtttccaaactcaaatggtctttcaagtcttgtgtttaatttagaaatacacatggcggtcacattcttcactgtgtatatatctacatatattttaattctgaaatactgctgaatatcctgggccatcaggtaaagttgacaccaggggttattctgtgaggtcatgcgcccccacccccaccccatgcaatggtgtgagtcattgctcagaccacgaagtcaggacttgaggaaacacacgggaatgagcaaagcccatgtggcatccaggcctagagagatgcctgtggcaggagctgagggcaagggatgagcagaggagaccaggcccctgcagccagaggctcagtcctggctttttccaaactcttctccagaggagcccgcccttgcacaccaacgcctgcatgcttccctccttccttccttccttccctcctttccttccttctttcttttcttcctccctcccttccttcccttccttcccttccttccctccttttcttccttctttccttccttccttccctccctccttcccttccttccttccttcctccctccctccctccttccctccttcattccttccttccctcctttccttccttcacctccttcccttctctcctcccttcatcccttccttcctttcttccttccctccctcttccttcctttcttcacccctcccccttccctcatcccttccctccttcccttccttccttccttccctccttccttcccttccttccttccttgcttccttccttctttcctttcttcatccctccttccctccctccctccttcctgccttccttctttctttcttttctttcttcctccctccctccttccttccctccttcctgccttccttccttcctttctttttcctccctccctccttccttctttactcccttccttccttccttcctcccctcactcaatttgttcatcaaaaaatctagttccttgccatgccacagcctgagtatttaaaaataacttttcctcattttagaagtaatgatcattttttaaaaattagaagctgcagatagtcaaataactgtaaggataaacaataaaaatgacccagtctcccaaccacagaaagtgaccgttaacattttgtgaaaatgttgatacaaaacaaatgaaatgatactgtgcatttttgtaaactacttctaaagcataaaatgtactgtgaatatatctccctgttatgaaatatattttaacactaatttttttgaatacattgtcccccattgtcggtgggccattgttttttggataacatcttaataagtttggattttttaagcactttgttatggtggtagatttcccgtctatccatccatttctataaacaaaggaccatttcctctcccttgaagcaccatcccccaaccccacttgctcctccctcacccccaaatgcccaatctctcacacacgcacctgggggtggcccaggactcacctgtcatgcctcctgtatatctcaccttgtaactttacagttggctgagtccccccagagggctttgccatgtgataccccaacacccaccagttgcctgtattgatgtaaaagttaaaccgtgtgtccttttgtttagacaaaatccccaggtgatgtccaggactaagtaaatgtttgggatccaggcagttcaaattgccttggatttctaaatgccacattcaagctcagaagagaagcttaaatctatatgcactcaaagaacatttattgagcgttgctgtgtactaaggtcagagtctaaggccaaagtgaaggttcagtcaccccccacaaaactcatgtttgtctacagaagcttcccactgcctgagccagtggggagccatccacggctgaaatagaagaagtcactgtggcatggaattggagcagcatctacccttgtcacttgggctgatgtggcaattggaggtggtttctacagggcagaaagtcacaaatccacacttttaacaatttgtaaaccagaaaaccacctgcagaatgtgtatgtgcatctcccatagccttgaaccttcttcctgggaacagaccttttcaaatgactgaccttgcccaatccccgccatcaggcctggccttttacttctttcttttgttcaagtaatcttgaaaataactgaaattatttctgatcagttttgactaggaggtttttctcaaaacgatgctgtgaaagcaaagaaatttaacagtgttaaaacacctcagaggagagaataaacccagttccacttattagctgggtgtgcagtattaataaagggttggttgtaacctagcaactagtttagaaacacagaacaaggcaatcacagttttaaatatccttgtagtccctgagtccaagtatgtggtttctgacacactgtcaccttctgccgagtttagtcaatatctattactgttatttgcaaagagggataagatataacctgtctgttatatttgaaaaataaattgctatgataaagttcccaaaatccaggaatgtttctaatgttgtttttcttgtccacatccctcctccagggtttagaactagtaaccggcagtgcgaaaaatgggacttacttccgaattcatattaacaagtataaaatggtggaaaccatcacgtgcctttctagggagcccttccccgcctccaactacatccgcttgtttggccagcacgagcaactcctcaacaacctgtgtgctcggtacgatgaaaacctgatcacagatctctataggtgagttggacattgcatttgactacagggaaatacaaatatatatataatgtctgtgaatgagggacatgtgttgtgatgcacccgagagcaaaacgggaatcccagagagaggctgtgtggcagagatttcgttctaatgaagaacacctgacgctaatgtgggctggggagcagagagtcacaggatgtgtccacacctggcccccatggccacaccagggcctggaccccaggtgcaaccaagcctaccatggacgggcttggaggagatgatattcaagtccctttccacacggggctgctaagagcagtggtcagaaatgtaggaggtcaatttgggaacagcatgaggaagggtctgatcctgatgggactccgcgatcatgggacggggtgtttgtgaccccagccttcctcctcatggcatgtgttcaggcaggcccagggtggtcatttgtccagcgttttggtaagggaattcccacactgacaggtcggttagacttgaaacctttgtcttttcaaactcttaagacacacttcatcctatccattaggaaggcatagaatttccaagtggaaagttacttctgaatgtagcttgctgcttagcaaagttaggagactttccctattcacaaagcaaggtgatgcagacccagcaccagagacagatgtggaatgaaaaccatgcagttccagtgttctcgacacccacagaagcaactgccaggattgccatcaatctctcttgcctcttaaaaattttttaaattgtagaatgcatcatacaaacaaaaaagtatgtgaaatatgtatggacacttaaaagtactggaaatctatgggcccactgcctatgttaagaaataattccttaacttagcagtcaggaagtccctctctgatcacagccctccctcatcttcgtggaggtagccactgtcctgaagtttgagtttgtcattctgttgcctataaagcaaggatcagtgaacttcttctataaggggcagatatagcctcagttgcaagtactcatcccagcccttgcagtgagaaagaagccgtagatgatgtgtaaacaaaaagacacagctatatcccaagaaagcctcattcaccaaaatgggcattgggctggatttgcccccagtcatagtttgtcagtccttgttttaaagatgtgtacttagacacatgtgatttcctaaataatatattaatttgccttgcctacttctgactcaggtttatggcttaccaaagaaagcgagcattctgtttagcacggtgtttgtgagaaccatccaggatgatgtctgtagctgtggttcgtttgttctccctgctgtgtggtattccatcatataatggtcatgattcagtcatggcttttcctgttgactgtatttacactggttccagttcagggccattacaatcggacgttgtgaacactgtggacgtacttcatgtgcagaatctctctaagatatcctagccctagaaccgctgggtcacggaacatgcacgtcttcaactttactagttgatgcccaaatgtttcccaagtatggtcacgtgccacataaacacgttccagtcaacaatgggtcacacatataatcggagtcccataagatattaatgaagctgaaaaatttccatctccaagggccacattcctgtcacctagcacaacacatgactcacgtgtttgtggtgatgctgggtcaacaaacctactgtgctgcccagttggtataaaagcatagcacacagttatgtccagtgcagaacacttgctgatgataataaatgaccatgttactgtcttatgtatttactatactatacattttatcattattttcgagtgtatgccttctacttatgaaaaaaaagttaactctaaaacagtctcagataggtcctttgggggtattcagaaggcattattatcacaggagatggcagctccacgtgtgttattgcctctgaagcccttccagtgggacaagatgcagaggtggaagacagtgatattgatgatcctgaccctgcaggcctaggctaatgtgtgtgtttgtgcctcggtttgtaacagaaagtttaaacagtaaaaagtaaaataaaataatttgtaaataaggacatagatgaatatttgtgtatagctatacaatgtgcttatggggttcttttgttttttttgtttttttttttttttgagatggagtctcactctgttgcccaggctggagtatagtggcatgagctcggctcactgaagcctctgcctccctgggttcaagcaattctcctaccttagcctcccaagtaggtgggattacaggcacgtgctaccacacccagcttatttttgcatttttagtagagacggggtttcaccatgttggccaggctggtctcgaattaccaacctcaggtgatccacccgcctccgcctcccaaaatgctgggattacaggcatgagccaccgtgcctggccttgtgcttgtgttttaagctaaatgttattattacaaaagagtcaaaaagttgaaacaaaataagattataaagtaaaaagagtaagcacaggttaacttattattaaagaataataaagattgagaaacatgtttttataaatttagtgtagactaagtatactgtttataatatcttcggtattgtatgataatgtccgaggccttcgcacccactcaccactagctcactaactgccctagagcaacttccagtcctgtaagctccattcacggtaagtaccctatacaggtataccctttttaaatcttttatgccatatttttactgtaccttttctatgtttagatacaccaacacttagtatggagttacaattgcctacagtattcagtatagaaacctgtacaagtttgtaacctaggagcaacaggggcatataggccaggtgtgtagtagtagactagactatctaggtttgtgtaagtgcactctaggatggttgccaacaacgtgtttctcaggacctattcccatcgttaagtgacacatgactgtcgttatttatttaaatttcccccagcagtgaatgagagagctcctcttgctccacagacctgccaagccttggtactgttagacttttaaatttggccagtctagtggcatacaaaggtatcctcctagggctttaatgtgcttttccccacttaatgatgccttttcatttgttcatgggccatttgtggcagtttctgtgaaatgccaattcatgatatttgtccacggagcagggctgtcttctcattactaattcacagaagttatttataaacaaactggacacaaacttgtgttggttatatatttttaaccaactttgaggcttatctttttactttctttatgatgtcaacaatattcttaatttaatagaatgtttgtcttcttcaagagggtcttgggtatttttgtcctttcattcttctaatagttttataatcaacttgtcaagatccatgaaaaccccattggatttgataggaaatgcattaaatcttagatcaattaggcaagaattgacatatttgatattgagtccaatatcataacatagtatagctctcaatttaggtattctttaatgtctttcaataaaggtttatcattttatccatgaatggcttgcacaacttttgtttgatatgatccaagatgctttatattattttttctgttttaaatgtcattttttatgaattgatgcttgtgtatacagatgaactaattttagtatggttctgtattctgaaagttttgaataatttacctgtagatttttagattttccgagtagaaaaattatatcatctgcaaatagtgacagctttgtttcttcttttccaacttttatactgtttatttccttttcttgccttactgcactggctaagatttgtaataaaaagattggctgggtgaggtggctcacccatgtaatcccagcactttgggaggccgaggcgggcagatcacctaaaattgggagttcaggaccagcctggccaacatggggaaaacgcatctctactaaaaatacgaaaattaactgggtgtggtggctcacacttgtaatcctggctctttgaaaggctgaggcacgagaatcacttgaacctgagaggcggaggttgcagtgagctgagatggctccactgcactccagcctgggcgacagagtgagactgtgtctcaaaaataaaaataaaaagttaagtaggggtagtgaggggtagtgcccttgccccattcttaatttgaaagggaaagtgttcaaaattaagtgtgtaatagttgccatatgtatatttttatagatgtcctttatcagattaagaaagttccttttgattactggttttctaagcattcttaccatgaatggatttttatttttatttttcggaaagagtacttagtccctgaaaccttttatgtgtaaggatgtcttcctaatgctttcaaatataaactacgttttggtaagtgtcaaaatttaaaatcatgagctttccctcctcaaatctttgtaggcttggctccaatacttattttaaataatgaaaactgcaagtatttaaaaaatgaattcatttgctccttcacttatatataggattttcttggtcaaccttacccaaaatatttgagttaagggagaattagctgtttgttacagaaagattttggttggtggggaatgatatgctaagactttccggaaaaaaaatgttttcacatttgaccatattcagggccctacctggtttgtttctccctaaatagaaggtgattctgaaacagactcggtgagtttgagactactacagggagtgccgctgttaactgatgagagtaataatttcaaaagttaatttgatttgtgatgagtgtttgggatggcaagacggggtgacactggctatcaggaggtgccgatggacatctgtcagaaaggagcagggacaggaagatggccgccagtcatttctaagtgaggtcctgagagcaccgctgtgccttgtcagttactccaggcgtgtgttagtgggtacatgcagctgcgaccacattcttttcaagtgccacgaaatgctgccaggtcctagtgctaatttttgcgccagcactcctgccctgtctgttgtcagactggctggcgaggctctttccaagcagggtgaatggttgagctgattttggccgcgatatgattaccgattgatttcctgaccttggcagcatcagcaacgtccctcgttcagaccaggcacgtttcatttgcgcacttccatccaccacgtctggggcacctacctcagtgcccgctgctgccgggagggctgacagttaaccagctgcattgttgttctgcaagtcaggcatgacttcagtatcagttcctctccgcattcagagaaatcctttggatccttcctctccacttccccctatctattctcactccatcgagggccaaaacagcgcaggcactagctgtgccaatgggaacggtggcagccctgcgggtcagatgttgctgtggtagccgaggcctcccaggcagaccctggctgcctgcaaggggctcacttggaaccatatggggacacgaggtggcggccgagctgtcagccgccatgatgcacaggcagacagctgtcacgggaccacagtaagcgaagtgtctgcggcccaggctggcttggattccacctatattttattctctgtttttacctctgagtaccagtacaaaccattggcactgaagagagagacagaactaatccaccatcggtgactgtgtgtgtgtgtgtgtgtgtgtgtgtgtgtgagagagagagagagagagagagagaatttgatcaatggattgatttactactttggaaaaagaatagagccaattttatatcgtttgttgctttctgaaccaaccagcatttaaagtcacacaaatatgttactaaaaatcttcctttccccaatcttccccttaaaagcatttgtgcccccacaggcctcgctcatgcacacctcactcacacgtgtgcacacactcatgcacactcacacggcactcacaatgtacactcactcacacgcccagtcacacgctcacacacacctgcacccgcctctccaaaacctcacagtgcccccgcctgccaactcccttggcagtatttagaatggcagcaccttctgccctgctgaaaatgctcctcccttcaggacaccgggcgcgaaaggaccttcagtgagggtgtggagaagtggggaaatgggagctgtgggtggagaggagaggggaggctgaggcggcttcttgagatgccgcctgtcaggtacccgaacacccctgtcccgtgtcttctcggctttcctgactccactccatcgtctttcacccccacttatcgatgaccctgcaaaagagaggtctcgcctacagaatctctcccttcttcaccttaattagcagtctgtgcatcctttatcctcgtggtgtaaataggtcttgccctagcttctttgtatgagcccatcagatactcataaaccttgattaaacctcttttcacatcttaacatgctcagctctcaaagactgccctcagacagcccggccctcgcgcccgcgccaccaccgcctccacacttccccgcacacgccggtggcctacatttactggctgagtgttgctgtgcacagtgttctaaatgggatttgagcagccctttacaaggctgccattaccattttgaactgtgaggctccagaagttcttccctcaggaaagccaccttgtgttatctgtctttggaactgcaaagcaggatgctgccagcccacgtggccccctaatttattgatttgactcccgttggaataatttaatcatgactttaaaatgtttttctgcgcctctgtagtcagcagccttttgctgtgttcagtggtaaattgcatactacattccaggtgcctgtttttccggatttatcaaaatcttcttgaatgatgactgcccactccagcttctcaattttttggtccatacctaaaaggtggtggatggtaattctcccaatatccgcctcatccctcacacgcttccctgcggccgtgtgccaggccactgacctgctctctgtagactctgtaagggttcctgctcctctgtttcacttcagatcgtgccagtcctgtgcgaccagcctcgcaaagaatcctttcccaaatgatttgctaaaaatcaaaatccattctcttccttttgcttcccactcattcaattacaggctatttatctgccctcataaaaggcaatcgaggtcagtttgctcacgtactctggggattcctcattgaccatgccttggccttcttactccaacaggcagatccttacctagagatgtttctgctactattccagaggccacgaggccaaactcaaatttttgaaccttacttgttcccaagatggtcaactttagatctggaagtgtagaccaaggaggaggcgaaagtccactggacacaatatgtgtctgttcttattggcgatcctattctgatgaaaactaggggtcttttttagcatatgtcacctcccacctctttccactatggcatttgtgtggaagtaacctttcctggggtaaaaggtgagaccatgtttgaactgccctgaaattacagccagcacatgtctgttttcagatattcatgccaaagatgatagtgtggaagaaaaacagactcacccatttgcatagtccaaaatgaatgttcagagaaatgaacacatggagttctgcaagaagtatgaactttgaaacatttacctcatttaccatgaaaatatcacttggcatatcatgttagttaggacttactagaaaggctcggattgagattttttatggttttgaggtatcaggaatgtataaattctgatttcaagtgcctcagtctcactagtgttagtaagaatctttgcctgaaggatagtgcccgtcaatgaatgaaagaaacatgagtatccccctctaacaggcaagattttgttttatgtttaaggcttttattaatgagaatgtaagaaatgagggaggaaattgagccccagttaacatcaatctgaagttggggtgagggtgggagcccatgtctattaacaggtaactctccaccaggattccccccacccactgagtcaacgtgcactcccacagtccttacgttgccctttccaggcaggcagaggaaggcgctggcattctccctggctatacaagaaaactagtgctttcattatttgaaaggaaatgtgtatatttaaatcacatattaatactaaggggagacaatttcagcacagggatggccctgcatcccagaagaccgtgctgaaatgtgaaccgtacatgaaacaaatcatatagtgtgagacacaatttgcacacgtctgttgactcatatctgcaatattacgaataaaaactgaactcttcaccaagctttacaaaaacaaagaaataccttatggtgagcccaccactgccacctctcagttatccatagcccccgcccttgtcttcttagctgccaccccgaccaccctctttgtcctgtgcccctgtgcacacttggtatatatcctaagagaatttagtttgaaactcctacagtctgtaaaagcaaatcatcacttccctttccttaacatggaaaggacactagactaagaccaacagaggggtcaaattcctgcgttcttgcttatcagctttgtgaacttgaagaagccatttaatctcattgagcatcagtttcctcacccataaaatggagatgtaatccatgataaatcttcccacatcatgggatagaagtatatgttgatggacagtaaagtacaagtgcaaaaagttttttaaaagtatgtaaagtactatacaagggcagagctttgtaatgactttagctcgtgtgttcctgttcgctacacatcaatattatcctttatggagagacagaaacacttccagccttctatacagtattccctccccctcccaaattaatacaaatttaagaaaatgcagtgcttcttttaataatttaaatgagcagatgttttaaaattgcattcgtgtatgtgcttgctatatcttatttttaaaattgtatgggattacatatgatattgaatatgcttgttttcagagtcatgctctaagaaaaaaatttatttagagagaggtcattatcaataattaaataagtgagaaatctggtgctttacttagaataaatgtactaagatgagagtcgataatgtacctcccagggcactttatagaaaagggatggatcagatgcttccatataagtttcacttaaaaatgatttcatttccaaccactgggcacccaaagcagccaaatacattcttaatatcatttaaaatgtaaaattatgagctgtttgagttgtaaagtgtgtctagaatctaatgtcatatagttttaaaagttgctttggaacattgtttcatgcattgtcgataatcactaatactctagacctgcactgtccactatgagagtcaactgccccacgtgacaagtggcgaccatatcagacagcggagaatagagcatttccattgttgtggaaagctgtgttggacagtgctgctgtaggccagttgcatccatggaatttggagtgggcgtgttggatgtagcatctatgaacagtcgttccctaaaatgctaattgccagccccatttggatccgacattctgacctgccgatgtagctatcagatgcgtgctcagtgaaggcccagtggagacagaggaagtgatttctctctgtgcctgttttggtggggtcaattagaaaacattctctccagatcatgtgccaaaggtgtacagatggggaagggggctggtgtgggggaagggggctggtgtgggggaaggggcggagcaggtaagctttctggggcacttggtcactctgcaggccttgcaagggacactcggccttgctgggtgagataaaaattctgtcttgccctatgcttatacttgtttcaagctcagctggccaaccccaggcagcctggcacttccctgccagagttatgaagacaaccttgattactaacatactgtcttgttgtcagagcccaagtcttgatttggggtttaggaatgctgactggtaggttcagaactgacttccatccctctgcacatcttcgtaaaatcgctgttcttttcaaacttgtacagcaggagttaaagtcctttatagattttcttcctccatttcattacatacccatctggcagcatgtggttgaaggttattacttatgagtttaaaataatagctgatgagccgtggttatctttaaggctactaagctgctttaatataaatacctctttgccgaactccaagaaacaacggagttgttttactgttgttggaactgtgaaaataaatgcatttcagaaatcatgttctcattctactgagccacgagaaggaactggcctgcctgcctaaattttttatggcaaactaacaattgcaaagagacgctttgaagccacctgggcagtagggattcacaggtgcagcattctccttctttccctcctacacctgagtctttataggtttctttttgagggttatttaagcatatttgtttaatttttaaaaatttccactccaaaagcaatatgtgtttattacagaaaatgcagaaaaatatttcaaaagccgagtagaatataaaatctatacctaatcccaccacccagaacctattttagatgattgcactatgaaatgaaaagaattgaaggggaactgcgatttcctcctagaaataagacctgcagcaagcttgcagacagcacagctctccttcctgggtgccaggcagaccctaactgcagccccgcacacctgtctcgtacaggtgaggcaagggagaaccagagtggccgggctttccacgtgccacaaccaagacagtggcaccaataggaccagaaccagagtttcctgactttctgtcaagtttccttcatacaggacaaataggagtaggtttgccatcatgcaatgaccattctttagtaaaagcagttgttgtgtttgactcatcatttacctattataagaagattggccaaaaaaaaaattatgtttgggacaggagaataattttgctctctgataaaatacctcagaagatgcccaggataattcatgtgtggaggaagaaaatattagaacttctgtttataattttatctttaaaaaaaaaacagaaatcatgttttattagtattcaaagcacacgcatgggtgccctcttgggtcagatggaagacagctgtgcattctacatggcctcaacacaccataatgggacagtgtcacagcttggaggggtcaaccttattaattaactttgtttttgtttttgttttttgagatggagtctcgctctgtcacccaggctggagcacaatgacacaatctcagctcactgcaacctccacctccctggttcaagtgattctcctgcctcagtctcctgagtagctgggtagcaggcatgtgctaccacaccctgctaatttttgtatttttagtagagacggggtttcaccatgttgcccagactggtctcaaactcctgatctcagatgatccacctgcctcagcctcccagagtgctgggactaccaccacacccagcccttattagttaactttggaacctactgcagcttttgtgtatctggttctggttttaactaaactaaccctccacaaaattgacatgagcatttaacggattgttcaaaagaaactacagaatgcaaagcctggcaaagcagacacacatgaaccaggaaagggcagggccagatcatctcctcttcctcagccacactgtaagtaccatggttcgtctctcagctaaggttccactgcagacagcagaatcctctctagctggtttaaacagaaagcaatatactgccagttatgggtgctttatacaattccttcaatgggctggaggagcaggctttagactgccttccacgaaaaattcagaaaatggctccgcagacctagccaatctctgccacagtgaggaatttgtggaactgagaaactgccacaaaagttgccagctccatgaccaatcctctctggcaaaatccacaccagcaaaatgggtacactaagccctgatttctgcccccttctgctacagctgacaccaaatactgccacagccaggcttgccagcaaaagcaagaaatgcagtggaagcacctcctcagggtgttccatggagtgagggagagtccctcctcagggtgttttatagagtggaggcagaatctccacctcatggtgttcatgtccatcgtccacgtcctgcacagggctgtctctttggatgaaactcagtcccatgtagaacctacactggacatgagtctggaaattgtagtctttcccttcccggcctgtgatattttggctaaatcatgctacacagtatcttgagtgtggctggctgaaacagtctacagtatctctcatagctaactaatcaaccttgaccagaagtcagcccccacaaaatgcaaaactatcaagaagactctggagtttgtatttatatctactaccagtgaggatgatggttctaataatatacaggtccacaaaacccttatccaaaatcctaggagcagatgttgtggaattctataacttttttcaaattttgggaggaaccagacttaccctcccacatgaaacaactaaatagctgccaaaatgtaagaaacaaatttttaaaaaagatattagacatcaggcaatgaaggactgtgatctttgagagatgggaaacaaagaaggtgaaccctgtggttgatccagctgacggccttgagagagttcccaggccacagcaaggggaagcagagcccatgcagagtcctgagtggaggagagggagccgagagtccggggagaccaaggcaggtggagttgtcaggacagagggagagggagctgagggtccggggagaccaaggcaggtggagttgtcaggacagagtactggagaggagaaggttgcacagagagagaagcttggagatgtgcagaagcctcccctgggagcattcagttgagtactggtcagtccatgtgggcaaggaaactgcccaagacaggggaaagaaccactctaaaggattagaaaaagcatgacagtgtctaatactcacacaaggctgggaacgctgcctgttcccaccagccagacttgagaactttaagattaatgaggcaataggtagggtacacaaaagggactcatctcagtagcagggaataattagtcctaaaccaaacattgctgcagtccgacttaataaatcttgaaagcaagacatgaatgtatcaaatgctttccaagtaacttatctacatctgaaaacaagtttaagagtgtttataggaatactgaaaatttccacacctaacaaaatgatacaatttctgatacctaatcaaaaaattactgagaaggcaaagaaacaagaaaatacaacccataatgaggagaaaaatcaatcaacaaaaccaacccagaactgactcagatgttagaattagcagacaagtatgttgaaacagctattataactgttactataactgcattccatgtgattaaaaagttaagatgtggaaaacacataaaagacccaaatcaaacttttagagatgaaaactacaatgtctgagacaagaactaccctggatgggcttagttgcagattagacctcgctgggaaaagggtaagtgaacttgaagacataacaattgaaactgcccaaaataaaacacacagaggaaaaagaatataaaaccatgaacagggtatcagtgaggaatgggacaacttcaagtggcctaaagaaataacgaccaaaatttttccaaatttgatgaaaactcacaaatctgagaagctcagtgaatctcaagcataaaaaaaaatgaagaaaactatgccaaggcatatcataatcaaactactcaaaacccacaataaagagaaagtcttaaaagcaacaaaagacacgggcacattctttacagacgaataagatgaaaatgacaacagatttctcatcagaagcaatgcaagccagaaaacagtggagcaacattgttaaagtaccattattttttcaaattttagaatgcattgattatatattatgtaacagctccggactaataaacatggcatacccccccatattacatacaccatcctacccatgccaaccaacatttcttgagttattctgtatctcattatttaactatttaatttctctattgccttactgtcttccaactgatagccttgcgtatagccccaatgctgtggactgaattatgtcctctcaccaaatgtatatgttgaagctctaaccccctatgtgactgtatctggacatacagtctttagaaggtaattaagatttaatgagatcataaggatgggactcttaggagagaaagagacagatgtcactctctctctgtctctgattctctctctatctctctctctgtcatgtgaggacacagcaggaaggtggccatctacaaactagaaagagagccctcaccagaacctaactatgttatcaccttgatcttggactttcagcctccagaagagtgagaaatacatttctgttgtttaagccacccaatctatagcattttgttatgtcagcctgagcaggctaagagatttacaccccaagtttgttgcttctttatatccccgcaattcagtaggctgcggtgtaggcaaacagagggtgttttgctctttccaatggcagatggtcattctgtccaaggcccatggtacccactggacacgtctgtgtagcagtgatgggaatggcatccatgtcagaacctggatccagtcccgggttctaacattataccagccttaagttcattctctaggcataaaggtagtgtcctcattctcaccaaaccgagtaacatgagtgaaaatgagagagcacctcgtgggtgtcttagtctgttttgtgttgctgtagtagaatacctgagactggggaatttgtaaagacgaggtttattgagctcacagttctgcaagctggggagttcaacagtggcatgaccctggcttctggtgagagcttctctgctacgtcataacatggtggggaaggtcaaaggggaaatggagacctgcaaagacagtgccaaggggcactctggctttaaaacaaactgatcctgagggaatgaatccactcccgtgagaaccaattcagtttctccagagcaagtactcactcactaccatgagaatggcaccagctattcatgaggcatctgcccccactacccaaatacttcccactgggccccacctcccaacactgccacattagggatcaaatttcaacatgagagcgagtgcagtggctcgtgcctataattccagcactttgggagactcagcagggaggatcacttgagcccaggcattcaagaggagcctgggcaacatagtgagaccccatctctacaaaaaaaaaaaaaaaaaaaattagcagggtgtcttggtgcatgcatgtactcctagctactttagtggctgaggtgagaggatcactcaaacctgggaggcagaggctgcattgagccaagattgcaccactgcactccccagcctgggtgacagagtgagaccccatctcaaaaaaaaaaaaaaaaaatcaacatgagttttgttggggaaaaagaaaccataaaccatagcagtgggggtccttcaaaccttgctgagtgatgctttcttatacaagccttggtttttgtttttttttattattattatttattttttttattattattatactttaagttttagggtacatgtgcacaatgtgcaggttagttacatatgtatacatgtgccatgctggtgggctgcacccactaactcgtcatctagcattaggtatatctcccaatgctatccctcccccacccccccaccccacaacagtccccagagtgtgatgttccccttcctgtgtccatgtgttctcattgttcaattcccacctatgagtgagaatatgcggtgtttggttttttgttcttgcgatagtttactgagaatgatgatttccaatttcatccatgtccctacaaaggacatgaactcatcgttttttatggctgcatagtattccatggtgtatatgtgccacattttcttaatccagtctatcattgttggacatttgggttggttccaagtctttgctattgtgaataatgctgcaataaacatatgtgtgcatgtgtccttatagcagcatgatttatagtcctttgggtatatacccagtaatgggatggctgggtcaaatggtatttctagttctagatccctgaggaatcaccacactgacttccacaaggattgaactagtttacagtcccaccaacagtgtaaaagtgttcctatttctccacatcctctccagcacctgttatttcctgactttttaatgactgccattctaactggtgtgagatggtatctcattgtggttttgatttgcatttctctgatggccagtgatggtgagcattttttcatgtgttttttggctgcataaatgtcttcttttgagaagtgtctgttcatatccttcgcccactttttgatggggttgtttgtttttttcttgtaaatttgtttgagttcattgtagatgctggatattagccctttgtcagatgagtaggttgcgaaaattttctcgcattgtgtaggttgcctgttcactctgatggtagtttcttttgctgtgcagaagctcttgagtttaattagatcccatttgtcaattttggcttttgttgccattgcttttggtgttttagacatgaagtccttgcccatgcctatgtcctgaatggtaatgcctaggttttcttctagggtttttatggttttaggtctaacgtttaagtctttaatccatcttgaattaatgtttgtataaggtgtaaggaagggatccagtttcagctttctacatatggctagccagttttcccagcaccatttattaaatagggaatcctttccccattgcttgtttttctcaggtttgtgaaagatcagatagttgtagatacatggcgttatttctgagggctctgttctgttccattgatctggatctctgttttggtaccagtaccatgctgttttggttactgtagccttgtagtatagtttgaagtcaggtagtgtgattcctccagctttgttcttttggctcaggattgacttggcgatgcgggctctttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtatcctcatttatttccttgagcagtggtttgtagttctccttgaagaggtctttcacatcccttgtaagttggattcctaggtattttattctctttgaagcaattgtgaatgggagttcactcatgatttggctctctgtttgtctgttgttggtatataagaatgcttgtgatttttgtacattgattttgtatcctgagactttgctgaagttgcttatcagcttaaggagattttgggctgagacaatggggttttctagatatacagtcatgtcatctgcaaacagggacaatttgacttcctcttttcctaattgaataccctttatttccttcccctgcctaattgccctggccagaacttccaacactatgttgaataggagtggtgagagagggcatccctgtcttgtgccagttttcaaagggaatgcttccagttttttcccattcagtatgatattggctatgggtttgtcatagatagctcttattattttgaaatacgtcccatcaatacctaatttattgagagtttttagcatgaagggttgcctgtaatcccagctactcgggaggctgaggcatgataatcgcttgaacccaggaggcagagtttgcagtgagccaagatcgtgccactgcactccagcctggatgacagagtgagactctgtctgaaaaaaaccaaggcagacagagtctcactctgtcatccaggctggagtgcagtggcacgatcttggctcactgcaacctctgcctcctgggttcaagcgattatcatgcctcagcttcccgagtagctgggattacaggcttgagccagcatgcccggctaatttttgtatttttagtagagatggggtttcactatgttggtcggactagtcttgaactcctgacctcaagtgatctgcctgcctcctcccaaagtgctgggattacaggcatgagccactgtgcctggcctcttatgcaagtctcttgattcctctaagccttgtttcccttatctgtaaaaggggccttataattattccctggggtgtctttgaaaactaaaggaggtgctgtacaggaagctttcagatctgaatcacccctggagggactgttccacagtccctgggctgcacagctcctctctctgccctgggattgcactgctgcaggccccaaacgtcttcaacctggcactgtgcgtgctgctcagcggtgtccccagcacacacccagacagctgtgcacagtgacagatggcagagccccagcatggcctcagccattttcacttctcttttaaagatactttttgtcaccttcttcgcaaaccttaagttgtgttttgtgacttattgttcactctatctagtaatttggggagaagagggcaccaaatgccaccaacgatgcccctgcagctgctaataggtgccactctttggatcccacggtaccctcttggccccagcggctctgacagctgctggggcactgtctgccaggccaggatacgtgctgaaggctctgagggcagaatagaacccagcgcagtcacgctgggatcccagagtttcacggcattaataatctatagttcaatcattaggagcaaatccaagtgaaataggaaagtgtacaccacgctggaggccgtgaggctgctgggagaaaggcttctctgctccttggcaggcttaatgattagttcccagccactagcagccccagctgacaaacggcgcctgcaagctgtaggctttctgcatgtgataattgacaaatgctggaagtcattcaggatattcacatggactggctaccagggatctgctgggcttttcaggcccccaactcaaaccctctcttgtaccaggaaggacgtcccttcttgggtcaatcgttgccctcaggacagatctgcaagtggatcttatgcagggtgcctccaaggctgctggagtcctggggaggatttgacacatgaacgaatgtgaccccactctctttttccaattatgtgttggattgaagtgccaacttaggcctgtattgcaacagctcaatctgcagcacactaagtaggaagagatctgaagcagagaagcatttttaatttcagagtttttaaaaaaatcattcatttcaagaggttattggataaagcatttttaaaaggttttatttatattcttcttggtcataagcattagtcaggaatcttgtctgcaagtgacagaagcccagctgaaaccagcggacactgggaggagactttcgtgtctcccacagctaaaccgaggagtgcagggctggcaccggaggcatgatttgaaacgccgttggccctttgtccctgcttccttctctgggattggcctcccctgatggtggaaatcatggggagtcccaggcttatgcatcttacagcttgctatttagaggatagagcaccctctcttgcctagtgccaccttgaaaagttcctggggaaggactccaaacagcctggctcccatgatgtgtctgcccacttagaccatcagcatggccatgtcccagccctgaggccagggggcaaggctgcttgggggtcaggagggatcctgggcagacaaaaagctttccttaaacatcagttacttactggatgtattcacagactttcagcctctctgggttccctgagtggttttggctcctccttccacttctggtattgcataaaatcctccaccacagttcataacatctggctcccaagaggccacatgatgcagggcagaaatgcagggtgtaattctctgtggataggaaggagccggagaagacaaaacccttgtctccgcctcccattggctgtcccaagaccctgattctctatacagcctgtcctaagttatccctcatggctgagtgagttctcctagcgtgaagcagtggcctgcccataatacatagttctgcattgctccccatcttccaggaataatgagaagctcctaaaagcttccagtgagtaaagcaggtcacttagaaaggaactagaatcaaactggtgtcagatttttgaatagcaacctcagaacctaagagataatgaggcaatgtcttcaaaagtctgaaaggaaataattccaaacaataattctattactgatatggtttggatttgtgtccccacccaaatctcatgttgaattgcaatccccattgttggaagaggggcctggtgggaggtgattgtttcatgggggcggattttccccttgctgttcttgtaatagtgagttctcatgagatgtggttgtttaaaagtgcgtagcacctccccttctctcttcctcctgctctggccatgtaagacatgcctgcttcccttcaaccatgactgaaagtttcctgaggcctccctagatatgcttcctgtatagcctgtgcaactgtgagccaattaaacctcttttctttgtaaattacccagtttctggtctttctttatagcagtgcaagaatggactaatacaattaccatccatcaagtaagaaccaatgggataggactattagtgctcataaatgaaggagaaatagtatgactagaatatcatcattttccagaaccccctagggaatcatggacatgggtatggagcatcagtggctgctgatatagaaaaggaggcagccagacctcatgcagtccttggtgggaaaacacaccacctgcgaaaaacaagccaaattgaacctgagtctgactaggactgttgatctaccaccaatatgtaggaaaccgagaggatagaggaacatgtaaaacatgtaaaacacagagctgaagtatattaaatacagagtgggaaactatgtgacaaacagcctgattccctcaacaaataaattgcaagaaataaaacttgcaatggaggggggcctatgaattagcatagtttttaaaaacatatcaccctatttggatcctgattcagataaactgttaaacaaaaatctgtgccatttatgaggtgattggaaatttgaaacctggagagttaatgatgataagcaattatgattaatttttttagcagtaaagatggtatttcagatatatagatatatatatattatatatatgtaatatatataatatatgtaatatatattatatatatgtaatatatataatatatgtaatatatgtaatatatattatatatgtaatataatatatgtaatatatattatatatgtaatatataatatatgtaatatataatatatgtaatatatattatatatgtaatatataatatatattatatatgtaatatatatatatttaaaaacagaaccattatcttttagagatacatactgaagtgtctggagacatgcttcaagataacccaggagggagaatggtagaaggaactagagatgacccaagactgcccttgagctaataactgttttaattgggtaatggatgatgggagctcattataggtatatttctaacttaaacataatttaaaattctcataataaggagttatttttgagaagcaaccaaagttgtaaactaagaaggagtaaggaaggggctgtggcactgaggggcaatgtagagaagtcccagctgccaagaggacagccaggtgggccaaagaggagaggagggaggggtcctggacacaattaattacttggattatttgaaatgtttacatggaaaataattttgaagggtgctttacagagctgctggaacagtttgaaaaaaattatactagatacattaaaaactaacaaaaatagggcagttattaattctaagaaaagttaaaagttatacaagaaaggcctgtgattaatattgcattgttaaaataatgtaatcacagaattcaaatttaaccaaaaaactgtgatacaaactatttgggaaattgggagagagagaagtgagggtttgtgttttaaaaagataaaacttcatttatcataacaaggtgtcaatagttatgcctaaagttaataaatgagagtgtctggtgattctcttcaaaataacctaggagggagaagagtaggaggagctagcaatgacacaacatgggccatgagtcgttaactgttgaaactgggtgataggtgatggtaacttatataagtaatcatatttatgtcaacaatcattcaaaaagtatctgataatctctgaattacttaacactctggttgcaagaaacagaaatcaaccaaagctatagatttaaggtaaaaaggagaatccattgtgaagtttcatggttgtatctaacaggacaaagggcagagataagactaggttttgggaaggaaccacagcaggacagacaaggtagggagagatcatgcagtggctgcttctttctcttgcagactggctttctctgcttcccccacagctcccatgtttacgttgcaagccccaaaacccatagaaattatccagatgtacgttggtcccaactccagtttccttggagagtgattgataggtatggcttggtgagacagtttcaaactatgactgcaaaccatttggccctcctcccagaaagagtgtaaggtgtatgtcccctgcccttgaacctgggcaagcttgtgattgcttgcttttaccaatagagtttggcagaagtgagaccatgtgacttctaggactggcttatagaaggccatgcagtgtccaacttgtttgctagaatattccctctgaatttcctggcctgacatataagaagtctaactatcctcagaccaccatgctgtgaggaagcccaagccacatggacaggccatacaggcactctagcaagtgtcccagctgagccaagccttcaagtcatcccaacccaggtgctagacatgtgagtgaagaagcttccagatggtttcagccacagtcatctgagtggcccccagtcactcattgttccatctgatacccctgtcatcatggagcagagccaagtgatcgtaagcataataaaatggctgttgctctatgctactgagttttggagtggttgttgcacattaatacataactgaaatgctcggatcaaatgacgttccctgtttcctgacatgaagtcccaacatgactgttgggggcctacccccacaaagagagagggatggcagggggttgagcggattccaacaaacctcaaggccttcactccatttctgagcctgatttcacagcagcctgttgcctatctgggtgcaggaaaggaggtatggactgagaactcttgacctcctgtatctaagcccccttctcaattcttgttctcccacatagtaagccagtgtaaaggaggaaagagggaagtggtatatatttgccgtggtaaatggtatcattaactcccttcccttccagtcccatggtggtcttccagcagaaacagttaccaagaaatgggaactaccctcagagttctggcatcttccttctgtggcctctcgagaacagaagagatcattagagggtcctcgtgttgcctagcaacctgtgaatgctgtttgctatcatgttattaatatggtaggaaagtgtttcatagaagacattcatcttgcattaatgaaaatcaaatttactaatatgacacaaaatctgttcttccttgtgactttctatacttaagtagcttatttattgaattagactgtgagtggtttccagggttgagactgttaaagttatcataataatgactttgttttcaataatgtcagatggcccttcatgatgagattatgcagctctgactttgtgatcactgttcttagacaaagcactgctgccctggggcctagccccatacctgtgagctactctgccactcgacttcaacttcttcccgccaaggctcagctaggcgaggattctagtttgagccagtatacctttaaagagggccccatggaataaacggatctcattcagcatgggcatgaaaggcactggagaagttattcagccttcgtcttcgatttttctaaaaaaggacaacaaacaaccctaaattttcaggccttcaaaagagagtaagaaatacagacagtcccctactttcaaacacaatttgttcctaaaagcaagtatggaattcaaatgcccagaaaccaaataatagacccatctcttaaaaaagagaattctcttcccaagagttaacatatgattgctgaaaatgttctttattatttttagcacgtgaaagtctcagttcagcagatagacagaagttgaagagtattgatggctaagatgtaaacagacaagttgtattaataacgaatggaatgcacagagccagtatccaaaagccaagggctgcacctagaggcacctagaaagaagccatgtaaaaacctaaactgcagagctaaatttctagaggtttttttaaataaagtcttgttttctatttataaaagtagtacatgatcattgcagagcccaacatgggggttgtggcgggggtatgaaataaagaattgcaaagaaaccaattgttaatttttttggtgtgtgtcctttcatatttttctctaaatatacaatgtatatataaacaatatttcacgtgctgatttgcagcttgctattttagcttctcagcatattctgaacatgttcccatttcttgagattctattttaatggcgttattttttaacgactggatagagttctaccataccaacgtgccttacttaattaactgggctgctcttaactttttgttttcataattaaccctgcaataaacattcttgatgatacatctttttggcgtatccttgattatttccattaaaattgttttaatattctcaattcttatgcattcaatgtatttttattgaacaatagtgtgctgcttacttgaaacacagccattgagacgtgccctcttccttcacagagcttaagattaagtaggaaagatagaaaattgtacatggctgttaaaaaaaaattaccaccacccaactgaacttttctccctccgctcagtcccactcctctggccaacactgaccgcagtctcagtttgtgaatatgtgtttctcaaatgggattatactgtacctatttccttctagttttttcacttaagaatctgtataaatattgaagttctttccatgtcagtacacatagttctcactctttttaatggcttttttatctttcatggaatagctaaatcccaatttacttaatgatttttctactaatgaacatttaggttattttcaagtttgtcctggcattgtatataatgttaccactgaacatatatctctgtgtgcatgaatgggatttctggatcagtgggtatatacatttacattttgatcaagatattattttaaattatcttcaaaaaaggttattcccactaacaggacagaagagagcttttttctccccatgctcatgaacactggatatattctgcaggaggaagaaagagtgggaagtgtatctctcattgtactttcaacttgcctctcttcagtgtccactgaatcttttcataggtttattagtcatttgtatttattcttctgtgaattgcgtgtcattctttgcccatttttaattaggttgcctgtttctttttcatttatgagaatttattatatttaaagactagtaatccttattatgtacattgcaaatattttacagcctgtctttaaaattaatagacatttttagggcagttctaggtttacagaagaaaatgatcagaaagtacagagttcctttaaggccaggagtttgagaccagcctgggcaacaaagcaagacctcctctctgtaagaagaaagtacagagctcccacataccctcctccacccccagccacttacacagtttctactattatttacatctttagtgtggtctatttgatacaactgatgaaacaatattgatacattattattaactaaagttcatagtttacattagggttcattcttgatgttgcacattctgttagtgttgacaaatgtatactgacatgtacccaccttacagtgtgaaacagaacgcctttccatgcctggaaatcctctgtgctgtgcctactcgtgccttcctcctgcctcccccacaagcttctggcaaccgctcattttattactgtctccgtagttttaccttttccagaatatcatatgttggaatcattcagtatgtatgtagtcctttcggactggcttttttcacttagtaatatgcttttaaggttcctccatgtctttttagcactgaataatattccattgtctggatataccacagtttgtttatctgttcacctactaaaatatatattggtggttccaagttttggcaattatgaataaaactgctgtaacatgtacaagtttttgtatgggcataagttttcaactcttttgggactataccaaggaacacaattttggatgatgtggtaagagtgtttagtttttgtaagaaaccaccgaactgtcttccaaagtagctatacaccattttgtatttccaccagcaatgaatgagagctcctgttgttccacatccatgtcagcatttggtgttgttaatgttttagattttagccatacccattgttgtttttaatttgaaattccctagtgacttaccatattgaccattttgggatcaataaatttaaaatgtatatatatttttaacaggtctcactaagttgtccatgctggtctcaaattcctgggctcaaaccatcctcctgtgtggctgggattacagggacatgctgtcatgcccaactcaaatgcttgcttgctatctctatgtcttctttggtgacgtgtccagctcttttgcccatttttaaatttggatgtctgttttcctactgttgaattttaagagctctttgtgtatttggtttactattcctttattggatatgtgttttgcaaagattttctcccagtttgtggcttgtctttttattcacttttattatttgtttttgatatctttttttataaaggttggaatttttacataatcaaaccgtctctaacaaagaagaataacaaaattcttctttttgaattctgtctcctacttaggaaattttctccacctggaaattgtaaaatatgctcctattttcttctatcactttcgtagctttgttttacattgacatctttaattcatctggaaaactgtgtgtgtgattgtgtgtggtgtaatataagaatttaattttactgtttccaagtgtagagataattttcccaacaactctttctaaataattcatgttttttcctatgtaattgaaatactaccattatcatacactgagccaaaatctttttctacagagaattcagtttctgaatttcctaccctgtttctttgctccattttgtctgtttctgtactcttccatgctgttgtaatgattgagacattataagttggcttgatatctttaatgtgtagtcttcttagctattctttccgaatgtattatcatgtccaactttataaaaattatttttggaattttaactgagtctgaattgaagttacaggttaatttggggtacatttataaaatggaatattaccattcaggtctttttaaattttcttccatgaactctgataggttttttttcatagagcttgcacatttatatttaagtttattttagtatttttatagttttgttgctgctgtagatggaatctttttgtttcattacattttctgattttaaaaaagatattggtagttgggaaagatgtgggttttgtatgttgctcttgtgttgaagtctcttttttgtttaagcatattttattagattatcttggaatttctttgacagatgattatcagttacaataacagcaccttttttctttcctctccaatacttctactttctatttatttttcttattttattgaattgcctggaattacatgtacaatattaaatggtagtggagatagtgcccacccttgtcctcttcttgccttttatgggaaagagacaatgaacaagtaattttttaaagagaaactaaatcaggaacttcgaaggccagtgcatatttcatgaattaggaacattaatgcaccttcttattatctttcttccctcagaaaaattaaactgaaatgtctctaaaaaatataaatgtaactcacattatgtaatatgtttccaaaatggctggcatgagctctcattttgattgtttaagagactctctttgggctaaggtcacatgtttgtatctttggactgccattaccttcagctttaggtaagagaaacattattttagttatgtttatgttatgacataatcaagatcttccccaagaggaagtggagctatctacccaatcctagagaaggtgatttcctggaagaaaagaaatgcattccagcctgggcaacagagcaagagcctgtcaaaaaaaaaaaaaaaaaaaaaaaaaaaacagaagaaacaggaggctttgaggtccctcaaagtccctatcacaggatttcttgcaaatctttcttcccagtagatcatatccatgagtaacatgaattgctgggtgatcactcataatgatgtcagcactcatctgccccgggtgagcacccacagtcttgggcgtcaacaccccttgctttcaggcactgctcttctctccagtcagaatccatgcggaagcgccagctgtggttgtgcaggctggtttcagtgctgcttcgctttgataagtaactaagtacaggatgtttgaggaataaaaagaaggccagcgtggctgtagcacagtgagagaaggtcagaagagctggatcatgtagatcatgtggaggtttggacttgggatcgttgtttcaaagcatgaagggtagcaacatgccaattcatgttttaaacattccccatatgctatatggggaatggagctgttagggagacacagccataccccaggtgagagatggtactttggatggtcatatttcagatgtattttagaggcagtgtgtgcaagacttgcttctaagctctggtgatatatacaactgcttacttgactctcaaacttaacaaggccaaactcctagaagaaaacaaagaggaacagctccttgacattggccttggccttgacttttgtgatatgaaaccaaaagcacaggcaacaaaagcaaaaataaacaagtgggtctacatcaaactaaaaagcttctgcacaacaaaggaaacaatttcaaaaaaaaaggcaacctatgaaatgagagaaagtatttgcaaaccatacttctgatagggggttaatatccaaaatatataatgaagtcatataactcaatagaaaaaataaataacccaattaaaagtgggccaaagacccaaatagacaatttttcaaagaagacatatagacggctgggaagtacatgaaaaggtgttagacgtgactacttaacggggaaatgcaaatcaaaatcggaatgagatgtcacctcgtacccgataggatggctgctctctgaaataacaggagctaacaagcgttgtcggggtgtggaggttgggcaccagcccaaatccggtctcaagatcctctcaactccttcttatcaagaaaccccttgggaccttactcttcctactgcagtcagctgaataaacctgactttgtttacacgccaggttcctggtggtttttggctggtaggaatcaaccttttgctccctctccctgtgttccttgtcatttcttctgctgacactttactcaagtgtccctcactgcccccctgatcccaccacccctcaggacatactgcgatttccctgggattgccatcaaccgtcttgtcatctcttccttgaaccaaacctgtctcttggggcccttatccagctccatctgtgctagggtcagtctggccaactggacattcccactttggacttctgcaggcacttctgtctccactttaaaaaaggaatggactcattccttgtcctttgcccctgttcacctctctgtcctgtgctcctgcttccctgcacctctgagccagggcctgggaatatctgcagatctttttccttcactcgcttctccctcacctcctaaatgtgtctccagtcatctgctgccattgcagctgcatttagcagggcccctttgcttccggccataccctgtccagtgtagcctcaacatggcttccagagcacctgttctgaaccataaataggatgtccacagcactcacttgtttaaagccttcccatggctttccatcacttgggagataaagtccaagccccatacacaagcatttagagtctgccccgcccactgccccccaccttgcatccgactggacgttagagcagtcaaaccacctgtcattcccagcaggccctgcctgctttgtgcctccacgctttcccgggcctggtttcccttgcaaacaccgactccttctccagtgcttcagtagatcctccccgtgcctctgtacgcagcgcctgtaagtgatggcggagctcccgcctgctctagtgcagccatcatcccacagtattgtaccgtattgtggttctctttacatgtccgtcatctcttgctgtcagagcacctctggatgctgggcccactgcacattcatccttgcatttgaaatgatgctcacaggaggcggtcaacagactcactttcttcacctttctatctagaccagtgatgtccagtagaaatataacagaagccacatacaaaattgtaccctttttagtggtcacattaaaaacataaaaagaaacagagaaaattaatttaataatatattatatttaacccaagatatccaaaactattgtcatttccacatttagtcaatacaaaaacagtaataagctattttacatttttgttgcattatcttcaaaattcagtgtgtattttatacaggaggtacatctcaattcagactagccgttttttgtttgtttgtttgttttgtgacagggtctcactctgtcacccagactggagtgcatggcgccatctcagctcactgcaacctctgcctcccaggctccagtgatcctcccacctcagtctcctgagtagttgggattacaggcatgtgacaccccacccagctaatttttgtatttttttgtagagacagggtttcaccatgttgcccaggctggtctcgaactcctgacctcaagtgatccgcctgcctcagccacccaaagtgctagtattaacaggtgtgagccaccacacctggcccagaccagccacattttaagtgctcagaagccgctggtggctcatggctcctggaccagaccatgggggcttcagcaggtgcagcggtgggcctctgttttcctacctgtagaacaagaaggttgccaaaatctgtaatctcttatccctcccagctctaaaaaaatggggctctgataccttgtgaggaattcaagagaatgtcctctctcagagtgaagtgtccttcaccagctggtgagctggatcccagcagttttgttaactgtgatcacttggttagaatggaggctgcaggtttcttcccctggaaagctgctactttgagattatttatacaggtatttttaccttcataactaattagtgatactttgagactatataaataccttatgtctcataatttcttctacaaattttagactccatggacaattcttggctgaaataactattactgcactgtttaccaaatggtgatttttctacttccataattcttacatatttattacttagcatcctactgtaaggaagaattgtcccttctcctccgtttatttactcattcattcatctttatcattgtggacttaaggattcctgcactcttctgtgggttgtaatccattaccctcttattgtgttttggtgagatatgaactaggaatatgttagttaaattttcatgcttgatttttggaaaccacaaccctgaaatcctaagagtgacaaaaaaaagtgaagaaacagtttgtggtttattattctctctgtaaaagctttagaaaaaaaaaaaaaggaacacattaattagaaaagcctatttgctgaaagagaattatttttaacatgtattcattatttatttttaaaattattttaaacacatttcaaacatggtgtgtgtgttctgtcctggtcaatgatatttctactgagcacttgttcagaatttaaagagccattactttaaccaaaggaataataagggagtgaaatatcttgctctatggagtttgctagttcttgcagcctcagcctcacaaaaggtcattctctcttgctcctttgtccccctgactcgtgggggtttatatgtgcacatatacacttttttttttcttttcctacagaaaatagataggaaatgggcatgattgtgagtgaggctgagtggccgcctggcctaatgctggcctgggctctctgcagcctaattaaaggaaaatggttgtgctctctatgaagagagaagcagaatgagagcagacaggcacaggaagggaagctgaagcactaagagcttccccttttctgcagaattaaatgctaaccttgcctcatactattagtgctgaacttatataacaaatcaatgtaaatagctggccaacttccagggcactagatttattgtgcaaattcaattagtgcagcccctaagaaaccagcaatgtgcaaacaaatactgtagatggactaaaagggaagaggcagagcactaagactcagtcctgtaccctgacggcagacattgctgtaaggcactgccaaacccagcttcccaccatggcaaagtgtgtgaatgacccgcggctgtgctttcaggataaacttaaatagaaacaaaattcttaagtgtctaaacattatgctatttctacaagaaaactggttcgctctggcaagtaagaccaaaagtcagacaggtcagaagaaaattcagcctgcttgggctttagaatgcctgggccttaattccggggccacttttcccaactgccatctcaatatgttcagtgaacaactggtttaactattttgatttacttggctcacccagtgtagtaagcaggcaaaacagcaaagaaataactccatttggacagtttgcatttaattttcatcaattcagacacaaaaaaagtaaggcctcagtttaacaatttccatgcaatttttatttgtttccacagaattcttttttaaattaaaaaaggtctcactttgttgcccaggcttgagttctgtggcatgatcatagctcactacagcctcaaactcgggctcaagtgatcctcctgcctctgcctcccaaatagctaggactacaggcacgcaccaccacgtccagctaatttttattttttaatttttgtagagacaagcgtctccctatgttgcccagactggtctcaagctcctgtcctcaatcctcccacttcagcttcccacagcactgagattacaggcatgagccaatgtacctggcccatttccacataattctttagtgaaagacaaaacttcaagaaagctagttacgatgtcctcttacctttattgctctataaaatggcaggcaaattaatttatgcagtactttcaaatggaggaaaagcattccctgaggagaaaaactgcagttatgccaaagaaagactttctttgaattaagcagcaaacaaaaaagtattttaatattttagtttctaattcacaccagaaaggatgtgaagcagcctacacaaacatatgcaataggataattaagaacaatagcagtaataatcattgatacggagcctctcccctgtgccaggcataatgccacatcttttacctggagtgtctccttgaattcggatagtaactcttggaacaaaggaccatcattatccccgttttacagctaagaagactgagactaagagagactaacgctaactagctccagattacataagctgacaagtggcagagctggggtaaaaagaaaaaggacattagtaaatgggaaactgaggccaggtcagcaacacgaatctgagctgagatggagagaccaccaacgcaagcatcggtctttgtttagtcaacttgcatcctgagaatggatcaccaactcagcccatatgtgtggcttcccactccttagagatcagagcaaggagagaaatgttagcactggctagattcgtaattcatgaattaacatattccatcttctaagctgttcccgggctgagtgtctgggattcagaaaaacaaatggacagcagacagatccttcaggtaattcttcaacattctgaaaactaagactctggttgcaagggtggcagggaatttctggtcccgtccagagcaaatgtgacctgatgaaggcacagaaggtcagattccatgttcttatagacatcaaaggacctaaaggaaaacttgtgcttgcaagagagctcagcctccctccctcgtcaggggaggtcgtggggcctgtgggctggtcaggatttccctccgagacagctctgggtgttcagctcacagacaacacacatcatgctggtcccagtggcctccagcagaggcaaaccatgcacttggagcagagaaagccttgcaaagcagtgcctcccagcaccagtgctgccaggcaagggagcccagggtgtgggaggcacctagttttaagcaatgttaacttcttcttttttttttgagacaaagtctcgctctgtcgcccaggctagagagcagtggcacaatctcagctcactgcaacctctgcctcccggattcaagcaattctcctgcctcagcctcccaagtagctggtactacaggcatgcaccaccacaccctgctaatttttgtattttttgtagagacggggtttcgccatcttggccaggctggtctcgaactcctgacctcaagtgatccgcctgcctcggcctcccaaagtgctggcattacaggcataagccgctgtgtgtggccatagtgttagcctctgaattcccaggtaaaccaggatcattggcaaaacagtgctctgtagcattaagagagaggaattttacaagccattcagaaaatagctgatttctgctgaaaattagaatttcagtcttagtgccaatgaattgtaagccgtttttctgcagagcaggaaacatctgaggccagctctgcattgtgacaatgagaccacagccaaattatatttcgaggctgctgctctttcggttatgtaaatcatagcatgtgacaattacaactggtcatcaaagaactagttggttttgctttcaaaatcattaatcttacctttctagatctgcctcaaagcaatcaaaaaattgactagatacggattcttgcaaactcaggctgaactcaaggaaatattcagtccgatttccatctcagtctttgggattttttgttgcagggcatcagggctgtgtctgctcgtgtcatggggtctcatttccaagcaaacccaggaataactagaaatacttacttgttcctattcttatttttgaaaattgtactgaaatgcatgaatttacattctttcatgagtagaataaaatgatcataaccctacctgacagtgtgaatgcaaattgtgcctgttctctgcagttaagccaggtcgggccagatgggaacatgtaggactctgaggatacagggagtttcccactggcttggaggtagaagtcacacatggaaaatattctgtgggtttttttccccagagtgttcggttttggagtagttggagtctagagtgataaacatgttctagctctggaaacctcaaccaaaaacatctcccaattttcataaatttaagaaaagatttttgttaaaagtagatgctgtagagtcttcggggtatcacagctgataaaacatccattctctctttccccttcaggaacagaattctgatttataaggaagtacatcatatctaaaataaatgacagtggttcccagcctcccatgcaaccaagaaagccatatggccaactattggccaataagatataaatggaagtgctttgtgaaacttccaggaactctccttagaagaaaggagatgagtcctctttttcccatacttcatcccagaacatatatgtgatggctggagctcagcagccattttgaatcatgaggccaaggcccctatgaatgtactctgctctgatgtccatggaaccaccctggcagccctagactccccatctagaccttctctacctgaaaaaagtacacttctgccttttgaaagccacagttactttgaaactttctgtaatttcaatcatatctaatcctagctaatgtaggggatacttgggaaactggggtgattaagagagttgctagaaagactcgggaaaaagcataaggaaataagatttggttgcacagttgttcagagcatgggttacacagaactatgggtaggacctagttcagccacttattaactctgtgaccttgggcaactcatttaagctctctgaatctatgtcttcatctgtaaaatgggccagcatgtcccactttctaggattagaattaggatgaaatgagataatgcacagaaatggtgtgcaacagagtctgtgggtttgtgtccccagatgaatctaagtgtgcctccagcatgaagctataatagaacaggatgcctcccagagtgtagcaagcacccaccaggtggtatgcaggatagctcaggcagcacagccacatcttactaatgatggatttgttccaacaggaattagaataaaacataacgagcacatcaaacctgtgatttcataggtatcattacttaggacaagacaaaagtaattatttcagtttttttaaagacaaatcaatgtaaagaaaattttgggccaggcctggtgcctgtaattctagctacttgggaggattacttgaggctaggagtttgagaccaacctgggcaacatggcaagaccccgtttctgaaagattccaaatagaaaattaggcaggtgtgatggtgtgcacctatagtcccagctatttgagaggctgaggcaggaggatcacttaagcccaggagtttgaggctgcagcgagctatgactgtgccactgtattccagcctgggtgacaaagcaacaacctgtctctaaaaaaaaaaaaaaattttaagaaaatttggaagtattcagtaatgtagtcacacagaaaacgattgattcccaagtgactgaagtttggcaaacactagcccaagagaggtagcctagggatgaagctgcagagaggacaaagaagtgaggtcaagagggccacagtgccaggccttgtggaacacactccagcccccacctccccagcgtgcacccctctgcagccctgccatgccaggccatcataagtggctctgacattctccacccccacccaccatgtgtgcatttctgggggcaggggctttctctcaccatggtaccctcagtgcccttcacatgtttgacacaggcgtgagggccatattcgattcatggcaaagaattgaaccctaggtcttctccttccttgcaaccgttaatgtcagaagctctgaagacacctgggacagagaagagagggagaaaagtttacgtggaagcatagggaaggaagggatgtttgttgaggggtggtgtgatgcagcagaggaagaggaccagaggaaagcagccactggaaataaggaaacagggtttaggaaggcctcactagacctgttaggatggatgcatggatggatggatggatggacagaatgggtgggtggatggatggatggatagatggatggatggatggatggatggatggatggatggatggatggatagatgggtgggtgggtggatggatggatggatggatggatggatggatggatggatggatagatgggtgggtggatggatggatggatagatggatagatgggtgggtggatggatggatggatagatgggtgggtggatggatggatggatagatgggtggatggataaatggatggatggatggatggatagatgggtgggtggatggatggatggatggatggatggatggatggatagatgtgggtggatggatggatggatagatgggtgggtgggtggatggatggatggatggatagatgggtgggtgggtggatggatggatggatggatagaataaaaaagaaagctaggacatggttctagtgttcttagcagacgtcccaccatggaagaggtcatggagcacaggggctttgggaaaggtgtttacaatcctgcctgcctctcacccagacctcttgccagggttggcacacccagatgcctgctgtgaccaatggagaggagcaattctggccagactggtgggaaagcaaggacgaaccacggaggccatccctggcaactgagctgacagctgccacacgaaaatgaggacacagcattgcctaatctgactcatcaaagaaaggcctgaaacccaaattccaaatgtcattcaggccaaagtagatgcgtccatatatcatacctggccttgggtatctgtttgctaccatgatatttatcactgcctgccttctgtgtattgaatggagacaggacacaggctgcttcatagagaggaaagccccaccagctatgctccatcctctggcatcacaagattgacactcatggctgagcttgacgttcgggcaggcatcttagaaggagaacagtctgccctccaccgtgccagaaaagacacatacaagcaagagcatcattctctaaggaaacccgcaggcctccctggcggcagctgcctgcctggagaaaagtggctcctcctgactttccagcagccctctctgtaggcgtgagtgtcagctggggagcctgtgaacagctctaaaagtagacacttttttttcatgccaagagaaaactagaatgctttttgttaaaaaaaatcttggaaaaagtgatatgtttcttccctgccacccgcctcctccttgccacctggtgcatagttgagcgcggaccgccacgctgtgccaatgctggaaagggcagacctgcagtcgcagcactcctttcctgctggccaggaaggccttggccttggacttgagatcccggcctttaaaggacacctttaccacttctctttccccgtagatgtgttggactttttcctacaatttctcccagtgtgttatgttgatcagctttcctcagccttcagcgtgtctaatggccaagccggccttcacatccccactcagttcatgagtctgtcgatgtaactgcctggatgagcaggcaaggatgacctctggagacgtctagtcaattgcttaatgatcggactatatcgaccagaaatggttaattcagttccgcaagtcaaaatctcccagggcttcttggaaaagtgtattacttgcagaagtgatggggaatttaagtcctcccagataaaccaggctggccattggcagcatgaacagagacagtaatgtcttctatttcagtcttgaagaggtataacttttttctcccagctgtgcaaaaatgatttttgtggcattgatgcccacgtgcacacagccccttaaaaagcacgttggagccatgtgcatacctggccctctctcctgaagatttctagacggcaggctgtgtgggttacttcatggctcctagtagtcttccccttttgaatataaattgggggaaaaagttaatattttttatttttaaaattcacaatattcatggaaatacaaatttcccaaaagctcatcacgaatgctgatagcaccatagtacctggcggccaaaaatgcagaaacctggccctaagcttcaccaggatccaagatgcccctctccttcctatggatacagaaggagcctaaagcatagaaatcgttcaacctgggggaggtctaaaacttttatttttatttttttagagacagggtttcactctgtcacctaggctggagtgcagtaggctggagtgcagtggcgtgatcacagctcactgcagcctcgaactcctgggctcaagcgatcctcccacctcagcctccctagtagctgggaccacaggcatatgtcaccaccacacctggctaatttttttttattttttattctttgtagagatgggggtctcactgtgttatccaggctggtcttgaactcctggtctcaagtgatcctcctaccttggcctcccaaagtgctgggattgtaggcatgacacatcatacctggttcctaaaacttttcttaaagcagaatttcttcctaacattcttgtatcaaaaggaaaccatcttcatttgactcaacattacgatcaattgtaaaataggtttggttaaattcagagcttttccagtttgaatgacgaaagctgccatgctgctgctgtaggatgattttaggaagcccacaagatccgagacaccctcactcctcctggccaccttcacctgggagcctgtagctggtgctgaagttctccttggataggggaaagcagccgggtctgagccctgccctcaccatgcaggtctctgccaggagcttgggccccgaggcccagccctgggccagccatcatgggcacctggagtgcacagcctcaagtcgcaaatccattccctttagagttgctggcaagtgtgatgtgtattgttgtgtggttgggagaacaccactctatttctgaaataaaacctggacactaggatttttttcaatgttttacaaaaattgctacacagcccccattttctctaatacaattcaagttcctccaaagttaatttgccaggggttcagagggaggcaaggagagagggtgagtaggcagatcacagagggctttttagggcagtgacgctcttctgcatgataaggctgtgggaacctgggtgtttagatggagggccagagctcgtgacagaccacagtgggttcccaaggaaagtgggacttcacagaactccctctctgaagcagacgatgaagggtccccgacgggcaacacagagagcagagtttaaaggcgccgggcagggagcatggcccgagagcacctgggctgttggaacaggcagcactggaaatgaggaaagcagcgagcaggcggttccgccaccagacggaggtggccgtagacccccaaaaccaagggggtgggagctccgatggtgccatggaaacaaacatgggggatttcagccgctgaggaaagacagtgtgttaacagctggatgaacataccacctaaacagcaacgcgggcaagtcagcaggaactgatgccatgttctgatccagcgagtgggcgtggggtgaggcctgatactgctgagtgccaggctgtccctaacacagactctcggcgtcgtatctgtcctctagtgcccccgtggcccctgggacactttacctccatccctaagaactaacttttacgtcttggaaaacggaaggtgcccattcacgtgggggcaccaggtttttccttcccctgtgcgcacacacaacatccataaacagtaataagggcagctagctcacatccagaggagagcaaagcccacccgagcgacgtggctttgaccctgaagcagttaagttccctgttccaagacacttaaagtaagagttaaaataccaataagagttcttggttattccaaaaatgcatcaaattttccagttaaataaaggataatcttattgttctccatataaggaagcatttcaactttcagtgaaaagttagcaaatatgaacaccaaaaaatgcagctctcctacaagagattcaattaagcgtcgatgcaaccgtgcgaacagcatgttgcagcacaaaggcagcctgtttttctggccattattaatctagaaagcttaatgatgaacaacatttgtgttattgtctacccaaatttaatttatttatgcagcagttaatcttgcaatctgtttttctcaaacgagggcagataatggagacaccgttctttacaagtcttcaggcttttaaattctgataaaatcaggattcttcactgggtcttgccccagctctgaattaaaccactttaaatgtaattatgggacctggccttacagcaggaacatccatttaaaaaattgattggtcaggctgttccacaagacattttatgagcaaacgattgcaatgaggccagaactgtaatttataaaggcaaaaaagcaggtaaatactttattagtggtaatgagagggttgccagctcactgagtctcttctttccttaccagctacttcaccgagccgtggtgcctggccctgttccacgatcgttttattgatctcaggaaagagttacgccaaatcttagcctccaaggaggtaagagtgattaatggatatgtggattattccttgcaaattataagcagctgatagctgttgatcatttagacttttccctacattcccattttatggttttactttttaaaacaacagtatctcatataaacaaactgcggagcatgtaaatgcagactgtgttatttcaggggaagtgattttatttaaatctttttatagggggcaaatttctttttcctttttttaaagaactgtatttttctgatcagctcagagtgctggcagaaaactgaatctgagttgcatctacttgccctcaagaacgaacgttgcattcctttagtttctgcctgtgtttgccagccatttgcggaacatatgtgtgtgtgtgttcttttaaagatgtacagggaagccatccagtgtgcctcaaaagcacactccttttataaccagaacttctttctcaaaatactacagaattaactggacattaggctgcgtagcccaagggctgcacgctcagcaagaaatttgaccccaaggtataaatagtgaggtatttgtgaaactttaagttaaaatatttctttcaatatgagaatctctagcagaactgtggaacgttaagagctgtgttcagtgagtggttgaatctccagcctggctctaccctgcttcactcagccaagtgccggggcctgggttagcttctacctcgtgttaccgtctacataggcaactcccacatctccattgtcacttcctcctgggagcccccacgcgccttattggacggcactgctagggagcgcgcaccctgttcccagtgcgtgccccacttaatcacagctcttgctgtgatttaaggagagtggagaagccactgttatcatcttgactttcccagtgaagaaactgaagtttagaggggtttttggagttttttgtttctgtttttgttttttttttgagatggagtccccctctgttgtgcaggctggagtgcaatggcgtgatctcagctcactccaacctctgcctctcaggttcaagcgattctcctgcctcagcctcccgagtagctgggattacaggcacccgccaccacacccagctaatttttgtatttttggagagacagggcaccatattggccaggctggtcttgaactcctgacctcaggtgatccgcccgcctcggcctcccaaaatgctgggattacaggcgtgagccatcgcgcccgaccagcttagagattttaaatcagctccatggtaacacagcaagcttcacactccggggtgtctcaccccaaagctgggaacatggttactgaaccatacagggccgaagtgcgtgtcctgggaccttctcctcagtgcccccacttttcagtttcactcccagggtccagctgggaactgtaaatcatttcctaatctgaagcaggcttagattgggaaacagaggtttaaagttaaaaccaaacagcagtggcttaggatccagcaagtaaatgcagctgagggaagtggagggctgggtggctgaatgcccaagtcagaggctgctgaaggcgtgcatgtggcaatggaatccactaaagatgctgcaggccaaacagagccctacacttaacccagggctgcaggaggccaacctaactggaaacctgaacccgagttgtaaggctggggctcactgaatgctcagctcctcagacaccttccttccttgcagaatgtcatccgcagcttcctactgcccctacagtaaagggcccttcgtttccaagtgatcccatcaaaactctgtgcctccgtctttcttaaccccagatctgagctcttcagttaacattgtgcacaaagccagggggttttagtcttaaagcttaaaagggaagccatggaaactgtcaagcccaaggcatccaccacgtttcatacaactcactgagataccctcaaacttctacctgtgtacggatatttgctgtggacccatttatgaactcagtgtggacagcaggcccaggcagcagaccagaagtggccacggacctttgcccaagacacactaaaggccctccagccattcttgtgggtcttgtagatttccagaaaatgaaacctccggaagaaaaaaatctccactggaggatttttctatttgcagcatttcgtttgtcaaatgggaaaggccacaggaagtggtgatgcatagagtggtgtctgcctagctcagctggactatgcaatgtggcctctgccagaccctcccattcctgcagaaccgtggccagccgtcccacctcagagagctgtgggggagtagcagaggggaagtgtgcgatggcacagaagagtggcccagtgagtgctgaccaccacgagcagcagtggaggtgacagtggagaagggctgctgtggaaacgacagccacacaatcagatatacaggaatttcaccaaagagtctggtattaggaaaataaaataaaatgaatagcctgcactaaagaataatcataatttattttctcaaatattgaaatgaggtacaaatggccaacaggtatatgaaaaatgcttaacatcactaatcgtcagagaaataaaactcaaaactgcagtgaaacatcatctcaccccagtgacaatggcttttatccaaaagacaggcagtaacaaatgctggcgaggatgtggagaaaggggaaccctcacatactgttggtgggagtgaaaattagtatagccactgtagagaacagtctggagtttcctcagcaagctaaaaataaagctgccatatgacccaccagtcccactgctgggtatatatccaaaagaaaggaaatcagtatatcgaagggatacctacacactcatgtttattgcagcactactcacaatagccgagataggggattaacctaagcatccaacaagtgaatggataaaaaaaaaatgtggtctatatacacaatggaatagtacctagccataaaaataaggaaatcctgtcatttgcaacaacatggatggaactagaggacattatgttaagtaaaatatcccagacacagaaagacaaatattgtatattctcacacatgtgtgggagcttaaaaaaaataaaatttaactcttggagatagtagaatgatggataccagaggctgtgaagggtggcaagaagtgggtggataaagtggggatgattaatgggtacaaaaatacagttagataggatgaataagatctagtatttggtagcacaatagggtgactatagttaacactaatttattttatattctaagataactaaaagagtggaattggaatatttctaacacaaaaaaatgataaatgcttgaggtgatggatactccatttaccctgatttgatcattacacattgtatgcctgtatcaaaatatcacatgtactccataaatatacacaactattatgtactcataataattaaaattaatttttttaaaatattcaaatgatgtaaaccattttatttcaccttctaccttgtcttcagggaagtatacaagttcaatcccattaactatcatatcctagagcttggtatatcaattttcttcttccacatgtaaagaaaggaagaaaagaccattatctatctattatctatgaatattgttagaagtcatctgttatgaagattagaatcattataacatgggccgggtgcagtggctcatgcttgtaatcccagcactctgggaggacaaggcaggcagatcacctgaggtcaggagttcgagactagcctggccaacatggtgaaacccaatctctgctaaaaatacaaaaaattagccaggcatgatggcaagtgcctgtaatcccagctactcaggaggctgaggcaggagaatctcttgaactcaggaggcagaggttgtatttagctgagattgtgccactttttttttttttttttttttttttttttgagacggagtctcgctctgtcgcccaggccggactgcggactgcagtggcgcaatctcggctcactgcaagctccacttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggtgtgagccaccgcgcccggccgattgtgccactttagtccagcctgggagacaagagcaaaactctgtggcttatgcctgtaatcccagcactttgggaggccgaggcaggtggatcgcccgaggtcaggagttcgagaccagtctggccaacatggtgaaaccctgtctctactaaaaatacaaaaaactagctgggcatggtggtgggcggctgtagtcccagctacccgggaggctgaggtaggagatttgcttgaacctgggaggtagaggttgcagtgagcccagaccatgccattgcactccagcctgggcgacaagagcaaaactccgtctcaaaaaaaaaaaaaaaaatcttcataacatttatttttaaaaagcaaactcattccaagatatctgaaatgcccttgtggaggtaaagagaggaacactggcactgcattatttagctgcaggcaaagccacagcatcactgaccaaggtgaaattttattcagtcaaaatgatccttcaaaatcctttacgaaagatataacaattataaccatatactcacttaacaaaagaaccccaaaatatattaataaaagcagaattgaaagaagaaatagttctaaaacaataatgcagacttctgtattttactttcaataatgactagaacaaccagacagaaaatcaataaggaaatagatgacttcaatagcactataagccaagtggacccaacagtcgtggatgaaattctctgttcaacagtagaatgcacattcttctcaagtgcacacggaacattctccaggataggccatatgttaggccacaaaacaagtgtcaatacattttaacagattaaaattattatattctccaaccacaacagaatgaagctggaaatcagtaacagaaggaagattggaaaaattcacaaatttgtggaagttaaataacacattcttaagcaaccagtgggtcaaaaaagaaataaaaaagggatattagaaatgctaatagatgaatgaaaactaagatacaacataccaacatttatgagatccaaagaaagcagaatttaaagctataagtgcctacataaaaagaactcaaatcagtaacctaattttataacttgaggaactagaaaaagaaaaccaaagtaagcctaatgccagcagaagaaaataataaggattagaacaaagataaatgaaatagagaataagaaaatagagaaaatcaataaaaccaaaagttagttctttggaaagatcaaccaaattgataaacctttagctagactgcctaagaaaaaagactcaaattactaaagttagaaatacaagtggggacattactatcgaccttatggaaataaaaaaggattatgagaaaatgccatgaataattatttgccaaccaattacataacctagatgaaatggtcaaattattagaaatgaacaaactaggctgggtgcagtggctcacgcctgtaatcccagcactttgggaggccaaggtgggccgatcacgaggtcaggagttcgagaccaacctgaccaacatggtgaaaccccttctctaccaaaaatacaaaaattagcccgtcatggtggcacatatctgtaatcccagctactcaggaggctgaggcaggagaattgcttgaacctgggaggcagaggtttcagtgagccgagatcatgccattgcactccagcctgggccacagagcaagacgccatctcaaaaaaaaaaaaaaaaaaaaatgaacaaactaaaaactgacacaagaagaaatagaaaatctcaacagagctataacaagtaaagaccttgaatcaataatcaaaaacctcacacaaagaaaagcccaagaccggatggcttcgttagtgaattctatcaaatatttaaagaattaacaccaattctcttgaactcttccaaaacatagaagaggttggaactattcaatgagatcagcattaccctaataccaaagctagacaaagacactgcaagaaaagaaaacttacagaccaacaccccttttaaatttagaagcaaaaatagccagcagattattagcaagccaaatccagcagcatattaaaggactaaacacccagctgagtgagatttaccccaggaatgtaagggtagttcaacatataaaaatgaatcaatgtaatacaccattttaatagaacaaaggggaggctgggtgcagtgggtcacgcctataatctcagcaatttggaaggccaaggcaggcagatcatttgagatcaggagtttgagaccagcctgaccaacatgatgaaaccctgtctctggtaaaaatataaaaaaattagccaagcatggtagcacacacctgtaatcttagccactcacaaggctgaggcaggagaatctcatgaacccaggaggtagaggttgcagtgagccaagattgtgccactgcactacagcctgggcaatagagcaagactccgtatcaaaaaaaaaaaaaaaaaaaaaagaacaaaggggaaaaaacactatcatctcaattggtgcagaaaaagcatttgacaaaatcaaatacattcttatggtaaaaacactaaaaaaaaaaaaaaacaaactgtcaatagaagggaatgtctccaatctgacaaaggatgtttatgaaaaacccacagataacattacactcagtaatgaattactgaaacctgaattcttatccctgagatctggaataagacaaggatgcctgctttcaccacttatattcagcatggttttggaagttctagccagagcaatcaggcaagaaaaagatataaaagacatccacactggaaaggaagaagtgaaactatctccattctcaggtgatgtggtcctaaagaatccacaaaataactattagagctaataaatgaaatcagcaaagttgcagaatatgaaaccaacacacaataatccattgtctacattatcagttgtattaatctgtttgcattgctttagaagaacacctgagactgggtagtttataaagaaaagagatttggctcatggttctgcaggctgtacatgaagtacatgtactgacatctgcttctggtgagggcctcaggaaatttccagtcatgatggaaggtgaagggggagacagtgtatcacatggcaagacagggagcaaaagagagagggaagtggtgccaagttcttttaaacaaccagatctggcatgaactcagagtgagaactcactcattaccacgaggacagcagcaagccattcatgagggatcctccctaagacccaaacacctcctccaggtcccacttccagcattggggatcacattccagcatgagagttgaagggaaaaaaacatccagaccatattagcatttaataatttgaaaatgaaatgaagaaaacaattatagttattataatagcattaaaaagaataaaatacttgggagcaaatttaaccaaaatagtgcaaggcttacacactgaaaactacaaaacatttttgaaagaagtgaatgactacctaaataaatgggacaacatctgtgttcatgcatttgaagactttatattgttaggatggcaataccacccaaaacaatctacaattcagtacaatcctgtcaaaattccaagggcatttttaaaaagaaatgcaagtcctaagttcctatggaaatggaagggactccaaatagccaaaactatcctggagggaaaaaagaacagagttgaagaactcacattttcttactacaaagcaacagtaaccaagacagtgtggtacttgcatgagaatagatatatagatcaatggactaaaattcagagtccagaagtaaacctgtttacatgaaaatatgttcagcatcatcaattattagggaaatgcaaatcagaaccataatgagataccactttacagccactggcatggctataatacaaaacaaggggggaaatagtgaagatatggggaaaatgggaactgaattgctggtgggaacataaaattacacctgctatagaaaatgttttgatggttcctcagaaagttacacacagaattaccatatgactcagcaactgcacttctaaatatatatccaaaagaattgaggccagacgtggtggttcacacctgtaatcccagcactgtgggaggctgaggtgggcagatcatctgaggtcaggagttcaagaccagcctggccaacgtggtgaaaccacatctctactaaaaatacaaaaattagccggacgtgatagtgcacaccagtagtcccagctactcgggaggctgaggcaggagaatcgcttgaacccaggaggtggatgttgcaatgagccgagatcacaccactgcactccaacctgggtgacagaacaagactccatctcaaaaaaacaaaacaaacaaacaaacaaagaattgaatgaggtattctaatgattgcttgtacaagaacattcaaagcagcactgtttagaacagccagaaggaggaaacaacccaaatgtccatcaacatatcaatggataaacaaatgtggtctagccacgcaatggaatagtattcagccatgaagagaaatgaggtactgatacaaagcacatgaacctcaaaacattatgctagaaggcagagaaagcatttgacaaaatttgcatcctttcatgattgaaaataaaaaacctctcaacaattaggtataaaaggaatgttcctgaacacaataaaggccgtatatgacaagcccacagctaacgtcattctcagtggtgaaaagttgaaagcttttcctctaagatcaggaacaagacaaggatgcctactcttgccacttctattaaacataggatcagaattcctagccagagcaatcagggaaaaagaagaaataaacacatccaactaggaaaggaagaggtgaaattgtctctgtttgctgatgacatgatcttatacacataaaatccttaaagactccaccaaaaaacttttggaactgataagtgagttcagtaaagttgcaggatacaaaaccaacatacaaaagtcagtagtgttggctaggcatggtggctcacacctgtaatcccagcaccttgagaggccaaggcgggcagatcacctgaggtcgggagttcaagaccagcctggccaacatggtgaaaccccatctctactaaaaatacaaaaaattagccagatgtggtggcgggtgcctgtaatcccagctactcaggaggctgaggcaggagaatctcttgaacccaggaggcggagattgcagtgagccgagatcatgccactgtactccagtctgagcgagactctgtctcgaaaaaaaaaaaaatgtttatatacactaacaataaactatctgaaaaagaaattaagaaagcaattccatttacaaagcatcaaaaaaaatatttaggagtttttaaccaatgagttaaaagatctctatactgagagctataaaacattgatgaaaaaaattgaagccaacacaaataaatggaaagatatcatgtgttcatggattagaagaattcatattgttaaaatgtccatactaaccaaagcaatctgcagattcaatgcaattcctatcaaaatgccaatgtcatttttcacagaaatagaaaagacaatcttaaaaatcatatggaaccacaaaagacccacaaatagccaatacaatcttgagaaaaaaaaaacggaaggcataacactacctgatttcaaaatatatttcaaaaccatagtaatcaaaacagcatgtgtattagtccattttcgcactgttataaagaacttccctgagactgggtaatttacgaaggaaagaggtttaattgactcacagttccatatggccggggaagcctcaggaaacttacaatcatggtggaaggggaagcaagcaccttcttctcaaggtggcaggagcatgagaagagcaaaggaggaacttccaaacacttataaccatcagatctcatgagaactcactcactatcatgagaacagcatagttctcagcatagttcaccccactatcatgagaacacccactatcatgagaacacccactatcatgaggacagcatagttctcagcatagttcgcccccatgatccaaacacctctgtctttcgacagacacgtggggattacaaattgaaatgaaatttgggtggggacacagagccaaaccatatcagcatggtactgccataaaaacagataaatgtaccagtgggacaggatagagagtcataaataaacctacacatttacaggcaattgatttttgacaaaagtgccaagaacacacaatggggaaaggacagtccctccaataaatggtattgggaaaatgggaacattccacatgcagaagaatgaaattggactcttctctcagcccatacacaaaaatcaattcaaaatggagtgaagacttaaacataagaccggaaactgtaaaacttctagaagagaacataggagaaatagttcttgacgttggtctcagaaaggatttttttggatgtgacaccaaaagcacaggcaacaaaagcaaaaacagacaagtgggtctacatcaaatttaaaagcttctgcacagcaaagaaaacaacagagtgaagagacagcccacagactgggagaaaatatttgcaaatcatacatctgatttgatgtatgatatccaattttggctaatatccaaaatatacaggcaactatataactcactaactcactaactaacaggaaacaactcactaacaggaaaacaaatgacctgatataaacataagcaaaggacctgaatagacacttctcaaaagaagacatacagtaggtccttgaataacatcctttcgttgtaacattgatgaggaaaacaaagtcattcccgggccactgtctgtggagtttgcatgttctgcccatgtctgtgtgcattgtgggttttcaccaggtacactggagttcaaagatcagaaaaaaacaaaacactatgctaagtgaaaagagccagacacaaaaggttaattggcatgtctaaatggtcccagtgtgcgtgagtgtgggtgcaggtgtggatggaaatgtaccctgtgatgggaggggtcctgttcatgggttcctgctttgtaccctgagctgccgggataggctccagcaacctaccacccggaactgaaataactcggtaaataattaccttacttgtttatgttaatctttcttaaatgtatcatagcccacaattattttagtgtttaatattagaagtgtttttcatctttatttagaagtttgatgatgtttttgtgaccagaaatatgctgtcggaacttcactcttgttcttatcaattagcctatggtaaaattggttttgttatatgtcatctcgcttaaagttacagtttccaggaagctacgaggacttactgtgaccaaaagatatatttaaaaaaggatcaacctcatgaatcatcagggaaatggaaattaaaaccacagtgagctaccacctcacccttgttagtatggctgttatagataaaaggttggcaaggatgtggagaaaagggaattcttgttcactgttggtggtaatatagattggttcagccattttggaaaacagtatggaggttcctctgaaaactaaaaatagaattacatataatccagcaatctcacttttgggtatgtatccaaaagaaatgaaatcaatgtatcaaagaaatatctacattcctatgcttattgcagcttattcaaaatagccaggacatgaaatgaacctaagtgttcatcaacagatgaatggataaagaaattatggtatatatgcacaatggaatactattcagccttgaaaaaaaggaagttctgttctgtcattttcaacaacatgaatgaacctggaggactttatgctaagtataataattcgggtacagccgggcatggtggcctgtagtcccagcactttgggaggctgaggcaggtggatcatttgaggtcaggagttcaagagcagcctcgcaaacatggtgaaacctcgtctgtactaaaaatacaaaaattagccaggcagtagtggtatgcacctgtaatcccagctactcaggaggctgaggcaggagaattgcttgcacccaggaggcagaggttgtggtgagccaagatcataccactgcactccagtctgggtgacagagagagaccttgtctcaaaaaaaaaaaaaaaaaatcaggtacagaaaggtaaatactgcacgatctcacttacatgtggaatctaaagaagttgaattcataagggtaatgaggggaggaaggggtggtcatactgtgtgaagggagatagtcacactgagggaaggtggtcacactgtgagaagggaggtagtcacattgtgagagaaaaagtgatcacactgtgtgaggggaggtggtcacactgtgagagaaaaagtaatcatactgtgaaagggaggtggtcacgctgagaggggaggtggtcacactgtgtcaggggaggtggtcacactgtgagagaaaaagtaatcacactgtgaggggatgtggtcacactgagaggggaggtggtcagactgtgtcagaggaggtggtcacactgaggggaggtggtcacactgtgagaggggaggtggtcacactgaggggaagtggtcacactgtgagaggggaggtggtcacactgaggggagatggtcacactgcaagaggggaggtgatcacactgaggggaggtggtcacactgtgagagggaaggtggtcacactgtgagagggaaggtggtcacactgtgtgaggggaggtggtcacactgtgaggggaggtggtcacattgtgagagggaagggggtcactgtgagaggggagaaggtcacactaaggggaggtagtcacactgtgaggggaggtgatcacactaaggggaggtggtcacactgtgagaggaggtggtcacactgtgaggggtggtcacactgtgaggggaggtcacactgaggggaggtagtgacactatgagcagagatggtcacactgtgaggggaggtggtcacactgaggggaggtagtgacactgtgagcagagatggtcacactgtgaggggaggtggtcacactgaggggaggtggtcacactgtgaggggaggtggtcacactgaggggaggtggtcacactgtgaggggaggtggtcacactgtgaggggaggtggtcacactgaggggaggtagtgacactgtgagcagagatggtcacactgtgaggggagggggtcacactgtgagggggaaggtggtcacactgtgagaggggagaaggtcacactaaggggaggtagtcacactgtgaggggaggtgatcacactaaggggaggtggtcacactgtgagaggaggtggtcacactgtgaggggaggtcacactgaggggaggtagtgacactatgagcagagatggtcacactgtgaggggaggtggtcacactgaggggaggtagtgacactgtgagcagagatggtcacactgtgaggggaggtggtcacactgaggggaggtagtcacactgtgaggggaggtggtcacactgtgaggggaggtggtcacactgaggggaggtagtgacactgtgagcagagatggtcacactgtaaggggaggtgatcacactgtgaggggacgtcacactgtgaggggaggtggtcacactgtgagaggggaggtgaccacacaggggaggtggtcacactgaggggaggtagtgacactgtgagcagagatggtcacactgtgaggggaggtggtcacactgaggggaggtagtcacactgagaggaggtggtcacactgaggggaagtggtcacactgagggggggtggtcacactgaggggaggtggtcatactgtgagtgaggagctagtcacactgaggggaggggtcatactgcgagtggaggtagtcacactgtgaagggtggtagtcacactgagaggaggtggtcacactgaggggaagtggtcacactgaggggaggtggtcatactgtgaggggaagtggtcacactgaggggaggtggtcatagtgtgaggggaggtggtcacactgaggggaggtggtcacactgaggggaggtggtcacagtgtgaggggaggtggtcacactgaggggaggtggtcacagtgtgaggggagatggtcacactgaggggaggtggtcacagtgtgaggggaggtggtcacactgaggggaggtggtcatagtgtgaggggaggtggtcacactggggaggtggtcacactgtgaggggaggtggtcacactgagaggaggtggtcacactgaggggaagtggtcacactgaggggaggtggtcatagtgtgaggggaggtggtcacactggggaggtggtcacactgtgaggggaggtggtcacactgagaggaggtggtcacactgaggggaagtggtcacactgaggggaggtggtcacactgaggggaggtggtcatagtgtgaggggaggtggtcacactggggaggtggtcacactgtgaggggaggtggtcacactgagaggaggtggtcacactgaggggaagtggtcacactgaggggaggtggtcacactgaggggaggtggtcatagtgtgaggggaggtggtcacactggggaggtggtcacactgtgaggggaggtggtcacactgtgaggggaggtggtcacactgagaggaggtggtcacactgaggggaagtggtcacactgagaggaggtggtcacactgaggggaggtggtcatactgtgagtgaggaggtagtcacactgaggggaagtggtcacactgaggggaggtggtcacactgaggggaggtggtcatactgtgagtgaggaggtagtcacactgaggggagggggtcatactgcgagtggaggtagtcacactgtgaagggtggtagtcacactgagaggaggtggtcacactgaggggaagtggtcacactgaggggaggtggtcatactgtgaggggaagtggtcacactgaggggaggtggtcatagtgtgaggggaggtggtcacactgaggggaggtggtcacagtgtgaggggaggtggtcacactgaggggaggtggtcacagtgtgcggggaggtggtcatactgaggggaggtggtcacactgaggggaggtggtcacactgaggggaggtggtcatactgtgagtgaggaggtagtcacactgaggggagggggtcatactgcgagtggaggtagtcacactgtgaagggtggtagtcacactgagaggaggtggtcacactgaggggaagtggtcacactgaggggaggtggtcatactgtgaggggaagtggtcacactgaggggaggtggtcatagtgtgaggggaggtggtcacactgaggggaggtggtcacagtgtgaggggaggtggtcacactgaggggaggtggtcacagtgtgcggggaggtggtcatactgaggggaggtggtcacagtgtgaggggaggtggtcacagtgtgaggggaggtggtcacactgaggggaggtggtcatagtgtgaggggaggtggtcacactgaggggaggtggtcacactgagggaaggtggtcacactgaggggaggtggtcatagtgtgaggggaggtggtcatagtgtgaggggaggtggtcacagtgtgaggggaggtggtcacactgaggagaggtggtcatagtgtgaggggaggtggtcacactgaggggaggtggtcacactgtgaggggaggtgggcacactgtgaggggtggtagtcacactgagaggaggtggtcacactgaggggaggtggtcacactgaggggaagtggtcacactgaggggaatggtcatactgtgaggggaggtggtcacactgaggggaagtggtcacactgaggggaatggtcatactgtgaggggaggtggtcacactgtgaaagaagatgatcacagtatgagaggtcatccttcaagaggcaagtgcccaaaaatctgtttataatctagagcaatatttgcctgaaataaactttaaaagtggttttacgctatttaacccagtgtcagaacagcagcatacaatatgagctcaaaatcttgtataattttagtaaggtaattgtttttggttggtttgatacaattctccagaaaaattaaggaagaaagagccaacctcatacacattgcagaatatatccacgaggccttactggtggcacccaaagttttcagaacctcccagtacttagttgtgagaatcagttgctttttccctatcactgcctttattgctctagtttaaatctgaattcctgcaaccctcactgactgctctttccaatgtgtgcataatctccagcaccccgttgtgtcttgcttagccaagtggcaatgactttatgcctccatatagcttgagtctgttttcctatctataagctcttatcactagtaagttaataatccaacaaaaccctgcaaggaattgccttttctattcaaaatagaaggaattattggaagttgaaataaatgtaccatcagagtccacagactcttgatctagggtgatgttcaagaatcacagtgtttggaaagcagccagctcaaccctgggggatgtgctttctagaagtaccctgctctggagggcagatatgcagtggtgaagcaaatatagcagatgttaactgtggagtccaggtgcaggtgtgcaggtgttcagtggacaattcttcaacttgtctctgaaaatttttataatgaaatgttaggaaaatctctactacactgtacctatgtgcagcataagattctcagcttcaaacaactttattctttctgagccctacctttttaaatatatcaataaaatttgacttgattgtgaatttattctaaggttttaaaatcccacttcttgggaattataagcaagaaaacttttcatataggacctttcaagtaaaaaggtttaatcactccttttttttatttttaaatttttttatttttaaaacagaggcagggcgtggtggctcatgcctgtaatcccagcactttgggaggccgaggtgggcagatcacctgaggtcgggagttcaagaccagcctgaccaacatggagagaccctgtccctactaaatatacaaaattagccaggcatggtgggccatgcctgtagtcccagctacttgggaggctgaggcaggagaatagtttgaacctggtaggcggaggttgcagtgagccgagatcatgccattgcactccagcctgggcaacaacagcgaaattccgtctcaaaaagcaaaaaacaaaacaacaacaacaacaaaacaagtatgatctacagatgatttttatctgaaaatgaagggcttgaaatgactaacctggatgactcttgaggacattatgctaagtgatataagccagtcacaaaaaaaagtactacagggttccactcatatgagatgcctgcgtagtcacattcatagagacagaggtggtttccagggcctggaggatgggagggtacggagctggtgtttaatggagacagcgtttcagctgacgaagatgagaaagtcctggagatggacagtggtgagggttacacagcaatgtgaatgtacttcatgccactgaactgtacacctaaaaattattaaaataagacatgttgtgtatactttgccacaattaaaaataaattttcaaaagctagaaaaaaaatgaccatccttgcagagctgactactgttgttttcattctcatgaaactgccgttacaactgtgcagggtccaattaatttctgtatctggcctcttactgtgttttacaggaggaagatcttccttccatagagcagttagcccatcaaatagaagatgaggaaatcaacccgactgagaagcccaggcaatacctcaaaagagtttttgaggaatccatctacaaaaccctggtggagagaagcactcttgactacctgcactataaccgctaccacctgcccatgtacgcgtggccaggcatcgtttagttgtaggcagggtctcccctttatggttttcatttatttagttcctggaaacgcgctctgtagaaatagaaaagttctctgcagcctggtttgacagcgaagccagcccctggtggttttgttcattcctttccttccctgacttatgcctgtagttttctatcatcccagtaggtggcacacggccgtgtgcctctcttctggggcaggctcgctttacaaatcccaggcatgttcctgtgcagaataatccatttcagcaataaaatgagatcatagtgtgtaaaacttg

SEQ ID NO: 390 - DNA, 21680 bp, Homo sapiens
attaaacttttactatcgaaaggatttactttggtggagttgagggtgggagagaaatgaatctttatgttctcctgttagagaatagcttttttccttccagctttcacactggcacatgcttattacaattctaccttgggaacatgacagaatttttttcttatgcattcatgcaacataaacagataattctaggaagactgtgattaagtcacttgcattctgacctattattttcatctctccctgactctgggtgagccaaaggctattaagatgatgttctcctgctcactcactaggcagacctctactcgagaagtgatctgacaccgcagtagctgatgctcgtccagtgactaaagcagtcaggctgaaaacagattttatctcaacaacagtcctagtttcttctgtcctcaaacactgttatttattttcaagataaaatttagtaacaacattacgaagtagcttttattcccttgggtgaataagatgtgcacatttaataataaatttgcttactaaaggtccttttaggggaaaacaaccttaaaaatacagttctagtccttgggcagtgaacaaagaaaaaatgtgcttgagaaacacagtccaggttaaaggaaaactctcagatcggttaatgcagttgaatttttgcttgagaatgtgagcaacgtatcagcaaatacattcattcttgtgctactcttcattatttagcatagagctaccttaggtgtttctacacatgctctaaaccaagagtaagtttaacatgtcagcagtgaggagtagacattttctactatagcacactgggagatgtttactggtactctaggtagaaatgactccattgtccactaagtttgggaaataaataatatggcaacattgctactggagatacataatgtacagaagcctaactataaagagatttgattaacgagacttaagtcttagtccagaatttcccaaatttatgtgaacatgggacatcatttttcatagcacacacgtgaacaagccattattctttaaacaaggtattacaaactcaaccactctggagaactgatgagcgcctaactgaaattattagactaaattcttagtaaacaatgttttctgaaccttgttcagaaatataatcactgcaaattattttccaagtgttgttctaaaaaacaatataactggacactagtaagaaagtaaggtaaattattaatccactcgcattcaattctacaaggaatgaaaccatttttaaaagtggcttagaacaaacaatttactgagcacttactatgcacccaccaggtatattccttttataatgtaatcttcaaaatgagctgtcaaactattggcccattttgtgaatgaggaaaatgaaaattaagttatataatcatgagtggcagagctgggaaatgaactcaagtctgtgactctgaagacatgaaaaagttacacatttcagatgaatgcataaactatctttatgggtatgacatgaaaagtaactgtagaatgttaccttaattacatttcctaatgcatgatgtggacagacattagaaaagtttggactcagttggaaaaacaaatccagcagttaaaaaagtcctttacttgcaatccctacccctagctaacccaagagcatttaaaaaataacttaaaaagtagccatcaaagataccaatcaatttcttactggtgaaatatataagaacttccaggagtcacaagagttccaaacaattaatttataaaaataacaaaacatttgtctatgaaaaaaagatcaggattcactctcatcgacgtcctcatctggatggtgctcagcatcctccttttcctgctgctgtttcttccacagtttggccatggccaggagtttgaggttaggttggttggcagcatcttctggaaagatgtaatcaaagtattcttcccagcctgcatcagactacagaaataaaaaatgaaaagataagcaaacgtgggtgatatactcacatatcagagtgaagaatttttactggaaatccggatgattacctccattttacaaaataacatcaaagtctactacagaaagaacaagggctgggtctgaaagactgggagtgagtaagcagcaactgtagctcagtgagaactaaactggtagaaaaacattctaaaaatctaagcacagctcctctatagccaaccaagatgttcagtgtctccaactacattgtgcagtcttacacttaagaaaacgtttaacgatctttacataatattcacccagtagcaaaagccatacatctgtgcattattattccaactccctaccttcccatcctcacctcctatcagtcactgatttcacttcccaaatattgttctaacaggccctgtggccctgttctagttccagcttccatgtcttgctcagcttataaaaactgcttcctgatgggtcttctttctccaatctaagccccttgagtctgccaggatgagaggctagcaatctggtcacgtcattttatgcaaaacagccttcactgactcccaccaaactccttcttaccgcctacaagccttctctggataggctcctatctgaaagttcagttccatcttcctccacacttacttcctattaaatgctctaaaaatatcacacttcatgaagttcccagactcaaccatcaccaaaacacctttgccaaccccttcccgttctccacctctgactggaccatatgttctaccccgtgtttccataacagccagattgcaaccatctcctactccaggtggtctgcttccattctaagattgtacatatgccacttaaaagtccacatttcgacgtcagaagtgtttctactcatgtgacgtgagatgaacagtcccagggcagagttcttaccccatcatcagtctggacctttcttctcttcttgactttctctggcatgagtttgtctactctctccttatctgaagctgttccaaattcttcttcaaaacttcgccaagattccagcagcataagtctctcttccttttcttcacagtttcgcatggttttgttagcttcttcataaatttgtctgcatttagtcaaacttccttcttttcctgaagacaactcaaactgagcaaagctgatccatacctttaaaaaaagttattattgaaccaaattaaccatatcactcagaagataataatgtagtaataataaagcgaattcccagttaatgacatcggaaagtaatgtgtgcatcactaatgtttcacagatgaaaacaatgaatatatgcttcaatataaacactgaaaatatttgattctacattctacaattaaatgtctgacatagtcttaaactcttgaaaagagtttaacttggctgggtgcagtggctcacgcctgtaatcccagcacttcgggaggctgaggtgggcagatcacgaggtcaagagatcgagaccatcctggccaacaggtgaaaccctgtctctattaaaaatagaaaaattagcctgggcattatggtgcgcgtctctagtcccagctactctggaggctgaggcaggagaattgcttgaacctgggaggcggaggttgcagtgagccgagataacgccactgcactccagcctagagacacagcaagactccgtctcaaaaaaaaaaaaaatagtttaactttttttcaatcttgtgatacccaagctactcacatgcagcataaacaatgacctggtataaacttaacattccaaacattccaaagtcctctgagactcacgtttctcttgaaaagcaaggaagtcattaaaaaaaaaaaaaaaacaaaaacccaaacacttaaaatacagaaatatatcattttcttctggactgctgattcaagcaaaatgaaagatcatctacaaagcaaggataccttgacatgctgcgtccgttgaagcaaccgccggtaaaggtttcgtgttctttctgtttcttcctgctcaatttcaaaatcaatatatgatttccaaagcacctaaggaagaaaagtaaatgggtcagtcttgacatttacaaagcagcatgcccccatccaaagcacagctgaagtatcactctaacctacatctaggaacataggatttttactgaacaactaaagaacacatgtggataagataaataacattggtatctataagctggccaaaacttggctagaattccagattacagaaaaagggccttggattcagtcttagagattctctttggaagtttttcaaatgcttgacttatcaagagctgagaaacttgccaagcatctcccaggtactccatattctagccacacgcaattgagcgtccagagagaaaacaggcccaggttagccagtatgcatgttcttacctctactgtacattccttgttattatgagagttcagtgcaacaagcattcactgaacaggtgcgcactggctcggtgcagcctggcagggaataaggatgaataaaccgtggcatggacacctgaaagctggcagtctggtggaggagccgaggacaactgatgaactcagtgatacccaaagccctgccttaattaatgcaatcagggggccaaaccattaaatgcagggtcatgttagtgcatgagattaacaaaacggctgggtgagttctacgactcatgtgagattcaaatctttcctagctgtggtttggtgctaccttgtgggtcaagcttaactactgaaggcaggcgaggactttcaggacagtgacaacagaagttgcaaggacatcctggtttagagaatacagggatgtgcagttcctacctccatccccctcgttctccgggtgggccagcctgctggcttcttccttgcctggcctcttccccagcccctttaggctttcctgctgcagaaggggcgtcacccacccccatgatatcccagttcatcctgggcatcatcctggatgtctactgctctggtatctaatgagagggctacttcccctgtcccccacagccacctttccacgtacaagcctaatctgagtagaagagactaagttagttagatcatcgttatactctaaaatacacccacatttagatggtcatctaaagtaagactaaacacgtatctcaaacaaaattatatttgacttgagatgctcacctctggcatgtctaaacgtggctgactgatggctaattcatagattgcccgtgctctgtcaatatcaccaaggattgtctctaattcagcgaatttaatccatgaggtacaattttcaggtccaaattccaggaacttttcataaagcttccggcatctgtcaaattctcgaagctgtagctccaattctatgtaaactttaaataatttgttctttggacatttgcctatggaagttccctggaaaataaaataaccagaccactgtgatactgtagtggatttaatctgtgcagttattgcactgccctagaggctgttctctgctgaggaagaatcttgcaaagtcaacatggcctaccattctttccctctgtggtatcacaatgtttactggttcttgacaaaaggctgaaggaaactcctctaattcactcagcaagaggcagtgttccagaattgtttgggcaactaaataaaataagatttgaaagtttctcaggatctcctagggaatagggatgtcaaatgcataaaacctcctataaataaaaaggacaaggcatggtggctcatgcctgtaatcccagcattctgagaggccaacatgggaggatcatttccgcccaggaggcagaggttgcagtgagccaagatcgcgctactgcattccagcttggggaacagagcgagaccctgtctcaaaaaaaaaccaaacaaacaaaaaaaaaaaaaagaaaaaaaaagtggaacaattaaaagtgcatttaacacaccaaaaagtttgcacaggatcagattactaattccagtctgtggaaagatttagtaactggtagctatagaagtttccaatattgaaacagaatgttaatttgccccaggtaataagaataatttacgcattattagtcagtgtttttacagaggacgcatgttttctaacatgtcccaggctataaaggtataatacttctgtcactctttaaagtaggaactgtacaacttccaagcaccaagattttaatttctttctcatagaacttgatgagacatcttgatcctttctttacttaccaatgctcttctggctaatgacagattcttctgtcgtatttcaaactgtgcatacagtatccacattttggcaaatgtgaactagaaaacaaaagcacaaaaatatctagcttaaaagcctcatccaaattaaattgaattaaaattaatttaaattaaccaaagccattggtaattcgatttctctaaaacttcagagtaagaggaatgtactctgcttatttacaagcaaagaccacattcatttcacaaaagttagaaacccacataccatgatccagatactatattgtactgcatggcatggtaacctctcctgagaaccatgatccagatactgtactgtactgtatggcacggtagcctctgctcagaacagactttgttttgtaggcatgcttgtatatgggcagaatgtcctacctctattctgaaaagtaactcagtcaacacttctacagaaggaaacacgttttgtttctcgtgctgggaaacaaggcggaggtaacatctcaaccatctacacaaggggcacattcatctgtgcatgcacacactcactgttaccaacaaacccgcctgtgtgtcccccgcacacgttgtgtgctctctgcatggatgtctttctccttccactcagactattcacattacctagccttctctgaatttatattatttgtttgtcaatgcaggttgtcctccaacctagtctgtgagctgttttcagaggcaaggagcatatctcagtcttatttatgttgtccatggtgggacagggaagcattttatcaatcaatattatttcactgaattacttcacaagtaacagaagaggattctgacctgtttgaaatggaacactttagagcaaacatacctttttgtgaggaattagttccaaagaggcttgatacacctgtcttgtcctctcaggatcctgtattaggataagaaattttcacaaaatattgaagtctgctgctaacactcattttactagttactaattttactgatattggtaaaaatgtacacccccaaaacagcatgtttcacaagttgttacttgcaaaccctgatttatgatctaaagtatgaacggccatgaaacttcagtttaagaatcaccaacaagatagccaccaaacttctaagcccttctttgtagaaagccgttttgcctgatggcagaaagaaacaaagatgtttcatagtctcagatcaaacccagaaggttaatacaaatgatttctgaaaatgccacttgatttttgctaaaagcaaaaatgcataatctagccagaattactcctattaatgagcaaatccaggaaactatatttcactaaattaagggctggttcactgttctctttcaagctccaagtgatatcttgttgtgcctcaagtaaaaatcaaaccaaagttaaaaaagcccctcacgtgtggccacaacaagcacagagggtttaaaatgttgcagagcgaatatataactgtatggatgaacagaagcctataaaaatttaaaactaaatttccttctttcaagaattacaaacatccacaataggtgagctgtgaatacagaagacaggaaaccattatcagctgacacataattctgttttttcacctttgcctccaattcttcatagagtgcatagttgatccaaagataaatgtagcgcttccagtgcctcttctcctgaatgggtgggacattggcaatggccctttcatagacttctctcacggcttcagcttctgcgtcactttctaccaagcgcaagtaatcaaaccatgcatcataattgtgtggattcgcctagaaagacaaccagtttaataaataaaaaacaaaaccaagagctgcacttgccaggttaagcaagctgaaaaaaggcatcaggctgactttctatattttagcaccttttcttctaaatgttacatgttctttcattttaaaaacaccatccctgagactgcataaatagaaaagaaacaggaatacagaggatagattactggccaggtgtcccacagcaaggactccttcatctatagccatcactctcacgacagtcaataattagatgcctattcttgccaatgcatttgcttaaatatgtgactatgtatcattatgtctgtaacaacagaatcgtatcatgctcacaattgttaaacttgcctttccaattaatagcaattcatctttaacatatcttgctaacctaccaccacatttaataacagacttagtcctttgcttggaggtatcttaattaacttgactaaggaagagtatttttaaatacacaacagaatactgaaggaaaatgacactctctttgaattgaaatcaaaatagtacattacagaaaaagagatgccgatggaaccctgtctagcatacatcttttgttcaggcagttaagctcaaaggtgatgtgcaaaacaggtttttggaccaatctctgactcttccaccttcttccaacaatgagctcgaatggattccacatttcttttgctccagttctacatacagtcaacaatcaacaaaacgacttacaacatgtaagtggcagagcaaatccaagtgttgtttgcttgccttttctatcagccttgtttattcctacttgtctgaaatagctgccaattggatcacgggcacatcatcacgagagtaatcactagtagtgctacttgctattattcattttagtgttgctagtattgatgagcacatcttgggttatctgcagagttgaccatccacaccagtgctcaccttcacttcttcttcgtactggaatctccgtttgctcacaatgatatcttcaataccccgcctatcaccaaacttcttctcaaagatggtataatttttaaagagttcttgggcatcttgttttgaaattctgtccagggcatacttgtaaatcactcgtaccctttcaaactaaatgcagacaggatgattaccttctataacacaatattctcatgccagtcacaactaggagagtaaatataacaaaatattacttataagttagattttgaggcctcataatatccagagtaagatgcttttctccctcttgttgaaggttatctctgtcaggatggaccggtactctgctttgagctccatatttaatactgtctacctaacactgccaactggatgtctactgcacatctcaaacaggtccaaaactgagcttctgtttcctccccactcaaactgggactctccccatcttcccaattttagtaggcaaggcctaacctacagtcacttgctcaagccaaaaccttcaggtgatcctcaattcctcttttttcctcatactccatattcactcttgcaacatgccctaccatttcaatctcttccacacagccatttgcttctccccagcccccagccatcaaactccactgttcacctggcccacttcaaaagtctccccactggtctcccctggttccacttttgccatctaccctcatacattctccatgaattagccagaggctctccttaaaatataaatcatatccaatcactgtcccgcttaaaacctttcaatgcttcccactggcccgaacagaatctgaactccctagcatggtccgtgcaagaccttatataggttgagtatctcttgtctgaagcatttggtatcagaagtgttttggatttgggatgtttccccagtttgggaatatttgcattatacttactggttcagcatccctaatccaaaaacccgaagtctgaaatgttccaatgaacatttccttcgagtgtcatgtcagcactcaacaagtttcacattttgagttttggattttcagactgggaatgctcaaacctgtatttggatggatctcaattctgtattatttgaactccctttttttttaagaaatggggtcctgctctgtcacccaggctagagtgcaatggcacgaacatagctcattgtagtctcaaactcctaggctcaagtgatactcctgcctcagcttcccaagtagctgggactgtaggtgtgcaccactatgcccactcaatttttttttttagagacagggtctcactatgttgcccaggctggtctcaaactcctggcctcaagtgatccttctgcctcatcttctcaatatttgagctattttcataggtacaagggaaaaaaagaactctcttatttgtagggcaatctctgtttccattctaaatgttttctgttctagggctttaagctttttgtttcccatatttattatcggttaagtcctttacttaggatgccaaaagactagttctcagtttacgggcattcagactaaaaggcttaattttcaaacaaagcacaataaaattaagacagttataatacaatctataatcagctcccatctgtagcttagtcacatatatatgctgttctctgtgagaagctgtgtttttgtattttgaaaacatctttccagggatatgtcagtaagaaaaaatggaaatgaactcaccatgcacaaaatgtaatctttgctaagctgttttacagtataatgaagttaggtatacttacctctttctgattttcttcaaacttggcaaaggcaacataaaggtgctcatccatatgttcatctccaaagaattccacagctctctcatacactttccgtgcatgggcaaaataagcatgtttttcttcaaagcgggcatacttgatccagttcttaacatcagggtgcacgaggacaagtgcaagggaattaaggaaatcccaggcaaaacagcatggcttaaaaaaatagtaagtaagtaaacaccaaaaccataccaaagcctggaaactccaaaaattcaaactacaactctaggggaacaaaacacatacaaaagtgtagaattaaacagtggcttctgtgagagcagggccacgcctgttcatctctattttcctccagtgcttagttaagattttagtggtgggtataaactcgagttggaagcaaagaaaaatctcaacccaggttaccaaccatgtgatcttggataagtcactgaacttagacgtctaagtctcagctgtttcatttgtaaacagggaaaaataatgccagcctcactggattactgccagctttaaatgagaaaatgtatgtaaagcccttagcacagtttctagccaaaagaacatggcaccgtaagcggtcaataatggtctggtcattaaatagcaccaattatattaaaatatgaatacttgaactaataattaagaaaaaaacatgctataaaaagaaaactgttaactagagtcaaagcagaaagttttgaattgtcattttaatctatcttccttgaataaatcattaatttccaaagtagtaatatattccaatatggcaaagaagagcatcagttctgaagctgctctactaggttcacattctatttccatcagcacctgtgagaacccagtcaagctacttaatctctcatgcctcagctccctcatctgtaggacagagaagttcctacactgcaaggatgttatgaggattaaacaacaatatctgtaaagtacttagaatactgcctggcacgtagcaagtgctataaaagctttcgtcaaactaataatattaaaattagtagacataattaagatcttaacattgtcacctcaacagagaagagtaaaaaaataaaaagatcttaatactgcataataaagttgactctcattatttctggtagttatgttctatttagtcaatgcgaacacttaattattgagtactgaaccactgctcctaggagaaacgtgtatatatacaatctcacattcatcatcatcttaaatcctaaaaagaactcatcctggcagattctatcttcattattttgtaagaaaagtggttcagaaatgttaagtgactggactgaggctgccccactgacagggattcaaactccccgactggccccagagccacagctccttgcactacatggcactggcccttcctgtctccaagctctaggcatggttatatgaggttaagaccagaaggcaagcctcaccttgttggacttcatgctctgtgcatgtccacaaatgactgtgaaagtgccacaattactgattttgggggttacaaataaattttagcaaatacgtgattttgcaaacatggaatctgcaaatagtgaggaatgactgtacttcagtttctaaaagtgctttcatgtgtatcatttaatcttcgcaacagcccaacaaaggtgtttttattcttgtttttaagaagaggacaccaactctcaaaggagttaaatgactctctggagccacacagctagtaaacagtaaaccttggatgaactccagtaaggtagtaatgaccaacacaaaccttagaaaaacaggactggcaatggcagccaggaccttagtacagttagtcctccagccatgggttccatatctgtggattcaaccaacctgagataaagtattcgtgagaaaaaagtgcttctgtattgaacatgtcgtttttttgcttattattccttaaaatatacagaataacaattatttatataacatttacattgcattaggtataagtaatctagagattatttgaattatatgggaggctatgcataggttacatgcaaatactacatcattttatatgagggacttaagcatcaccgattttggtatccccttgagttcctggaaacaatcccccaggaatatcattttccacaaggaaacattagcttttagcattacaataaaataaacccaaactctcactagaaaagactagttacccagaatacaaattttcattctgaccaatctctttccctacaaaacatagggaagctgataaactggcattcttgactttgagcctgacattaatgactgtgtgtcctgatcatgagacatctctacaggagcagcagcagcatccaggacaatcatggcaccatacagatctcgtccaaaggatatatcgctcataaatggtgcgggcccgatccacctctttgtatctcagctcaaagttgatgtaggagtgccaggcttgctcctcaggctgccactccatccagcgctcaaacacctgccgggcaccggcaacgtttcccaacatttcctccatgtacgtgtacttgtacctgtaacaaaatcacccgaaaatatctgctgtggtttagttcttccattgttgaatgggaagaagattgaagattttacctttcttaaaggttaaatcaaacatgttttgtcatttgtatgtaaatctgaaaaaggatgaaccattggaaaaaaagatttttttttcttaaaagttgcctagttcaacaagaagcttatgaataaaagattgcaatcaaaattttagttttgattacatagctatagaacattacgattatgacttaatagactatgggacataacagcatttatgtctgaagaaaaagtaggatatcaaattaaactatcatcatgtaaataaaataaatacagaagatgtggaactttgctagtctataaaaggctgttttgttagatcagaaacttaccagaactgattaactcgaggcagcgttgttatggcccggtcccagatatttcgagcatggttgacttggcgattcttcatttccatttctgcgtatttcagccagagtgtaatatttcggtagtctacatctaaagcacgctcgtatatggatcgagcccttaagaagcaagatttgcagggcatcaaaaatagagcattcaacacatgtagcagttatttcaaactatctggaatgcactgatgttttattaggtgtctaccatgagccaagttctgggcataaaaaaatgaaaagatataatgctctcaagtaccttacaaagtcttataaaaagacatgcatgcaattataatgcaatgtgatttatgttatagtcaagatctgcacgggaaacagagaggaagaaatgaaaatgtttggtggaaaaggctaagtagtaggtaattgtagaaatgagaacttgaggaacgttccgatttaccaggaaactaagtttggtgaggagggggtgctcattccaggcaaggagaacagtcaagcctcacgataaggagacatgatatattcagggagtggcacatacacaggcacagtgggggaaggaggtatgcggggagaatgcagaaagctagaccacaggaagggccagattgcaatttttattttttttggccattggttttattttttttggccattgtttagctgaaatttgtaaaaatctcaatatatacaaagcaaatgaaattgtgcttctttagctacaactgacaagatctatctctaaagcctcttctgccaccctccccaggactattctaccccagtactcctgaggccctcaagggaaccctagggttccatggaaccaaagttgaaaatttctacccgaggcacaatcttttacctgtgctttaactttttcttcttttctttttggtatctgttaatctatgaatcattatatacaaaactacactctcagtaattttacctttgaatctcctttaggctttcttcccattgtgcgtattttatccagttactaatcacagtcctgttttttcttatattatcttcaaaagtctggaagaaggcaaaaagggtcaagtcaaaagacaaatgactaaaaatgacagcacccttggtctattttaagtcttgtactaaaatggttattcattttgttcatatttaagagaaattacatcctggaatccttgaggaataagaaacccactacagaaggttacagtcaactaactgatactttaaaatggtctatgcttgtccctaataaaaaatgtttttgactattacctttaagtcctctggtaattctcagaatttcatatataacagcattagtgctttaaaacagtcccacattctagagtgaagaggtcaaatcagatcccaaagtcttctcatggtccttttgcagacctcaattccttttcctttctttctttctttctttttttttttttgagacaaagtcttgctctgtcgcccaggctggagtgcagtggcacgatctcggctcactgcagcctctgcctcccgagttgctgtgattctcatgtctcagcctcccgaatagctgggattacaggcacctgccaccacgcctggctaatttttgtattttagtagagatggggtttcaccatgttggctaggctggtctcaaactcctgacctcaggtgatctgcccgcctcggcctcccaaagtgttgggattacaggcgcgagccactgtgcccagccagatctcaattcttaacacagaaggtggtatagacagaagtacacagtgcagccttactaagcataccctccttcttgttgtcagttgttccatctgctaaacttccgctcactttgattcagcatcaaaaattatgcagattcaatttctttacactttaaccagacaactcatggcatattttatatagttcagaaaaatgctgttatctggtaaccagaagtacattattcatgcgtctggaaacacttaacctcatcttgccctacagaatccaaccaatgaggagcttttcaaactgaccgatacagtcttaacaattagtggactgaaagataccacactgactgaccttccttttccttagtttataatcatttaattcttcttcatctgtgatcttctgttgaggtggaggtggaagaagctcaagttctctttctttagcctctcttaagagttgttcagcagttatctgtacctcagccggggctttgtttttcaccttttaagaaagaagacatttctatttttagtagttgctcttcacacaaggcttaagaaacaaacatacattttttaggatatgaactttgttagtattatcacaagatgccctttttgtatgacatgttcccattcctccatgagactgaaaagaaaaaaaaaataccgttttctctcttattcatagtatctactgcaaagccataggtaaaagtctcaagagaaaaaggtggcaaaaataatagcaagttttcccttttagatgagtataataataaactttgaggccgtctaggtaaaattctgaccagaggttttgttttatcaaaatgtgtagcacatcttattaacagcattacaacctgcatttacagaattcttcaacttatttaatgccccggtgtataactgggtttggttttacatggcacttcaagtcaaaggcaatttcagtaagttctcatcattagactgtaagcttcttgaggtcttagaagcttacagtctaacgtagcttagagctgtgctgtccaacacagtagctatgagtcacatgtggtgagtacaaattgaggtggactgtaagtgtaaaatacacattggttttgaagatgaagtataaaaaagaataaactacctcattacattttttataccgattacatgttgaaatgataatattttggatacattagctcaaataaaatatatattatcaaaattaatttcacttttttgctttgtttttactttttaatgtagatatgagaaaatttaaaatttcatatgtggtgtgcattatatttccattggaccagtgatgcccaataaaagtttatgtagctgaattataaaaaatgttacttaatgccacatgtggagtaatgatgataatggtgatagctcatatttaataagcactaagtgccagacacagtgttacttgctctatatgcattactcctgcgagtcagacaaatagttatgtaaaggtccagttcaagagagtcatccgggctcaagaaagactggagggagggtatctgtaaaggcttcaaagtctgccacatattaagcacttggtaagtattagctatcaaaggaaataccagatagtaagtctactgtttaattaacttatgatactatactactcctaccgtctactctcgccctccgctgtcagctgggctaactcctattcagccttcaagtctcagcttaaaggtcatttcctcagcaaaatttactttcaggaccccttcatacgacccccttattcacgcccatggcatattctactttgcctctcggtaacatctagcaaggtcgtctttatacagaaactcgtgttttgagtactgcttgtggccagcgtacgagcgtagcttcccagcgcccagtgcagtgcctggctcagtaaatcttcaccgaaccaccccactccactccccagcaaaaccaccccagaacgaaggccacgccaacgcgggtcgtgctccgcgatgacaagagcccgcgccccaccaccagctgcccttcctctccatctctcagggtgagccttctccccggcgggaacactctctcccaacccgggcaccctcagggctgagggatgcccctttcctaggccacctcctacaaggcccctcgcgatcgcctaccttggccactttgggaatccgctgcttcccggccgcggtggaggccgccatgtctgcagcagtcgacctctggacacctgtccccggcacggacgctagaaatcggctctgagagctcaccgaaaccacaaagctttcagaaaacaaacaggatctcggaaccggaagcggaacttgcaggactgacctttgacctctcgcttgagccgtgacggaggcggcaccgtttccatggtgaccaggctgcgcgtcctccttgcggcagcgcgtggagtgcggcgtcctggagctgcggatgaggtgggtaacgccgtgctgactagcagcgacgcaaggactgcggtgcagggcgtccagggcgcatccccaggtcagcctccggaactgggatgaccaggcgaggacgagtggctctgtcgagccgtggcgccctgcaagggagtaagaacggagctccaatctggatgctcgagggcgggggaagaagggagagcgaggaaactaccattcccagcatgcgacggggcgagctgccgcccttttaggctgcaatgcctcgagcattgcattctagtagtctctgggtccacgccccctcgtttctggtttcgggacagttgtgcccaaataattctaaggtgcccaaataattaactctaaggcttggaattaaaaataacagaaggtactttgaagccagatattaggaaaaaatataaatagagtaactggaaaacaactcagtcttgtgataagaaacatgtttaaattctgtgtgtgccttaattactctagttaaattttcttagcctcaatgtcctcaactataaaacaaggctaataacatctgtttcactaggattaaagacaaatgctcagtagatgttagctgttataatacttaacctgccctcaaaaactgaaaagcaaaggttaagagaattttttttaatagacatttttagagaagttttaggttcacaacaaaattaagtggaagacacagagatttcctccctccacagcttcctgctatcaattattgtacctcttccctcctctaacagcctccaactcttaaaaatatcctccaccagagcagtacatttgttacaatcttgaacctacattgacacatcattatcacccaaagttcatagtttatattagggttcactcttggtgtacattctatgaggttggacaaatgtataatgacatgacttggcagctcatttgttaggataatttccacagttgcaaagctcttttggtgtttggggaaaatatatatttatgtatgtagtaatatcacgtctaccaatgcagatattactttcaacaaaagatttatgcagatttctagaactgcagtcagttataaccaacatcaatgtatttgccataactctttattaaccatattatttagatattttatctcacttttcaaaatttaaatagagaagattttatatcactttcataaagccacctaacaaaataaataaatattaaaaagatgtttctttgaagtgattttccttaaatgtgttactgtaaacaattgatttaccaaatgaatcattggtttaatcatctgttgcctttgctcaaaagtacaaacatgctagaatactttgcttctgatcaccatccttctctcttacatttctgttgtctggcaattcagttcatctctgtgtgtgttttttttgtttgtttttttttttttttttttttaggaaaaatgtattatccttcttactttttgccatcaatgcttttgtagatataccttcatgtttaccttcttatttcccagcatttaatcttgtattccacttctttctgattttattcttctcagaatataccatctcctagttctttctacaagattctttgaattctttcagtctttgtatgaaattgtctttattttatcttcattttaaagtgattgtttaggtttatcagtctaggttaatggttattttttccttttatatttttaaaacactattctagtagttagaaaactatgggccgtagactaaattcagcccattgactattttgtatggactgtgaatgagctagggatatatatatatatatatacacacacacatacatacacatatacacacacacattttacattaaactttatatgtagtttacattttaaacattttttaaaaattacatggcacatgaaaattatacataagtcaactttcagtgtatgtaagtaaaattttgtgggaatacattcatgctcatttgtgccgatattgtctctggttgttactgtgctacaatggcagagttgactagttgtgtagacaacatgtggctcataaagcttaatgtatttattctctggccttttacagaagtttgctaacccccgtgctactggcttctaatgttgctcatgagaaatattctgtcagtctaattattttttatagacagtctgtcttttgtcaggttcctttaaagttttctgtttgtctttagggttttgtagttttactatatatttggagtttatttgtattttttgctctgaactgaaggttcatgtctttcatccatgctaaaagtaattagccattattttcaaatgtttcatttattccttttggaattcccataagacagatgtttttcattctgtcttacatgtgtctttactgaattctgtattttctgtttctatgtgcttctttctagataatttgttcataagtatcttccagtttattttctttattcttctgtttttaacccatcctcttagtttaaattttaataaccacgtatttcattttttaagtttctgttcttttttaaataatgacctgttctcttctcatgacttttgtttctctttctatatttctttattataaacatacttagtttgtagtctgtttcagagtctatcatctaaagttcttggtgactcccataatacacagattgtgtggactagaatgccatacccactttagtctagaatttggacttctcagcagtatttttgctttattttctacctagagctttgtgtagagaaagcttgtcactttcttgggctggtgagtttaatttttctagccccctcacttaccgaggggcccatccaaagtcccaggtagatgcatggtttaatttttaattctctgtttggagtgaggtccattctatccccaaaacctgtgtcagatcggctcacatcattgccacctggttggagaatttccctcgctcgctttctttcttcttttcttgttttctttttaccaaagtcagttatctaattaattatacttccttattttattcagaatttttatatacttgtagcattagtttatgatatgtttcacaaacaagatgtctcattccaattttgctttcaatttaaaaccagaacaaggaatgacaatatttatggttagcttcgataggagtctagacattattaatttctccttcattgttttccctgttttgagctcactggctagtatataataaaatggctttccctatgaaggaaagaagggagggaaagagagaagagagacttacagaaattgagacaatgagagagaaattgaaatcattttgtgacctactgtttttgtcaacagcatttcccaaagtgtccttctggaacgttaggttctccactgttgccgtcattagagattctcttcccaaagagtgtcggaaag

SEQ ID NO: 391 - DNA, 269658 bp, Homo sapiens
tgaataatctgtgctttaatggaaaaatgaaacattaatttgtttagtttctcatacaacatgtttactaaacatttcagtgtcaataatttcttaagattgtaacatttaaccttgtattggagctaataccaattctagccatgggagtatgttttggactttttgaacaattttaagtaaaatgaatgtcactgtctttaaattgtacttggagcaaagacaaagaaacatcagctcattctttccaactaatagaacatttaatgatgcaatttttattacattattttaaggctattatcataatgttaaatattcttatttttttttgcttccgtctgttactaaagctcaatacatcattctgaacattattaattttcacttaacttagatttaagtattgaatttttaacttgggctccaggaaaaatcctgaaaaagaaagatcagcatctagcatccttttcctattctttcaccacaaattctcaatttgatatgacttaacatgaaatctgtattgggaagtatagatttctaagataactttttgtaactaaaaaataatttcctgtgcatcacaagggggattaaaaatcaccaaagtactgaaggaacacgtgctttgattattattcccacctgtttcttttttattataaagtggcaatttgtaccatcattagaaatgtacattaatgtataaagttttgcattcaaatctctttatttttgattacctatgactaaagaccacaaatcaaataaaaactcatataatatatccttatttcagaagcatatgtatatatacacatatatatttgtagaacaatccactgttttaaatgtaattttgacttaaaaaatgctatttacaattttatgacagagaaataacctcagccttttatggtattaaaatgagcagggaatttttatgtttgtgtctcatcttgtgcagatgaaattaagcaatatcatggaaaaccttctcaagagcaaggccttgtagactaaggtatgagggtgaaatcgatttgctatttctgggtctatgtttttaaaaaattactggcaacgtagtcatacttacttcttcaccaagaaatcagtgctcccaaattaggaattccaaacttttcaatatgcaacctttaagtctttccttgtccttactcttgtcttaatactctcatctcccactagtggcaccgcaggactaccaatctagatattagattgttgctattttattaaacagaagagtcttagttcttttaaacaagctttctgaattagaatgaggcccataaagcatcacattgcattacattgatatctctttattgcgccaatccataatggctaaaaatgtgctattaaattgtatgtaaatttcaaagccaaaacgattactatgagaataggatggcttgctgccctccaatttgcggaagcacaaaagtctctgaattagcaaatggaacttcagctccatttgtttctatactttattctgcgagcttaaaaatcaagtaaggtgtattgaccagaaagctattttgtgagactctcaaaagttttgttttcattcttaagctcgttgattttgaaacttattccaataagaactcagaataaacatatcttaatttatatctgcgtagccaattgcaaagcattactaaaagccatattttttcctgggaaaaatcccaatgcaactccaaaaaaaaaaaaaaaaaaaaaaaaaagcttattttacttaaaaaggaaaagtgacgaatgaattgaagacccagaaatcagaacaatgaaaatcaaagaattattatacttgaaataagcctgaaaaacaaagtacttaaactcaaccatatttttggatgaagttggatattatatgtttacacatggtaatatttttaaaaactcagtgaatactggcatattctattaaagttttcatgtacttgagaagtaagcaggagttaagcaaacattcaccctttgctctaagctacattttttgtcaggtttatgtgtaaaagaaatcaggtttccaattaattctctgaactaaactggaaataagacaaagctaatttccaaaacattttactgcagtgaacatttgcttaacataatacggagaaaaacaatatacaaattgtgtggttagaattttttcttaactgctatcaggaaggagacaaatgtgagtctagatgataaatgatgaatagccactgaaaatggaggaattttgttagtgattcatatctctatttttttcataacaaacttaattaaatatattttgtcatgaaatcataattgtaattgatttttatgatttgcatcaattgtgttatttatgaaaccatcgttttactgatgagtgtgtatgtgtatcatcactacaaaagctcaagtcatttcatgctaaaagagccagtgtcccatagtgttgaagtttcttttttatttttttcaaataaaataagctttgtgcttgggatttttttctttttttttttggttctggtagtgacaggtgtatttataatcaagttgaatcaagagtgacaagaagaaatacagctagagttatatttttgccccaggggtattcttttcctagaagagcaagtccatttttagaaaatttaaatgtctttatttgttactttccaaatattttggttaaacaaatatctcttgcaaatgtatcttcaaaatctttgcctacatgcatacaatttgttcttcccaactgcttagggaaattccttcatttcattttctgctaacctctagataacagaaataggatacctggtgaaggatatggtccactattgaagaataatgattgtgtaaagtgagggaaactatattgaccttgaaatacggcaaccaatggcaaggtttgaggtgagggcctagagcttctgcaaagtgtatatattttagggagtcatatttggaacaatacatgctggacagtagagatataggagaagttacatgctatgtcttctcattgataatatccataaatctgcatacattttttaacattctgttttgtgtttttttttctttaaatttggatgtctctacaccactcctgatttgtaggactaaatagatctatttattccaatgcaaattgtgtaacatttatttcttccttgatttttaaaaatactttagtattcttaactatgtatgtgccttctcttacactgagttcttttttgctcctttcagctgctcacacaatcctgtctgttggagtcatagctgctaattccatattatttctctacacaccttgaaaatttagtgtattactggtacccttctgtgttctaggaaacaaatgaattgcaaactggacttgtaacaggatcatacatagagcaacaaattagctactggctttgtaagatagtaagttaggaatttcacagtcatgtctccaaatttcatggcagagtttaaaaaacaatataagactgtggtaaggtacaaacgcaaatgcaatttgcgttgactaatttcctaggacttatttccttatgtaaaacccctgttctttctttcctgccacaagacagggtacaaagctttctaaaacatgctctcaggtgtccacacctgagacattgctttgtggatactctcaaaggtgtccacaaagcaaaaaaatcagaccaaatgctaagagcaagtaacttatacctcaccacctggacatggcactggcaaaagtcacttcagcattagaacagtaatgtttttgctaaattactaaaaaaaaaaaaaaaagaaagaaagaagaactccggaaataatatctttgataaaaatgttatactctaggataatttgaaatcatttttgtgaaagaattaaactcattaaggctattcgatgccatacaagattttccttttacataaaacaatcttaaattacatctcaaaaataatttcttacacttttcttgatgataaatggttcctggctatatattttataggtattaacatagtttataatttggaaatgttcaatttcatggttacaaaaaaaatcctgcaaacagaatgtaatggtgtgtcaattccagatgcccaaataaaatacaaaatcaagcaaaaccacacatcgcagcattatcatgagtttaagctattgagtatataacatcagtttgtgagttcaattctccaaatcctttcctttaaagtaataagtttatttcatctttattaatgtcttcattacaattagccttctactaataacaatacagtttaatttaatatttatggagttctgatttattttttcctttgcttttaagtgtgctaatctttgtgcacgtgaattttctaccacattgcaacaagcaagctttggttcaattttcttgtcctacacaaaggaagattttgagtgcagaatcttagccactaggtcttgcgttgtcattttattttcctctccttgggtggatttactggaaggaaatgggtaaatgggaaggaagggaaggggaagggatgagagagggaagaaggggagagttctcagctatgttgaatcttgattcacaactttgcctccattcatggttggtgttccagaacttttccttgaacgcccttgtttttctccaatttcatgtagcgatggttctctgtacatacacactgaaaggcaaaataacaaaaattacttatgacagtggacataaatttccttcaataagcttttcaaatttgattttacaatattcttcactctcatcacaagctcttcttctcattataaaaaaacagttttaacttgataatcagtgaatacacttaattttctttcagttctttcagtcacaaccttttaaacttttcttgaactgcagacatttaagtaagttgtttctgttctctcatagataaggcttgaatctttacagtttcctaacctagaaaagaggattttcatccagagtcagaggagacatgggaaatatttcgctttttggtccttagtctgcagtctaattcgggtaggtaaaaaaatattcatttacatgttgctaatctttaccctaccataggaaatataatgtatcaaactgaaatatttattgccatttccagggcatcctatgtaaaaaaataagggaggacagagaagaggaaaaaagatgaagcaatttccccgactgccctacatttagctaaagtaagaaacacagtccgtgactttgtagtttttcatcaatagggaacgtgattatgcaagcatgagacttcagttcatatctatataaaccgttcttttctcctctattgtattgtctggctgtaaagttcagtcatctgtgagccatcatggctattcctagataattgtttagaaagaacgatgttttcaaattattcaagttattcttacaaaacacgttaattcagcttcattacactcttgtgaaatagacaaatgtgactagataagagtatatgatatgtctcaggtaaatatcaggagttacttttatcctcggcttaggaacaaacaggtatctccacctattaaaccatcattacaaagatttgataatttgaatgttacttccaacatcaaatagcttcctcccttgaactttgagtggttaccgatttgcgaaccatgctacccggatccacaccctgactcagccatctcctagccttgttaatttggacacattttcataaatgaaaaattgcatatttatgaagattaaatgccttgcatagagcaagtaccaaaaaatgtttatgaaaattaaggagctgatttctttgtgagcattttgaataacagatcttcagagaatatagaaataaattgttttggctgaaagtattctaaatccaaaactagactaaaacagaatttagaatacaagtgagagtctcctgagactggttcagtgatgaggagacagatttcttccaacatattctattacagaacttcttaaatgttaccgtacatgggaatcacctaggaatattgttaaaatgcagattatgaatcagaaggattgtagtgagcttgagagtctccattttaaatagatctcaggtgatgttgatgctgataaaacccagactacactctgagtagcagaaaatatatgaataaaatatgtgtgttaaggctgttatgtaaattagccacatatattttaatgagatttaaaaatatttcaattactgcacggatggctcttccaacatccccaaaggactaaatgcccttggctgaagtaacagagtatacagaggaaaccagctcagagagtagatcatataattttcaaatgacacaagtaagtcattcaagtttgtctttcttcttctttttttgtttcaacaaatagaagatccttagggaatatcttgccagaatcttgaagttccctaagtctaatggtgcttacctctctttctattataaaaaaaattaaaaactccaaaattaaagcatagttttttatttgtgcaaaatacaaccatttacataaaactgctcaatgcacaggggaacgcaagaagcaacgaggtgatttagctggaacactattcatatgataccataaaatagttcttcccaactctgtcacctaatcagctgtgaaaacttacacatctgcaggtcaccccacagattgctaaatcagaatctcaatgaatttacaaaaatctcctttttcaaaaataatatattttgacctgcaaatccttaagcttcatccagggatacttgaggaataaattttctaattttcattaaagtgtatattttttttttttttttgagacggagtctcgctctatagcccaggctggagtgctttggtgctatctaggctcactgcaaactccgcctcccgggttcatgccattctcctgtctcagcctcccaagtagctgggactataggcaccagccaccacgcctggctaatttttgtatttttagcagagatggggtttcaccgtgttagccaggatggtctcgatctcctaacctcgtgatccacccgcctcgacctcccaaagtgctgggattacaggcatgagccatcgcgcctggcctaaagtgtatatttttatcactttttaagctgagtttcttagagttgcaatttcctttttagtttttttatgccacagattctacccaaaacattcacttggacttttatctttttttttgttttgttttctatttctcacttgcacataaaatacttcatttgtgtcaacacacaatgttactgttataattactgctgcagataacttttccagtaatttaaccctgctggccatccttatattgagcggtattgcaaattgacatctgaaaatatacagtgtttcaaaaagaccaaaagtcaccagtgccacagcaagatgtaaaatttgctctttttctcatacaactcattttctaatttcccaatctttgcactaaatggagtaataaaattaacggttttgaaaacctagttcatgtcccagttagaaaacgacaagtaaaaggtaggttttccagttcactgatgaaaactgcccccctcctcaataaatcaaataggtatttgaatttctatacttctgttaaccaaaataaaaagatgttcagagaaagcaaactaaagttattctagaaactgcatgcaaatacaaatacggagagcaaaaccttggtcaaagcaatagattaaatgtaatttcttgagcattaattttcattgttatttacaggacctaggattcagtaatatatctaagaagctgacaaatcaaggggaataagtctcaatcaaatttctgaattacaatataatttaaagaccataatccaattagaaagcaaagaaagaataaagtacctcccttcagtaatataactgccttactaccatccatagttgcattaacgcttaatgactgctattctgaatgtacatggtaaataatgaaacaaaattaaggaaggaaacaaggcgtaagtgttctctaaagtgcattatatgtgcaaaacgtaaacgaaaatcaccatgatgtatatagcagcctcaatatcatttcagagtattcaaagcaattttaaattgattaactaaattttacaattataacccagtgaatatagtaggtgagaaattatcacccccattttttttaaatataaaagaaattaagccacttccataaagtcagagagtgagtagtggcagggccaggatgaatatttagggtttcaaggtcctagttaagagttttgaataaaatcagaaataccataatttatccaacaaacaatgtaaaatgactgacatatcagtgtttgaattcttatgtctgtatgttaatcaagatttaagttggccttaacttcactaaatattcctaaagtcattcagaaatggtaataaaagaaaacatatggctgttataaacaaaatcaaaaaagaaagtaacaagagttggtgagtatgtggagaaattgaaaccctattcatttctacttaaatgtaaaatggctcagccaccgtggaaaatgaaatggtgattcctcaaaaaattaaatacggatgtaccatatgatccagcaattccaactgtaggtgtacactcaaaataaatgaaagcagggaccccagcatctatctgtacatccatgtccatagaaggattattcactgtagccaaaagatggaagcaccaaaatgtccattgacaaatgaatgggtaaatataatgtggcctatacatataatgaaatattattcagcctaaaaaacaaaattctgacacatactacaacatgaatgaaccttgaagaaattctgctaggtgaaataagccagttacaaggagccaaatattgattccacttatgtgagatacccagagtagtcaagttcacagaggcaaaaaatagaactgtacttgccaggggctggggaagaatggggatttcttatttaatgagtacagagtttcagttgggggagatgaaaaagttctggagttggatgatggtgatgtttgcacaacaatgtcaatgtacttaacggcaatgaaacatatacttaaaaatgattaaaatggtaaattttgtattatcatattttaccacaattaaaaagcaaacaaacaaacaacttgtcctgaattgtcctgagtataaggtataagaagtgactattaaagccagaggtgttccatttgcataggaagagccagcaattccccaataataaaaaacattagttttagaactgtattaaggaagagggagttgagatataactgaggaggtacagggcgaggaaaaggatagagaaatctgatgaaaatattctaggactgtgctgcctagtatagcatccatttagccatatgtggccactgagcacgtacaatgtagctagtcctaattcagatgagacataagtgcaaaaataaacactacaggactgggtaaaatagggaggtgatgacgaataagaaggataaggctaatttgtgtcagagcttgctgaattccaggccagaaaatttaaaccgtgaacatcatatatatcaggctcaatatgatagcaagtgaagagttaatatacttagttaattaagtgatatgatagcaaatgaagagttaacgtccatccgacatgagtgtataaagaaaaatctattaattcctttatgtagaaaaatgtctaggtttacgtgatatggatacaactagtcagtatagtcaagaaaaatcattcaaactgaatctcactgagtgaactctgtaaggaatgactggcagcatttgaaccttttttttattattatactttaagttttagggtacatgtgcacattgtgcaggttagatacatatgtatacatgtgccatgctggtgcactgcacccactaactcgtcatctagcattaggtatatctcccaatgctatccctcccccctccccccaccccacaacagtccccagagtgtgatattccccttcctgtgtccatgtgatctcattgttcaattcccacctatgagtgagaatatgcggtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatatgtctgcatgtgtctttatagcagcatgatttatagtcatttgggtatatacccagtaatgggatggctgggtcaaatggtatttccagttctagatccctgaggaatcgccacactgacttccacaatggttgaactagtttacagtcccaccaacagtgtaaaagtgttcctatttctccacgtcctctccagcacctgttgtctcctgactttttaatgattgccattctaactggtgtgagatggtatctcatagtggttttgatttgcatttctctgatggccagtgatgatgagcattttttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgactaggttgcgaaaattttctcccattttgtaggttgcctgttcactctgatggtagtttcttttgctgtgcagaagctctttagtttaattagatcccatttgtcaattttggcttttgttgccattgcttttggtgttttggacatgaagtccttgcccatgcctatgtcctgaatggtaatgcctaggttttcttctagggtttttatggttttaggtctaacgtttaaatctttaatccatcttgaattgatttttgtataaggtgtaaggaagggatccagtttcagcttcctacatatggctatccagttttcccagcaccatttattaaatggggaatcctttccccattgcttggttttctcaggtttgtcaaagatcagatagttgtaggtatgcggcattatttctgagggctctattctgttccattgatctatatctctgttttggtaccagtaccatgctgttttggttactgtagccttgtagtatagtttgaagtcaggtagtgtgatgcctccagctttgctcttttggcttaggattgacttggcaatgcgggctcttttttggttccatatgaactttaaagtagttttttccaattctgtgaagaaagtcattggtagcttgatggggatggcattgaatctgtaaattaccttgggcagtatggccattttcacgacattgattcttcctagccatgagcatggaatgttcttccatttgtttgtatcctcttttatttccttgagcagtggtttgtagttctccttgaagaggtccttcacaccccttgtaagttggattcctaggtattttattctctttgaagcaattgtgaatgggagttcactcatgatttggctctctgtttgtctgttgttggtgtataagaatgcttgtgatttttgtacattgattttgtatcctgggactttgctgaagttgcttatcagcttaaggagattttgggctgagacaatggggttttctagacatacaatcatgtcgtctgcaaacagggacaatttgacttcctcttttcctaattgaataccctttatttccttcccctgcctaattgccctggccagaacttccaacactatgttgaataggagtggtgagagagggcacccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaatggtaccagttcctcctcgtacctctggtagaattcggctgtgaatccatctggtcctggactctttttggttggtaaactattgattattgccacaatttcagctcctgttattggtctattcagagattcaacttcttcctggtttagtcttgggagagtgtatgtgtcgaggaatttatccatttcttctagattttctagtttatttgcgtagaggtgtttgtagtattctctgatggtagtttgtatttctgtgggatcggtggtgatatcccctttatcattttttattgtgtctatttgattcttctttttttctttattagtcttgctagcggtctatcaattttgttgatcctttcaaaaaaccagctcctggattcattgattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcgtcccagagattctggtatgttatgtctttgttcttgttggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttccaactatgtggtcaattttggaatgggtgtggtgtggtgctgaaaaaaatgtatattctgttgaattggggtggagagttctgtagatgtctattaggtccgcttggtgcagagctgagttcaattcctgggtatccttgttgactttctgtctcgttgatctgtctaatgttgacagtggggtgttaaagtctcccattattaatgtgtgtgagtctaagtctctttgtaggtcactcaggacttgctttatgaatctgggtgctcctgtattgggtgcatatatatttaggacagttagctcttcttgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcatgtgagatgggtttcctgaatacagcacactgatgggtcttgactctttatccaatttgccagtctgtgtcttttaattggagcatttagtccatttacattgaaagttaatattgttatgtgtgaatttgatcctgtcattatgatgttagctggtgattttgctcgttagttgatgcagtttcttcctagtctcgatggtctttacattttggcatgattttgcagtggctggtaccggttgttcctttccatgtttagcgcttccttcaggagctcttttagggcaggcctggtggtgacaaaatctctcagcatttgcttgtctgtaaagtattttatttctccttcacttatgaagcttagtttggctggatatgaaattctgggttgaaaattcttttctttaagaatgttgaatattggcccccactctcttctggcttgtagggtttctgccgagagatccgctgttagtctgatgggcttccctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagtgtcttccaacttggttccattctccccatcactttcaggtacaccaatcagacgtagatttggtcttttcacatagtcccatatttcttggaggctttgctcatttctttttattcttttttctctaaacttcccttctcgcttcatttcattcatttcatcttccattgctgatacccttcttccagttgatcgcatcggctcctgaggcttctgcattcttcatgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttcttctctcagctcgtcaaagtcattctccatccagctttgttccgttgctggtgaggaactgcgttcctttggaggaggagagacgctctgcattttagagtttccagtttttctgttctgttttttccccatttttgtggttttatctacttttggtctttgatgatggtgatatacagatgggttttcggtgtggatgtcctttctgtttgttagttttccttctaacagacaggaccctcagctgcaggtctgttggagtaccctgctgtgagaggtgtcagtgtgcccctgctgggcggtgcctcccagttaggctgctcgggggtcaggggtcagggacccacttgaggaggtagtctgcccgttctcagatctccagctgcgtgctgggagaaccactgctctcttcaaagctgtcagacagggacctttaagtctgcagaggttactgctgtctttttgtttgtctgtgccctgcccccagaggtggagcctacagaggcaggcaggcctccttgagctgtggtgggctccacccagttcgagcttcccggctgctttgtttacctaaacaagcctgggcaatggcgggcgcccctcccccagcctcgctgccgccttgcagtttgatctcagactgctgtgctagcaatcagcgagattccgtgggcgtaggaccctccgagccaggtgtgggatatagtctcgtggtgcgccgttttttaagccggtctgaaaagcgcaatattcgggtgggagtgacccgattttccaggtgcgtctgtcacccctttctttgactcggaaagggaactccctgcccccttgcgcttcccaggtgaggcaatgcctcgccctgcttcggctcgcgcacggtgcgcgcacccactgacctgcgcccactgtctggcactccctagtgagatgaacccggtacctcagatggaaatgcagaaatcaccggtcttctgcattgctcacgctgggagctgtagaccggagctgttcctattcggccgtctttcagcatttgaaacttttatgagttgttctggtgctttgcaaacacaatcacaatttcgtaggaataaatctagctgaagtcccactgtgtgtatagggcccactgtttatctaatatacccattccaagtaccataattctgaatgcaattgaaaggtgaggttcatttgggcgatctaaaacatgttcttttgttttgggggggagcttaagaagcctaaacaaacaaaaaataaattaagaattactaatgtcattgcttctggccttttggctatgaacaagtatggagaattactaataccacatagaaaatgggaatcacatgtactttatagtaaaatttattcatgatcttatataaatatcagcactagaatttggagttctgctattaatttctaatcacatactattaagcatttaggggaaacctttagcaagtatgtccagagaactgtctaggctctgaccttcaatagctacatgaattctacaactcttaaactgtggttctcaaattattcttatcctatgccagattaagtttctctcttcctaataatcagatccttattattaaccagaaagattcctagtcccttgatttgtagtagctcgaagtgcaatgtatttcaagagggactttttccatctctttctgttataatgcgcaatattatttcaccaggaatagatttgccatgctttaggaggtgctagaattttttttaaatctcttttttttcttcaaaaattattttcctgtttcctctgtgttatgcactggaggccacttcagctatgagaacaaaatttgatattttagttcttatgataagcagtaatttctagactggaaataacatgaaaacaaaacaaagaaacagaaactccctatctttcttgtcttcccagttccccaatcctgttccacaaaaactcagattcagtggcacttctcatatgaaattggaagcaaatcctctaatttagacaatatgggatgttactagttaactatgtctcactcaggaccttggggcaacacttgtgatatagattttattttcagcaggtatgatgttatagatagtacttagtataaaactgatttaaactttgtttctctctgattgcacttgatactatttttccaacacagtttcagtacccaaatttcaaggatgttcagtgtcctaaagatgcaaggcctgcaagataaataaacaatgttatttccctttcatctggcctgcaagataaataaacaatgttatttccctttcatctggcttttctgggttgtccttgatcaagccgcttgccctctttctattcatttgtcaagtacatagagtaggaaaagaaatatttgcttccctcaccccaggatatttctgagataaaatatcattgctcctctaatgcatgtatcatcataatagttttggacaaatggtaaaatacgatcatgttttgaagaggaagcatttctttttggttcttctgtactctttcttcaaatcaaagcacactcttatttcacttcttttcttcttatttttcctctattctgacttacatttcaattttcttccttcttcttaatgtttctttctattcatgcttttgacttttctagagctatcgtagattgaaacggagagatttaacccagctttctgagtgaaaataaggtagagatttggtgcgagagtgttcctccttattttcagacacaaggacaagcaggtttctaataacacagctcacagtatgtactactttaaagcacagtatttactagaaaccagtttaacccttgaatgtcagcagaatgcacttgtgagatagacagtagttaccaggtgacccagcacagtgaaggttttgattttaacagctgtctgagcatgcactgaccatgtagccatagaaagccctgcagttctggtaacacaaatacaatgcaacacttggtcagaacaggaccataatatattgactctgtgatgatatatggtatttgttctatttatttaattcttgcttcattttaaagtgaaaaatttacacttttagaaaagagaaatgtgaaatatatatcactgagctttgaagtattgtcaaaaacaatccattttctctttgtaggattaggtatggattttttccagggcaagctttctatttaatatttttctattacattcttttcatgggtgcctgtgttgcaaatgcagttaccagaatatgcaggctttccttgccatcgtgatggctcagattcccctatttacaacttctaacattcaacaataacttctattttagttataaatttcttctgaaaaaattacaatgaaacaaagactttcttaaaagtatgaaaaaagtaaaatcttgggcattgctgttatttataaagcacacagctataataaaccgggtgccaagtaccatcctatgagtactctcctattaagcattagtcatcctcataataatatctaacgttaactgagcacttactatatgcctgcacattatacatacaaacagttttttaaatgaccataaaaatagatacttttagtggcctgttttgcagctgagtaaactgaagaacaaagagggtaacctgtccaaagtaatatagcaatacagggcagtcagctttaaaatccatttgagactaaccctggtgcccctgctctaagctgatagcctaacagttgagtatgtgtaaatatgctgaaaaacataaaactgttttgactggtcgtaagtcaaaaccttgaccccaaacctcatggttgtacacagcactttctggaattctactacatctttctggtcaatcagctctctcatgcttcgcaagttacttatttcacaccttccccttgtacctcaagcttccaataccaccttagcccctccacagactcaggaaatagacctgcctgcttttcccttttctctttctttctttctttctctttctttctttctttctttctttctttctttctttctttctttctttcttttctttctctctctttctttttctttctttctctttctttttcttttttctttctttctttcttcttttttcttgctttcttgctctttgtctctctctcccttccttcctctctctttcctttttctttcttctttccttccctcccttcctcccgccctccctctctccctccctccctttctttctctttctttctttcttctcgtctttctctttttttcttcttccttctttctttctctctgttttttccctccctccctccctcccttccttccctccctccctctctctctctctttctccttccttccctccttccttccttctccctctctccttcttattcttcctctttattttccaagacaataaactgtctgactttgcatttcacttagaaaggagaattagatgagaaatgttttcatggcaaaaattaccaacctatggacatctgcccccacgtgttctgactcctgcttgttacaatgcttgcactgtgcagttcttacctaaatctagagcgccatggtgcactcagtcccagcccttctactcagtgttctttggtgtccctctctcctgtgatcccaatgtctgcttatcccagattgttcccatcagtatatgaatgtatgaaatagctttaaaaacaaagaaccctaccatgtaactgtcatgtttctcaccagctccctcctcatttctctacttcctttttatagcagcagttctcaaaagaactttaatattcaatattaccttcttcttttctttgcctccagttatcatttaattctttccattcagacttatttctcactgtttcaccaaaatcactcatgtcaagtcactactgaccacgagttacaaaagcaaagatcaattctcatttagcagcttgctagacactccagcagtgttggatacagttaattatttcctcctttttgacaagatgttttcacttggcttcttgaacatcaatcaaaatagcctagtctttctgcaaatcactggctactctattttattctcctttgcaggagcctccttttccaataaatgttagtgttccccaggagtaagtcagcaattacattcattttcttagcagtgtgaagaaactagggaagtattctccccatttcttgtcacaactatagtgatggaggtcaaggtggtattactaatattctataatgtgagaaagttccacacaatagaataatttttccaaacaagatagtctccccatttgaaaagtagtcatagaacctagggcagtggttgtcaagcggtggtgaatttgccttcagtgaatctttcgtaatgtctgagacatgtttgtttgtcaccactagagaggatgatttgctattggtatcctgaacatagaggctatagatgttgctacatatcctccaatgcacagggaagtgccccacaacaaggaattatagaacccaaagtcccaaaatgtcagtagtgtctgagttgtaataaccagtactaggggattacaagtgattttaaaatgtcatatttaagtagtgtgtgtgtgtgtgtgtgtgtgtgtgtgtgtgtgtacacatttcagcacacagacccattattcgcccagttcatcatgcctaacacctaaaagtcatccctgatttctgtctttatctaacaacctacatccaatccattagcatgctctatcaggtctaccttcaaaataaattcaaagtcattctctctacctctagttataaaaccctagagtccaatctaatactatcttgcttaagatcctggatgatttcactgcaattctgctcaaaatctataatgaatccccatcacattaaccataaaatctaaagtcctgaaggtggttacaagccctcaatttatagtctttcctttctctctaagttcatctcctaccttccattcctttaatcaatccattctagtcacattggctttcttgctcattattaggcatcctcggagtctataaaagcctttggaatctctcagctttgcctgcaaaaaccttgtgccacatctttgcatggtttactactaaatttcattcagattactgttcaaacatcatttacgtcatcttctctaaaaaatttaccttcatcatcctttttaaaatagtcccatatttttttcttggaactaatctctagtgatgttttaaaatgcttgcttatttttaattgcgtattttttacccatttctagacataaatgctatcaagtcaaaattgtctttccttgagtactaactgtgtccccattagtacagtgaaagacgcttagtagatgtttcatagttatgttccaaatgaatattcctatctactatgctacagtgactaactgaagaagtctttggttggagtaaagctgatttttctttcacctttaaagtcagtgaatctttactttatctaaggtcctaaacttgggctgagttccctgaaactgaccaatataaaggtaaaatagatgactttgacacaaatggagcaaggaatactatacggtagacaatatttatcaagctcctttagttaagtgatatttgaataatcaaataataagcctcatcttcacagaaataagaaaaatcaatgaaacagaaaataaaccaagaaagctgacgaccacccttacctttccttgtatatatggtgcattatagagtctagaaaggaaagagattctaaggatcattgcatcagacagttccctaaacttagtgattgtcaaggcatgacccctaaccaccaccaccaacagcaggaacgttaagaaatgcaaattatttggccagctcaaacgtacagaattaaaaattcaggagatggggcctagcaatctatgctttagtgggctctctaggtaattctgatgcacactcaacttgtagagttgctgtccttaattcttccatgagaaatacccggatgttctaagaatacacatttgtatctatgtcttgcctctgcagattctaattcataagaagttacacacaaatacacacacacacacaactgattaagtaactaaattgaataactttaaggaatgacaacgcctatttacacacacacacacacacacacacacacacatcacatcacatttgtagtaggaaaagcatgacatctgaagttaccaggtaacaattctagttttgcttctttctagctgtatacacctaagtgagttaacctctagaaatgacatctttctcgtgtttaaaatagggatagtaaatcttaaccttcatacttccaaggatttagtggctattaaatgatactttggttcagaaagcatgttgaaaggacaatatgccattcaaatggaatataaggtagtatagctgctactaattatcactttatattgttgctgtattcttgacagatcctttgaaatttgagagtgctagcagtaatttttaagtgtcaatgtcactctgtagtggagagttgaacaacctgtgtgtgggaacactggagttgttctgacaaattctgttttccaaataaaaacaatttaacttctgtttttaataaaactaaaacattaaactctataaagaacctccatcgactactagttaccatcaaagacaaatgaaatatgattaatcattttattactacaaatttaattgaattttccttggtcctctgtaatttccaagaagctgaaaggttagactgctgtgttagttaatgcaccattgaagatacttaattgtcttaatagcagatcatagaagggtgtgggaaatttacctaaagcaatttcacacctgaattaatgttacatgggatccttttggaactctgggagaattctaagtgctagtttggaagaaatgtattgccttagaaatgcattcactgtgctatacatatttactataatgagataacaactataacgttgtgaacaaaagcgtctgtatgttcgtttagaaagaaagaaaaagcaatatttgcaatgagggacaaagagagagaaagaggaagaatgtgtggggaagaggtaagagggttgtattaaagactacattcagaaaccagaaaaaactggtttgaataagttacaatggtttgcaggaggaaagtatcacaggctggcagaaacccaaaacacaaaagaaagagttgcagctattatcctttctgtaattaaaacaattactggcagagaggttcttttttgctccatctttctgcttttgtctttcagtatggttgggtccaaaagagaaccaaggcatttatttctatttccagtttattgaaataaaaatatcaaatttggcattagtgtccaccagttggagttttaaaacatcaggactcctgatttgctctgttctttggtgtcttattatgtagttttgaagggattgttattttccttccagattccattttcattgcctttaatttctcatgcaatgccacatctcacagcatttttccaatacaaaacacagtaagacaatgtccattttctaagacaaaatgaaaaaggcatttcatgtttgatctgacagaattctcttgaaaaatccaacttttttttacaatgtctaattttcatattattcctttgaagcaggtggaatttataatagactttatcttcagagatgactgaggtagaaggagataaattattttctcaaaattacttagcaaggctgctctgcctatggagtagccattcttctgtttcttgacttctccaatacacttgctttcattcaaacaaaaattgcttagcaaatcattgccaaattttgacccaaagaattagacacttctgtattcttggttacttgatttctattaggttgctctaagaggtgtcaatttaataaaataattggcattacctctactgacttcatataggaatttaaccctggactaaaacatacctgtcttgatagtagtagggaatgtaaaaatgtaacatatatagtatacttaatttcatgtcagagggacaatttatattacattagattcagtccaatatattgatcacaataatatgaataaatttaaatcatccatggccagatttgaccaaaaggagcttagaaacaccaaattcagaacactgcatctcaaactcaatgccatcagaaatcccctggacagcgttttaaacctatagagtcctaggtcatacataggtttcaaacatcagatcactttggagatttgctctgagaatctgttagcttctaggaacactacagatggttctggtactgatgtttgggaaatgacagtttacattctgctgagtcttaaatcagattctatgagcttaaagcaccaattctaacaaagaaaatggaaaccatgtatatggccaagtgtgtgtgagtgtgtgtgtgtgtgtgtgtgtgtgttagtactgtctccccactaccaaataaattgggagaaataaatcaatattcctttattccaagtttaatacttctgtatggatggctctcaaatgattcttagttatcttatttggaaatatatttatttctccaggtctcagctcttgaagcttaaatctttgcaaagtacacagactttttttttcagaagggaagaaccagatcctaaatactcagccacctgcagtagctgagcaatgtgcttcttgaaggaggagggaggagaaaaggaggagactatattttgttctttgtcaaagagtatttgactgctatatctgatgctaaagggggaggtcaccactaaaacactttacatctggggaagttacttatctgtgctttgaacaatactctgaaagggcagaattgagaatcaggaagcctgtgctattgtccaaaattccaggggaggggacccatgtaagtagaggtttatatgcaatgtacatagtaatgtgcttaaacatcaaggccatctatcagaataggtgaccctgaaacccctcatcaacgctcctgttctctaaacacaggatgagacgtgaaagagtgaagggaaatgggctggtgggtaattattatcatgttatcagtgtaggacttaaccatcctcaaactggcagagcttaattttgggaatcgtgacattcaaaagacaacaccagcaggactgggataaaggcagacatatgtgaaaaacaaataagcaggaaaaaacaaaagaacaaaagcaaaacccaaagccaaaaaaaaccctactttggcttttcctccctaagaggacaattcccttcacaaaggaagggctcatttaccgtgcagtgctggactctgttaggatgttaacagtattaccattggacttacagggttacaaagatgcctttaaacattacaaacaaaatagtcaataatttttttggttaacccattagcagcaagttagctaatctcttatgctatcattttctaatcgttttctaaaagtgtcatctagttatgtgctttatacctgccctatggaaaaatattatcgaaaactttatttatttatttattcacttatttttgggacagaatctttctctgttgaccaggctggagtgtagtggtgcaatctcagctcctggcaaactccgactccctgggttgaaagtgattctcctgcctcagcctcccaagtagcggggattacaggtgtgtaccaccacacctggctaattttcatattttttagtagtgatgacgtttcatcatgtcggccaggctggtcttgaactcctggcctcaagtgattcacctgcctcgacttcccaaattgctgggaatacaggtatgagccactgcgtctgtcctaaaatctatttaaatgtaagttatggctaggatgcctttcatcctatcccttcattaaaaaaaaaaatcacaaataatggaaatagctcataaagctgtaatttattttttcaataattcaataaagaaaatatgtttagaccagttttacatgtaaattctaggctaggttctatgaaggaacatggttttacagtgaagggcttataacgactgccacacaatgtcattgccaaagaactttagaaatcatctggtccaatttttttttttttttttgctgagtggaaataaaccttgttagaattcaccagaaaagaagtgatgcattgttaattctttcttgcctagcttgaacatggcattccattaactgttttatctgattgtttaccaatgtgtttctcatcatatcatgtattcctgtctcaattttgcatgatttaaaactagtttactattcaaattgcatcatagtataaggtttctgctttgctatcactgacttttctgagtatttgcatattcacaggcttacttcagattgaagggcaacatagtacagaggttacgtgacatcagggttcctggactgcaaccccagttctgtatttatctagccctgtggtcttggactggttacttagttactttaaattacgtttcctcatctataaaatgaggataaaaatacagaactattgtgaggcttaacagagataacatacgcaacctggctagcaaatagtaaattgataaactgcatacagaagtagtaagactagtaatagcagtaatggtggcagcaaaaataatttgagtatcccagcagcgaggagaaaggtttcaatgtccagtggattaatgcctgacacaacctcaagtgtacatatctttgatagtaatggtaacctgttaaaatcatttaaggatataatgtataactgcatggagaatcataaggtaattgttcacattttctgtattataaggacatcaaagcacataggaggcagaagagaaccaaccaatttcatgtgtttcatgtcagttacaagagtgtgatgatctccattaatctgcaagaacttttatttctaaggggtagggatatattgcagatttttaaaaagagaagcaattaggagacatttattcaagatcatttactaggtcccactatattgaagttacatctacatctttctcagacctcagactgtagcctgtcttaccagttttaaatggggtttaagaacttgattgttcaagtcagaatgctttggtttcatttctggctttgccaattgctagctgcatgatttaggacaaattactcaatatctctgtgtttcatttttcacatttgtaaatgcggataatactggaacctacttcgtacaaatggaatggaaagtaagagacagtaattgagacgtgcttagaatagcacctgcacagagtaagcatttataaaactgttagctaagattgttcaataaagttagttccctaagacaaaagataaagacatttatagggaatgagaaggtgtttggcctaaaaccaattaagttttttttttcatttttggaagtaattatcatcatattctatatgcttcacacctagagagacaaaaatccttggaagtgaatcaaagtattagtgaatctgatttagaatgcattttttttcccagaacaaaaagaaaatcattctaaaggatcagtcaataacataaagtaaaaacacgataatctaccaaaagatgtcaatcagaaaattaggaaatcagagatattctaaaattaagaggatggaagcctgaagcagagtttttagtgtctcaatacccattgtgccataacccctagtcacagaacatttatttggtatatggctatcaaaaaaaaaaaaaaaaaaaagactacattcttagcttctttacacctaagtgtgactacctgactaggttgtggccagtgcgataagtagcatatggcagttaccatggacaacttggaaagaaaactggccctggcttttccttctgtcttcttcacctctcctctgccctctggctggaataagatgctggttggatcatgggcagaagggcagatccagggccagcatgtgtggttgtgttccgggtgcagtgcacagttgtaaataagccgtagcaaaacactgggagagaggtagtaaaagctggatgcagccaaggccctaccaattggaaaagcacagtaccagctaggatagctggtctctagatttgttttgtgagagaataaaaaactttatatgattaagctgctgttaatatgagtttgtgttgtgtgaagacaaccttaattctaatccatataggaatgtccagttgtacacgtacatgctcatccagacccaagaggaaacttgattaaccaaagtacagatagcagctaaaattaggagggtaggttataggtatatatatatatatatatatatatatatatatatataaaatttttttttttttttttttttgagaaagaatcttgctttatcacccaggctggagtgcagtggcgtgatctcagctcactgcaatctccacctccttgattctcctgcctcagtctcctgagtagctgggattaccggcacgtgccaccacgcccggttaatttttgtatttttagtagagacggggtttcaccatgttggtcaggctgatctcaaactcctgacctcgtgatccgcccacctcggtctcccaaagtcctgggattacaggcgtgagccaccaagcctggcctaggtgtatttttaagtggggtcatgagggtgaagttgaatataaagggcattatccgtaaagggaataaacacaacacgtggatttcttttcttcatactttcctaaattttccaaaattgttaatgaccttgtactacttttataacaagaagaaaatcaatgtaaatgaacaaataaaaatgatgcaataattaagagcataattcatcaaacatttcatttttgagaatccatatatttccctgtgaaaatattacttacttctcaggtaccctttgcttaaccctaagaagcaggcactttcctgcctttattcacactgcacctggaatgtttttgtctgcctaatccctacctctcatctcaaattgcaggaacctggcctagccctgaaggtaagtttaaatattagcttctcaatgatatcttactttttgggaaaataatagcctttttctctgagtcccaatataaatcctatatattgcatcacttaacattttacttttgctctgagtaaacatatgtcacacctctaagaatatcataaagttctctggcgcatatattcttctttgtctttatagttttctattcattaattcattcacatgttcacttttcagacaactgattatcaaatatctctctatgatatgccaactattatagaagacaaagggagatatgaagaaaaataaaacatgttctgttcattcaaagagtgagctaaccatgaataagaggagacagagtggcattgggcaaatttaatgtcataatttctatgggagagaaatgtatgcaatgacaagctgaccgaatgtttagttctacttgaagaaagtcaagaaggccatcatggaagtattgactcttgaattatttttttccaaagactaatagacattttccaggcagatgagataaatggataaaaactaaaggagcaggggtgatgaacaaaatgagcccaataagaatgaaaataggccaggcatggtggctcacgcttgtaatcccagcactttgggaggccgaggtgggcagataacctgaggtcaggagtttgagaccagcctggccaacatggcgaaatcctgtctctactaaaaatacaaaaattagccgggtgtggtggtgtgtgcctgtaatcccagctacccaggaggctgaagaaggagaatcgctggaacccagggggcagaggctgcagtgagccgagattgcaccaccgcactccagcctgggtgacagagcaagactccatctcaaataaataaataaataaagtgaaaatatactgcaggaaagaaaagttcatttcatgtgctgaatacacagcatgtgaagagggtcctgagaggggctaggggctttgaatatcacatttcatccagtgcttggaacattggaagatagtattgacttaaatgtttgcagtcaccgtgctatgtactatgcaccaggcattgtgtacactgattgactgaccatgccatatgagatattcaggggacagcaagcttgactaagccacagagttgcaatgcactgcctcaattttctcatttcctcagacgaggatgctgagccaatgtttaaagtgattataatgtgactttcagaggagaaacaagcttactcagcctgtagtagaaagcttggctgaattcaggaaatgtggttacccaaatgatatgctctcatcctagctaaggaatttctgagggaacatagcctagctgccaaaaatcggtttcctcagaaaaaaaaaaacaaaaaagtttattctaatggtcagtttgaaataaatgaacagagaattaaatgattacgagagaaaaggttataggctcacctgagaaggatacagtgcaatacggtaaatataaaagtatcatttgtttttcaagggtgtatcttgagaaaggaaattattaggtttagaaaaggaggaaactgcatactagatagtaactaccacttcttttctactttcaaaatttttccggcttctatattcaggcattttttttaagtgccaagtatttgtaatagaattttccttttttttttttttaataggaaaagattcccagctactacggaggctgaggcaggagaattgctcgaatccgggaggaggttgcagtgagccgagactgagccattgcattctagtgtgggcgacagagcaagactctgcctcaaaagaaaaaaaaaaaaaaaaaggaagagatactattgtgttctctgaatatttcttttgaatctttcttctgatctgttgcattccaggcaaactctctggaccaaaagggcaagaagcagaattgatgtcaacacacagataagggtccaacaaagacagtcagttggtttcataccttcaataggtttcggtacaaaatgtgatgagggcttggttttcttcactctgttccccttcataatttgaccttctttattgagtcccagaaaccaagctcggcctgattcttgctggcggtacagtgtggaagaatagatcacatagtagttttcaaacacagattccttgaatttgcattctggagtgaaaacatcctgtaggaaaaaaaaaaaaagacacaaaaaagagaaatgatttaaaggtgaatcagcaaatgcttaaatccaataagcttgaaatccatgtcctctgttaagaacaaatgaaaggcaatgacacatagtttctattagcctttggttacaaagattcatcatacaaaatcaaaaaacatgattgcctttctagccaaccttcagcccagagataataacttgctcaggcttgaagctacgttaaaatcattcaggactgtggccaagtctgcgctccgatcctagcaatatgttttgtaaactaaagtgattggccattcctcatttactcacccttaacatgtaaataaggaactaaaatttatcctggaaatcaaaatcaaatataaccacagcaaacacaggcacacaaggtgcttttgaagagactattctgtatatacaaatgtattacacagccacagcttggtcaggaaaatcaccacttttcctaaagtcagtaacttcctctctaatttccttaaaacatttttttccttagtaatcaaaatctcaggtaaaaagcccaggaataatagaaaaaaattactattatattgaagaaaattactaatagtattaattcctattactattgacctcagtgaaacacagaatgagagttctagtctcagaagaaactgtaagatcctgtacttcaactccagcatttggtaagtgagaaaaccaaaaggtcacgtgattaattcaaatacacatttaagaaactactgagtcaatgccagagctcacattcattgcttcacaatcacagtctctcaggctcaccttttctgcctgagtcttgtttagtgacttataatgagatttaaaaatcaatacaataaaatcatatcctaacatgtcacatgaacaaaatgtattgtgtggaaggaagaaatttctccccttctgagatcagcagaagaaaaacaaatgctattgcatcttcttcagctgcaattaaacaggagtcctacatgtcagacatattcaccacagtcaccatcttcctctccatgaactggaagaatttcagtgtgagactcccatgatttaatgcaagcaaacctggaattaagttattaatgaatataggaatattaatgaatataggttggttgaagccatgtccttgtaggtgatactcccatgccaatctccttatttgtagagagtgctctctctctctctttctctccctctctccttttttttctttttctttttgtaagaggtggggtcttgctatgttgcataggctggcctcaaactcccgggcccagaagatcctcccacatcagcctcccaagtagctggaactacaggtgtgtaccactgcacccagcttgtttttgaatagttccaacattatagacgaagaaaaatgagactaagaaaactggagtaggctggggtgtggtagcttacctctgtaatgccagcacttcgggaggttgaggtaagcagatcatttgaggtcaggagttcaagaccagcctggccaacatggtgaaaccccgtctctactaaaaatgcaaaaattagctgggtgtggtggcagatgcctgtatttccagctactcgggaggctgaggtgggaggatgacttgaaccagggaggtggatgttgcagtgagcagagattacaccccacactccagcttgggtgacacagtgaaatggatctcaacccccccttcaaaaaaaagtccaagaaaacaccccccaaagaaaattggagtagaaaggtggttgtagatagtaagataatatgaatagcaataaattaatattatgtttatattaatactgaaatatgatttcttagagtactttgagttttaagtaaatgaactactagcttaagaatcaaagaaacaaatgaccatgagatactacttcacatccactataaaggctatagtttaaaaatggacatgacaaagtgtttatgaggatgtggaaaaactgcaactcacatacattgctggtggaaatgtaaaattatgcagaagctgtggaaaataggttggcagtgcctcaaaaggttaaacatacagttgccacacaatccaaaaattccacttttaggtatagttctaagattaatgaaaacatatgtccacacaaaaacttgtgcacaaatgttcatagtgacatcattcataatgtggaaacaacccaaacatctatcaagtgatgaatggataaatacagtgtgatagttctacagaatgcaactgtaataccattcaattataaaaaagaatgaaatactgatttatgtggcaacaaggatgaacctcatacacattatgttaagtgcaaggagccagatataaaaggccacatgtatgattccatttatatgaaatgtccagaataagcaaatccggagatagtaagtactgtagtgattatcaagggttggggaaggaggtgagagggataagggtggagtgactgttttgttggagggatgaaatgttctgggattagataccggtgatgtttgcaaaactttctgaatgtaccaaaaaccactaaagcatgcatacatttttaaaatgtaaattacgtggcattcaattgatatctcaatgaaaaaaaatcagataaaccaggtgattaaagaaagtgagggaaggaatgaaactattgcacattccttgcctggcagcacagggctatatgataacccatgtgaaggaaaactggctcttcgaaggccttgtctcaatattgccaggacagagtttagtcattgccaagtatatggataaaagtaactcagattcaatatagatgataatattaagttctgtttttttcctaggactaataaagtatttttaaaatgcttagatttaggtctgaattttaattcattttcttttaaaaacaaactaattaaaataatcccaaagctttttattatttttttttctcgatctagtccaatactagcaaacagtattaaccctagatgctatgctaaggaactctggaaagttcaagcaatacattcaatgtataagatttcagactttataaagaagttaggaaaaaaataattcctgttttgtgtaagtacatatcgtcatatatgtagatggtgataaaaccttcttccttatgaatgtacatcacagaaacatgtaaatttgaagatagatataaagctgcttagtgatgatagtacaatttggcacctttatctaacaaggtaactaaagctcatgacagcgaaataattgtccccagtgtcataggaagctagcggcagatccagaccctgtgttgaacaacgggctcctcgctgctggttcagtacttcttccaatgccacacattgctttcctactgcatacgcaatcctgcttttgatgccaagcttgatttgggcaagccttactcatattatagaaaccatatcagtgatgtataattactacattgtcatttatacatgagaaaaacaacactctcatttaataaataacgattcttaggtttctgtttcatactcatttaaaattccctcccggaacagcaaaaatcagagatattgcacagaagctggagtcctggggtcctgagccaggaaccgcattaggtaggaaccgggctttgaactactaaattgacaaatgggggatttcttgcacagcatccaggtcctaatcagcaatgaaaagccaagtggagttttccattcagtataattccaacagggctatgcagagtcagaatctgaaaatgaggcagctattaatacctgaccagggcaagacatttccggctggaaacatggcaggagtttgctgcaggcacttgtgtggacacaggcaggctaccctataaactggacgggaaatcttaatggcactgaaccagcttggatagtcattctaagtagaacctttacaatatatgtgcagtttcagtttcaatatggagttgggcatcaaagaatttacattgtatttgctattatgcctcttttttttttgtaatgagaaatcagagccctacacgtggagtaaaaaaaaaaaaaaaatcagggttttccttctggctccacacatattagctgtggattttaggtaagtgattacaattctctaaatttcacattttcaactgtaaattgagttattttaaggaaaatcatgcatatggacacatgttttaaatgtttagaatttaacaacctccaactcattattcacttttcacatagcaggaaaaatgcaatgaatcctataataaggcactcaattctggtttttgtcacatgtttatatctgctccaacatctaggaccttgtgccataagagtagttaaggcaggttacaaatatatagacattttaaaaataatctaaagcttttggtaaagacttagacaatcacatatattcagaaggggttctgtggttataaaatgtgtgttcagactgacaaaaaatctaatgtataacggaaacaggcaggcttggggtcaaaggtgataaaatcccaggccaccttgatccagtgcatataatagaaagcagagtaaataatcagtataataaggatgattttgtttctttcgtaagactaaccagtagtcatgttgtatctcatgagtgtttctttttcctatagtcttgagccctcagttcaatgtaggcatcagagaaaacttatagaaatctgctgaaatagaaacacccccgtgttctattctatgtcatgtgtgtagatatgtgaaatgataggtctatttttcacaattattactttaaaacctgcccattcttcaacttccactcactttgacttcagcagaaaatgaatattttgatagtgttccgaaattatttttgaatgctccctcttttatcagcatttgcagaactgagtttttgttctatcatggtataagccaatatttgaccaattctttttcacattccaaatacctgtccaccctagccttgcctcaaaagttaaaatctccaactcattttaatccagatgatgaatgaatgctggaatcctacgtaagcccaacatgatcactcaggaccccttctagtctctccccatcccatgggattccaacctcctctccctagaatgctccctgaccccagcttcatagtttcatactctaccttgattcctctccaacactgaatttcttcctgtttcttctccctgcacatagacaactgtcacacagtttctggcttcttagggtctaccactgcccaggaaaagtcctttcctctctagtcagcctctaactgtgtcagctttggcctttcccaccgccccctcatctgaatggaattccccttaagatataaacaccatcaaggataaatagacagaaatttagagattttaatgaatacttggataaaatgctgtatcttttcaggtttgactcccactgtcaacactgttttcatcacatgctaatttcttgcaatgcccccacttcctaaccctcaagctgtgctttgctcaagctgttctctctgtttctctatcaaataggaccataacagatgctctttcaagactcttcaggttacagcaaactttccttccttttgcttctcatagcatttgatatttcttttagtatttaatgtgttctgtcttgaatcacgatggtttttcttgctcctatagcagacaatgtgagctttagttcacagggacataatcctcttcaatgctttttatgaagccaagcaattcagcgcccagtttattcttgtttaaataaatgtagcaataatttaagtcaaggaaacagcaaaggttatgtggtgagatagaactgattgacagtactgattcagtccctttacctgtatgaacttggacatgctatttaattttgttaaaaatctctttttctattacattaaactgggagcaataattctcacattaaaaatgtttgaagattaagtaaaatgacaaaaattacttcccaaaaatctttgtccttctttcaatatcaagtttttcctacataattagctaacagatgatgtatggtaagtttaataacaaataacaaccattcatttataggttgcaagcaaattttgttcaagatgtaaatataacattgtggatcacataagttattcaagaaaaaatattttccattctgtctccaactaacacattccccttcttattttctattccacaccgttatattatacaacgcccatgcttacatgtttgatttactaataatgtttgtaaaactgtgtaagttaaaagtaaccacttacaaggtcctacagaataattatgtcaagacatcaaatgaacagaatagaaaaacagaattgtccaggacacatggagaaataaacagtaagtattttctggaaaatcatttgaattatctaaatttctgatttgtcattcactgacaattttctccctgacctttggcacgccagttaacctctctgagcctcaacttcctccactgtacactgaagatacgtttactatacagactaggagcattgtaatgatcaaattatttaacagatatgaaagctctttgataactacaaaggcctataaaattatttgagattatttcttttcacagacaactttgatattgtaactttaaaggcttctacattttagtatgacatctgctcagaataaagttcttgaaaggtaaagaatgttatgtgattcactcagaaccgcttttgctcccatgagctttacttgccaaatgcatgctttccaactcaagtaggaatacagcacttggtagcactgtatagttaatataattacacgataccataaccataattcatcttcactctgctctttgcagatccctgtttcctccttactgctctggctgagataacccatgggtgaatgtacagtcaatgagtgaatgctcgttgtactcagccactggtctccttgctgttactgaaacacaataagcatgtcccatttcaaatccttcacaatcaatattccttgttcttgaaaatgtcttcagtaacatattaacatggtttgatctcttatttcattcaggttactgcttaaatgtaactacctcagagaaagctcccttgactaccttacataatttagcactacggccactttctaaccctttaccttgcttttgttttccttcataacttgaccctttctggcattataacacatatgaatttgtttaagcttcttgaaagtagctaccatgattgctatattctcttcgtattctcaacagttctgggaattaaacaacaaatcgactccaacaaaataatttggtgaaaatacatcataaaatctgaattttttcttcctgtatatctctaagttgtgatcaaatgggaaaggcctctttctttcttaggctctcagtttctctaaatgtaaaaaagaaatgccaaattacacaatctcaaatgtcacttttgtcttactttatagctatattattcatattaaatacataatgtattaaaattaaagagcctatataaaatgttgtttcttcaaaaatagagctttcctaccaaagaaatggtggtaatatattattatttaataagcaaacaaagaaaaattaatcagagaaatagactttgctattgtgttagtaattatgactaatgactctccatatggtatgtagaaattattgaattttcaagcatatgccagataaaaaagggcctctgattttggttctatctttcccacttaaaaccccaaatctaaactcttttttttttccagagggagtctcgctctgtcacccaggctggagtgcagtggcacgatctcggctcactgcaacctccacctccctggttcaagcaattcccctgcctcagcctcctgagtagctgagattacaggcgcctgccaccatgccttaatttttttgtatttttagtagagacagggtttcaccctgttggccagacgggtctctaactcctgacctcagacaatccgtccaccttggcctcccaaagtgctgggattacaggcataagccactgcgccaggtctaaactctttttaatgtatataaccaccttctctgtttgctgtgccaccttgtggattcagttttgtgtaagaaagaaaggaatcaaaaacaactggggaatcttccaacacaatttatatccaacaactccagagacagagtcctttcggttattctcactggatatttggctgtgaagcttctgatttgctaacttcattaatggcctttagatggagagaacttgaaaatccttgctataatagctgctactttgctaactctgttgtcacgcataatgatattaaatcaagcaagagaaatattgttttccatcctgacaagaggcaaagaaaatgccaaattacattatctcaagtgaatttttttgaaaaaaaaattgggattgctttgactagaacaagtctaattttataacttaaaaaaaacaactctgcagatacggaaacctttgtctacacacttttgaaataatttttactggaaaactactgagctgattcctctaaaaataaaggttctttgttaacacattctttgcaacatctgacaaggaaacaaggtaaatttataccatcataaaataatgcaacctgtgacgtactggaaatgtaatgttggaggtagatggacacaactactcaatactcaaacccttgatttttgaccttgagcaagttacttaatttctctgaaactcagtttcacatctgtaagttaaggttaattatatcatcactgtaaggttgattttttttttttttttgagacagtcttgctctgtcactcaggctggagtacagcggcacaatctttgctcactgcaacctccgcctcccgggttcaagtgattctcatgcctcagcctcccaagttgcttggattacaggtgtgtgccaccacaccgggctaatttttatatttttagtagagacagggtttcattatattgtccaggttggtctcgaactcctgacctcaagggatctgcctgctttggcctcccggggtgctgggaatacaaccatgagccattgcatccggccaggttgtgattattagactagacaatgaaggtgtgtcaagcatgtagtacctgacttattactcactctccttactcctggttacaatttcaggggaaaactgatatcacaaatgagaatgcagtagcctgagcagcgggcagagaaaagtcactgtagttgtggatccacataacgtgtcatgaggatctcttacctgtgagaggttaattaagattatcttgcttaaggctcaacttggtcatctatatatagagaacacagagatatcagatcacttttctttctctggtagaggaatttggtgccatcaattggagataagtgatgtggtaatttcaggttcttgtcacctcctaatgaggcattataccacaataccactggactcagcctctagccagaagactgtaagtatagaagtgaggtgggagaaagccagtgggtgaggggtatattatattacaattcactattatcatcaaaataacttccaggagcttcaatgttttagagacgacatatctagagcagatattggaggggcagcacaattctccattgaaaatgcctttggttcttaccaagtgaacctgtgcacaatacgtaatcatgtgtcccactatgactgaacaggaaaatcatggcaagatatgtgcttctagtgcctcagcctctgtcttcctttcttgggataaggatgaaagtagggatgttgtcaaatgcacatatttcaatttcaacattcttctgctttttggaaagtcacatttcatacactaaaaggtacgagaaattatcaactaaggctaaaaaatatattttttacatgaaatttcctaacttttaaaacttctgtatcaactcccatgaagtcaaactaactgatatcaaacttaactttccgatgtaagcaattataaaactggacaaagtatatgaggtagaagtttccaggcacttgtcaactggaactgtgggtgtttgatctttgagagaaggcagatacacaggaggtaagcactgtgtatttgcttggctctgtgttggttttcttgctttcttcaagggacagcactgtggttttgtgaagctgaagaggcagaaactgtagttcgagattgctaaggtgacttgaatttgtggagcaaggtgccagtgaaaaagggctggatggaatgaggggcaggagactgtacggagatctcctgtggatcctgggtttacagagagaaaagcacatgctcaggatgagactcttcaaggcccagcatagaatggctgctccaggattgagagctgaatggagatggctgtggctgtgtagggctaggatatgataaacttccgggcaagtcagaaagcaggggcctcactaagcaaagagggcattcaatgaagacctcagaaaggccacaggttcaagttaatgaccacaccctaagtgagcacgtcctcatcccccagattaaagacagaaccaaaacagtcaagacaagacctacacgcacacacacagacacacacacacagacacacacacacacacacacagcatgacaagatcaagaggatttattagttattaatccaaatgccagaacaaaacacacacctgtatcagcagataatgtaatacactctacaatgttttttataaatgtctaacatacaatatcacaaaacatggatgcaagcagcacgatgtaactcatggtcagttacgcagatagtagaaaagatcacaaggtcgcctagatgttaaaattaagagaagtaatttgttttttttttttttttttgacacagggtttcactcctgttgcccagactggagtgcagtagcgggatcactgttcgctgcaacctccactgccccagctcaagcaattctcctgcctcagcctcccaagtagctgggactacaggcatgcaccaccacaccctgccaatttttgtatttttagtagagacagggttttgctgtgttccccaggctggtttcgaactcctgggatcaacccacagtgctgggattacagacatgggccaccatgctcagccaacagataagaactttaaaacagccactataaatatgttctagagaaaacatatctcaatgaaaaaaaagaacataatgaataaacaataaacagcagaaaaaatataaatgatttttaaaacccaataaaaatttaagaactgaaaggaaccatatttgagggaaaatattactggatataattaattataggctggatactggcacatataaacaactcggtatttgtgtgtattatgtatgattggaaaatatcttgaagcttacacaagctggtaatagtgttggctcctgggaagggatttggttggctagggagcagagatataagaaatagactttttttttttctacatgtattattacttcaagtaatgaatttaggggaaaaattctgggtcaagtacaattaatgtactagttaaatatagactacagacctccaattactaatagggttttatttcaaatcttataaaacatatattctgaagtgcaaatttacttacccaggctcacaaaacaaagatgactataaggatataccataagttttcctaatcccatataaaagaatggccccttcctctgaaaaattactgaaggaagaaaatcaatgaagaacccatgaaataggcaatctctaaatggactcgttgagtataggagggaatgagaataaatatgtttacttaccccatcgtctatgtcctgcttagaccaccagaactacactggacctcagtacaagggatatatattaaagcaaacaaactcatcattctttgaactctactcgcttcatttttcagtattttcatgactcagatcaatcccaacatccagggggccctgaaattcctcctccaacactacctaattttctaatcaaagctggaatgaaggatgtaggctctccagaagatgatgacatttcacctgcgaatatgcagtaaagggcttttattgggggtcttatgttcctgtaggcatgacataaaattatgcctacggccatggggaagaaacaactccagaatttgtttgtgttacttgtttgctcattgggtttaaattatacattcatctaaacatagacttcctgcaggtgattacaatgctcagtgactgaaacatttctcagtgaggagagactataatggtcaatgaaggagaaacgtggactgggacgcagcatgtggtgcagtattgctgagatattgatgtgagtacagcagacacctcaaatcctttttatggatctggagagcatgtaagattttttttttttagaaaagcaaagaagccccaacaacatgaagatacccagcagtgagtaggctgagatctgacatcatatccttagcagagctagaaacgcacatctcacaggtgttttctgctcagactcaatcaagcctgcatggactgtcactccagccacgttcattttaacagcctaaagagtaatctgctagataaacagttctgatggcactgaaaagccggggctgtgtttttgaaaaaaatctttgctgcaatgcttcttgctgtgatggtgtgtcctcagaatgagaatgcaaagtaaacacctgcaccaccaaagaagaatgaagacagagaggcctggttcactttatgctttatttctaaagtcccaggaatatcatttacctgtatcatgttttggatatactaccatttggacaaagagatcacaagtacacttgtttaatttcataaaaggtactaaaaagaaagttcataagctctgtcctcatcatagaatccttgaaatctaaaattgcaaatatgtagtttgactcttcactttacagatgaagaaagcaaggctgagcaggggaaggaattaacccgatcaagaccatggcgctaaataacagcagaataaggattagaacctgctctccagtccaggggtctgccctctctttgccacagtgggtgctttgcttatgatttatgcgctttcgtagattaagaatgattagctaaaatagacttttataatccaggcatggtggctcacacctgtaatgccagcactttgcgaggtcgaggtgggcagatcacttaaccccaggagtctgagaccagcctgggtaacatgacaaaactgtgcctctacaaaaacatacaaaaattacccaggcatggtgacaggtgcctgtagttgcagctactcaggagactgaggtgggaggatagcttgggcctgggaggcacgggttacagtaagccaagattttgccactgtatgccagcctgagcaacagagaccctgtcccccaaaaataaaataaaataggcttttacttttaattcagcatattttccattaatcaaatgactgaccaatgtgcttcggttaatataatagttgttttcactttgcttaccgattagagtgaattctctgcttttagacattttggctgcaggtaggaagttatttgctcttgattccataaagcagacactagtaatgtaagagctggcaaagggcaaaaaagggtgattctttttatatgaacaggataaaaccagagtaagcttgaccgatggtctgaattagagatggtgaatggagaaaatactgtatttttcaaagtagaattgccatgtgtgggcaaagggaacaatgggtgaaaggtcaggggaaggccaatccaactctgaaaatcaatagccgtactgctacctaatgatgctatcaatgcacattttgagttcatttgtgattcagaacttatgatttgatcctaaagtaattttctctagcaaactgaaagttggcaagtgccttcctcaaagcatctttgcagaccctacaaaaatggtaaagaaatgaaatcgttctccaaacgtgttttatctaccaattttcccatttacagtgttggattacaaatccataaaaagaattcagatatatgtggataatttacattctctatctttaccaccagattgctaaatcacctcatatatgtgcctccatctcattagggtacttgatatatatcttatcacttctcacagatttcattacaatttatagttatttcatttgttgttactactgctgtgctttcacatgtggcaattcctcccacctatatctgcaaatccaaatctctcctggtcttaaagatctagttcaaattcaactcccttcacaaaattgcctctgatcctgtcatctaaaattatctctttctcttctgactcccgtcatagctatttatctgtggctgtcttaacataatgatcactttgtattacatatcatgtgtatttgcaatgatgacatactatatagaactcacttgagaccccggcctctgtcttatttctcactgaaataagatacttgcacagtagctggcatctgacacccagtagctcctccataactgtttgtaaatgagctaatgaatggaggagtctagcctgttccatgtcgggagtagtttgatgaaatagcccttgtaacggcttatgaagcctattacagatagcttccagcagtagactttctacaaatcaacatagctaacaaaattcagaacttaactcaactgtttacattttctttttttttcatgaattttttttttaattgaaaggtaaaagttatagctaataggccaggcgtggtggctcacgcctgtaatgccagtactgtgggaggcctaggctggtggatcacggagtcaggagttcaagaccagcctggacaacatggtgaaaccccatctctactaaaaatacaaaaattagccaggcatggtggtgggtgcctgtaatcccagctactcgggaggctgaggcagagaaatgcttgaacccaggaggcggaggtggcaatgagccaagatcgcaccactgcacttcagcctgggcgacagagcgaggctccgtctaaaaaaaaaaaaaaagttacagcgaataattaatggatcagtagcctaaaaaataaccatttaatttttcagaaaatattcactcattggtgaaagagagagaaaaaacattaaaaaaatataaactgaagcatacaatctcaagaagcctataatatgagagaataaacacaggtatgattcaacctcctcttcacattctatgttagtttacaaaagatagtgattttatgttgagtgtaagagatactatttttttttcttgaactgagaaccaattgtgtagaaattcaaatatatgttaacttgataaatgtcattaacatgtatgaaccaaagcaaacagatggtattctgggacctggagagtataaggaaaatgcgaatacttcttttctgatgttaatactttgagaattacatgtgaatcacttaagagtaaatccattgttttgatacattctaaaatgtcagggttcctgttcagttcatgactacgtggtgccaccatcttgcataaagccttagacaaatgctgtttgataaatacttagtgacatgtacatgatttattcttatatatgtggttgtgcacatagtaagcctactagaaagaaggctatctacttcctttctatagactcattctattaaagttatttttcaggaatatcgaatgaataaacaatttcttcttcagatcatcaactacaaaaaccatcagttcattttctcttacatttgtgtgtgcgtgtgtgtgtgtatactgctactttatttgaaaggagaataattttgattcatttcctgttttgattttcatgctcttgcaaaaaaataaaataaagaactgcgttggcagtttcaagaacaactgaaaaatctattgtttagtatgagtcatgtctcctcttgaccttaaattcttttatctgcctaaacttcagttttgaagtttgaggttcaattgttgataagcagttagtatttgattttggttccccctgaaatgtaccaacacactcaaacatagtctgctcttttcagatattttgcagcttggcatttttaattctcttctccttagtagaaatctgtattagtacagatgaagctgaaaggaagcttggaattcttctaattggaatttcatcattttataaaaggaagccaacctcactactgtttctgttctcttaacttgaagccaagtagcagaggggtcacagcatctcatcagtttagcttgtattcaacatgaatagaatctgaccattttccctaatagaatcagcatgcaaatttctagcattcaattttgaaaagctgtatttaaaactactgtgtgggagagcagaacaatatgtgaaggagatattatgctagagtcgacgagttttagtttctgacatatatagtctttttttgagcaaaggcaaaatttatatagtatatcttataatttatcataaacaggtcagtaaaaccataagcatatttttgcctgcattctcaacttccacatatatttttaatgtaaaacagctataaatgagccagtccaggtagaaagagaaggttaatgtgaagttgaccaaacagcatttgctatttaattacacgatagacactaaaataattatgtaattcatgtagtcttttagctaacacttaaatcctgtccatgttctaactggttaatgataaagagattaataaacagtttttgcagtcaaagaatttgccatactgtgaggtataagattaagtgataatgcttccttcttgaataagaatcaggaccaaggagagcttcctgaagaggctgctttggattgacccttgaagaatgtgtaggaacttggaagcaaatgaagagagataaacgaaaggagagagagaaataaatagaacagatggaaagaaaaaagaaaaaagagaaaactaagaaaagaaagtgaaggaaggtgaagaaaggaaagaaaaaggaagggaagggaaaaggaagaaagaatagtaagttttcctcgacatggggggtcaactgtggttaccatatcacggaaataaacagtagcagatctatgtattaggaaatgagaacggaaagacaagtgaggtttagaaagtggagacattcctattctagtcccaggagtttcagagacattccagtgaaacagagagccaggaaagtttcctaaggagagtagtggcctcatgtatttattcatcaatgtattattttattaatccaacatcaatttataatattctaataatttcataatcatgtgattctaagaatgaaatctagaattcaaagaggtactagtgagacagcttgaactaaaagactgtccaatggcaggaattctaagcataggacctccatactctttgctccacaaaactcagcacatttcaaattatgttattctgtcctctttacaggttaatggggattacagattgaaactacgcacgtgtttttgtgtttccattttcaggttgctttcctgaggtggtacttaacctccaattagagaatgccgccactaggtggcggggtggtgacttggttccaagaggctacagttggtgggaccaagaaagggagggttatgggtcccatgattcttatatctatttcattttttctttcaaaaactgcagtggacagttgagaaataagcttcgataataagtttttagaaacaactaagtgtgtcatgtgatacctggatgacaatacattgtctgagaaatacagtaagacaaatgaaaactctgggctttgatgcaagacactgagtttcaattttgcctgtgccatttattagttgaatgaaaagcagaaagttccttcatttctatgagcgttggactcatttaaaacttgaatcatcatacttatttcacaagtctgttagaagacaaagccatgtggtgcaatgtgctttgaaaagaacgtgggtaaccacctagatatgatccacaaatatgcctgatccaatcccaagaggtttttcaagttcacaacatttcacatagaaatgtaatctctaatttcttatgaaaaagtctgaagttcaggtaacacttcatcttcattcctctgtctaagaattagctggagttacgtgacccaggctcccctccctacacatgagtgtgctaacacagatttaggggaaacttgcctgggactccggcacatcaatgtcaaagaactacttgacatttcatgccagccgcagcttgtaggcttcctcagcctcggtttcatggtatctccagtcctgtttaagccatctaaaaggggcttttttgatttcctttgatttatttattctcctttcttcctttacttcccatacttggaggaatccaatggagaaagacaatattaattagataatctttaagggagtcataccctctcctgtgacataggcatgcttctcagttccaaaataacagagaaatttgacctctccaaacagaaattagctggcgactgaatgcatttatgttagattaaaaaatgtaaagttgacgcacctctctcctctctttgccgtctgttacaaactaaactgtgccttctctcaccccaaaatttttttgttgaagccctatcctcccggtacttcagaatgtgactgtacttggaaataggacctttagatgaagtgaaatgagctgttagagtgggctctttccaagctgactagtgtctttatcagaagaggaaatttggatatgcacagaaacaccaggcatggtgtgcacagaaaacagccacatgaagaggcaacaagagagtagctatctggaagccacagagagaggtctgagggggaaccaaccctgccactttgaccttgaacttccaagatcaccataaccacgagaaaatttatttctgttgttgaaaccattccgtctctggtactctgttatggcagccttagcaaactaatataccgaccaaagaggattctggtttggctacccagtccctccctttcctctttcctttgagcaggatgttttaaggacttttgtgtttgacactcaggagcaaggggggatggtgggggagactatgtgaaacatagaaggtcaaggtggaattgtccactttttaatggatcaggacaaattgaaaaaagcatggaagcacttaaggtatggcacatagtttatgagagctaaggaaaagtttttttaaagttataagaaatataaaaaattattttgaaattatgttgcatagactttgcatttttatataacttctctaggatcaaacacagtggtcaaagctttatagttattatataacaatacatcttcccataacaagcatacaaacaaaaacaccttttataaattgcaactagtatgaagttttatgtttcaaaaattccttatgtttcaaaaactattttaaagggcaaatgattaattcattgaaaatattttaaagcatccacattttagaagaaaatttaatgaattatttaacagagctacaatattctttttatataaaccaactatacattgataattaaaatctgacaatctgtaagcccaatactctttttttttttttttttttttttttgagactgagtctcgctctgtcgcccaggctggagtgcagtggcgggatctcggctcactgcaaactccgcctcccgggttcacgccattctcctgcctcagcctcccgagtagctgggactacaggtgcccgccaccgcgcccggctaattttttgtatttttagtagagacggggtttcaccgttttagccgggatggtctccatctcctgacctcgtgatccgcccacctcggcctcccaaagtgctgggattacaggcgtgagccaccgcgcccggccccaatactctttttgaattattctttataaatctcaataggtcaacatctccccatgaaaagaatcagaatacaaatgatgtgataatgctcgtgaaatggtctttcaaattataaagtatcacgtatgtgcaacggattattatttatgacccttatctgaagaatgatgacttcttcaaaagaatattcattatttctgtcgatttctttaggctatcctaagagtgagcctaaaagaaaacaataatagatcttgtataattagacaagatattgtaaggacacctctgtaatttttcttgaaggtacatctttcccatcagtacttttagtattggtgactaccctgacataatatggagaagtattttcataagtaaaataatgaagttctacaaaactatgaggacaatagaaagatcagtggtggccagggatcccaggggaaaagtcaggtgaatccatgaaaaatagaaaatttttagggcagtgaagctactctgtgtgatactataatggctgatacatgtcattatagatttgtccacactcgcagaatgtaaaaaaccaagagtgaaccctattgtaaactattgactttggttgataatgatatgtcagtgcagggtcatacattgtaactaatgtgccactaatgcagaagatgctgataatgtggaggctatgcatgtgtgtttcagggagtatatgggatatctttgtaactttttctccatttttctgtgagcctaaaactgctctaaaaatagtctttaaggccaggcacagtggctcacgcctataatcccagcactttgggaggctgaggtgggaggatcatgaggtcaagagatggagaccatcctggccaacatggtgaaaccccgtctctactaaaaataacaaaaaattagccgggcatggtggcaggcgcctgtagtcccagctactcaggaggctgaggcaggagaatggcacgaacccgggaggtggagcttgcagtgagcagagatcacgccactgtactccagcctgggagacagagcgagactccgtctcaaaaaaaaaaaaaagcctttaaaaaactaataacaaagccctaaacaaatagcagggataaagaaagatacacagagtaggggaaaggttccccagaaaataagagaattacactgaataatttttaagttcattttatgtgtttgtcacataggcatgggataacatcgtgtgcctttcaacacactaagcatacaacagtggtaaaatctggtgctctggcataaaccttcaggacaaactctagagaaatcattcttcaatctcattggatccaaaaactttaacatgctaaatgaagatctgtcataattagagctggaagtcttgctctcctaactttcacttaatggagaaataataaaattattactagcttcatacttttcttacaagttgatcaaaatggaactatttagctgttgattatggactttttggtagaaagggaaattatctttctctcattgtctcttaggcttacaaaaatttataagtattttattttattcaaattatatatacacatttacacatatacttttcatagaagaaaatttgtaagattttttgttcaaatcatatatgtacatataattatatatgataaatatataattatattacatataataaatatataatataaatatataattacatgttatatataaattatatatatacacacacagtggggcaggaaacaagacagatcttcgcacttgaaacaggtttttaatataactagtaataacttttttcttctctccacacttttattatgcattctttccctgtggaattatagaatcacagtattttcaaacttaaaagggagaacatttgatttttacaaagaaataggtcctgagtgagacaatgaaaaataaaagaagtgtctttaattctatattgttgcattaagtctgccttcaacaggtatttatgaatacctgcagttattttttattcatataatacatcagcgcatacatagcatatcattgtgtaaatacagcattgagatgtttgttattttaagtaggaagcattttgcatcatgaactgtcaataaaaatgaaattaatgacaatatataatcatgtaagcagcagtgtcaagaatacttttagcacctatactgagtgaaatattgttgctgtaattgtctttttgggaggtaggaagaacatagagcaggacaagattcgatccaggtagaacagaagttgggtatcagtggtctgggttctcaagctcacttctttcagagaccaaaaaaagtttcataaatgccatgtgtattcttaaatattctaaatattttaactctgcccatgatatggtttgacttacttcctggtctcgcttgccttgctctagatctgttctggattgtcaatgttcctattaaaatatgactccaataaaggaatacatactttagatataatctgatctgaggtgacaagagaacaacttcaactcttatgccttggatatgatactgccacgatcaccccatcactgtcttggactccaacactggactgcacagaatactcagaagggtgctcattttcttctacaggtaataaaggactcactcctcagcagtgatccaagtttcttttccttttaagtaggttctcataatcagcttcctttatcagcagccctaacattataatcatcaaatttatttgacattctcttaccaaacatacctcttctcttgaagattaatgattagagttactttggttaaaaatcaagtatcatttccagaatacactctatagtctcaccctatgtcatcttccattttcaacatcactggtcaataacatgactctatacctatcttggaatgattccccagtccttactgaaacacttttaaatactagaaagcagccactgtcttcttttttttttaaggatatttttattccaaatgcattataatttgtatatgtaccatcagcgtgattctcaggaatacttctggcctgtcctacaaagcaattacagtcggctcatcttcgtgtacttgagtttgactgtgaataaatagctttctcaacttttctttctaccaaatatacatactgggccagcagggatgtgtagtatgtagaaaaaataaaagcaatatttttctagctaaaacaacgtcacttctccaactcatacagccctgtatttctggtcctaacataatgttcaaaaataaatctgagcggttttaaatgtaggcacatattttataaaatgcatagctttctattccttcaagcagctgatttatataaagcagaaatccattcacataggtcagaaatttgtaaaatgtatgacaagagatttagctcattatgcttatcttgtggtctgcccaaattgttaaagcttgtgcctcaaagtatgctgagcctctttggcacactgacccagtgattagtattttctcacccagtgcaaggataatgcatacctcagaggatcaggtggtaactaaaatcattgaatcaggctgagtgagagctatgaaactctggagattctcatttctccacttacaaaatgaaactgtggcttagagtctaattgacactgataataccatagagctatacattcatattactctggatgaaattttcattcacagcactaaacatctgggtatttccacatggacttattttcatatatatttagatgtttgacaacctaaaaataaaatagtatatacctggtggaatttttctttctgtccatgactatcatatggatggattcagagtgtgtcaagtttttcctgataggatactcatagaaatgtaactttattaacagtttaaaaaccaatactatctttgaaacattgtggagtctattcactctacctaactataataagactttttaaatgtacgcttttttagtaaggaatttgatcatttttataacatatttttcagatttctcaccaataaaaaattaaaatacagtgcaaccaatattaaatgttaaggcttaatttaactaatttatatagcaaggatttacaagatacctgctttgggtcagatatcgtgcaaagggttgtggtaaaagaagcatgctgactgactttgtcctcaagtggtttacagtttaatggagaaaagcatctccaccaagtattctgtctcccattgtggttgtcttggagccagaactaggatgcagattggcagtcctatacgtagcccggagggcccaccaattgcttacctctttcaacaaaggcatcgtgaactctcattttgaagtgggaacaaaacaaattttttttatatgtaatgtatcattggccttttgtgttatttttcatgaggattttatttcaactaaagtcgttaccatttaaatgatcaaagagaaaagtcagagtccatgatttttgttacacgtttataatgacagatacagttatacgtatttatcgtgtacaacatgatgttttgaaatacagtcatgcacctcaaaacatttaggtcaaaaacagagcacatgtgcaaatggtggtcccataagcttgtaacactgaagtttttactgtaccttttctatgtttagatacaaaaacacttaccgttatttacaattgcctacattattccataaatggacaggtttgtagcctagcggcaataggctgtgccacatagtgtaggtgtatagtaagctataccgtctagttttctgtaagtatactctacgatagtcacacaatgaacttgcaataatgacaaatttctcacaatgtatccccattgtaagcaatgtataactatatgtatatacatatacacatttcacaatgtgtgtgtgtatatatatgtatgtatgtgtatatatgtatgtatgtatgtatgtgtgtatacacacacacacgcacacacacacacattgtgaaatggttaaatatacctaagtaacaaatgtattacctcatctagttatcacttttgtggtaagaccacttaacatccactttgcatttttcaagagtacaatatgtcttctttaactacagtcaccatgctatagaagagatctcttgaacttaactcctcccatctaactgtattacatacactttgaggaacatttctccattcccccttcccccaaccaccccagcctttggtaaccactattctattctctacttctatgagtttagagtttatagattctacatgagtgcgataatgtggtatttgtttttctgtgtctagcttatgtcacataatataatatcctccagtttcatccatgatttcaaagagattggcactcccatgtttattgcagcactattcacaataaacaagataatggaatcaacccaagtgttcctcaatggacggatgaaaaaagagtccatcaactttaaaagacacaaaagactgttccaaatattaccttaaaaattgagatttaaaaactaatctgggtaaatagcacattttttaattccttgggcaaagtttttaaatgggagtgttagaacacaacaaaatgtaatgctctgaaatgtaaaagatcattataaacaatagagaggtgagatgccacttttcattttttagccaatacttagagcttattagataagcatatctgatgggacagtagagctttttaattgcctgggagacaaaaaaaaaatcccatctatgccataaagctgtttagcaacatgtttggctgtaaagaatgtgaaatgtagataaaattaataactaaaatattctagggtgtaaatttctaactttccgtcaaaaataacactctaaatgtgaaccatcaaggtagacgtgacagcattttgtagcattctttccaccatttaaatctatttagtttttgtgtgtgacaatttgacagtcttgagcatacaaatgaagacacagggtaaaattatagattcagttttcagagaccatatttgcaaagacaagtatttttttttttcagcaagaaatcaactaagcagtagttacagaaaataacttaataagacagtgaacagaaaaccagtatctacttaacagactcaggaaagagatcggttatgagatgcttggggtttctgtttttgttagataagatgtgcagttaccagaaatctaaggaaaggtaagagccccctcaaagatttcccttagaattaattatctaaaaattataatggattactgttcctattgattgcttagatttggcccaccacaatctctgattcggcagtacatgtgcaattttctataagtctttctggaaaatcctagtataaaaatgtatttttagtgatgtttgttttacactctgtattcttctcggtgcctacatgaaactctatagacagttactgtgaacttcaagatcaggcaatcagtttcaaacacgtatcgtgtgtccttctgtactcatttttaaagatgtttaatattcagtgtgaggtttttatattggggataaaacgaagtctgcgttatatgaaatttaattttgaaggtaacgacatttgaactgcagtgttgtgttgttatatctccttttttgtctagcttttataaaatgatctagattaagtaccataaagatcataaggaccttataagtccctctgcatttgaaacagtgaagggaaatgtgttgctttcacatttccatcctatccaaggggcctctacagtgcctgaactcaccaatgaggtaacagatgaagggagaatagtgatggcctttacaaagccctcctgggggccggatgtggtggctcacgcctataatcccagcattttgggaggccgaggcgggaagatcacctgaggtcgggagtttgagaccagcctgaccaacatgaagaaaccccgtctcttttaaaaaaatacaaagttagccgggcgtggtggtacatgcctgtaatcccagctacttgggaggctgaggcaggagaatcacttgaacccaggggacggaggttgcagtgagctgagatcatgccattgcactccagcctggggaacaaaagcgaaattcctcctcaaaaaaaaaaaaaaaaaaaaaaaaagtcctccgggggtcccgagtgccaaactacaaagccaactttttttttttaacttcttctctcacaatatcagcaaatttgctgtcaacaaacttcttaactttatagttttgtacaaattttgaataaaagaaagaccccaaaggatccagaacggtgcatccattctaaaggcagagagctgagtattttgtattctgataaaaagatatgaaaagcaaatgaatcacataaataggattaggagagaatgttcaacttttttatgaccaaaatgttttcaggcacttgaaaattagaagcaaatgttcactgatggcgattagggaattaatggcctttaaaactgacaagatttttttcattgctttagttaatatctattttctaacctttaacctgagtaaaaaagaatctgtacattagattgagcataaaaaccactgagcaaatgaaaaaaaaagctaaaatcagtaataatgctcactaaatttgtaaatgttgaaatgctgctttacctttcatgacctcacttattcagccatgaaaaaagggtgagagaaggaaggcagcaagataatttctatatctgttctctaggtataagtgcctatgagtctaaaatagactgctgaggatattagaaagatttcatgaaaattaagatttggggaatataaaaaagcttacaaatctgatgttctccaaattcctgaaatttgtaattaccaatatcatgacccaactggttagaaatatgtaaataactaaggaatgttttgaaaagtcctaattattacagtgaagaggtaaataaggtcaacatgctagtgtccaccatcaaaaggaaatttcatgttgtttactcagcttctctggacactaccagagacacagctcttagtggcttttaaggtagtttcttcatcactgggcaatagttcattaacagactatcccaaacttatataatcttttcattctggaaaattttacacatgtgttgtttaggttaatcaggagaaacaaagactaatcagaataatctttagtagtaagctaatttagctcttctcagcaccgtttcaaggaagatatgtgcaagatgtgtgaacaaatgggaaagagctgaagtcagtaacaatgctaactaaagttgcaaatgctgacatgttacttcgtctctcttggcctcacttattcataaaatggggcaaggggagaaaagggatgagataatctcagatctgttctatgtctaagagcctatgagcctaaaacagaatgctaacaaaattgaaaaggaaaactaagtagtaagtgtactgagttgtgctcctgttcagtctttttctattcaacctccctaacgtttcactcaaggatagcatttcatgtaagacatacatcataacagttcagatcagatgtcctccgtatttgagatttcttactttcttgagagggaaggagatgattaggacaaagaaacagcattgtctgcaaataccaagtagcttagtgaagccagctaacaaatggaggccaaatgtatatgtggccttctttcacaagcaggccaataaatgtagaaacctcacctaacctgcatttggtttgagagccagtgcatgaagtttaggaataaaggataattatttggccatctgagaaaagctaaatcttgtaagtgggtattaaaagatgcaataaatgatattccttgccaatctgaaaaggcaaaaaataaaaaggtagtctagctgtttatgagatctaactcctccctcctcctcccactctgaaaacagtgaagatgaaagtgattgtatcatacgccactcttacgccaggaaagctcaagaataaaaccatcacagttcagatggactaaagggtattttctaggtttatgaccagaatgattcatatatcaaaggccaatcatatacatgtacttgctcagggattttcaagtcgatttcttagagatgaaacgtactgctccctggctccaggaaacagagcaatgctaaagaggtaaatcaaaacagcaatagaaaggccgggtgcagtggctcactcctgtaatcccagcgctttgggaggccgaggtgggtggattgtctgagctcaggagtttgtgaccagcctgggcaacatggtgaaatcccatctctaataaaatacaaaaaaaaaaaaaaataattagccgggtgtggctgcgtgctcctgtagtcccagctactccggaggctgagtcaggagaattgcttgaacccaggaggcagaagttgcagtgagccgagattgtgccactgcactccagcatgggtgacagagcaagagtccatcttaaaaaaaaaaggcaatagaaattattcatgtttgggaacatgaagatattaaaatcataataaaatgagaatgccaatcaaacaggaataaaaacacttgctgtgtactgtttctccttctccagtttaaaccagaaaaacactagatccaagagataacatgtaatacattaagaaagaaactttcacgtaggaagccaaatatcctcccacattgtttcccccatatgtgtacactaattactggagcatcttcacatgccagcgattatcaaagcctcacaagtgtagactgcagtgtcagtgagtgcttggtaagacagaccaaactccgtcagtaccttgccatgtgatcctggacaagacatacttgtcctctcatggtcattaaaatgggagagggaatggggacaagatgctatctcgactctttacagcaccatagatttagtttctctagcaaggcctatgctccttaagtttatggatgtcacaaagtggttctgtattttatattatttgtcagaagattagtaataggctcccattagaaccagaagaaccaggcttttgtgtgaaaaaaaaaaaatgagtgagtaggctacctcagtactttaagagatggtaaaagtatcctgctttgacagccaggtgaaaaagctaataaaagcacagaaagttttcataaaggggtacagcttcagatgtctccagataatccctctgttaattgtgaagggtcatctgtagggggccactggtatatatctctttactaagttagctggttaacactggatccttagggaatgagatgatgtatgaatatggaaggagtcaaggtgctaagctgtactttatgttctaaatgtgtaatttcctctgctttcttgattgatctctttagcattgtcctgttttctaaagtcaaattttgacacatattggatggacaacagatttcattatatgtgtgggggaatggaaatggaacacaacaactgaaatggaaatattcagaaaggggcaggcaagggcaaagctttatcaagaaggtgtgagtggacacctactctacaggtctttaaaattcatttttatgcatttaattaacacttgccattttacaaaatacaatgtcaatgtgagttatttgacattatcctcaccacatctccatgcagtaagcccagagactacagtttagagaactgatatagctccaatcaggccacacatcttgtaacccgcagagcttgaataggaacccagtcttatattcatccctctctgtataccaccaccatcagcccataactgtggaaactctattagcctaggaactcattaaaatcatgtttacacttttactaacttaaaatcatatttatttaactagatgtctcattagcttattgaagtcattactgcctgtcagtcagagaaagcaaacgaatgaatattcttcataatagaagagcaagcaggactgtaattaatgactttgctaataacagccccgtgtttgtgcacattgattttcagatatggaatatacacataaacctctggggaacaatgttcttctatttaccaagaacaaatctactaatagttattaacaatacattctttaaaaggctttatttctaataatctcttacatatggatgtttcttcaatgtgaattaccaaattgactttgaacaatttatgctgccaaatttttccatttatctcattcagatgacaaaagtaaatacaccaaagattatttctatgcaaaaatgtcttaagtggagtggtatttgagatgggaccctgaaaaaaaaagtaaggtatccaacagaaagttccaatgcagaaggaatgcaagatgaaggaaacagcaaaagaaacagacagattgaggaagtggcacagttcccaagaacagagattggcccggtagctctaatgaaagcattagaggaaagatctaaacagagttttgatgtcaggctttggaaggtcatgagtactttgtctacatgatagcaaaatccaaatatttaaagccacagataactgcccaagatttttgtctccatttgtgtttggtcttaggcacagatttattatgtgcctgttctaattaatgtaggcaaaaacactgttttttaattgaaataagcactttctgttttcatacaacactgaagcaaatgctaagctggaagcttttatttttgtttttgacaacggtttctttaattgtaagggaaaatcaagaaaatatttaattttgtctcatatccgaatagtagaggaaaggccatattgttggaatgcagtgatgggagctctattattctccctatgtgaatttgcagcattagcatctctgaactacgggttctatcaccagaaagttgaggataccagtaattaccactttacttgcttagaggaatacaaattataatgtatatgacaaggctttgcaacttaaaaagtgctataacacagtgagcagctctctacgtgaagctgataaagactgaaaaaaataaggttaagaacttgtgattattttatatttattttctatatttctagtgcttgctcctgatatcaatgaagaaaagtgggaaatacagcctgctaaacagtgcttgatggtaaaaatacaatgctaaagcatttcattggctcagctacttttattttcaaaaacttcagtctatatataatattaggaggaaaagactagtcaaagtattgtttagattttttttaaaaatgtacttaaaagcattaaatatttgtgtgtgtgtgtgtgtgtgtgtgtgtacatgcacactaggtaaaaataatgttcttctgtagtttagaggactgatagaactaatttggtattttctttccttataagttgtagatttcatatgcatttgtcttataacctgttttttaccttgacctagcttaatgatccttctaaacaagatattctctagttaaaaggaattagaattatgtgaaattgacttgggaggtaaaactttattttcattcatttgcacatatccttattgaaaagtataaacaaagttaagatttggaaggccatgctaaactcttctgtaaatatcacatgtctatatgtctaaggatttggatacatgttgcatttgaagtagcttaggtgtctctaataaatgagtcagcttacaagcttacactcttttttctttacttttttttttttttttttgaagatagggtcttactctgacaccccaggctggagtgcaacggcacaatcatggctcactgcagccttgacttcctgggctcaagtgatcctcccatctgagacttccaagtagttcagattatagattatagattacagacttccaagtagttcagattattagctgtcacgcccacctaatttttaaaatttttttgtagagacagggttctcactatgttgcccaggctggtcttgaacttttggccttaaaaaatcctcctgctttatacttccaaagtgctagaattataggcatgcatcaccatgcccagcaatttactttctttactatgatttcaattttagacatgtcaggggcctccctgaataactgcactttttagaaataaaggccagtggttcattggccaaaaagaatttgtcgttaaaaaaaaagcaaatctgtccgatttattaattatgattgtgtgatttgatccaaccaatgatagatggcaaatttcacttttcaatttgtctaggtattagatgaaggtcacccaaaaactgagttggaaaaaaaacttgaaaaggaatccatctaatccatgtcttttagccccacacacggcagatctgagcaaaaagatgaaagaaaattccattttctttatcacagagcaaataagagtctcaacatgcaaagctgtacagcagaactttctctaatgatggaaatggtatacctctgcactgtctaatacagtagacacataccacatgtgactactgagcagtcaaaatgtggttattatgactgaggaactaaattttaaatagccatatttgtttagtgtctactatattagagagtgccactaaatattttagtcacactttactgaagcaagaattgtaaagtgccacaatccaggcagataaatatgctgcattttaataacctgtgaagtcaggttgttgccttttatgcaggtcccataatatcaggagttcactttcagatttgcacttggagccaggagtggtggctcaggtttgtaatcccagcactttgggagatcaaggtgggtgaatcacttgaggtcaggagtttgagaccagcctggccaacgtggcaaaaccccatctctaccaaaaatacaaaaatgagctgggcgtggtagcatgcacctgtagcctcagctacttaggaggttgaggcaggagaatttcctgaacctgggaggcagatgttgtggtgagccaagatcgcaccaagactgtactccagcctgggcgatagagtgagactccatctcaaaaagagaaaaaaaaagaaagtaagaaagaaagaaagaaagaaaaaatttgcactccttggaagaagtatgcacagctctgcttcattatctctgcatttctcttccttagacttggtcactattgattttctactctcctaagtttggactgctcattcctcctaatataaatgctgtctaagcatgtgttgtggaagaagtatcctctgttatcttttgggaggacaaattatgacagccattagaaaaaaaaagattaatctaatttagaaaatctcttagtgtaataggtctttaagtagatttttgtgtggtcccagaattgtagctaaatccaagattaaaatattcaaccttatccaccccacattctaaataagcttcctagaattagagacatctaccctttatagcactttctaagagattaaagaaataccgccaactaccataccatatcctacccccatgttaatataagaaaaggatgagagatgagagagggttttcttggacctaggtctttgagagacgcagcgttcctgaggacaatcaattcccttccctccttgtggattagttaggggaagggagaatatccctcctgcctgaagctaagtgaaggaagctccaagaatattatgcataaaacttaagtgcccagcaagaagagactagcatcttatccttagactgggtgcttgataaacagtagtcctgttggtgtaggcagagtagggagtgcttaagaagttcttgtaaaaatgtgacttgtgccacctcatgttttcggcctttgagaacatagaaaatggtgcccacttctgatgaagagatttggaaatcaggctccctgctataattgattatgggatcatagaggaggccttgaagtggtgtgataagcgtggaagaagatgagaatgccagctattccactccagtctttacatccctgcagggacacagaagaagacctctggattccgcatggctatgcatattgaaggtccagttcaaagaatgtggtgctctacacagaggaggtgttactattgtgcaccattgatggggtaatcagagacacagctccttctctgagagggtcctcaccaagagaaggtcacaggaagttgaagatgactccaagaaaaccatgcatattgctaatatggagacaattacatcacctgaagctttagcagcagacagaaccaggccaatccagagcaatgccatagacatcactccactatcttcatgtgcctttataaggagatctctgcctttccatccttttccctttccctgaaaaactgaaggctctaggcccagaagcagcaacggaaggggaaatctcagagaaccctcttctctttcactctacccaacaaaggatcatagatcatagctctagtctccaaaagggaagatcaatagcctgaaatcagatatgagattaaagttttttgctaaattagaccaagtggttggagaataatagaatctactcagtacgttgttaagcaggaaagctggatttgacaaagtacagttaaaagtaatgacaggaagaacaaaacaaagcgtaataggttcatatttatatccaccaagttgagactgctcaattacaaaagaaatattaatgcacttctgtgtttttggtttttagtccagtttaacagcactcaatctacattagtaaatgaatatttctaaaccatatcacacattttgaaacaaaacccactcatattttcgggcactttttcaaaaaagaaaaaatatattttcgacaagatagggtggatgatggggaccctacctataagttttatttcttcaaaagttgccttgctgtcattgaaacaaatggtgagcaaaacgaagttaacagtttaacattttattaaaagggtgtctgtatccaactctaaagcactgccctgactctcaaccctcctggagggccccctggaagctgcccctgaagcttccttcacactgacctcaatagtgggaaatcttattctctgggggtgaatgtaaactttagagttaggcagaacataatttcacacattttttcatgtattagacatcagtcgtggtgctaagtcttgaggaggaaagatattatattgggaaaaaaataactaggctttggcatcagaaaatgggatcaaatcaaagctataggctttattggcagtctagtcctgagaaagccccttagcatttgaatatccatccattcatcagtgaaacgaaaataatacttcataattgtattgaaagtccttaatgatatattatttgtagagcatatagtttctgggatttagtaaacatccaaatgttatcaaccttcaacataaaaagattatgatgtcatgcctcctaaacttaaaggccagttgtggagacatataattacaataaaatgtaatgagttctctcagatgtgagcagattgctatgacaataaagaggcagatgactaactttccttggaatgctggaacagtgatatttgagctgaagcttttgcagaaggagggattcttcaggtacaaaagttgttggacacggagcgatcccggcatagccaaaggcaaatgcagagaagtatgaaatgttcagtgtatttggagagtggggagaagtgaagtgtggctagagcatatggcatgtagggggaataccaggaagtgttgctggaaaagcagtcagggccaaaatgtgaagggtcatcgatactttgctaaagggcttggcatttatccagcagaggatgaagatctgcaacggggatccagcagaggtttttagcagggcagtgaaatgagtggatttgtttttcaggaaatatttccttggcatcagagtggctgatgaattagagttgagagaaactggtgtcaagacttacagcaacagcctcctacctgggctccctgccaccatttcagacacgctgaagtggaggtgcctgcaggacactcagtgtaaaccacactcacaaagctaagcagaggaaaatcctacttagggccagataaattacagggtaattatttccactgcagaaacattctctgcttcataaaaggattcattttaggatcccagagttcctctaaatagcaagtttcttagtgcatttaggcatccctttacagctcattagctacttgatagaggcggagaaagtcaagaaaatcctaaagatgtactttcaagtgttcttattaaaaatcttcatggatgaaaataaaatgtttgaagttatcatttttcaatgaaaaaggaaatttgatttataaaagcacttcgatgtgatttatagaaactagaataagaagaatgtctgttacgatattccatagaatgcatttcacaaatttcagccaccataactcaaaacactgtagggagtgtgacaatatgagtagtcagattaatagaaatagctagaaatacagctgtttagccactgaataagaacctctattgtctttaagcctgaatctcatacatagttttatgttaagtgcttctctctgtccacagtttctcatcagatgaactatgtcctttgctacataaattaaagaacatgttgtaatttggatattttatatatatacaccaaattataaaagaaaaactattttaatctcattatattgaattttcttgtgaatagatatttcacgagaatacattattaatatcaacggagtcacttccagaatgcaaataaatgtagaataatttcaattttaaaacaaaaaacactgttgggaaccctctttgaggaatgctttcagagcattctttgacctatctttactgggagcaactcctttgtagtgaatttactttttcaaaatagacaaatttcaatttgagccaaatgcttctcagttgccacgtgagaggtatctaacttagctactgtctataagtgtctcactcggcataaagtgtagtattagtgttccttgtagtaccttcagttgaactagttcagagaattccttgttgataaaagcatgtggcagaaactgacaactgtctttcagtattcattcttttctaatgtgtttgataacaacacacgtttttatacttggctacattacttaaaaagttagacaatatttaccattcttccttgtagctatatgtagtcatctgactaaattaaggctaatatgatataaatgaatatatattatgggactttcagaaaagctgatttaaatgagttgatttggcttagaggaaaacattttctcccctacttcttccagctattgccactaccaccaccaccatcatcatcattttcatcatcatcatgaaatgtggatgtaatggctagaattccagcagccatcttgaatcaagaggtgatgaaaattatcaatgaggatgggaaaacagaaaaatagaaagctgggttcctagtgtcctctgggaatcctgtgctagctatggactgtagacattcagatccctttttataatagaacaagcttctgccttgtttaaaccacttttagtttgtttaaagtgaaaattaatcttagctgacacaggttatatcaaaagagaatgtattcttgtctacataaattatcaggataaacatgcacaagatgaattaaggtgaagtgttttgtcattctgaattttctagcttcacaaataatgatgatgcaaataagaatatcccctcacatcagtacaggattttagagataggatacaggattttagagataggaatttttatatctgtgaccacatttaatctttgaagtaactctgtaataaagcagaaggacttccatttcccatacaaacagatgatgaaattaaggttgagctatctgcctcaggtcaaacaacagcagttggtacagccagaaaccaaacgttcttgacttaaaatgtattgctttcctattgataacttgcaggttctacacgtgaacattagtcacatgttgtataccattcactacctgactcacttacgtgctcctttgattaaagataaaaaaaatagctttcatagtttttcactgggcttctgtttttgccatggtgcagtaacagtgactagatttaacttcccactttaaacaaccaaaaattataccatatatgaaacaatgattttcagatgttgggaaacatgcagtgtacaactgtgatccttgagagaaaaaaacatagtgagcattgccccagaaggaaatgtctagacagcggcacagaaagaaagaacacaaacagccaaggagattcactgagctgaggaaacagaaactggatttcagggagccaggggaggcaaggtggctagaagttgggtgtcagtgtatcagattaaaagaagtcagtaatttagacgaatactgacctgcatatgtgtgagaggaaactacccaaggctatgggagaaaaaaaatacacaagaaaaaagccagataattcttggagctcacacagagccaagagtagttcatgtccccacaaaggtggacagacctggtaatatatggggctttggctggagctctaagaagggtataactagtttaataaaattctaggaaagtcaacatagagtacacagaaaagagatggaagaatagaaagttacacagtaacctaggattttatgaacttgaacataaatgacaattgcagcacttctgtttgacctcggtatttgtcatagaattaaattaaatttctacatatcggatatagcaaggaatagagataaaagtctttaccatcgcggagcttatattctaacgagagtagaagagagagacagtcatgtaataaatattatattggaggaaatgagtgctattagaatataaatgggggtaaggtgttgtgagaaagaatgtggcaattttaagaagttcataaattcatcaaggtagatgagaccaaagacagtgatgaggccagggtggctggaggcaacgagaagaacaacaggagagaagtcagagatgtattgatgggttagatcctgtaagccattgtgaaaacaggagagattgcaaggtttaaagcagaggtatgacataatgtctcatatctcgaaaggatactcttcctgttgtttggattaggctccaagggtgcaatggtggattcccaccactaaggaggatattacagtattccagaggagaaggactgaaagcttggatttgaggggcactctggacaaggtgagaaatggtcagattatgcatataattgaaaaaacagagccatgacaatgttcaaatattatatgtgggatataaaagaagagaagaatccaggatgcttttgagagttgtggtggtttttaagcaactaaaagggtagagttgccattaacgacaaaggagaacactttggatggagcatagtagaagagaagatcaatcctggacatgaaaaaatcaatggcggtttagtgtgtgataccacaatattgtgatttatttgtttatttttttgagacggaccctcgctcttgtggccgaggctggagtgcagcggcgcaatctcggctcactgcaagctccgcctcccaggttcaagcagttctcctgcctcagcctaccgtgtagctgggattacaggtgccccccaccacgcctagctaaatttttgtatttttagtagagacggggtttcatcatgttggccaggctggtcatgaacccctgacctcaggtgacccacctgcctcaacctcccaaagtgctgggattacaggtgtgagccaccgtgactggcctttattttttgtaaacataaaaatattgtaaaatattgttattttaacaatacattttaaagaaggtattagatctgctgcatggtcatttttaaatgctttaaaaaagacataatacaaaatagctttccctttcaaataacataataaatcctacataattgcatattttagaagaaataggaaaacacgaaagtttagactcttgctacaaagtgaagtctctcccacattaaacacaggaatgttaaacagcctatagcgttctcccaaatagcccattgtgcaacttgaacaacatgtatttgcaatttaacttctgttttgcctaacttctttttcaaatgcatcctctctgtgttgcaacactgtcacttatacagacgtgcacagcagggcctacctttaaatactgaaatctctgagaagttgattgctcttccaatcacttatctggctgcaaaccgctgagttgttgccatgattaacagttattctttcatagacaataaaaacaggaaggttatatagtgaagatttaaagctagaaacaaatatattgataatgaatacgaacactgtcattttgcagctatgaaaactgaggacagtgtagggaagagatttcccataaaacgtcaactctgatttagttcaggcagttagtttcaggaaaaaaaaatgtattaaatgtgttatgtaaaacggtgtggggagaagaatggttaagtttaaataacttgttatttagaagatggtaggtgaaaagaaatacatatatatttgctgctgtctgtctgccccctatactccactgtgtgaaaatgcagtaaactgggctaataacttatagcacaatttgcacagtcaaaatgaaggtttctgctagataccattaaactcaaaggtcacatttaatataaaccttttatcctgcctggactcaaagcagtttcaggatttgtcatttaacagtcataaataatgtgcctcattttgtggcatcctggagactgagaatctctcatattttcttctcaacattaaaattcacaaaaatggggggggggttaaaaaaagaaataaaaagataacttggtaatttctgttgataatttcaaaagctggtccttgagctttggtggagacaatctcgttagcatcagtgatgtgtaatacaataaagagaaacacacaaaaatcaaacaccctgtctggagtggcagctgctcttgtcagagctatctgtctcgtgccagtcccagaagtgcaatggtaccaatggtctttgtcccatgttcttcctgcagcaaaacttgtcaggttatgatgtgccaatctttatcaatgtctacagttctgcacaagaaggttcctcacagaacgtgcttacgcttctgggcaagaaaacgctgtgtgctgtcactcttccttcccccttgtaagcacaattgtcccagcaagcgagcgccagagcagctgaaggcgaaggagagcatctgcctatttctaagtcttggttatctgaaagcgtctccaattcttttttttttcccttttttttggaagctgcttttgtagtcagtagggagctctggatgaatcagaataggaattacccttttaagagggaacaccttctacttgtttgaaactctaaatccaataacactatttccagacatgaattaagctctttaaattgataaatgctcatatcattttattttctcatttataaatatgcatctcatttcattcgcacagccatttccagagtaagtattatttttccactatagtgatgatgatacagttttcaaataagtcaagtgacttatctgagatcgcccagcttagaaggggcaagactaagtcttagatccagtctagctctcattttacttcattttaactgcctcatttcaggaagttacagtttctatcactataggagtttatcctccagagagttgaagaaccataagaactgtctctctccgtggctcaacagatagattgaacacagctcacactactcacaggcctgtgattcagccaaattgttccttatttcatgtagctgtggtgactctcaatagattggatcttcgtggcccatttattccaatgcagctttcagtttcactgaccgttgtggaagctgtgggcatttgactgtgagtgagctctgattccagggttggggaacttcctggagtaccagggcatgaaagacccaagtcaagaaaagggaggggcttttttttaaaaaactgttacttttctccctgtgtgtccatgtaatttacaaatattataacgctcgttactagaatgccaaactgaattaggtcatttctcaatctagaagatgcttttccttcgacagagacgggaactgtaacatttaccaagaaactatatgattgtgtgtcacgttttacatttactaattcatttttgtttattcttcacaataaccacgtgagatcagtgttatactcattttactgcttaggaaattcagagccagaaaaggcaagatattttctcaatatttcatgtttaataaatgagagaacccagaaccaaagctagaaataataacagtgaatctctgagtaagcacagtaacatttcttccatgaatcttggtgtgttttacttttttatttgcaaatgttctcctgggggaggtaatggtactgtcaaatatttttgctaacagaagatgtggaatgagaagagacaagtgacacataggtcaccatcatcagatgctccaaataggtctatatgtgtgttacagtagaaaaaaggagctctaactacaaactggcttccagatcagtcacattttcctgtgttccacatagtttcagttgttatgatgaagcaacttacccacgagcagaaataagcatggagaaggcaaattggtaattgacatgttaaaagttgttaaaaatgccaactcataagcattgttagtccaaggccaacagctgtcttaaatatcaacattaggatgaagctaaatagcacacacatctttgatcacataagaatgtttggagaagaatgattttaggaacttgcattatgtaaagaataatatttgtcaacttaaatgtagttacatgaaaacaattgttttaggtactctcacatgtaacccagttgcctccttaggaatgaatttattccacagctgctgggagaactgctggaagaaattcttcatgctttcagctccccccagatctgcttaagagagctgccttacaatgactaatcgacatggaggtataggggccaatcctcttcagcctaaatcagaggatgcttacgttgtcatcggctcttcccgaactctctacaggagtgaatggctgtgttctcccatcaaagcttcatccttactcacaattccctctgctgaatcctgtttccttgtcttccctttcctggctttccctcgaaggtgttgatatcattttcattctcaaataacccccacctgcccattagactctgcactaatctctgtctcagagtctgtttttctgagccaatgaagaagggagagaggagaaatacttggtactcatcacccagcaatttaaagaagtctttcttaccctcacaccactactgctggttgctaaaccttagcactataattgatggacctcacatggcaattattcattggagcaatggtgcttcttcagttaagatttttacttactacacattatctgtagcattgggcccaaatgtaagtgcttggctaatggttatatgggtcttaaaggccaaaaagccataaattcaatactactttaaggctgacagcttctccacaacactcctgccgactctgtacctattatctcctagcaggtcttctgttaggaagttctcattgtctctccaaatagctcagagccatctctgtacagattagactgctctctcttatttcctccaaaacctttttcccctgtagaagaaattctgccaatcttttactggtggtagacatataaaacaaagccatttctttgatataattcttcaatgacataaaaacaactttctagtttccctaaaagtctcatctaacgtccagctttttattattctttcctcacaggaattaattttaagactcctccttcttcactttgctgccctcctctctatgcatcccactatcttatctgtattaaaatgttgaatatagtcatgattaattcattgtacaagcacgtgagtttctattatgtacaaggcaccttgctagaccctaggaatatagttcacaaggagctcagataacacagtaaatttaggaaaatttactttcctctgaaaccaatttccagaccattgttacaaagacaatgtagtgtattgttatattcaatgacagaaaaacaccatctcctcccatttacatttctccaagtgactatttcttttattttttctcctcgcacaaagaagtattattaaattattgttaaccagaattttatgaattggacattgtcacacatccagccatttgttatctaccccctggtaatggaggttattccctgccacccagatcttgttttactatccattgtctttaacaacaaaatggaaattatttttccagctcttagtctgaaatcaaaacaagatcactcttgcatggaaagtaaatgaatttgcacatcgttccatcaaatgaaatacatatcataaaatttgtatgtgctaaaaaacttggtttccctttatataaaattttttataacgtgtaataaacaatacctttaaaatgctacataatcagaaacttctataaaagatttataaaaagaaaattattgacatttggtaggatttggtaggcaatagcagggtagaaaacaatctctaaatagttctctcattcctttttcattttatctcagaaatcaagtttaattcacaaaattgtggagctgaaaataatctttaaaactaccattttcaggtgagaaaactgaggcccagagaaatgcaatatctgtttaatctacagagagtgtggagcaaacacgggcttaaactctggtttccaactcttatcactttatttcacaacaattttttctttgtactggtaagcatcttaataattgaatattaaggatgtgagaagatgaattaatcgaatcaggaaacttgatgtttctaatgtgtttgttttatttataatctgtgcagcaaggaaagcatgtttactgagtggcacttgctatacatacagtatgcaagagcacagtggttaagaacatttgctttcagccagataaacctggcttcacatccccacccagccgataactagctttctggcactgtgcaagtcaattaaccacacaaggccttagtttcctcatccctaaaagagggataatgaaggtacctctttcataagcttgttttgaggataaaacgagttaatccatgcagtgcacataaaactgcccaacaccttaagcgctatatgagcgtctgctgttgtttttgttgttgttactatttttaaactgaataagtactttttccatattcttctcaggttcagtttgaatctccactcttttcactttgtaccagccggtaaccaaattcaagctgaagcaaagaggtctaatccaggggaagaagtgggcacaagagtttgactctattactgtgggtaaatgctctttattagagagcaaagaggaacgtagacaacaaaataaaaacacatggagctgtaaaacacctgcaggcaggtctcaatggctgccaagtctctttgccatcatgtcaataatggttttatgaataacttagaattaagctttagtattttattaggaaaaatatataaaatcaaatttgaagatgtttctctgaattgctttgctttaaatagttttgtaacggtacacatgcatttagttcttttaaaatcctaatttaaaaggatcaagggctcatcactgccatcagtaattcatgatatatgacatactaattaattcttgtcacttttctttttttcttttcttttcttttcttttttttttagatggaatttcgctcttgttgccaagactggagtgcaatggcatgatctcggctcaccgcaacctctgcctcctgggttcaagcaattctcctgcctcatcctcccgagtagctgggattacagacgtgtgccaccatgcccagctaagttttgtatttttagtagagatgtggtttctccatgttggtcaggctggcctcgaactcccaacctcaggtggcccacgtcggcctcccaaaatgctgggattacaagcgtcagccaccacgcctggcccttcttgtcacttttctacgtcaggaaatcacgttctattaatggatctaaaaagtgaaatttataaagataaatggagaactttaaatttgagttcatcttgtggcagggcatttgtggcatgtgggaaataagtaaggagatactggcatcttttggggccagttgatctggattatatgtgatatggcttagatctgtgtccccacctaaatctcatgtctaattgttatccccaatgttggaggaagggtttgttgggaggtgatggatcatgcgggtgcgtttctcatgaatggttaaatactatccctttggtgctgttctcatgatagtgagtgagttctcatgtgatctggttgtttaaaattgtgtggcacctccccgtctctctcttcctcctgctctggctatcacctgcttccccttcctatgtcaaccataattgtgagtttcctgaggcctccccagaaggagaagcctatacagcctgcaaaactgtgaggcaattaaagctctttttctttataaattacccagtctcaggtacttctttacagcagtgcaagaatggactaatccaatatgattcacaattgcatacacaacaaagtactttgactaaaaatgagccaaggcggaaaagaggaagagcattttaaaataaccattttatttggacaatatcaaacttcataatttccatttgattgctagatttgctccacatttaaaaagttacaaatacatacctagctctatgaccacaacacaaatgtatcttccaggtcctgaccctgcctttcggctgcctattgtgacccctagctagatgttgccctagttgtgtagctgggttggcaaacttggaagtccacatctttgtttatttggtaaatgcaatgttataaaaattagaaacatttacttataaatatctatttttattttttttaattatttttaaattgagatggagtcttgctctgtcacccaggctggagtgcagtggtgcaatcttggctcactgcaacctccaactcctagattcaagcaattctcccccatcagcctcccaagtagctaggactacaggcacttgccaccatacccgactgatttttttatttttagtagagatgggttttcgccatgttggccaggctggtctcgaactcctgacctcaagtgatccacccaccttggcctcccaaagtgctgggattacagatgtgagccactgcgccaggtcattttaatttttaaatatcagaagaactgactagtggtttttggcctggctgcctagtgggatcacctgagatacttaaacacgaaaaacccccagaaatattttaatataatagatgtggtttgaacccaggtattggtatgcttcctttaagctcctcagatgattctcatgtgcctcatgctacagtgagctgggctacagtagcataaattcccaaagtggttgactaacagcaccaacatcacctgggaatatgtgagaaatgcaaattatcaggccatatcaagacctacacgatcagaaattctggggtgagactcaggaatctgtgtttgaacaagtgttccataaatgtgcatgtgattctgactcacactcacatttgagaaccactgcactatgtagaccctgcacatctctattagttattgcttatagttattgttttcactcagttaactgacttacctatagctgtgtttgtatttgaagatcctctaactgagttcattctcattttcccagacctaatttttcttttgaaattcctctttctgattatgacaaaaagacaccaaccaagcttcaggcattgttttcttttccagtgctaattcaaccctcttaatattacaatcatttttttttccttatagtcctactgccattgttccagtccaggccctcattacttcttatcttgacaattgaatctgtttctggcttccctgcctctagtacctactcactccagttcctcatatatactgttgacagttttgtcttcctgaatgcaagccaagtcataaactcattcagtttagaattcttcagtgacttgccattgaatatattcagtctactccacctagcatcaaagaccctccatgacctggctcctccttgcatttctacacttctccttcaccattctacttccctattaactttaaactctaaataatttactattgcctaaactttcctactccatattgacttttaactttatgtttcaacttatgctttcattccacttggattgaccaaactttgtcttctgttaccatctcctccaaattctcctcacactataattgtcccaaacaccatttccttctgaagccttccttgatccatcaaatcttaagtagttttgatccactctgtactaccttaggtttttattccgcctctcatacatcactcgacatactgagataacatgcacacacagacaacatattagttgtcagttacgaactatcatccatctagttggttaaccaaaaaaataataactgacttctataagataagaactgtgctaagctctatatgactggtaaatattggttcattgaaaagaagccttagaaatttgggggtataaatatgttttttaaaagtttctttgaaggatttttgaacaaatggaaacatgatgttaaatattccaatagtctactgaagatgataatctgtgaatcctctcctttccatcttcaaggcaattcctctattattactctctttattagatgaaatgagacacaaataaatcctccaaatattgtatcttaaaagcatcttgcaccaaccatctgaatgacaaagaggtgagttaatgtatttgtgtgactccatgagaggatggtttaaagggaagagtactggtaacaagataagactgggtctcagccaaacatggcagcttgcctacctttggtgctgcttggattttactcaaaacacacaattctccaatttcctctttgctagagttgggtgaccttttctgtttgacaaagcctcacaaggctaacccacacacacattcatacatgattggtatttctttttattttaagtgttcttcatgttccggagccttctcaccttaaagccacaaattctgcacattctcttaggctcttatatgcaagccattaatctgacagatcagccaatggaaaaatggtaactaggttaaaatgctatgcatacgtagtactaattagaatttaataaggccttactcaaatgagagacactattatacctgtaagcaccatgacagcgcagggatgtgatcagtatctttatactaaggtacgttaataaacaccagtggtgctggagggaggaagagatagccatcatgaataaccaactgcttggacctttagaacatcataaatagtcctttaaatatctacattttggacgaagtgacttaggaaggcttaaagctggggcaaatcaagagaacaatatgcatgggtaatataaagaaagaaatatagttcaagtcttggacatctaaaagtaaaatgtaattcaggtcaacaaagatttactgaagtataaaatatagaagaaaatatcacgaaaatatttaagatacaatcctgtctctagttatgactggcagtgtaaaggtagaatataacaagtataaaatgatcatgatataaataccaccaaggttatatggtgtgaggattcgaagaagcaaaatataaacaaaaacaaacaaaaaatagattagcaaaagaaatagagaaacatttgatagagatttgccttataattcaaattacatttttaccaggaaaggtgtggtatgaagaggaagccacaggaacagagaacatgacaggtgtgacatgtattcagatactatccataaatcaaatctagagagaatacaagtaaatggggcaagaagtgggagacgagactgtaaaacttggtggggtcatcctgataaggccatgaacatgggaatgagtacttagtgctgagtaggtgaaaagagatggatgaaagccaggtttcttattctcttaggttcaacaaagaacgctgaaatacagcattcttaacagccgactctattgaagagactctattgaagagactcaaataaggttcttcggctgtaacatgtccttagaatgtccagaggaaaatcagtttccatatcagacacctttacttctattctgaaaaattctgtaaactcccgaacatgattattggattccagattaattttttcattgttaaaatgttagcatctggaaactcaaaaggaaagaataataattagtatttttcttgcacatcagatttcaccttgctctagtgtggtgttctttaggaagctcagttggcagataccaattgaattgtgaaaatatgtctctcctccacactcaaagataataagagtgtctgggaaacaggctgtatcaatacatgatacttttattgtgtgtgaaaaagggaaaaattccaaattaatcttaagaatatactgactgatatctatcaagttaacccgatacaacaggctggggaatggtaaatctattccatcaaaaaatatggccatgagtttcaccaaaccgagtgctcatcctggctctttgtaaatgcaggatgaaactcagcacactttcattacttattctgcaaaaacaactgttcattagaattctgagaaatgagtgttgaattaagactcagtgtctccatcaggatgcagttgagaaactcccccacgtttcatgtccttcctcttcagttgcacgtattccgcactgcacctctgcccatactttacccaaggttagatataacttagtaaagtgaatttaaaattattaatattttcaaagcaaataaaatcacatgaaagggatcttgcaaatgcctaaattaaaactcttttcttttagctatgtaccttcaacacattttacttactagaggcgcctgaacactgaatattacaggttacctaggaaacttacagtgactacacttaaaaacaacacaaagccctctaactgaagcagaataccattttagaaaagtctattttgggaatggcaaaaagaaatggttaacaagtaaatatcagtgcatagctactgtcacatttgagtttttcttcctcacattattcttcaatttctttttatgtctgccactgagttgttcctgaaataaaataaaagctaaagatataataatgaataaagggcaattatttctattatcagctataatccagatcatgagatcttactccgtggctcctcagataatatggaaataatgttatgcctttttagcattcattaatgatggtgaccatacatccagtttgtctggtatatttccagtttatgcctatggttctggcaaaattattcacggtatctcatttcacttgaaaattatccaggctcggatgataaattatgtttgccgtaactgtctattacaggtatatgcagaatgtattgagaaatataaaactgtactaggatagtcagtgcccttggggagctataaatgtataatctaattgaaaaaatataaatggtaacatattctttaaaatattcactactaaacaatataatgatattattatatcattcactatgactaaattgacaaaaatacttgtttccgcaaactctcctgcctaatgtaataaattacaccaagaaggcacttccccatagcccataaaaagaagaaagacaaagtgtatagagtgagttgtgataattctgcaagcctcagcagctttgttagcagcaaaatcaaggtcaccttggctactgcccaaatctaatactaccactgagagattgcctcagggtagggattttgtaagatacctggagagttgttgcagtgttttctgaaatccaattacaaaatccattattactactagacaaactgatacagcatttctatatttgcaaggtgcagagcactcacagctcagcaaaacggtgctggagaacgctttctgtattatgatgatagtggtgatgatgatgatgataatgacatacaattccatttatttaaatactttctactccagtccttcgaaaacaaacgtgaaggatttcctacacaaaactggaagaagataacatttctttttccttttctctagccaatccttgttttatatagtaaataaaaattataccaatatggcttgataaagtgaaaagacattttagtgttcaaatctcaattctgcatctcttagatctgccattttattatagaaaaatctgttctgggactaggaaaagaaatggttaacaagtaaatatcagttcatagctactttttttttaatttgggcttttcttcctcaacttattcttaaatttcttcttaggtctgccattgagtcactcttaaaagaaaaactctccaaggctcaatgttttcatttttataatgaggattatcatagtcctacctcagaaaattagttagaataaaaggaaagaaaaagtgtgaagtgtctggcatgatgtcaataaaactcgaaactgaatgttctcaactgtacataatcctcagagtagttcgagttgccattgccactgagattcttgcagtgacctcttcttacgctagtaggttacagcagtagttttaaaagtccagtatgtaaatgaatcagctgaactacttgttaaaatagaaattcctgataccatacccggaattctgacgtaatacatgtgagagaggccccaggacttagcatttcttaccagcacctgccttgcccatccttactacaggccacatttacacaaacacaagtcagagaaaatgaagacttgccacaacttcaaggctgaaatttcacattaaaaaaagtatcattagccacttaacatctccccctggatattctgccagcaagtctgtatcccaagctgaatttaacttaaaccttgaaattattgttgcttctcttaatgacccttcaatctcaaaacctcagtatgctcatcctcctgctcactagccatcatcgctctgcactcaatattttgcatatttctcctctattccatcgtcattctctgccccaccatcccttgcctgacttttataatcatctcgtctttgatttttccatctccattctctccctcatgctaatcaatcctactcttgctaccacacatacattcttaatgcataattataatcttaaaactccttataagcctccaatgaggatgtaaaaacactgaaatcatcatatgttgttgatgggaatatataaatgtgcagccacattggaaaacagtttggtaattcctaaagttaaacaggttaccacattaccaacacttctactcctactttatatatatataagataattaaaaacatgtatctacacaaaatgtataaacaaatgttaatattcatagcagcataattcataacagtgaaaaagtaaaaacaactgaaatgtccatcaactaattaatgaataaaatgtgatctcttcctacaatggaatattttcggtcataaaaaggacacgtggacacatgttataacatggatgaaccttgaaaacatgctaagtaaaagaagccagccataaaaggctacatattgtatgattctacttacgtgaaatgtgcaaaatagacaaatccatacagacagatagtaaactgatggctgccaggggctgggggaaggatggaataggaagtgactggtagtgggtatgggatttattttgggggtgatgaaaaccttctgaaattagatactggtgatgaatgcacaaccttctgaatatgttaaaacacactgaagtctccaatagctcctcaccacctgcaaaaaaacaaaaccctaaatttcctgacttggtatatgagacccattcttctatagcctctcttcatgcgtcctatacccaagactaagtgaaccattgctcttttgaagtcctggtatgcttttttccccatggcttagggcattttttgaatatctttgtttcatgcatgattaccataatatgtcacatagtatcggtactctatgcctgaatgcccagtaaaaaagcaaactatttttttcaaaacacagtatcctttaaattttgtatgtagcaatctccatttgaaacatgaacatgctgagatccttaaaataagaataaggcagaattgtgtgtgttgcaaagacaacataaaatgccattactgcagccattaataagtaagcacacatctatgtataatgcacacacaaaacccacatatatacatacacacatactgctatggtctgaagttttgtgtccccctcaaattcttatgcttaaatcctaacccctaaggtgatggtaacaggaagtggaacctttgcaaggtgattaggtcatgagggcagaacactcctgagtgggattagtgtccttagaaaagaggttggagagatctaatgtacaacatggtgaatatacttaactacaacatatcgtatactagaaaaatgccaagagactgaatgttaaatgttatcaccacaaaaatgatagctatgtgaggaatcatatatgtcacttagctagatttactcactccactatacatatatatatacttcaaaacatcatgttgcacttggtaaatatattcaatattgtgtgtcaattaaaaaaaatgaatataatgataaaaagaggtttctcaaaggagcttgtttgccctccttccgtgggaggatgcagcacaaaagggccgtccaagaaccaggaagtgggcccccatcagacattgaatctgctggcaccttaatcttgagctcccagcttccagaactgtgacaaataaatttctgttgtttacaagccaccaagtttatgctattttgttacagcggctcaaacagacttaaacacatacatatacaataaaggaatgatcatatcttataaagtcttactactctgtttcctcatactgctatcagcaaaatcactactttagcagcaatctcagaaagaaaaataaaacccaggaagcacagttcttgtacttatgcacagacatttaagccttaactccgtaccctgtgcctctcaccttggtttatgagatatcctttcctttgcttttatgaggatgccagttcaatctttttccagaagtagaccattaagcagtcaatatccgaaatgtaccctaaatgcttcctcatatttccctttatctgactaatggaatatggaaagcaatgtttaaccagggaaaaaacatttacttctacctggtaaagcttaaattccatttagtgctcagaacttaaagtaaaaaaaaaaaaaaaaaagaaaaaagaaaaaaaatttctatcacaccatagtaagtgagcaagaggtaactagtaagtatatgaaattgaaggaaaaattgactgaaagtcaaaacatagtctaggaagggaaactcactcccaacgaaccatcattgacaaacgcaggtcaattacttcttattgaactctatgatacatagtcatgattttccatttgtgctcaaaacagaagcaacttcagcaaaaaatagaattgacaagcattgaaagagaactgcaaatagttgaagcaaggggaatgtttttcaaaacaaaaaaatgttttgtttcctctttctacttttctgtattttctacaagaggacctattactttaaaagtttgtttgtttagaagaaataaagataagtcatggggggatgaggaaagaggagatgttggtcaaagccaacaaagttttgatcagacaggaggaataagttttagtgatctattgcccaccatggtgacgatagttaacaatgtgttgtttaattcaaaattgttagaacagtggattttaaatgttctcgccaaaaaaaaaagtatatgggtagttaatatacaaatcagcttaatttaattattccacaaatgcatacacatcaaaacattacattgtactccatacatataaaaaattatttgtcaattaaaaaataagtgattatagatgacatgaggcatgcattacccatcacagtggtaaaaatccagcttccctgtgtcctgacctcttattctgttgagcaagcatatcacatttaatcatgacaattgcattacagatattagcgatatataaaaatgtaaataggctaaatgtaactaactttgctcttaccacaacagtgttttatctatgtagcaaagcttccatgtcaacttgtcaaggcgcgtcacctttggacagtatacacagacaagatattaaaaataatggaaaatttatcacaatcaccatgccctcgggtgatttttccctcagaatgagaaatgatgcatttttacagtgttagagataaatacagaatcatcatcactattttaggaaagaaacaatactcagaattgaatgtcatattctcaaggaatccacaagtcatgtttccttagggcatagaaccattaagatgaatataaaagaatatcacttgctccactgatttacattcttgctttagttacaggatttaagaaattattccgtacaacttttaatactgcgtctgaggaaaaacagagggaaactagacactacgagagccaatacatttgcagtcacagagttcaattacgtttttttaaaattaacttattcaatcctcacaataattttccgagttacatatgtagcataatcctcatgttacagttgatcagataatttcaggctatggtagagcttattatattgtgagattcctcacctcatgattggagctcattgagagtaaggacattctatactaaacctaagttgtctaacttctgggacatggctgatgcactataaattttatggatctaagtgaataaaattttaaaaaaaaaaacctgagttcttggagggctatgcacacagaaggaatagatgaaagaattaagatgcgaacccaagaatgtctttccattttaccaagccatactggtaaaatgtttatttatataatggtacaaaacaagcatttgagaaaagcaaagaaaaatgattatcttcctccagtgataggtgggaatccttcacatttgttcctttaactgacttctctcatagggaaagtggaagagctaaaatttagatgcaggtattctggcccctgtgtttctctaaaacctcataacctactattggctaatcaagtgtgtgttgatcattgcagatttttatttttcagaaactctaaaattgttttttagagtactgctaccaggttagaggtcaactatcactattaagtgatacaatacaacattttgaaaattaattacagatcctggagactaagaagatccatgttatgtagtttaaaatgaggtaaatgtatatttctatgagcaatttataaatggctattgtaagtaatttgaatggtcatggaaaataaactagctgaactacatgctattcctatacagctttggaacattatgtaaatgaaagcgatctactcatggaatccgaaaaacaaagctcttgcactatgtttactaattagaggttcatacacctgaaaagcttgaaattgtcacattcactttagttttctcatctgtaaaataaacaacttacttttcatgctttacataattgttgtaaaaatggatgatacattatgtgagaaagatgttgtaaactttaaagtgtaatgcatatgacggagcttattacctaacatctttctacttaagctgtggtcacagcgcaatggcatcaacattcctaggaagtgaactgatccaaagaatctcagaccccattccacacttactgaatcagaatatacattttacccatattgccaatagacttattcacatgtaagttggatggaaagcagtaatttcactactttcaagatccacttttatcattcaatattaaaaatgttttgatatcccaattatgtgatgtgaaacttcagcaaatccatgggcacttatttagacagatacatatatggtgttactgtttcatattctaattaagcattcctctacataactgttttggcatacacatatactcttgatgtatttgttttttgcatcactgaagcaaattttagactgcacatttctggacggcaaggattgccttcaaatacttagttcagtgcctgataaatatgtaaactgccttgagaaacagtgatgacagtatcataatctgacaataattagagaaaaaatgctttggatgcacaactaagagtaggaaattctcagaaacattaattccaactcacctggaaataacaattcacagaatagaaaaaaaccaaaaggttgctaatattcttgagcacccacacttcattttgatgaaatctaatgtcagactaacctagagtttcaggtggaagtaatcattcttttttttaatctctttattttttactgtcatagggtaacagtctccatgtataattttaataggattagaggacaccttgaaatgtaaggaatgatcaatcaaattcatatagtgcatcagcaattgtgatctcccaggttgtggaaatcaagttgaaaaatatagatggtagacatagtcctggaattttcaaaacaagaaatgaaagctttaataaaattaaacactttaagctaatgatgacctacttaagaaaatcatttacctttctaatttttaagcacttgaattagtttagatttatagtctctagacattgctaaatttgattaaatgtgaaaaacttaaagttcacctgtaaaaatgtccttgattaattttatctgttaagggaaaacctataccatcctctctggccttggaaatatctctgacagagttccgaattcttctctgtattttaaatattgttgatatattattgatgcaggtttcagtcatgctgaacaaaccttaaaatgcatggaaaatctgaaaatgcctatttagataggtcacaggcccccctttttttttactaagctaaaatttaaaaatcaggaatcacagaacatcaacaacgagaaaagaggttgaattagaggtgctctgtagaactccaaataaacactttacatttgtattttcatgcatttaaattagggctgttaaaataagagcaggtggatataaaactattaggttggtgcaaaagtaattgcagtttttggccaggtgcagtggctcatgcctgtaatcccagcactgtgggaggcagaggcaggtggactgcttgaggttaggagttcaagaccagcctggacaacatggtgaaaccccatctctactaaaaatacaaaaattagccaggggtgttggtgggtgcctgtaatcccagctacttaggaggctgaggcaggagaatcgcttgaacccaggaagcagaggttgcagtgagccgtgaaggtgccactgcactccagcctgagcaacacagcaagactctgtctccaaaaaaaaaagtaattgcagttttagttactacgttcaataggaaaaaaaaacaatacttttgcaccaacctaatagaaaaccatcgactagattaatcagctcataccatgtgaattactgaccagtaggaaacagagatcaaagtcagtgctgcctgctacttaggagatgcaaaggtaattcctctgatggacttctacgttcatttcattgctcaacgacgtagagataattaattcttaacgaatattcatttgaaataaattctgacaagtgctccataatccttccagaattcagtaataaatcaaatacacctttttttttcttgtaacttcccattgacaatgtcatatcattaaaacccaggctatatgtggtagctctttcccactacagtgaaagacatttcaatgggaaatgagcttgtctattaaaaatatcttcattgttgttttctaccaatctgtatcaacaggtcattttctttcctttctttttaaaatagtaaataaagaaggaatgattatgatacttcttgctctctaggagccacgtcataaatgcttaattaggtatgccaaagttattttttctaatagagtacagaaaactcttaataaaagatcagattcattgatgtatatgcacaatatcaggaaagagttctcataatttgtataattccatagtcaaccctagcaagtgaagattaatcaatggtgggctcccatgcacgtgtatttatttatttatttatttatttatttatttttcttttccactttcttttaggtccagggggtacatgtgcagttttgttactttagtacattgcacatcactggggtttggtgtacacatgattttgttacccagatagtggcatagtacttgataggtagtttttttgactctcgccctcctcctaccctccaccttcaaataggtcccagtgcctactgttccattctttgtatccatatgtactcaatgtttagctctcactgataaatgagaacgtgtgatatttggttttctgttcctctattaacctgcttaggataatggcctgcagcttcatccatgttgctgcaaaggacatgattttgttatttttttatggctgcatagtattccacgacgtacatgtgccatgttttctttatccggtccactgttgatgggcatctaggttgattccatgtctttgctattgtgaataatgctacagtgaacatattactatgtgtatctttttggtaggataatttatattcctttgggtgtacattcactaaagggattgctgggttcaatgatagctctggtttaagttctttgagaaatctctgggctgcttcccacaatgggtgaactactttacatttccaccaggagtgtataagcattcccttttttccacaaccccaccagcatctgttattttttgactttttgataatagtaattctgactggtgtgaaatggtatctcattgtggtttttatttacatttctctaatgttagtgatgttgaacatttttcatatgcttgttggccatgtgaatgtcttctttggaaacgtgtccatttgtgtcctttgcctattttttaatggggttgtttggtttttcttgttgatttgtttaagtttcttacagattctggacattagacctttgttggatgcatagtttgcaattttctcccattctgtaggttgtgtttatgctgttgatggcttcttttgctatgcagaagatctttagtttaattaggtctcgcttaatccatttttgtttttgttgcaattacttttgcagactttgtgatgaaacctttgccaaggtcatgtccagagtggtatttcctagattttttttctaggatatttataatttgaggtcttaaatttaagtctttaattttgagttgatttttgtatatggtagaaggaagtggcccagtttcagtcttcggcatatggctagcgagtgatcccagcaccatttactgaatagggagtccttttcccattgattgttaatgggcagctttgtcaaagatcacatggttgtaggtgtatggctttatttccgggttatctaatattggtctatgtgtctatttttgtaccactaccatgctgtattttactgtagcctactactgtatctattactgtcaccctgtaatatagtttgaagtttgatagtgtgatgcctctggctgtgttcatcttgtttaggattgctttggctattccagctcttttttaggttcatatgaattttagaattttttttctaatgctgtgaaaaatgacattgattgataagaatggtattgaatctgtaaattactttgggaagtatgatcattttagcagtattgattcttcctgtccatgggcattgaatgtttttctttttgtttgtgtcatctctgatttctttcagcagtttctgcaattctcatagagtactttcccctccctggttagctgtcttcctaggtacttgattccttttgtggctattgtgaatgggatcaaattcttgatttggctgccagctattgttgagctactaattgttgtacatttattttgcatcctgaaactttactgaagttgtttgtcagttctatgagcttttggatggagactatgaggttttctaggtatagaatcatatcatctgcaaagggagataatttgactccctctcttcctatttggataccttttatttatttctcatgcctgattgttctgggtaggaattccagtacaatgttgaataggagtggtgagagtgggcatctttgtcttcttccagttgtcaggcggaatgcttccagcttttgtccctccagtatgatgctggccatgggtttgtcaagatgattcttattattttgaggtatggtctttcaatggttagtttgttgagagtttttaaaacaaagggatgtgatgttgaattttattagaagccttttctgtgtctattgagatgatcatgtaatttttgcctttagctctgtttatgtgatgaatcgcatttattgatattcatatgatgagccaatcttacatcccaggactaaagcctgctttattgtggtggattagctgtttcatgtgctgctggatttggtttgctgatattttgttgaagatttttatatctatgttcatcaaggatattagcctgaagttttctttttccctcgtgtctctgccaggttttggtatcagaatgatgctggcctcatagaatgagttaggcaggagtccctcctcctttattttatggtataatgtcagtaaaattggtaccagatcttctttatacatctggtaaaatttggctgtgagtccatctggttcagggtattttttagtttgtatgttgtttattactgattcaatttcagaactcgttattggcctgttcaggatttcaatttattcctgattcaatcttcggaggttgtatgttttcaggaatttatcaatttcttctagatttctggttgtttttttgagacggagtctccctgggtcgccaggctacaatgcagtggcgcaatcttggctcactgcaacctccacctcccaggttcaaatgattctcctgccttagcctcctgagtagctctttccatttctttcaggaatgacaggtgcatgccaccacacccagctaatttttgtgtttttagcagagatggggtttcaccatgttggccaggatggtctcgatctcttgaccttgtgatctgcttgcctcagcctcccaaagtgctgggattacaggcgtgagccactgcacttggcctcttctaggtgttttagttggtgtgcagagaggtgttcataatagtctccggggaatttttgtacctctgtggggtcagtagtaatgtcacctttgtcatttctgattgtgtttatttggatattctttcatttttattaatctaccaagtggtctatcaatcttacttatccattcaaagaaccagcttttgggcttgttcatcttttatatgaattttcatgtcttaatttcattcagttcatctctgattttggatatttcttttcttctgctagctttggggttgggttactcttgtgtttctaactcctctagttgtaatgttaggttgttaatttcagatctttctaactgcttgatgtaggcatttcatgctataaactttcctcttagcacttctttagctatgtcccagagattctgtttgttgtatctctattttcatcagtttcaaagaaatttttgatgtctgccttaattgcattcttcacacaaaagtcattcaggggcaggttgtttaatttccatgtaattgtatggttttgagagattttcttggtattgatttctattcttattttgctgtgttctgagagtgtagcttgtatgatgtcatttttttttgaatttatagagaattgctatatggccaagcatgtggccagtctaagtgtaagcgccatgtgctgatgagaataatgtacattctgttgttgttagatacagtattctctagatgtctccgaattccatttgataagtgtggagtttacatttgatatatctttgttagctttctgccttcatgatctgtctaatactgtcactcgggtgttgaagtctgccactattattgtttgattatctaagtctctttataggtctgcaggaacttttatgaatcttagtgttccagtgttgggtgcatacatatttagtatagttttcatgttgaattgaaccctttatcattatgaaattcccttatttgtcccttttgatcactgttggcttaaagtctgttttatctgaaataataatagccacacctgctctttcttgctctccctttgcttgatctttctccatccctttactttgagcatatggatgtcattgcatgtgagatggatctacagttgggtcttgcttttttatacaacatgacactctgtgtcttttaagtaggggcatttagtacctttacattcaaggctaatattgatatgtgaggatttgatcctgtcctcatgttgttagctggttattatgtagacttaattgtatagttactttatagtgtcagtgggctatgtacatatgtgtgtttttgtggtggcaggtaatcatctcctgtgtttatatttagcactcttttaagaatctcttataaggcaagtctggtggtaacaaattcccttagtgtttgcttgtctgaaaaagattttatttctcctccatttaagaagtttggtttgtctgaatatgaaattattggctgaaatttcttttctttaaagatgctgaatataggaccctgatctcttctggctcataagggttctgctgaaaagtgcactatagcctggcggagttccctttgtacataacctgccccttatttctagctgtctttaagatttttttcttccacattggtttcgaagaatctgatgactacgtgtcttggggatggtcatcttgtatagtattttgcaggggttctctgaatttcctgaatttgcatgttgatcactccagcaaggttggggaaattttcatgaccaatattctcaaatatgttttccaagttgcttgttctctttccatctctttcaggaatgacaacgagttacaggtttggtctccttacataatctcatatttctcagagcttttgttcatttttcaaattcttttttatttttgtctgcctgcattgattccaaaaaacagtcttcgagttctgagacttttttccctcagtttgatctattcagttattaatgcctccaattgcattataaaatttctggagtcaatttttcatctccagacattcagtttgtttctttcttaaaatggatgtgtactctttcaactcttggactgtttcaccgtgttcttgggattgggtttcaaccttctcctgtaactatatgtggttccttgtcattcagctcctgaattctgtatctgtaatttcagcaatttcattctggttaagaaccattgctggggagcaagttgtagtcatttagactcaagaagacactctggctttaagaatcattagagttcttgcactagttcttatctgtgtggactgatgctcctttggtatttgaagctgctgtcttttggatggggctttttgcttttctattatttgatgctcttgaggttttgactatggtataaattgggtttcatggattggtttcaattctgaatgcttttctggagccaaagctcacctcagcactcttgggctgcatgctgtaatcctgggggatgggggattagtcctgtggctttgctctctggccccttgagattaagcacctgctgtgctggaggtgctgaggtgttcccagttcacttgcaacaacactctggcaggggctgctggcaaaattgctccagtggggcagtgggagtctccacacacatgtgcaccaatggaggaggctgcaggcgagtacgcatcagtagggggaggctgagggtgggtgtgcactggcagggaaagactatgggcaggtatgcactgacagggggaggatgcaagcaggtacgtgctggcaggggaggtcatggttggagtgtgccagcagggggagacaatgggtggatgcataatggtaggggtccaccaggtcgttttcttactccaagtttcagttttgttaacctgtactataaaatgactgaactgtaatttttaaagttttcttaagcagaaagacttcaattattttatttgatgtgccactggacagacttgtaaatggaagctcaaggaattcagtgagttgtctctggaaaagagcagagcaggtaatcccaggcttttgtgttacatgtatattgctctttccatcatcttatggctgcttcaaaggttcctcacaggtccaaagtttactctaactcagtgaattcctttggtcattccacatgtaatcctcctggagcacattatcaatggcaatctttggacagtgctaggcctatcaatggtgaacctgggatggctgaagctcatgctgagtcaagtctatactaatctaattctcccaaatgtgatgggaagtgcattttccacaaacagtactcatcttggaaagtagaccagcatcctaataaaagcagagattttagtgtaatacaggttaacattccaatcccacagaatgggcttgcttagtgtataacttttcctagtcttcatacttacgaaaagacatgaggtctatgtgtaacatgtagaagtgtacatggcccaaaatataaattgagcccaaaaaatatctgcaggatacataaaaagctagctcttttctattctctatttggtttgcatacaaatggtagcatccatgcactttaatgttattcaaaatgaacaatagaaaaatccatggaaacttgtccattttgtttgcattgatgtttccagaactactgattttgatagatttgtttttccattaaagaagtaggaacaaatccctgatctcttacactgaattgtggtgaacagagtaagatgggaaattgctcttttaataccaaattgggacaaagccgttaattatgtgaagcttattctaacaatagctcttcaagtgtgtgatggaccaggggcccccaactcctgggccacagactggtactggtctgtggcctgttaggaactggtcacacagcaagaggtgagcagcgggtgagtgagcactactgcctgagctctgcctcttcctgtcagatcagcagtggcattagattctcataggagcatgaaccctattgtgaactgtgcatatgagggatctaggctgagcgctgttggtgagaatctaaccaatgcctgtaaatctgagatgaaacagtttcatctggaaaccatctccaacccccaactagtctgtggaaaaattgcgttccaagaaactggtttctggtgccaagaaggttggggactgttgtgatagactactaatcctgctaatggggtaacccaagtcacaactaagtttaaggttggaaagccccagtaaatatctgaggtcttagtgaaacagggtaagatgaaaggtgagaaaaagttgtattagacactatgggtgcaggggggaagatcccagaaataatagtctttgaatgaaagtccaagatatgaccttcttggtagagaaaaactcaaccaggaaagttgtcttatacatttttcatagatgttgtgcatgttgaatccccacccttatggtaatccattagtatgctgaaggctcagaggaaatagtacaaaacagatgcattcatgcttcatttttccatatgtttgttattcaacaccacacgatgactgatagatcccatatctaattaccatatactggagagctttctggatttttccagcccagcagtgacaataattgccattcaagaaaagataaatcaatgttataataataatacaatgacttatctgatttcccctgttattttttttggaatatcaacttttcactgaatttaagatgattttctgataaaattattatttttttgctctgaaaaccaatataaatatgtttatctgctacaataagaatgataacatgcaacaataaatgtaaacttagctgttatatgcaaaagattttgctagttgcaagaaataaaaagacatcagaagtagttgttgacttcaaactgctcagaatctggtaaaatagatgacctagtgcacagtgattatctcacccaatgtcccattatcacccagctgtattctgttccttttccagtcctcatgctctaattatttaagactcagcttaaatcctataaatatcttggtctgatattttgtcagaagacatatctccccccaatttctcagaggtctttatctctactttgtatgttatttgtaattttttattttatgatactatcatgcttttcaccataacaaagcaaagcctctattttttcttaagttgtatcttattaaagcaactaacctaaagggtaaggaaaggacttctttgagctttcaggaaataagaacaagccaattacgaggagggaaaaaataaagctgaccttagatatctacacagcaacatttaattctagaatacagtgaatcaatgcccacaaaatattcaaggaaagaaaaatataatccaagtctttaatatctagccacagtgttcaagtacaaatacaaacaaaacccaatttttaacatgtaagaattcagggaatactattcccatgagttcttgctgaagaagaatttcactgaacagaaagatatttttggaaagactatataaaaagattagtactgaaatttgaatctatacatttgttgaacaatgatttaaacatatgcaaggattaaggtgacagaagagaatgtaaatgttaaatgactgggtgggagagtgataagtatggtaattttctcacttataataccaggagttaaaggatattttcaatacttcaaaataagtaatgtgaatataaatgtatttaatatctcaaaggaaaacactacaaagattatgtaattaaccgaaatcaaggggataagaggaaaaagcagtataaagaaaaacaaacatactaattccatcactgattatagtggagaatcaaaaacagtttgaagaaacaggggatttagggtataaaaattatattagatcaagaataccaactttctaatgagcagaagcagcactctctctctctccaaagtaggtaaaaaggaaatacaaaaagctttaaagatgggaaaggataacatgaaattctatgctagaattaaaattaaatacatctcccctattgatagttccatgagggaaaggatgtctgcttgttctgtccattgctgtgtcccgagcacctggaacattgcctggctcatgactgcaggcaaaaatttctttaaggaatgaaattcatacggctaaattcacataataaagaaaaaggctttcaagttacttcaaataacaaaaccaactgttcttgagtatatcttcaatcaaaaaagagatcaagaccaaaattacaagacttttagagacaaataataaaaatacgttgcatcagtatttatggggtacagctgaggcagtgttcagaaaaacaaatcactgcattaaatatttatgtaagggaacaagtaaaaagaaaaacacattaagcattcatattcagaaattagttaaaaatcatgaaacctaaggaaagtagaaggaagaatattgcaatgattaaaataaattgatgaattagaaacaaaagagtaggactagtaaataaatacaaaagtaggttctttgaaaaaatataataatataaataagttttagctgccaggatatttccacttcggtacttaaggaagataatttttgttgtgggagctgtcctgttcattatgggatgagcagcatccctagccagatgccagtagccctccccttcctagttctagcaaccaaaagtgtttatgaacattgccaattttccccttgggggtatcaaaattgttccaattgagaaccaaattgttccagttgagaaccactgaagtagcccagtcaaaaaggaaaggaagaagcacaaacacccaatataagaaataataagcaagtaatgatcagtcagggaaaattttaaaaatcaaaggctattttaataaactctacaaattaatatgaaacctgaatataaagcataatattatattaaagtaaaattaacaaaaatagaaaatgtaatatatgaattaccaaaggaggaaacttgccaaaatccaatcatctcaaaaaaaagttaaaaccagtccttactacaatgctatttgacccttccagatacacttggccatataatttagtaaaagaaaataaccttagaaaaagattaagaagacaaaaattagtattattgtttacaggtgcaatttaattttgctgatattattgtttacctggaaagaaaagtatattttactgagcaactatgaaaaatagtaagaaaatttagtcagttagctcagtataaaattaaaagacagaaatcattttcctttatgtatacaaataacctctattatatagaagatcatggtggaaaaacacataatattcaggaataatactgatagttaattttcaggatctatatttagagactatcaaaatacttctgaggtaatcaaaacaataccaggtacttaaacaggcagattcaacttcataaagatgttaaccttaaatatatctataaataaaataccaaaagaaaatctgagagaactgaaaaacctaatgctaacattaatatagaaaacaaaatcagaaagaataactaggatgatcatgaaaacgaagagcaatttggtgtgggatgtggagattaaaagaagaggtagacttgctgttattaaaaaataaagtaaagctacaataattaaatcagtgtgttattggcacatgaataaacagtcataaaattggaacagcctgggtagtacagaagtccaaataagtaaagcatatatgtatattcaaggtagcatttaacactaaggggaaaaagatagtttatttaaaatattgtggtaaaacattagggcagctttatggaaaaaaaaaaaaaactcaagtaaattccctttacagtatatccaacttaagcataaaattttaaacaataaatttacttcaggcattttaatgactttaaatgacaacggaataggaaggtattcctcagtaggagattttaaaatctcagaaactataaaaaaaagattaataaaatgttaacatcattatgttgttgagtctgtcaaacacacggtacttatgaaaatgcaaaaatttttgtattacttaaaatgccataaaccaatcaaaaggtaaaaagtgggaagcatttgcaagggctaactttccgaatataaaagggttccttcagaaagataagtgaaagaccaagatccaaataagaacaaaagcaaggataggtgacaagtaaaacaaaattaaaataaaatcagctattggctattctcctacaatatgctaaaaccacatatcataaataaagtaaaaattaaaactatgatgaatagaattttttatccatcatattttttaaaattacataactcactgtgctagtgaaagtgcagaaaaattggcactgtcgtgtcatatatttctttattgagtgtaaatactatatctagggagatcgatttggcattatctagcaaacttacaaatattctgctttctgctctacttttagaaatttactctgcagatatactataaaatgtgcagaatactgatgtataactatattatttataatagcaaaatattgaggcaaactttcagaaatatgggactgatgaaatcacgtatgtcacagtctatggtataataccacatagcttttaaaaaatacagaaactccctgtgtactgattcggaataatctccaagaaatattaagtggaaagagcaaaatggagtgatagtgtggacagtggctatcttttctaacaaagagaggtaaatagacatatctacttatatgggtataagcaaaaagtaataataataataactccagctgacaaataagaaaattgtaatattgatagcctatagaaaagtggctatagataggcagaatgagattgttcaatttatcttgtatcttatggttgtgagttaagtgaatgtattatctgttcaaagggaaataaattgtttcaaaatagttgacaaaagattattatgataaacctgaaagaagatatgcacagtatgatcaacaaatgctgattttgaaatccagaatactatcccacatgagtcatattttgttaatttaaaattcatgttgacagatgaacacaacagatgaagctattaatgcagctttaccttactgacccagagcccttcgagtctgagtttcctctggaccaagtggttatcttctctatacagactggggattctatctcccaagcatgcaattaactgccccttttgaatattctattccaagactcattgcaactatgatactcttttcttttaagtgtgagcctcagaaacaattaagcaagaaataatcgtgcatttgcataagcccaacttactgtgtttttttgttagtttgtttgcttgggactttctctgagaagcaggaactcgttttgtcatccaggctggagtgcagtggcatgatcaaatctcactgcagccttgaactcctgggctcaagcaatcctctcatctcagcctcccaggtagctaagaccatgagcacatgacaccatgcccggcaattttattttgttttatttatttatttatttatttttcagaaaaatggggtctcgctattttacccaggctggtctcaaactcctggcctcaagttatcctcctgccttggcctcccaaaatgctgggattacaggtgtgagcccccatgcccggccaaggacttactgtttactcagcaaacatttattgggcatcaattagctattggcataatcataacacttcctcctacatgtgagcatcagaaatatttaatcaggaagtaattatgcatttgcataagcacaatttactctttagtcaatgaatatttaatggccatcaattacatgccaggtagcatggaaggtactggaaacagagaaagacatgttccttgcccttaaataatttgcatggtaatcattattcagggagacaagaatataatagaatttaatacaatttggtccatgttagaatagtagccacaaatcataagaatggcaagaggctaggagaaggaggcagtaacaatgcctggggagactcagagagggctttacaaaacagaggaagttttacttctactagactgtctagaattataagtgacagacaacagagtccttgctttttcggaccctaatgctaaaagactgaataaatgtaatagtaaaaaagtgattagtaggacaattaagttttaagttcacattaaactttaaaaaacacttaaaaacttaaaaaacattaaaattaaaatggaattcctagttcgttgatatctcatcacattacaaaattctgtttttaataacatcagaacataaacataacttcaaaacatttaccggaaataatagctttagttttaaaatgcttcctccaaaagcatgttccaattcaaggcaaggctcataaactaaatgaattttaaaatttatattttagaattataattacatacttgattacatatttagtatgagtttataaaaaaagaaagcaaaaggatcactgtgacaacaggtgacatcaagaaccacttggaacaataaaagggaaagaaattaatctttaacataagtggagtaaatataaatgggccaaacattatactgaatttagtggtgctgcccatggaattctggaagtcttaagatgttgtagatagatatacactttccttgactcaagatagcataagtacttattttttcagatagtatgcaggcttttccaggtaggacctggttctaattgacataaatataaaagtgataagaaagcctaaagctgccgggtgtggtggctcactcctgtaatcccagaactttgggagaccgaggtgggtggatcacctgaggtcaggagttctagaccagcctggacaacatggcgaaaccccatctctactgaaaacacaaaaaattagccaggtgcagtggtggacgcctgtaatcccagctactcagaaggctgaggcaggagaatcgcttgaacccgggaagcagagattgcagtgagccaagattgtgccactgtactccagcctgggtgacaagagtgaaactccgtcaaaaaaaaaaaaaaaggagagagagagaggaaagagagagagagagaaagaaagagagagaaagagagaggaagaaagaagaaagaaagagaaaaagaaagaaagaaagaaggaaagaaagaaaaagaaaaggaaagagagggagggagaaaaggcagggaaggaagggagagaaagaaagaaagaaggaagggagggagggaaggaaagaaggaaggaaggaaggaaggaaggaaggaaggaaggaaggaaggaaggaaggaaggaaggaaggaaggaatatcctaaagcaactctcaggaaacaaaacagaatgttgaggaaaggagactggtgatgtgcaatggtgctaagacttgctgatgggaaacatttgtgtagcacaaacccaaatctgtaggcatgcttgcagcctaatcccaaatagtcaacaagcagatgcactcatctgccatccccagagacttcagcactgaagagttgtttcgtcactgtagagtatcaaattggtgagtaattttgcccttctacctggctaaaaaaacattcattcagtttctactagcttaaaggtcactgtattttgcagtcacccatgcatgcaatcagatatggctcaatggactctgctcacctcacaatcatgaatacaatatgatttaaaggtcagccaacttgcattctgtcaaaagagcataaggagagaatttcagctatgtgggtctatatgatggcacatattttgctgacagttttctgaatccacacctagcgatcactggcaggagatgacagttcaaggtcaataatttaataaatcatttcattatatagttattgattctaccacttttaataaggaatgtatgcaaaattgaagacgttaagtctgggaaagatttatagaaaaaacagtcaacagcttctgtgtggcttccaggagagatgaaggccaaaagagtgaggtagaattttgctctaaataagactttaccaataataagggatattgaaaatgaaaagtatttagcttctgaaagtagtgttcctgacatatggttaagccagatggtggattaacacatattgtaatgtctaaaaaattaggactttttaaattggggcccacatactgcttaagaaattgagctatctgacccttcaagactttcttattttattctctatgatcagccatgagagttctaaagggggaataaatggttcagcaaattttatcttgttccaatatactatctagaatcaacggaaccaaactatgaacatctacttcctctaggacaaatttcatcaaaccattagttataatacacatgttcaaaggagctgagataaaaattacaaatggcaaattaataaaacagccattaaggaacttggacatagttaaagtgtacattgaactgaaacatgaccatggagaacaaccttgacaatatgttatttgaagctattttcagatgtatagatgtggcccaatatggcacttttcatattctccatgcagctgctttcacctatcctgacatcttcaagttatctgaatttaagaagtatcactattcatgttgcacaattactaacactgaatatacttatcacattctctggcatgtggctttaagctatcctgggtattcagacagttaagattcttggatgatcccaaagtttccctttaattatttgtagcagtcttctggactaataatacttataaaaccttgggaatagcctatgcaacatagtgagaccccgtctctacaaaaaataaaaacaaaaaattagccaggtgtgatggtacacgcctgtggtcccagctactcatgagactgaggcgggaggatgacttctgccccggggggatccaggcagcagtgagcggtgattacactactgcattccagcctgggcaacagagagagaccctgtctcaaaataaatacacaaatatataaaatcctaagagttaattctttagaaagcattttattttagcttaacacaattaatttgatctatcagaaaaccctacctgcttgatgagccatatttactatcatcactctctgtctaccattacaatcagtgattattgattgggttagtgaagagttttgaatagttttaacaactgttttggcgctcaaattgagacttgattaacaaatgcaaaactagtcaaccatgactaaaatgaaactgcttcaataattacataatgaagatggtagcgagtttttattataagggctatgtaaatgcagcccactgtactattataatattaatcacaagttttttgaggaaaggtatgtgatataactcccatccaaggtccctagcagaatgtctttcacaaagcagatgttcattaaatgacagctgaataataaaacactattatagagaactcaagtatgaatctagtatttcattttaaaaacttgtctgattatacttacatatacaatactgcatgcagcagctactcgataaacgtgtgtaaaagattaagtttggtcaaacaattgctctgaatcaaatttgtgatataattcctgactcagcccccacagaatatttaaaatatagtaatacagtaaaataatttttccaccacttcatgaacagtcagtagggtcttgaatgctacctttcaatatgcaatatggtggccttaggaagagaggagttttttttttctcaacacgtagaatcagggtcttaagaatgactttgtgaaaactccagctttcgttgctagggaacattgattgttttccatggtgcttgtaaaggcattatttgccctgattcttttgatgagttgagactgttcacatagtaacttcagaatggaaagaacaaacccctctcttcctctggtggcactttgcctactgtcagactacaaaagggagaggcatgtgaggtgaccctctcaatgttgtctgaacaatgaggcaatcattacaactcacattctatcagtttttatgtgacactgaccaaaggcaatttggggctcctttcaagcagtttgcatcaaaaaaacgttgaatggcattgtcaccaggactacactacaacaaaaagcaacgattgagaaaggctggtgtctaactagaagacaagagtgctttagatatggaagccattgctctgatattttaaaatacatttttaaaacaaccttattatcgattcatttatacagtcaactccattctgcttagtactcgaagtgtgcactcatgtggataatctaaaacattgagaattcaaataacatttatattaaatctgacataataacctaacgttttagggtatgcctaaatttgcctttctatttctgtttattctggtaacttttgaatttggttctctggccctggaaatgccacatttagccaaagaaaaacagttttgattaggggatagcattaatcattagctagttaagtgtacactaaggaaaaattagagtcattattttgatgagttgtgcataagttatggtcagcacaagaaaacagggcacctgttcatatttggtcaccaaagaatgttctacatttaattaaccacttaatatttacaccttgagaaaaaattatgccacaatacaagcataagtgtttttgataaatattcaaatattagaaaaatatattaagatttaaatatttcaagtttgtttcagccataaaattctgatcatactctccctatctacctaattgctgctaacaataattcaaatgccaataatgatatatttagataattgattttaaagaatttatcaaacaaaaaatagaggatacctataggtatcttctttttctggagaatcaaaacatagtataaaatggaagctttctttgtgctgtaaagaattcaatacattatggggcaaataaatctattttgaaggtttttttttaatttctggtagactagaaaggaaggatccaactcggatgttcatttatttaaaatcaaacatagaagattaaattcatacaagccaaagaacatctggcccttccagaaagagaatagagttctaaatgctgaaatcaggtgaagcatacttaattactggtatccagaaagagcaaaagtgagacatcctattatatttattctaggacaaaatataccattgcctatgattgtgggttttggataagaaaaacttacagtcttaagctgatcgtgagtcaataatggagctactgggacacaaatctgtaccctttgtcactctatggaaactcttctgtctcaccacaactcacttttgtctgttgatcaaatatttcagggccttcaaactcatataacatgtttctcctagaaagagctgcttatcttttcctaactaagagcagggagtgcgccatgaaaatgttgtcattgatgagaacccactttgattctgatagagagtaagttgtgctcttttgctttagtcatgctgtgtattgtctataactctattgtactattacattcctaaatttggctataacaggtgtatcagttgattcaccaactttcaagaaatgtttgacactatctactaaagctaaacataggtagcctatgactgtgcaattctattcttatacaaagtcccaagacaaatgactgtacatgtccaccaaaagaaaatgactagaatatgtttagaaactttattcataatagctccaaactgaaaataacccaaatgtctatcatcaggagaatgggtaaagaaattgtattatatacaatacaaaggaatactacattgcaataataatgaatgaacgaagatgtacaaaacagcatgaaaaagattagatatttttagttgcatgagaaaaaaaagccagatacaaatggcccatatagtatgatcctatttatataaagttcaaaaacagaaaaaaaaataggtgtagaaaacaaaatggtagttaattcttgatggagagctttgtctgtgaaggggcattaggaatacttcggggagtggtagaagggttccaaatatctggatagtggttacacaggagctttacacattagatttgagcactttgtccataaatcattcctcacaagaaacacgtatcgttatttaggatttagtctatgctaggtatttatataagaacaccaacaaacaagatgacaggtaattgcatgcttaatttttttttgtgtgtaagtctttttaatatagattgagagtaacgtgaagtcagagacctgtctgactaaattttgtattctctaggatgcgaaatattcaggctcttaagaaagaatataagccgggcatggtggctcacgcctgtaatcacagcactttgggaggccaagatgggcagatcacttgagctcaggagttccagaccagtttggccaacttggcaaaaccctgtctctactaaaaaatacaaaaattagccaggagtggtggtagcgtgcctggaatcccagctactggggaggttgaggctggaggatcccttgaacccaggaagtggaggttgcagtgagcccagatcatgcccctgcactccagcctgggtaatggagtgagaatctgtctcaaaaaaaaaaaaaaaaaaaaaaaaaaaaaaagaaaagagaagagaagacaagagaagacaagaaaagacaagaaaagaaaagtcttctccaactctacagtgaccgaggaaataaaaatgtatgtacctatgttggttgcttctaactagaatcaatgtctctgtcaaagtactttctgccgccaactctttgacaaataatcacttgtcttcaagtaacacaaggatcaccttaattttgattaatgtcagctatggtagaaaagaaaaaaacttactggatagtcaggaaaaatactctgaaaaatagtacttaattcacataagatatatatctcagtaaaattaaaataaagagcccctaaaaagattaattataataaaaagcattatatcaagtgtgcttttcacattattgccttttgaaacattgctctcattataccctgggggaactgatttggtcttaatgccaaggaaagaaacaataagaaactaaatcacatcagttgttgaataaaactgttgaaatgcatatccttgaaaatggatttatgaattgatcaatggatccagaggttatttctgaccaatggcatataaaatgtatcaaaaatcgttggatctctctacttttcactgaaggaaaaatatgttctgactctggatgaggagatatggtttgattttgcaggctcctaggatctgaactcaccctctcaattgcatactttacaaaagtgctcagtcacctcctttcaatctccagaagataatatttcttagagcagagagaccattttattgatgttggatttttgctcctagacatggaactaatcctattaaagaaaagggaaagggaaggaggaaataagatgacattgagaaatcatgactcctggcaagagtaacgcatattacataagtacttaataaaaaatatggcaacaaggagagagggaggaagggaaaagggaagaacaaaagtaagaaagaatgaaaaaaatggaaagagaaaagaaattaatttagctttagttaacagtaagaaatgaagattgaataaaaattaggatgttctcttgcttttctgttaaatgtgtccagaattacagaattattttaaaaaattgaaaaaagaaaaggctggatgtggctaaagtttgtggtttggaaggggaaatggtgttattcaaattatgtttggagtcttgccctctcatatcaatccagagaaagtcggatgttttcctgagactctcggcataaaaagatgcaggaaattttccccacagaatgatttaggctatgaaaattattcactttagaaaagaaatgaatcatgtattattgttaacataagatttgtcattcatttataactggtttaaaacagctatttgtaaaaccaccacagtattttaaaaattaattaactttaacttgacgaataaaaaatgtatatatttatcatgtacaagatgatgttttgaaatatatatacattgttgaatggctaaatggagctaattaacatatgtatctcacatacttatttttttgagatgagaacacttaaatccactctctcagtgattttcaagaatacattgttattagctatagtcaccaccttgtaccatagttctcttgaacttattcctcctatcaaactgaaattttgtatcctttgaccaatatctccccaacccctcctctccccaagacccaggtaactaccattctactctctgcgtctatgaattcaaatatttagactccgcatatagatgagatcatgtggtatttgtctttctgtgcctggcttatttcatttaacataatgtcctctaggttcatttatggtgtcaaaaatgacaggatttcccactttattaaggctgaagtgtatttcattgtgcatatatactacattttctgtttctattcatgttgatagccatcttaatattgtgatgcattataaataaaatatgtattcaatttcctattatgttacagccattctctgcaatattgacacacaacataggatatttgataaatttatcattgaagataaattcagaggctatgtaggaaaatgtacaaaggataactgcattgaatgtgatactggactactaataatctgtaatttacctttaaactaaaaatatttgattctacaactaggcaaaagccaagattctcaggctaatgtataaacattaaaagatccaatgggaagacattaagtgcttacataacaatgatgagttaaaattctctgtcactttgcactataaaaagtttaacaattcaatcaaaagaagttataacaagttaaaagtgtgtttatataacaaatagatccttccttaatatttattttataatgaacacatataaaactccttcaaattatttggaacattaggtaacattatataatttttgctaagtttcaaaatgttcactctgcaaatgcatatcatgccataggtctagagagatgagaggtatggatgtgaactagtaggaagagtattaacttaggaggcacactgatcagggtatgaattgtgattcccctgtttaccagctgtgagatcttgagaaaaatactttaattgctgatgcctcagtttccttatctgtaaaatgtgaattaacagcacagctctctcataaaaggctacaggaaggattaatagaaatactgctcacagcattgtatcaaatagctgagcacattataaaacctcaataaaaggtaatttattattaatgttagagaaaagtttaaattattaatattataaacattgtcaacttttcccattacaatcgttctaacaaaagccaatgaatagggctgggggagaggtatactaattaaaattacaatctaactggggagagaaaacatttcagagttttacttattaagtgcatcctgagtaagctgagttggggaagaaagtgttatggtacctagaaagtttaaattatcaatgcacagtagggatcatgttaaaatgcatatcatagcataaagttttccaatctattccaattcacgtttggtataataaaataattagatatctgttttacatatcacatgtaagcacaacctaatcctctactattatttctttattatttgcaatctctgattagtcatcaatgtaaacctaactttattaaaacaatatttaaaatggtatttgccaaagcttaaacatagtttctcatgtcggacccccaagcagtttttaacatgaaagaaatatgttacatttactaaacgtagccatgcacatacattttcctagagatgtgcctattattaagtctatggaacatctccagtagccattaatgtctttcccgaagttatatggcatttcatgaatgtacccacctggcaggcctctggttggcattccacaacaaagagttaaaacatcccattaatgaaatttatagtgctttttgacatcatttctggtggggagggaaactgcaagtcacttctgttatggtttaacttgttatgctattccagaagatgaattcattgtcataaatattcagcttcacgccaaagaagagtgaacccagctggttggtccttgtcctgtcctcatcttctgtcataattcttacaactagctacaatgaggcagagtcttacttcccatgcaaattagtcatttactttgatttccagcttctgacttataaatatgcataattttataattgttaaataatagaaactttcaataatctgaccaagtatacattgttccttttaatcttttgatacttttgcaataattcattgtcttattgatttgtaccctctatgcaaatctacttccccattactcataccgcacacacacacacacacgtaaacctataagcaacatacttgttactgtatagatatttacatattttatgtttacttataaatataaattgtacatattttatatatttatatattttaagtaaaatatgcgggtttactttctttagaaatgatgtgctctatactaatttgcatgttatttggtatggcatatgccatatatttaaagcatttaatggcaaaaaaactttttaacatcaagtttctcttgctcccttaaaaatgctctttgagccattttaattagactgaaatgaaatagattccttaggcaacagcataaaaatagtaaagtaggttttaaaagtcttattggagaataatttcaagtatggttttatttgatgtaattatttatggattaaacacacagatagcagaatagatgaataatgagcattccctcaactcaggcaatttaaactgaattttcttgagcttttggactttcctttaattagcttggatctggttagtgactatatggaaattaatatttgttttcaccatcgctagtttccaagtctggatttcaagaattgtgctcctcagaaaacctcacccttcagtaactttttcccataagctcataaattgtaattatgctctcacagactaaatgtaagatcctactagtgtttggtttttgtaaaactgtaagagcaatctgtgcaaataatataacgtgacttggttattcttcaaaatattaaaccagtaccattattgctacatgccttttctaattttcccacattttatcagattaaataagtaccttcccatatcttttgggggtaattttatcagtatcaaaagccctgtcagagtctcagcattagcatttagctatagaaccagaattttgaatttatgtcctagttttgccaccgtgttatttagacccaatttcctattcaataacaatcaaaatatagcctgtccatcacccagatgatctctatatcaacatcagagagtggcagatgaagctctaatccctatatcagttgcacacatattgcttgtaatcgtgcacatccctgacttttgagtaatttctcggaaacccttacccatcattatcttgggattttgacttcttaaagaatagatttctccatatcttctcttcagagccattttaacttccacttatggtgcagtggtggctaagtgtagttcatctatttcatgaaaaatattttggtgctgattttgctgattggttgagttaaccaaatgttctagttatttgactagggagggttttttgtttgtgtttttactcttaagcataaacatactactttgccagaagtctccctttgaagagtctttccatggtcacaggaaaattggctttctcctgatttcataacaaggaatacaaatttacactttatacaagattagggtgagcaaattctaaacgatattattctatttttgaacttcggcttgacttctgagagggcttgacttctgagagggcttgacatgcagcaaatgtttgagaatcaaactcttaaattccaatccttacggtaccctgtgtgattcagaaccagtgaagcttgcatattggtaaggtagtggtaaaatttaaaaaaaaaaaaaaaagcaaaacgaacagaaatgttacaaagtaaaggttgtttttgtttgtttgtttgtttgtttgcaggggagagaggaaccaggaaaattttgcatgaggaaaaatataagacacgacaataaatataatttaaaagatagggctgggtgcaatgactcatgcctgtaatcccagcaatttgggaggccaaggtggatggatcacttcaggccagaagtttcagaccagcatggccaatatggcaaaaccccatctctactagaaatacaaacattagccaggcgtggtagtgcacgtgtgtagtcccagctactaaggaggctgaggcaggggaatcacttgaacccgcgaggcagaggttgcagtgagctgaaatcacactactgcattccagctgggtgacagagtgagaccctttctcaaaaaataaataaatacataaataaaataaacaatagcagttaaaaacagtatagtttgtttataataaaaacgtatttaaagcataagcagtatgtagttgattcattttctttaaaattggagaaggttaatattggataccttaatcttttgctctgttgtaatccatatgaagatttaaaggtttttgaagcattttatttttatactattaaagaaagtataaaaacttttgggtgactcaaaagcagattaacacaaatgggcagattgatgactagaagttcctcaagtaatgatatatgaaagaaattcatgttccacataaagagaaagaaagcagtgaacgacttgtgaaaatcgtgtttctataaatctttgaatatgatatgctgtcatcaatgcttagcaactgcagaaatatgcgtcactaacgaatcagattttattaaatgtatgtgtgatgtgtgtgtttgcatttgcacgtatatttatcccccttatctgcacagcatcactattacttacgtaactgcagttactcagttaaacacatcctaatagagaatataaaatcattctcttgagaatctaagcaaattgcttggttgcatttaagatccatcatgagtagcttttcctgtgtcaattcattatacccaagggcaattcctctatttcatcctttttcaaggtcatgggttgagcttgattaatatgactggaaaacagaatcataagtggaaaatatcggtctggtatcagaaaaggttttgctaagaaactgaataagggaaagcttcataatgaaaatactgcatcataagataagagttgtattggaattttaaaaattattttgggggtgatgaataagaaccataacaatagatgttaaggctatggttcaatggctgtaaaacaactttctatacgtaaaaatgtagctgacaatatatccataaaatagaacaaaaaatgaattgagctgagcacaattatgttatttaaaaactccagaagcattagattggaacaaggaaagtctaagtgtatgggcaaaacgcactaagtctctgacatgccatgtataaatattcatggcaataattttcccatgagaggaaaaaaatgttttaggaaatgtttgtaagtagaaatagggtggttttatactttcttcactaaagaaatctgtagattgaggggagtttaaaaatatttcctcaaagaagaaacaatcagaaattccctctttttttataagatacaaaaagacaataaatatgttcttaccacaaaatagtggaaatagtttaactttaggtaatggttgaaggaaaagtttgctgaagcataggatgtagcaatgaaaataaacgaggtgtgaggtttcacgaccaatgattcacacctaggattaatgccagaattcttaatagctgatctcgtaggtgggattatatgtggcattctcatatatgtctctaatggttgaatgtcttcactgtggatgcttttgctgacagaaattactcagtaaaatctgtgggcttagcctaagtttataatttgctgttacatattttttcttccccaaccggatcttctgtcacttgaagcatctctacgataatatcaataacctcaccaatctccaaaccaaaatcatcatgccaaaatgttcctatgcctagcaaactagttttccctttgccaagtacaaaaccttctgacttgacaaactacaagataccataccagggtagtttaggcaagtgtatatcacagccgtattcatctatatttagctatttacagtgtatctggctttcccaattaggttgtttgccaatgaagacaaatgttatattttatacatctttgatctcccaccaaatttttactgtgccaactaatagtgtttattcagtggctaagaaatcacactaaattggattctgttcatccccaacttgttaaaatatgtaacaaatccttggactgggattcttcctgcctcagatttcactgtagaatcaacccagcggataccataatacaacccgcgtattacacaaatctccatatgcagaatttacacatgtgatgtgggagaacatattccattactcttggacctctcagttagcataaggtataaatagaggtccaagggtcagaaatagaattttggagaaagcctgttatcagatttctccagagaaagttattgctgtgttgtaagtcccctttcctgcttctatggagggagggctgagaggtgttatctctctgcaatggaaagacacagaggacaggggcctgactcatttcttaaaaagttaaactttactaggctctaacccatgccagagaaatatatacagagactgaaagcctgaccagctgctttgatagcagaaacagataggagagtaccgctgtattgagatagggcacaacccccagaagttgtgagaaccaaggatgtatagggttttatctggatcagatgtaggccaagacagatgggggtagggagtcacttcggataagctaaactggggtacaggggtaaaggaacctcaccacaaagagaccggccacacaccacagggtacgcaggggctgaggaaggagccacaaaggaattatctgcaatagaaatatcagctaagggaactgcaggtgagagaatccagcaaggaatctttaaagattccatgaaaacactcatgaaaggaaaaaaagatggcttttatattggcctggtctacctgaaaacctcaacttcaaacgttggccatggccgagggtttatgaagccacccagataaacaagaactgtactatttttacacctcctctgctctacacatcactttggtcctggtagagctaacacagcatctaggtagtaagagactctaagaggagctaatgctatacttccgtttccaaccacaggcttctgcactaaagcaaacctcacctgggagaggatttaactgttgattacacaagcttttaagtttggattaacaccttggactccattctaattactgaattggcactatgtttgtgatctaaagtgtctgtagagctgtggagatgtcatggctccgccagaggttatgtccaggaacacatgaagatatgccacactgtaacaaagtgtaaggaggacagagagagagaaaaggaaatcttttttgcttacatcatgagcttacatcgaacacagtggttacaaatagatgagttttttagttagtaaaatgaattctccctacctaaagtaattttatgtagagtcagacgaggaaaactcaatacgtgttatctccagcagcctgtggcacaatctgaattgttcgtgctttatggggaaagaagtgtgtgaagaaaaaaatagtagtagtagcccatgaaaattctctcttatgggttgttttcctgagaatgtgtccagctgattttattaaggagggggactgactgtcaaagacaacagaggtgcccccttagtactcgaagaattagaaaatgtgttcagataatagcttgaacccctaggtgtgccaagagaaagggagacagcaggctcttaaacagtgttgttaaaattcacatttatttaaaacacagcaattagctaacaaaccttggtgacagactgctatgaattttgtgctgactccgtacacataaattaaaccattccaagttccccacgtgcagcttttgacatttgtttcgtacaagtatgctggccgtggggaggcataaactttgcttttaattcctttggcaacagctgtggatcattttgttaaatttcttgtaagagattcaaaaacacttttctgaagacaaaaaatgttgtctccattgcatgttaagctctaaaatgtattctatatgagtagttttcaaaatggtttttagatctgactgcagacagttaaatattatggaattatggtatatatagttgtgtgccacataacgatgttttggtcaacaatgtactacatataagaagatggccccataagattagaatactatatttttaccgtacctttctaggtttagatacacaaatatcactacgttacaactgcctacagtattcagtaccacaccatatgggtttgtagcataggaaccagagtctataccattcagcccaggtgtgtagtaggctctcacatctaggtttacctacgtatactccatgatgtttgttcagtgacaaaattgcctgaggatgcatttctcacatgtatcccaatcattaagtgacacgtgactgtaattttttttttccaatcaagtgctcctctagttgctttggataaacccatcaaaaaagtagataaaaacccctaagaactactcccccatacacacacacacacgcatcctgcagaaagggagagagaaagaaaagatgtcagatttcaataatttctaaaacgtaagaaatctctctaacaaaaaggcataatacctcaaaattaagtataaaatcaaaaattttacttacaagccttttccttttaattatggtcattagcataaacactctgattctctgagctatttaagcataggatttctatttttctactctgtacattccctgcaagactagcaaaatagtaagtatatagtaggtggtcagaaaatataggattgaatcaagcaatatggcagtaaaaatggtccattgtaaaatgttgagtatgacatcatttcgagtaatcaagtaaacattaattatttcataaacaattatttagtatcaaggcattgattgataaaatgttttctaactacattgggccttagcttagacctttcttactgaaaatatggtctttgactcagcagcattaatcccatcaatgtcccatcccagaactacagaagaatcagaatctatattttaacaaaattcccaggtggtttatacatgcattacaatttgagaagtgctaatttataccactggttttcaatcaaaactactcgttaaaatcatctggtgttgttttaaaaaaataaaaaaaaagagggaaaaaaaaaaaactattcctgagccacactccaaaccaattaaatacgcatatgagtccagggatgaagtttcttttttaatgctccatgaagttctcaggtgcagccaagttgagaaacattgatttaaacaaaacaatgaaatatcatgctggctatgctggaattttctgaaataaatgaaattgagttttgaaattaaatcagaggaaataaacttctaataccatatatgaaaactccagtaagacattacttaataccctacagattttaggatcaaatggaaagacacattagtctaaatatgccctctaaggctcataaatgcagtccaacaaaatatcttattcttattcttctttgactcaaaatcatcttaaacagttaatatcagtatgcagaataaaactgaactttaaagttctgcaaaattaaagcaaactttccttactgagcctaaagaggatctaatgtgtcatatttcatctttaaagcctgaaacactgttttcccctaggaaaaatcaaatgaatcaatcctcccatcaagtaaactaatatctcattatgacttagattcttgttaaaaatttggcagagtattccgatttgttttcatatatcaccataactatatagcacatccagaaatctccagaatgaataaatattctccaagcacacgataactaaattgacctaacattttgtgttaattcacaccatcaataaaatgactttcaaaaaggaagacttttcctaaaagctaaataatacaattgcctgggtatatcatatttttttgacgatattgatgaacaaaaataagagatgattttttttcacatttaatgtggaatccaaaagcgtctaagcaaaaaaagcttgcattcataacagataaatcaggaatgtagaaaatatgaattctatttttaattctggagaaaagggtaaacaaaaattcaaagagcgtaattaaaataatttaaatgatttattttcttatttagtcctctattcaacctaaggaagtagctattattacccccactttccagaagaggaaactgatgtacagagaggatagaaacgttgccaaggtcatactttatactttattgagtagaatcttatgatgatttgactcttagagtctttgcagtcagacagacctccatgaaaatctctaatatactcctggttatcaagactctacttctcaaccaacaagagtggaattccagaagtctagccctagaaacttacagcaaatgtctagtgaaccttaaaacgtctctgggatccaccgtctgatgccaagtgctttgcctctgtctctctaaatgttctggtctacatcaaggccattcaggtgtgttagaattcactaggtatattgaagtatacaggatatcatcaatgctttctaaggacataatcaggcttgcatcattttcactttataagtaagtcaaacttcagggactttttcatattttttaatcaaaaagggaaccattgaagataaaggagaaaacataaaaagcccttgctgtgtaaagattgacaaacaaggtaacttaagtatgacataactttgctcactttaagagttggcctggaaacatttctttgttcaataatagagtcaagtcttatctcagatgatttttttaacctattatttttcagcagatgcatctgtgtaagaggtagtaacatccgatgttatattcctccgtgttgggagttcactggtcactcaaactgcagagaccacaattgcaggcagtgctattcagatggactaaaaatcaaatgaagacccaggagttgtgtgatgcgatggcctcatataaagggtaggtggctctttctcccttaattatttctcatgataagtattgataaagcttcaagggtcagcaaagtatgtcctacaggacaaatccagcccacctcctgattctgtagagccatgagcaaagaacagttttaacatttttagatagttcagaaattaaaaagaagaatatttgatgaaacctgaaaactgtgtaaaatttaactttcaatatctataaatgagttttttttttaacacagccatgctcattcatttacttatggtatatggctgcttttaagctatacaccagagagtctggtgtataccatggcagaggtgagtaattgtgacagagattgtgcagtgtaaaaagcctacaatatttactatctggctctttaagcaaaggtttgccaacctctctctgacacaataatgaaaaaaagaaatgtctttcagcttagcaaatatggcagtgactctgttacttgctctttcttttggccagaaaataaactgaatctctgcaagcttccgtttccttctatgcattgtggggataaagaactggctcataggaaagaattcatttagcagactgttttgcacataaaaagcacttaataaattaatgtttcccttaagttggaagcacttagcaccttttctcctcctctatctgctaaaatcgtactggtccttcgaaggcaaaacaaaatactgtattttcatacaatcttctctgactgctcaggttaaattagttgctccctctatgtttccacagcattctgtttaccagtctgtcatattatgatcctcaatctaccttgtactttggttatgtctaagacccttcttaaatgcagatattatttcttatgaatttcatgacttgcataatgttaagcacagatagggccttatacacaggggacattcaatgtttgctgaacaaatgaaaagctgaatgaagatgaaaatgaacaaccaactgggggtatttaagtaggtttactgccctcccaaataataggcaacatgttatctaggaggttcagtcaaaggaatgtcagggaaaggctttctccaaccagtatcaaatattagactgtctaatttatatcttgctatattttacctatgaagatatatattccacttggctttagggtataaattaaaatatgtcatagcaatagcaactgccagagtcaaaagaggcatttagtgagaaaatggtagctcataaaatgaatatgttaattaggaacttttaatactttccatttttttctgctgctcaatcagtcttactccatcctgtattactaacccgaatggctttattaaccacgttcttttcaaaagtcaatttgctctatctttaaacaccacacacacacacacacacacacacatacactacctcacacatgaacaaatacacttttaaaaagctaacaaaaggaaaagaaactcagggaaaaaatctatgaagtgacttatatctcaaaaagctcttattaaagtaaaagcaataaaaacctgaattataggagagaaataaatctcttctcattggttatctgcttcaaggaactgatgccttgaggaatcagatgtttcatgctaatttaaatttttggcaccttcgattacatgaaatctaaaagattgctttctaaataatgacaacagatttcctgacaatgcgaacaacagatgtcaccaaggtaagcaatggaggtttaattgagtcttagtccttggaaaggtgatttcgtctgagaggaaatcacaggttacatagttgattaatgcaacttagataactatgcttgattggctggcagcacagcatctccaggaagaaccccagtctatcatctcaatgctctgattcatctttatgccaaaatacaatgtgcaaggtatagctgcagcccccgtctaaaattcccatgcattacgcttttcaatggccacagattaaaggtatttaaatacatgttagttatttccatttccaatgagagtttaataaaagactatatcttctctttttaatgagaatattaacaacattagtaggggccaagaagattctccaagtctatgcaagagattatatttatatatctgtttttatatctatcatcaatctatctgtcatctatctacctaaattaccattcagtcctctcttttcccgtaacatatcagtggagatgttatagtagtaaatgtggcattgtggacatttataaacatttgattaaaaccatggatttcccttcctgaaaatattcatatgcacatacatcaatttgctgtataatttccctaaacttattcatggactcccaatgttaaaaattttataggacattttaaattataaaatatgatttctgtgctattcaaaatcataaaaacccactatagataattttgcatcaaaaatcacaaatttctaacaacgcacctttaataagtttaacacaaatcatagttctccttccacatcacatattctctattctataagttgcttgacctcccactttgtaagaatcctttctgtttctatttgagtattcttgttctcccaagggatggatatctcagatttaaagataaagcttttattttaaaacatgaatacacaacccagcacagtactatgaaatctcagaagttcttcctaatgtttaacgtaaatatttcctatgccagatgtagctattttccttgtcacttttgcatcataggctagaggattacaaactgattacccagactgcacttctctgccctacatactagcaaattctgctgcttccaattttccacgaagagctcatccttcaagcatctactccatctggggagctgtggtggcctttatctaaaactagatttaacaccagaactctagatgtgggttttcaaatggaataagaggtcatgtgggatagagagctcttttctttcatactatgtgatggatgatatcgtttggatatctgtccctgcccaaatctcattttgaaatgtaatctccaatgttggaggtggggcctggtgggagatgtttgaatcatgggagcagatgcctcatgaatggcttgggtcatccccttgatgataagtgaactctctctctgagtttgcatgagatctggctgtgtaaaagtgtgtggcttctcccctgcattgctcctgattttgccatgtgacatacctgctcctcctttgccttgtcatgattgtaagcttcctgaggcttccctagaaaccaaggagatgccagcaccatgcttcctgtaaaacctgcagaactgtgagccgatcaaaactattgtcttcataaattacccagtctcaagtatttctttatagcaatgcaagaataatctaatacaatagcctactttaataaagtttgaactttgtatgcaaatgttacacattactaaaacatttttatttttatttatttattttttgttttttatttttttgagatggagtctctcactctgtcacccaggctggagtgcagcagcatgaacctggctcacagcagcctccgcctcctgggttcaagtgattctcctgcctcagcctccctagtagctgggattacaggcgtgtgccaccacgcctggctaatttttgtatttttagtagagaaagtgtttcaccatgttggccaggctggtctcaaattcctgacctcaagtgatccaccagccttgtcctgtcctctcaaagtgctgagattacaggcatgagctaacatacttggccctactaagacatttttaaatagtgaaagccacccactagaacataaaagaaaatttaaaaaaatgcctctcttccaaatttcagcagtcttaactaattttatttctctatattctcctagctttttaacctgcactcagtgttaccagatgtaatcaatgtagatacagccatttgttgatcgtatacacagtactggttaaatgtgaactctgcagacagactctctacatttgaatcccaaacccaggggttatcagccctgcaatcttgctcagttccttcatgtgtaaattagggaccataatagtactacctaataatattactgttaggcttaataaatgtaaagtccttcaaaagtgtttggcacattaaaaggacctaataaatgctatatttattatgactagttatttagttcctctatataacactaggttggagccaattttctgcagttgcagagtctacccaataactcttaatggccacacaatatttctttacctcttggcatgtaaactcatttaataatttctataccattgggtatttaaattgtttccatcttttactattatagctaatactacaaagaatatcttcagacatacagctcttttttttctcctttgaagtgattttattaagacaaatttctgagtttaataaatggctgaaaagctgaacattgttagtgagccctgtgttataaagagaaacaaaactgacatccattcaggttagtggcaaggtgtttcattaaagaacatggaatatttgtaatactgtagtattactgaaaaagagtaactttcatgggccacaatttcaattttgtgttccacatcctcctgcattctgaggtcaatggagtcaggacctagcggtttttcagtagaaatctttcacatataaaattcaaggcctttttgctctgatgaccatagagctatttttcacagaaataaagcttttcctgatggtcttgaaacaacttcccacagctcaatgaaaagcaaaagcatttttcttttctccaaggagcctcaggctacatgtaatacagcacttaatttcctgcaccttagttggtaactgttaaatcaattcatgagcaaagaactgaactttcttgaaattctccactcatgctattccactatatcaacatttcataaaacccctcatttctcccctactattactgggcaaagtgaactaagaagagaaaaagaaaagaaaaataattcaatctaagttactatgaaccacagcagatctcatgaagggtactggggagaaataagatgttaagtacattgcaggagctgacaaactaattctggatgagccaagtcacaaaaaattaagagaattattgtatcttatacgttatgtatccttcactatttcagcaaaggtaaactaaaatgacaaatatgtttccacacttacataacccatatattcctccagattgtagaagaaaaatgctatgctgaaatttttaaaaagaaggaaaaaaggtaagacagatgaatggatggagggaagaaaagtgggaaggaaggaaggaaggaaggaaggaaggaaagaaggaaggaaggaaggaagataaaagaatccactaattcaatgggaagaaaatagggagatataatgggtgttggtggatgttagaattccaccaaaaacacctcaaattccatttaaattgatttgatatgtaggtttttcttgcccttctgagtttctcagatagtatattggcaggcagcctcattccctgcagtaaggatggttcttaaaaaactggaccaaaatcaatcaattagacattgccaaagatttctctccaagtgtcatctaaaaatcattaactgtggcatgaaatatcatggacattgtataagacatccatgcatcatttttggttaccaaggaagaataagcctcatgtttgaaactacagagcctccttcatgtcatgtatttagtaacatccagtacatctgctggctttgtatgaattcagaggttcaagcactcttcaaattcttttctcctgtattctgtgttattcgcccattaaactttttctgagtcgacataagtatctgcattgttgaatgctgtactgtcaaccagaactattgtgaatctgattctcagcccatttgctggaagttacagtagcaaggctgaaacattacaatagcaaggcaaagtctgatttggctcagaattcctgatttaaactcccatcagcgtatcccacccatctttgaaatccaacctacaaagcctaacttaccatttcccacctacctgcctatctctagctttccctatcacctctgccttccttctttctactaatggtatcttccaacctttacttaatttactcctaatttttcctttagatatcaattcaaatatttctgtttggggggaagtctttcccaaccctcatccccagattagatcagtccactctcatgtatcacatctgaatgttttataaacaaacacaaaggcaacttaatgcaggagtctgaaagacatacaatatgtcccaaggaagaggtagagaagctgaggacactagttttgcagcactgtaaaaagaagtatcccaaaggattcagaatttcccaggctacagactgactccttggtttactgagacgtcttaaaacggctcttcaaagctgatctcctaattgtgattcttgcctagaatctgatctggtcctactcatttctcttatccagttctagggttttctgggaagacaggagagggaaaaatattgactttcctccaagtgatattaggaatgactaataaaaataatggtgagtcctggaaaattcagagagctgcattaaaaaattaatggcccgagttccttggagtcatctgaaaattaaacaatcacccagagacaaatccaaatttttttaaaaaagcatttcataaagacacagtttattctaggaattttcagtaactgttattgcttttttgtggtagctatgcttcaagtaaggctcatttcgtttcaagcctaacttagttccattgcagacaaggaaaggggacggggaggttatattttcatattatctgattttgtgaaattgctatgtaaaaatgtaatccatttcatgaagataaaaaactactttaaaacatttttaaataaaataaaacgtaaccagtgaaatatggctgcatgattacggggcacagttgaacctaattaccagcaaattacaaaccactccactaaatgaatataaatcctcaacaatggagaagggggctctatgactatatgatatgcttggtactcttttaaatgatacttccctatttgagtaaaacaaagaagaaactgcaaagggatgaggcaggataactgcggctcatttgtcacaaggctccaacttgcttgatttttccctgtgtgtcagagaatgtgcacattgaaagagagggagctctccatcaccaagagagcccaaaaatagcccaactgatcatagccattgtaaaaatattcatggatgtaaggaaagatcctttcccagtctgatgctccttgacttgtgatttgctaaatttgagaagccatcacttacacaacctgttttatagacaaatccttccagtttcagaagaaaaaatgtcatctatctcaacctccatctctttttcaaacttcgatagatgagaagaaaatggtgaataaatttttagaatcagttttgcaagattggtttcaaggaaggaagagaacaggtgaagtggatagagccacacttcccacataactaagggcaagttagttttatcacttttgggtaaagtgttccctatgaggggatttactcctttcataagaaaatcaatctcttcttccaacaaaagctactgaaccacttatgctgttacataaatgtgttaatggggaaatccattcaaacatctgcactaagcactctgtatttatacatatgaatgagattgagagacactgccattcctactgttttagcttccactatagtggaaaagggaaaatatatacaatatactctgatccaaggagaaagaagaaaacttcacaaaatacaaacttgttaaaaaataaagacaaaaagaccaagtttccctggggctgaagctgggttatgggcacagacaaacatagggcctctaagagagtcctgcatgctaggcaatatttagagttcttcctcaccagtagctcaggatgcattcagatgtaagctcgaggagtcacgcagcatctcttggcattattggttgtttgcacatccatgtctgtagctggactgcaaaccattctcaaggtggtaaatattcttccctggggctttgtgcatggtacaccctcagtaaatattaaatgaatggatgtatatctgacactgggcgtgtcaaggcttcggaaaatttacttccactcccataaaacttcttctttaaaaaatgcttgcaaaaataatagataggaggattcaatttgtgtttgcaaccttgagacagcaagctgaggaactggtttgtctgcttgctgcccgtgtccttcctgctcagtggactgattcaaggatttgagtcttcaggatgttaagtgagtgaattaaaaaaaaaaaaaagtagaactgaaaacagtgaaaaatgcctgtcatcagcatcgtaatgactgatcaccatcagccagataattatacaggctgaagatgatttttacaaacataaaacctaaaatagatgcctcaaggttaacacatcctaattatcttttgtataaacatcgtataaacactctatactctatttttaaaggtactgctaaagaaaaaataaaaagaaatagagttaataaagattatttgctatatccagagatatactgaaattccagaataaatcttcctattacattattacctatcaaggtagagcagagtaaaaattccaccaatacaagcatctttgtaaaataacatatttaatatgcacacttaccaaaatattacagtgagaaaatcagtgacaagtatttatgtatataaaatgtgtagagtaagccataccaaaaataaataacagagaaagtacttcaaaaattccatatttgcctactgtttatatacctcacaagaactatacctattaacacacttgagagaagatacatagtaataaaaataggaacgtggtcacactgatggctaatcagaaaaactatttggtgtaaaccagggtcgtcagagtttaagaatttggcaagaaagagaggaagagagaggagagagaagaggggaaagagagagagatagaatatagaagaaatggtttctacttacagctactatctaatcccctggcttttctgaagttgaagccaataatatgtgaatactttaaggatacgtaagcatttgtccaaattagcatgactgatgttcagataaggacataacaaggacacagtgtggcactaaagaaacaaagttgctaataacatacagcttttgcaagtaaactggtttccttcatatcaatcactgtggaaggcttcacattttctttatccaacgatgccatcagtacaaagtccatggtttaggtgtttctttaaattatgctttaagaacctaggacaggtccttcaactgttttcaaagggaaaaaaaatacatcctaacaaagtgaaaacagatctttcaaataatatagataatgaagctgcatattaatgttttagattaaagatgattagtatctattatttcttttgttcagtacctggcatgagagctatctataagtaatcagactttatttatagataaataaaatttataggaagccattcgtttagactgagctcctgcaccaagcccaacagaccaaaccaagatggagtcactcatgctgaaattcctcatcaccaagccaaaactaagttgtttatttgaccttttaagcaatcaggagagactcacatccccaaacagtccagttttaggtactacgataaggaagttcctcctgcattaacctttgcaagtaaagtaactttgaaaagaccaatttgctttttgttttctatatatgttttcctctacccttttctgtttgtaaaaccaaactctgttcagctcattgaaatattcattctattttatagaatgcaaaattgcttgactctagaatggtaaataaaaaacaattaggatcttcaaactaaaatctgttgtaattttgtctttagaattatatctacctgttgggactagaaaaggttttgtgaaggtggtgttttctaagtgggaactaaaaagattggtagaaacaatacaggaaaacacaatagaaaaataatgaagagagtttgcccaaggaatggtaagatatcctttttagttaagtaaagtataagtaagataaacaactagaaatgtactttggggacaaaatgtgaagaaatatgaatgtcaagccacggaatttggactttactcattgttctccaggaaattatgaaagattataaattacgagattggcttgaccacattgttcagataactccacattccaacctcccagctaaggatattgcctcactgtcacctcactgagatggattggaacccctttccctgtaatctgaaactaacataaattatattaccaacagcatcttgtatgtatcacaacactccatataaaaccaacacctactgataagggatggaataacgttacttacttttctagattatcaatgttaacagtcagcgattcattaagaatcatcaaaccttggagttaaagaggctcatatatgcagtgttcaaaaagcaaacgtggaaacaaatgctcactggcaggagagctgattcaccagtcgtacagtcactgcagaaaatatagtccacgtgtttaagcactaaagtttcttttccctcacaagagcacaacttcaagaggaaatgcatgggtaaaatggataaatcccaggcctacacaacaacctagatgaagtctagaaatttagtgctgagtaaaatggacaagtttgttcaagtcatcatccagcgcaaatcacaatgttctgaatgtgttctgacaaggttttagagtgtagattcactacttttttggttacagcttattttaaaatttatgatttcttataaactcacagataaccaaggtgccttatgagaaaatgattctcattttaatgttgttgttgcaagttagaaaacaatacccccaactgaaggcctcagaatccaatctttttctgtccttttcctgtcctcctgcctctcagttccaatttttcctgaggttagccatagaaactagaccccttctttcccaaggtgggtgatagaaaccagaaccccatttccctgaagccagccaaaaaccttaacatattactctaacttgccccctctacctttctgtacaaaaattggctatgaaaaaattatctgacctaccttgtttaactgtaggtaataagattccctttccagagagggtcctcaccacactcagaagaaaggaatacgtactcagaaaggccaagaaaaatctagacagacaggtcttactgagtttccctactcagtctattagcattaaatcatattcgttttgtccaatcatatttctacaggatactgtccatactttgttaaacctaagaataaaaagggacaaattattcccctgcttctttgggccttcattctgaaaggcttcatgtcatgtaaaactgtgatcaaacaaatttatatgcctttttcctctcaatctgcctcttgtcaataattttcagtgaaccttaaggcagcagaggaaaatttttctcttagcccgtatactctccattcattgataaaatgattcactgctgtccctatcaaagaatagattgtttctaagtgaagatattatctcaagtttattcagattttagagatatgcctaggccagaagagagaagccagaagttggtaagaggagccaaatttgaggagcagtcataaaacacttattacttttattgggctgaatgagaaagcattctgtaaagatttctgtccatatgcataactgctgtgattgcaaaaccaagagacacagtaaagacggttttcaagggaaaccaaagaatgatgcttggtctgcagtgggggcagctgtttgatcaatctctatagggtattcacatgaagtttttggtccacaagaggcaaatctcttactatttttaactgggtaactatgagtattgcttgcagaacctacaactgtgttgcagtgctcactactgcttgcatgggtctttacagtgaacattctttcctccttgcgtgtattcagagcacggaagtccaccgcccagcatctgtatgaggatctggctgtcacagtccctgcagctcctatcccgtacacatacatttccctgttttctttttttgagacagagtctcgctctgtcgccctggctggagtgcagtggtgcgatctcagcccactgcaaccttcacctcccgggttcaagcgattcttctgcctcagcctcccaagtagctgggaatacaggcgcctgccaccatgcccagctaatttttgtatttttagtagagacggggtttcgccatgttggccaggctagtcctgaactcctgacctcgtgatccacctgcctcagcctcccaaagtgctgggattacaggtgtgagacaccgcgcccagccacatttctcctttaaaggttttacgctgttaccaatcagtcagcttacctacgttaaagactgaaaatcatcactatgttaacatatattgatgaatagacattatgtatgtaacaggatttttttaaatgacaaactttgactaaggcatcagggaatagatatgaactctaaaattttattccagaaaatatagaaatctgaaaataggtaacacagaaattgattacactgctctaaattctacaaggaagacatagaaagtttaagagtagggcttggtaatttcttcatctaaaacctagagaaagggcttcaatagggccatggagagtttttgatcttcttcccattgtactgagaagcacagtacaccaacgtcaaaatatagtcccacctaggaacgtagaaagcaagggcaaggagctcatcctatattttgactgaacggcattcccaaagctggtcaagacagaggagaatgagtgtataatacttctagaatagatgtgggccacatggcaaaaaagaaccagcctagagtcttttaaaactccaatgcaagagaacagggtaagaggaaacgaggctttaataggaaaagcctacatatggtagaaagtggaaaaccaagagctgatggaaaagtggtttgaaggtgagaagtcatcactgaccggacagagtttcagttggagagcccacaaagggaagtctctaaaaaacccttaactacagtaggtaagcgctacccccagattcttactgaagtaccaatcaagtaacaattctctggttcccttcctgctcctccctctccatagtctaactagtcctgaagatatcagtcatggtggttggtttgggcagtgggggtgactaaaatttttggtggccttcctgcaagaatgtcacagttagggcctgattgtggatgagagtgtggaatgaataacctttgaataacgaaggaagtgtttatattatattgagctgggaaatttacttattaagtgaataagtgttttacaacttgaagaaaaatgatgagtttcatccatggacatgggaaaatttttcttatgcataaatttttaaaggacagttaaagaaaatgatcagtttgtatactgattttaccttataagtcatgcttggttaatgtatgagtatatatatatatatatatatataaaatgtacattcccatagagaactttatttaacctagacagccactctgtgagataaatatgtctctcatttcataggtaaagaaaatgactctaagagagagcatttaagacaatcaatagcttgcttgaattgaatgaactgccagacatttttctaagcatttcacatatttatttcatttaattctaataacaaccctatgaagtagtcactattatattccccattttatagatgaagaaacagaggcatagagatactaaagttcacagccagcaagtgatatggtcagcaattacacctgtcagttgagcttcagagcctacagtcctatccaggaggcacatgatatagtgagtgagcagcaaagccagcgtctacaccagaaatcctgaatgagatttcccctagatcaatttgtgaggactcagctgtatcataaacaataaaacaaaagttaaaaaggaaggagggcagcacaacaggtctgtcactatcttgctgtgtggcatggggtaaataacttacattttctgggcttgagtttccatgtcgattaaattaaggaaatggactagagagtctccagggtcccttccagatttgaatttgatttccagctctaaaagaatatgtgtgtggtgggtagctaatgcatattaaattatgcaaacaatttagccttgcatttgactgcagggctgatgaaatatttttaaaatttacatttacataagagatagttttgaaaaaatgctatctgaacataacatgcaatcaaaaatatgttttataacatgtcaactggatgaaaataaaagacagtttcaaagatcaaagaagcctaaatgtgtttttttaaagagagtgtgatggggttatacatagattcattattattatttttagaactgcacagctgttttggcagcttgttttgtaaatcctactttgcaaatgtaatgaggtttttttccaaacaaatgttagttaatggagcagataacacatttatttccttgtcatagcttagcattaaataagaaatgtaacaagaattcagagtttaaaatatgaaacatggtatttggtctctttacttactagttacaaaattagaaaataactcaatattttactttctctccatatatattataattatctgtaattataaaatatttttcataacttcatttcttgtcacataagtcttttgctactgtaaaatcaatagttgtattactagtgcctcttcaaagcaaatctcaagtcgctgagcagaaatttttatagtatctgacatgatttaggcacttcttatgtgcaaaatactgctctgaatgctttacatttatgatattatttttttctcacaacgaacccatatctaggaactatcatcctcatttgacaaatgaggaaactgaggcagaaagagtaacttgccaaagttaatcagttagttgaagagctaggatgtgacaacagaccgttgagaggtgcagaataaaaccagaaacaacaggataaatagcaataatataagctaaaatattgtaatttttagttcaaatgtttgaggctttgatgtgatatcttagatatatttccacagaaggtctgtcttaaaaatgtaaaatttaggccttttttgaagccttatttattcttgaaaattctgtttcattacaaaaaggatttgacaagagaaatgctgttctccacttactcactacactgaatgatggggcctcagaaatttgtggtgcagttttccttacactttctgcagtctctcacattcagtgtgtggggtatattagtttcctggggctgccactacaatcaccacaaactgggtggcttagacaacaaaaacttattatctcacagttctgaaggccagaattctaaaaccaaaacgtcagcaaggccatcttccctctgaatcctctagggaagaatcctagtttgccttttcctagctttggggggttaatgaaaatctttggtgtttttggtttgtagccacatcacttcaccctctgcctctgtcttcacacggccttctacctgtgtatctctgcatctctccttcttttataaggacactagtcattggatggagggcccactctgaatcaagtatgacatcatctcaaggtccttaattaattatatatgtagaaagcctatttccaaataaggtcacattctgagattcgaagtacacatgaatttggaggacactattcatgtgtggagatactgtggcctggcattaagttgacattgacatacacctctgagagaccctatattaaacacataatctctgtaatgacttcacagatgtctccatgctgccgaaggtcgcactgtgacctcagcttgggcacttagcaacacatgggcaaacagttttcagcgatctcaaaggactgaggtgaaaggattaggggtaatcctctgagtacagtgcatccagggcttacctaaaacataacaaatatgtgcctcagccctcccaaagctgttccctatagcccttatgcaatcctagagtgcaaaggcttcagtgtttcaaatcctcatacttcctgtaatcgtttcctgattatactgcagatgctagtatgaaaatgtctacttggagatttcctgcaaaactgtttccataaatctccaataacagtgtaaattagaaacgagaattaacctacactcatctgactgccatgacatacagagaacacactactcattcatttgctgtaggtagtcacttcatccacttgaagaacattcgtaagtgataggtggtgtttttaatcataagttagtaaaatgtgtattttattggtaggttatattttcaatcttctaaatatttctgaacaattgtctgattaattccttagaatgcaagctccatttgttctcagatttcttgccaatatctaggtgaacatctggtacatagtaggtactcaacacaacacatattttttgagtaaatgaatgaatgagtgaatgaacttggctgaatgaatgaatgaaactggatgacaaagaagagaatgcaaaattactagattcttaaatacacaacatgcccccttattactctagtcaaaaaataatttatgctaaaagagctattttgttttggattctcttccactgtgtgccgtccctccatactcccactatgagatgtttgaaaattttctttaaggagtggctaagtgtactatgtaccaaaatcaaaaagtaagtatgtaaatgactatatctttgttttcactgtggcttccaaggagttctaggtcaattaattgggtcaaatataaaagctccataggcctttatgcctacagattctgtatatctaatatttatctgatatatgtatattagatatatatatgtatatattagagagacagagagagctgtaacacatataacaatatgacctcgaattaatattttactcttgtttcccacattaagaagttcattcttttgaatagtttcaggtctacagaaattgcacagagagtgcagagagtatatactataaataaggcaccagatgtgattactcaggaagagcgaagagacatgtagagcttaatttctgcccatgaggtaagtggacgtgagagatatacacataaacagataaaatggatgccttgtactgttgaaaaagggatgaccatgttttgcaggcagtattacagtgtttcctagaatcaagaaatgctgtatgtgagggaaaaccgggagggacttcccagatgaagtggctcttggactggcctttgaaaaataatgtaaaggtacaacaggtatgagaaaaattttcgtgacatgaatggcataacacatatttttgaatgttatctaaaatattagatgaatgtaaccaccatagtctggggctagaacatatggaaccacagtctagaagaactattactatttatgttatttataatagtaataacagtatgaaaagttctttgtcagttgtgattcactctgggtaggacattgtgattcaccttgttttctttccaaacaaaaacattattatctttaataattttttgacatcagagaggcaactaaactcttcgttaaaggataaggttgagcacaggcatttatttgatcatttatattcagctctattcataaaaggattgaaaataatttccacacacatataattaaatagctataggatttcagtttttaggagattttagttagaatagttatttgtgtacacatgttatcactcctggttgggagagaatatcattttaccttagaagggtaaattgtcacccctttatttgccacaacagagaagccgattttcagtcactcctcctacatctttattccatatgagatgtaggtaatctcattagtcaaaacttgatgcactgggccatgtaaaaaatgaatagggctatttaggtttaaaaggtggtgggagagtggtcagtcggggaagcactattttatatcactgcctgaatagtgacaaagaattcctctcctatttccacgtggtcagcacttctaaaacagagcccaggttctctcaatctcagtgcacacataaaagcctgaaattctccttctttcctgctctaccagagaaattccacaaagctgaatgcataagaacatttgggatcacttacagacacagctttctccacaggtaggctctgaggtctaattcagatactcagaaataatcccacactctgtcttagagcaacactgaattctgcattgcagcttttccagctactagacacttgccactaataataaaactgtactttgctccccatttgcactcttgtccctattttctactagttagaacctagaaaatcattactccaaacctcaacgttctttctacactggaaagttcttgatgaggaggatcatggaatattcgcattttacctttggtgacatgctgatgatcacagggcaccctgcccattgtggatgttcaattaatattcttaaatgtaaatctggttaatataattctttgagatatctgctaaaatatgccccaattgctgctatattctactctgtccttcaaataatctttacaccagaagtttccaacacaaatgtaaaaaacatagtattacctttgcaatttggcttcccaatgatatgagactctagctaaatgcaggatatggggacagaagggagaggagattttcaaaaaaataggaagaacaaaatgtattgatctatttgatttttgagaagcaggtcacactgcagaacagccttttatctagcattccacagggagagagtaatgtttgtcatgattctcaaggcaaatcaatagagctagagaataaaaagaacaaaactccaaatctcaagttcccaattaactcagaaagcaatgaaatctagacaagctctaatgtaatgcactggctttcataaagtcatagaatcaacaggctggaagtgttgaaataagttcctggagtcacctagaaaactactggggaagctggattttaactcattggccctggtgttatgcagcaagcactaggctcttatcagattgctggtgactctgaagttatgaatgttactgggatttacaacaagctgattggactgcccaggagctactttagttaggttccaccaaggtacaagtacagacatagcctttattcggatacacattacagagacgtataacaagctattgtagtatactaagtactatttgggatttaccatgacctgacaaatgcagtgttcaagtcttgagtatactgctgccctatgaaatgaaatgtaatataaatcatgttctgccagtttaatccccatgacccttagtagttgataagcaatacctgtgacagtggaattattatctccattttacagatgagctatataagcctcaaagaaataaagtaacttggccataaccacattatttctaattggccaagccagtactaaaattcaagcctcctgagtctaaaccttatgctcttttcactacaatctcaagcaaatatcttcacatcaagaactgattttctagatcaatgacttatgaagaatatcagcttattacagggaatgcaacatgagtaaattaaatatcattcatatagtttgctcctgtatttttttttcaaaaatggcctatgtaaataagcatttttctaagaatctctcatgtgagtgtagttcagttactgtcattttcttattataacttgaaattcttttaaattctgaagctctcgtttcactttctaccctctgtaataaaactgaaatgtccaaaaaactaattatactttcatttttggtgtttatgctgtgaaccaccttttaggtcaaactaaaattattttcatggctgcctttagtaattaaaacttcttgcatgaagtaaaagaaataacatcctattgtgagagtattctagactatttcaaggttatcttgtttttggtggaaataaccaaagataattgagtgaacgaatagtgtgctccttaactatgacagcaaatgtttgcatatttacaatgtgctggagatacaaaaattagcacaacctggtgcctgtccctgacgagactgcagtttaggagagatggatacacaatcaattaaacaaaaatttatcaaacttagtcatataagcaaagaatggcaggcttagagaaggccagtcattcattcatgtgatgcaagtgaaaattccaataaggaggtgataactgaaccttgaagtaacagacatacttttgctacaatatgaactttaaaaagctaaggagtaaaaggatcaatcctagagctctgaattgtatatcatcggatttctggttaagttttccattacatgtgctgttggcgcccatcagagagaggttaattttctgatggagctatgaagcctcccaaaggtccttaccaaatcagaaaaccctccaactcaaatatgcatccatggtagactctgtttggaagcgttcccactcactgtttgcattcactgttactagtgctgagtactgtggtgttactgagttatggagaatttaaagcagccagaaatctgtaccctctttttcagttgcttagaatgatctgcaatctgactgaattgattgatttctgggatcatgaccagttttggttgtttcacatatgcttacaaatggtagatacagaggttttcaacaaggaaatgttaaatcgtctcccaaaaaggcacaaaagagagaatggaatgaactgattcttaatgaagaaataactgaatgaaaaagaaatccttttatctattgtgttaattaatattcacaaaacttttaagacaatggtttattgttgttctgagtatactcttgagattgatttttgtttaattatcttcatttttatcaacaagtgatcaaataacacaacagttccatgatagcagagggttttgaccacttatgggaaactttaagacactatatatctgctgctaagccatggcatgcacacttacaatgtacagaagtgttgctgtaaaatatgtcagcctttcaaaatgttttcttcagggtttacatcctatgcaattctaagataataaggcaatttacaaacttataaaaaagccaaaatagaaaattaatgatcaaacataaatggaattgtctgaatgactcagaataaattaaagactaccaggcctaaaataagaaaaatatagcatttgactatactaaccttttttctccaaataaattttgtcaatctccctgtttctttttgattaacgttcaatgtttagatctaatcacatcgactaccataataatttatgaaccatcctttatttactaattcccttagtgttacttccttaaccctcatctgcacttaacaattcactgctggatatattatctcattctccagttgtattccctttttgcctattgtctctccaagtaaatcagggaggaaccgtgtcttgtactttctttgtatcttaatgatacttaacacaactctatgcatatacctttattcagcagttgttcagaggttaacagtccgtgaaatttagcttattgttttaatgtgtttagctatctggtctgttgcatcaaagcagactagaagcagcaaccatgagaaaagctccgaaagctagcacagatgagaagagattacatttaaaaagccagccaaaatagtaaaaccactaaccccaaagtagactggggtccttcagtggaggggcaaatgattgcaaaaccttcagtgactctgagaatgtaaatgaaaagggtattcatctagattccaagttcaacaactatttatttaatacttattgtgtgccaagaactatgccagaatttgagtttacaaaggttgacacggcatctggatcatttgcttttgagatgctcactgtctactggtggaaagggatacattatcttattttcaaaaaaaagaaaaagtggcaaatgcgatgacaaacacaaacacattagagcagaagcgcagacaaaagatacttctttaacccagcctaagccaaaaagggcttcctggtgtagtaacttcccttgataaactcagttgccaagaaaatgtagttattgtctgttattgtttaataaggcactaatcactaatcactcctagaaataagttgaaggaaaggctttagaataaaaaaaatcttccaaaagtgcttcaggatttggggtgttcactataggcataactttgggtagaagtgacaagttttcaagcgatgtgtgggcagggaaaaacttagtttgtgaattgcaatgctactctgtgtgacaaagatgcgtcattcacaaaatacaaacaattacctaacagaaaaataaattcacagcaggaacaagagtgatttatagcaattaatgcagaatacacttaacacagacatcaagaaatactatcaaagctgaagcacaattacataaaccatctaggtatcgtttaagagaaagacaaaacatagtatctattctcccgaaggattcatgaatcttccttcaaaattagatttatacctgtgattaatttttttaatttttactaaattatggtatgctcttttgttatagctgatatccagatgaaatttatatttaaaatacaaatgatacttgtatcttaattgatgattccacgtttccacttaacagcctgaaagttcatccatggccatcctattttcttgaatcatcaactataaagtgttcataattaggattttggcaatgataaatgtacttaagcaatggagctcaaactaattcttatttaatggcttttcagtatcaaagtagacaaaattttagtctatcccaaaactagtttgtgctggttaccaaggaacatgggacctggttataaatccatttttctatttgaaatgacactttaaagattggctgcaaactgtgcactcaagatataaacactatatttccattttaaatgtcttcaacattacctaagctctcatgtgcaccatgccttttatgcttaacttttatcacagaactaccattcatgataccaaaaaaggcctcatgtccgagtgcccttgacatcctgctacaagaggaaaccactcactgatactcaagtctattatcaccaagaaatctttccaggaaattagatgacattcaaggaaaacactgataatcatgcaggaacctgaaggttatattttaaatgatttgatcagcctctgacgataggaaatagatttggggaaatagctgagcatctttcattcatttattcaacagttattgattatgtattcacaatgccaggctccattctaagtgctgggatgcaggacccaacaaggtagacaaggtccctggtctcatggaacttacattcctttgaatgagtccatcagtgcctagctaaatacatcaataatttcagacagtggcaagtgctgtaatgacaacaaaataggtaacgtgactggtgatttggagcaacaggatagcgtctcagcttttgtgccaaaaggaaggtaagaataaaacgagaaggaacactcactggaagatatgaagaaaaaaataagtagaggattcaaatgcgaaaatacaatgaccattctaagtcgatatgtgtgaggaagagactggaatcttgctgggtactgcacagacctggctccagcctacagaagagaagagcaaacaatccagagtgggattatcgactgcatctcttattttcattatgtgggagagttaaccacttttaacttttgtttattcactacaaaattagaggaacaacatcaaatttctaagtttgtagttaatattaattagtgtaaataaagcacttggtacatattagatgtccaataaatgccagttctctctttatcaggggaataagtagaatttacaaaatagggattacaaggagatatgaaacccagttataataatttattttataacacagctgacagtgcctcattcaaccttccagtaacccttcagaaaaggttttatcatctttctcttatggatgagaaaactgaagctcaaagagatcaagtgacatttgcaagatgattgctttgcatgggagcttggagttagacccaactaatatctcctcttggctggggatggaaagacaaagttgttggtcaaagggtacaaagttttagttagatgagaataagttttgagatcaattgcacagcagggtgattataatcaataataatatattgtgtaatgcaaaattactacgatagtaaacttccaatttcttaccacagaaaattatgtgagatgataaatatgttaattagtttgacttattccactttgtacatatatatcaaaacatcagtctgtacctcataagtgtgtgcaattatgatttctcaattaaaaataacaatttttaaaaagatttggctgcactacactgcctactgatcgtatccctatgataaagtaatacataagtcacagcttcagataaaggcgtaggagcttttcataaagtagtgaaagaaggggaagttgtaggagttacaatctgtctatagagtacaattccaagttacaatggttaagggcaagcctactgaagacagctaagcccagccctgtggtgtgccatttattagtcatacatgcgaaacacctagcatgctacctgacactaacagagtattcatttgcccaagttgtgctgctcgtgagtagcagggatgggacttgacctctcaagtttccaacacatcatgatacttatttcttcatgtaactagctgggaaattcacttgctacacagaaaagacaggttcttaaattatattgtattaaagtgactctttgttaaaacacaaaaatatcccaatagttacatgcaggttgtatccttgttaataacaatataggaatcttagaatcaattctggtctggtaagctataaagttatttacttcaaaaaaaaggacacatacaaaaaatatgtatataacatacatgtatatacacacatacatcgaaaaacatctatacatacaagtgtgtatttttcacctctatgcatatatgtgtgtgtatttatctatctatctacatatacaatgtcactatcccttgtttattaaataacattaaattaccatgtctccagttcatggactgtacatgtatttgtgcataaataaattgcttttcttattatcttctggtgatttactactattgagtaggagagcttcttgtatacgaagaacatctgatatatgtgtatatatttttataaaacacttttcatttattaattattctatggacataacagtttgagaatcttatggatgttactttttaaaaaattatcactacaggccaggcatggtggcttatacctgtaatcccagcactttgggagggcaagggagaaggatcacttgaaaccaggagtttaagaccaacctgggcaacacagtgagatctcatctccataaaaaaataaacaaaattagctgggtgtggtggcacacacctgtggttctagctactcaggaagctgaggtggaagaattgcttgggcctgggaggtcgaggttgcagtgagccaaggttgcaccaatgcattcctgccagggcaaaagaacaaaaccctgtcttaaaaaaaagaaaaaaaaaaattaccatggccagaggtttgttccagaatatcacccaaaaatattcctcaaatgaatactctgggaagtactggcttactaatacagagcaaaaggtatatattaatagaataaatgtgagaaacctatggaaataagtaggggaaataaatatatggaaacaaatgagtcatagaaatacattctttctatgttttaagggaaatactaaagttatgtaacctttgacacaacttgtggagcaaaagattgtgaatcttaactaaaaggaaaaaagaactattttcccaaagtcctcataaaagcaaagtgtgctatattcaacaatacgtgtatcaaattggcattgggatcatgcagctaacccaatttgaaatgccatttaagtagaaataggaaggcaaatcataataattccacaatcaaagctcaaaacatgtgttgacactcaaccaaaatatgaaaatggctaacattcacaccaaattttgattacactcatagtaaatttaaaactactcactaatattgctcagaatcagaagtttgttcagcgtgttataagcgactttctaagggcaagttactttgttcacatatggaccaagtagctattgacaaatcacgtggtttcttttcaaatgctttgtgtttgtggcattttattggtcattgtgtcaggaataccaaacaatttttttttttttagtgtttgcagaatattatacagtacaaacataaaataatatgttgcaatgagtcagcatccttttctaagttttataaagagaattcgtgataatttactttaggacagtgaccttgattgctttaaaatgcctttaatcagtgctaatttctcatcttaaaggaaaatggaaacatctgagtcaattctatttctacattgtcttacttataaaataataaaataatgagaggatattaaaggaaaaatcattcatttattcaaatatgcatacaattgctttaagtctaagatattgaaataaacatggcaccgttaaaaatattttaacggtctatacaattttctggcttgtaaagtcagtctctctctctgactggctcactttctatctaaaacatacctatctgaaacaacaaacaacacacttcaatacaaacataccagttgaacaagggacttcttatttattttcaattttttgagacaaagtctcgcttggtcacccaggctgaagtgcagtggtatgatcatggctcactacagcctcgacctcctgagctcaaacgatcctcccacttcagcctcctgagtagctacaggactacaggcatgtaccactatgtccagctaggctttttttatttttttaagatgggggtcatgctaagttgctcaggctgatctcgaactcctggcctcaagcagtcctcccacttcatcctaccaacgtgctgggattataggcataagccaacaactgacttcttgagaggtaattttgatcatatgatctctcagaatttcatttaaatttctttcatagacatctgagaaagagatattaaagaaggaaagagagagatttcatttaattcaatcaaagttttctctggttaatctaattctgtgccttagtgatgtttactgaaaaaaaaatggtggaatttagaggaagaaaaacactttctcttgggaaataaaagaaaatcatatgaaaatttacctgttacaattcgttaacagaagagaaaatgaagtgtatgtatctggagatttccaatcatctttccagtgctaaatttgaacctcattctcaagggttttctaaaataaaacttaacatacctttccatcgtcacatcctcatgtcctcaaggctaatttgatttagggattattctagtgtttcgatttgctatcagtttgagagcctttgtatcaaaaagaagtgccaaattttgtgaggttcttaagagaataatgcaggtgaataaagcctcagtatactgggcttctcaggaatgtagcactgactgccatttataattaattaaagatttagagattctgtacctttcaaacgttccttctttttgtgtggaacattttctaatatatattcaacatttgcctgccttttcttttgattcagggttgtttctcctagttcttgcttatcttcatctgtttgggtagttgtagccaatggcttataaacaatataactttatttcttacagttccagaggatgggaagtccaatatccaggtgatggcagatttagtgtctggtaagtgcttgctcttctggtcgatagatgaggctgtctgtctgtgtccctacccaaatctcatcttgaattgtactcccattattcactcaagttgtgggaggcacctggtgggagataattgaatcatgggggtggtttcccccatactgttctcatggtagtgaataaatctcatgagatctgatggttttataaggggtttccgctttcacttttctctcattctctctttgcctgctgccatccctgtaagatgggacttgttcctccttgccttccaccatgatcatgaggcctccccagccatgtggaactgtgagttcattaaaccttttttcttcccagactcgggtatgtctttatcagcagtgtgaaacagactaattctcagagtccttacttggaggaaggggctaactagatctccagggtctcttttataaggacatttatgacatttttgagagcccttatgacttaatctcccaaaggccccatttcctaaaactaccaccttaggagttaggatttcaacatatgaatgtaggggggcacaaacattcagtcatagcactgttccctgtcatcgctgtcactcttttctttttctcctttttaagtgtagcttcctgtctccttaggcaaagaaacaaaacaacctaggttggaagaagcacagatatcagatcatataaaagcagaataatttctactcttacaaataaagtgcatgagattgtatagaaaggcatcacaatttgtctttttaatgtttaacatgcttttttgctttcttcctgatcttccaacatattttggcttatagggaaaagttttgcaactataacataaaataaaagataagcaacagcaatcttctaaattgataggggtaaataaactttaattagattaggtaactacttttagaaaaatataatatctctctataaagacatattgtttaacactaagagggctcccttgagtatataaaactaagaagtcatcaagaggtttggtttcttgaaacacaaactctcagaattttgcccataagaccctaacttaaaataataccagtggactctagcaggttaattatcctaccaatcaaagacagttctatgcagatgtaaacatattgtttctagtgacaaaaaatgatgaggctttaagactcagagtgatggagaagaaacggtatgaatcttgcctcattctcttgctagcattcagtcacctccccacctcctactctctctggcttacaaaagccgacctatctaagagaactgcctagagccttctggcaatacattgtactttttggtgtgggtcagtggcaggattggaactagtaattggatttccgcactcccagttcacttatctatccactacaaaacagcatgttaattttggaaatatttataccactaggtcatcatgacctttgaatataaccactggcaccaattatataccaggaatctccttatgcctcacctaactagagtcattgcccatggcagtatggacttcagatgccttctctcctggataactgttcgacatatataaaacctcaaaataatgtgttatatttaagaagaattcgaagacagaatatccaagtgtggatatatcaaattaatgtctacatttctctcttaattttctatccaaggaataagagctaaatataatcacagcaggaatcctaatgaaatgtttcaacaggaagcaatattaaagtatatcaacctagagtgattgttttgatagactgtcttaaaggtaaatctagattttctctttaaagaatactgaatctcaaataaaatcaaatctcttccctgaaatatctgtcaaaatcaaattggtatagactatttttatcacaaacactcccatttttcatagctattccaatacaactctgatttaaaaactgcaatagaaatatttaatttaattaatttatttttaaattttattttattttttttgagacaaggtcttgctctgttgcccaggctgagtgcagtagcactatcacagctcactgcaacctccatctaccaggctcaagcgatcctcccacctcagcctcccaagtagctggaaccacaggcacacaccaccatgctgactaactttgtttttctttcttttttttttttttttttttttttgtggagacagggtttcaccatgttgcccaggctggtcttaaattcctgacctcaaccaatctacctgactcggcctcccaaagtgctgggattacaggcgtaagccaccatgcctggcctacaatgttttcattttattttatttttttttttttgagacagggtctcactctgtcacccaggctggagtgcagtggcacaatcatggctcactgcagccttgacctcccaggctcaagtggtccccccacctcagccttcccagtagctgggaccacaggtgcacaccatcatgcccagcttatttccatattttttgtagagtcaaggttttgccatgttacccaggctggtctcaaactcctgagctcaagtgatagccccgccttggcctctaaaaggggtgggattacatgtgtgagacactgtgcccagcctcattttatttttaaacaaaatcttcaaaaattgtcctgatttaataagaaaatacaacatcctaaaacatgatattaatatttaccatctttagttgtacagattctttatttctttgtaaagaacattattaggtcttcataagaaatgaaatattgctctttatgagtttaatgcacataagtaatctataattctgtatgaaacttttacaatcccttaagaaatgtcctgcaaatttgataatatcaaatttaaaaataaaatacttttaaggtccaaactttagatttcagaaaaaaacatgtggagtacttagtttatacagcctaactctgttctatcatttgcactgataacattattcctgaacacattttagcccaaacccagggaagataggcttacatgcaagtttacaaaaggaataaaatccaggtagtcagcaaagtgcccacaaatgagaaccgaaattcttctaaattgctttgttcaagtttcattatctagacttgtttttggcacaacatggttattgctcaccctttactatcccttctaccagcacatgttgtgaagaacaataaaagtactagggtcaatatataggtatgtctgctcaaaaaaataataataagagaaaaacctatttggttagaatttcccacgatttgcgtcatagcccacaaacaagaccgattcattcacttttctggaaatatgctatgaagcaaaaattttaaaaattaaaaacgtcttctggattgctagactggttcagtcgcaatactttgtttgaaaagggaagagaaaagtatactgtttggtaattggaactcaaagaccacatcctgtgttgttaaatgcagatttcttgattggcatgacagagtatgcaatataattatttttaattgccaattcacatatctaaagaaaagaatatataagactcccagaggcactgttctatagcaggagtttaatacgtcaatgcaggctttagcaaataagggcttttgtcaatatttccctggcacatcacccacaacataacaataccacttagaatttatataggcccttcatttgcaaagtgctttaaaataattaatccccagaatactcatttgtcaggggaatgagcaattgattataaaactgaggatttcaagcaagaaatggtttggataagttcaaaaaggaatctcattttgaaatagaatctctatttgaaatagaatctctaacatccccaaagttagcagtgctgttttgatatggttaacatctttaatatttttaggcactgataagttgaacccataggtttctttatgctctctatatttctcgaaagctcacttctgtactccaacgtgtgtgcagtttttaagagccacaggtttttccatacattctcaaaaatggtagaatgtctatatttctgaatataacactgagaaggcatttgtaaccgctattacaatattagaccattagcgctgtggtggcaagcacaagttcactattgtatacccgagactgaacacagtgcatggcacacagcaatcactagtcatcccaacataaaaagctaatgttctctcagcttcattaactcatatctttatttgttcattcatttaaccagtcaatcaatcatcatttgttgagctctgctatctgcaaatcactgaatgatttagcaagaagatgagaaaaatgttatctgtcccttgatctcatagagtttacaattaactagagatatataggtaagtgaaaaatgaagatgattaaagacaacaatagaagaacaggaaggtcggagaacaaaagaagaaagaaatatttctatttggtgagtgtcttagtccattttgtgttgctataaaggaaaatctggggctgggtaatttattttaaaaataggtttattttggccagtcacagtggcacatgcctgtaatatcccagcatttcgggaggccgaggtagacagatcacttgaggtcaggagttcaagaccagccgggccaaaatggtgaaactccatctctactaaaaatacaaaaattagccaggtgtggtgcatgtctgtaatcccagttactcaggaggctgaggcagaatcacttgaacccaggaggtggaggttgcagtgagctatcgtgccactgcactccagcctgggtgacaagcaagtctctgtctcaaagaaaaaaaaaagaggtttattttactgatggttctacagactttacaagaagcatggcaccagcctctgcttctggtgaggactcaggaaacttctggtcatggtggaaggagatgtgggaggtggagtctgcatatcacatggtgagagagggagcaagagaacaaacagaacatgtcaggttctttttaacacacagatctcattggaactaagagtgagaactcattcaattcctcaagaatggcaccaggcaattcataaaggatgtgcttccacgacctgaacacctcccaccaggccccgcctccaacagtgcagatcaaatttcaacacctgatttgaaggggacaaatatccaatcaatatcagtgaggattcaaaacaatgcttcacaaaagatgtagttttacttgggttttgcatgattttgataggcagaagaaattggagaagattgttgcagactgagggaaggccaagaagtagaaatagctttcctgccaccaccaatttggagaaatttgtagctgaaattatatcacttttgactacactctgtaaattcaaatttgatttgtgttgctgagaaattctggatgagattggcctgtgattaccatacaaattggttgtatgtaaatatgtgcttctatagtgtttgaggacatgacttattctttcatatatctgaaatattcctcagattgtttcctctcctaatgtatattgtatttaaaaaatgagaaaatgtaagtctcttttgaataaaaggctgaaagacttctatggcatactacaccataattacttatatgcaaacatacaataagtctacagaaactcctcaaatacacatttaactttgttctaggcattatggaggatatagtgttgttcccaaaagaatgtcttaacagtgctgatacattaaaaatgttctataaattcttgttaattaaatattacctgatgagtttacaatttgaagggaggacgagtgactccagactatgaggagaacgactggaatgccacatgaagtcgtagacagtgctctctgtgcaatgagtaaggcacaaaacactgagccagtcattgaactcaagtcttcccgatcccagtctaagatagtctttccacagatacattgattctattagatatttcctcattagaaggacttcatttcagtactgaaattacaaagctgcctcaggtatttatgcattttatttttcttcccctgtgctcatgtgatgctccacctgtcccactggggcctattttctctatggattgtgttcatctcccacaaaagccaatagaaactctggcaaaacataggggagcacaggcaatcccttctgccacccctagggcatgctcaggaagacactggtatcgctgctaatagcacctaccaggtgtcctgggttggaaaatcttacctactctgtcacatggcagccctcctcccagagctagccaccagtggtacttactaaattataatgatctactttaaatatcagtaaatgatggtgcaactgactttaaaaccaatttggatatttgctggacatatctgtcattgaggccgattatgaaaggttatataaaacttaacaatggggctgtccagatgggacctaatagtttaccttaatttttagcttaaacagagacagcccaatattacaatcctggactaccaatctattaccttccaaatgcctggggccaggtcctgggggaagcatggtaggtgccaattttggtcaagtcaggtctttcttgggggcggtcatgagaagtaagagtgaagagttgtagataattatatttcataataattcattttctttataatgttatgtatttttttatatataaattaaaaagtattattctaaaaagggaatccctagacttcacaagactgccaagttgatccatggcacaaaacggttaagaatccctgaaggctcacctggcgcagtggctcacatctgtaatcccagcacttgggaggccaaggggggctgagcacttgcaactaggagtttgagaccaccctggacaacatggtgaaaccccatctctcctaagaaatacaaaaattagttgggtgtggtggcacatacctgttaccccagctacttgggaggctgaggcatgagaattgcttgaatccgggagtcgagatcaccccactgcactccagcctggaggacagagtaagattctgcctcaaaggaaaagaaaattcccgaaagattgtccagaaatcagttaatgtgcaagcatagcaaatgcatgggacaaagaagagtagagaggtcactttccataaggaaaacacaatgaggtattgaaagtccaaagaaacatggacttaaaatattactgtgaaaaaaaaagggcaatagaaaggagtttgcaatatctggaaggggatgggttaagactaggtgaagataaacgaatcaccgggcatggagaaatcattccaagacaagcatcagggagaaaaccgaatactctctttatcttgcaagtagtgtcttaaagaaacagggtcccactaaatagtcacttgggagaaatagccaagagctactaattattgtttagttactcaattcatccagtaagtaaaaatgtattgaacacttattatgtgtcaggtaccacatgctaggtgatagatatccaatggtatagaaacaccacaaatggtctttgaccttgtgaagcttacagttgacttggagagacaggcattagttaagtgagtaagaacccaaaaaattatgataagctctacggaggaaaagagtactgtggcaacaaaggcatgcatagtctcgtggtcagtggaattgaagttttgacctgtaagatgagcacaaattggccaggcagagtggagggagggtgttccagatgaagggaggagcatgtagaaaaagagggtactgctgcttagtattttgaattatgacactcttcaacacactgcagaaattgggtagattctccaccttgagaagaagaaaagagagtatgggagtagaagtcaggtaaggaagggagcagggaaagaaacaaggaggaggaggcaaactttcgccatctaatcctttgactggagcccgagcaaccacctcttcttttatttactctccaaatcagagccatcttttctctcttacaccttttgccatgaaaagaatatgatgaagagaataagagaaaccctatttcattttaatatttaccaagaatccaaaatgtacaactgagacggtgttatggagaatataaaagtgagcacaacacttgctttgcagaacaatcaagtgacagggagaaaaaaatctaacagaacgcctgctaggtgttgaagtagagccaccagccctctgggtggccttaggcaggtcatgtctcctctgggagccttcctttcacatctgtcatagagcttgtaggcaactgactttgtgaagttcctgccaggttaaacagactctgctccatttttcagactgttattagaaaatgctcaaatacatctgagtttgtgtaggattggaggcagttaatatatttaaggagtcagacatataattaagattttgttgttggggtgggatttctcccccttttaagtctcacttttgagaaactggaacctgaattgagctgttcagagatgaagactaatatatcataatgtgcacttactaattcactaaatgtctagatgttgatgttggggatttaaggaggggtgtttactaagaccaggcacgggactaggtcccaggaattccaaattgcataaaatgtggtccttgcatattagtcattcaacgggctcagaatggaaatggccatgcagaaaacagtgagcataaagagtttactgctgtatcaacctggacatacaaaggaagaactctgagaccactaagaaggaagtaagtgttaatgggagaggtacatgtggaaagttttgtcacaagtcttgcattggtgcctgatcttaaggagtgaacaggagttagctaaacaaggtgaagaacattccaggcagacagactatgataagtaaaggcaagaagggaaagaatgaacataatgcttttccttccccagcatctatttcagtcacattgcagataaacaggattttaaacatgggaagtcatccaaatcagacaattctcattcttttatcaaaatcctaaagggaacatttttaaatctcttttgtaattgctaggaaaatgatgtgtgcccagagtccttatttagaaaaaacagtccttattttttaaatcaaacaatatatcaattttccaatagagctggaaccaaattctgcatttcatatgttaattgcaatgtactttttcttttgtaaggtgcatgaatatggtctgtcagccattacacaaatttaagtatggaaaaaaaatgggcttcacaaaaagcaatgaaatgcatcaacatcagagattttgtcacgttagtagacaaaaacatcgacttgaaggatgtccttgccaggttaggatacgtcccttttctagctaatgtcaacctagactcagctccagtcagaaatgcctgcttggttggcagctgctgagagatagcaactcctcctagcaacagatggagccaatcaaaagccagcagcagtgatccttgctgttaagtgcaatgacatctcatttatctggcaactccagtgaagactgtatagtgcacaagataattactaagagactgaaatttacattcccatgcaccagggactattagaatttcaacagcatgattggaattttgcctaaaattagatgtctgtgtgtttaaattatgaacaggtatcagagtgtggtggattacgcttaggttttaaagacacctaaaggtgactgttagttttatcacttactgcccatgtgttctgaggcatgatagtttccctgagttttaatttttccatctcttaaaataagatacatacattgcctggcctaacatatctcacagcagtgttgtgctaatcacaaaatatagcagatctcaaagccctttgaaactgtcaagcttcatgtaaataaatactaactgacattttcctactattagagaaacagcatttaatatagctaatagcttcagctcccatctgggtaatctccagtaagccatttcatctttatttcctcacctgcccaaggaagataatgctaggacgtgattcagggactggctgtgaagactgtagtaagcactcaaaaatgttaactaacaattattatcattccatcatttaatgctgcgagaacttgaggtgttgctaaattggagacagtttttattcctactaaatgacccccaaagcaatattctatagaacccaaaaacacatgtatccaagggatcttgcacaaaactctcttaaccctccacagctttttaacacattcatgcatgctagagattatttccaagacatctacttcccctgttgggcaccgagcgctttacttttgctgtctcctcctgatgacctctccattccatgaaattactattctcctgctctacatataactaaaaacttgggatagtccatggtttatttgattaagcaagtgctaccaagcttatagttcctcacaggtctgtctaaacagagtatctactttttatcttattatcaaaattctctcctgcatagaaaggaaagaccaggaaatttttttaaaggacctacagtagtcagtttctcaattctcactcaactccacttgcttgcggtaatatttaatattaaaaaggtataatataattatcgcatataccatactttacatgttataacacgtgaatctgttatacagttaagaacaggtcacaatggccagtattctgctggacccaaatcagtaagacttactgacaagaactacagttttaagctacaattttaaaatatcctctctgcttcataatgcttattccatactcagaactttagtagatcccactttgaatgtcttaatttttgtactgtttagctttcttgctgtataagctcctttgagagcagaatttttgtttcattgtttgtagcacacacacccaaagcatctagctcactttgtacacagtagtacatgcttaacaaatagctattaaagaaatactcataaaaacaaaaaagaaagggatggagaaagaggaggaggattggaggaatggagcagaaacaagagagattaacagagaagggagaggaaggagggaaataaggagaaaggaaagatggaaacagaagaaagaaaactaaattgttataaatgcatgaggagagatatcaaagatgtttgactactttaaatacaactcttagaccatttttcagatacagtataacactgtttctcattgccactcttgtatgtcacctcttagtccttaggatgactgatgctactacagggtgtcaaaaaaatggaattttaacaggcttcattttcatacaaactcaaaaagctaaatgtaaaaaaaaacaaatttttaaacagagatataatacctttgtttgtgttttacttttcttcccagaaatacacgtcgagctgccctttctctatatacctcccactccttctctgcctcccagccagattctacacgtcagtttgctcgagtccccagctctcacgtcctcaaaccatcgccgtctctcttccagacacacacctcagccaatattctggcttccagtgaaacacaaatgaagaaataaaagtcttaaatagaaattctaaactcctgcacatgatagaacatttacttttctaataagggagagaaaggtggcttaggaaaaaaaaaaaaaatatatatatatatataaatatatataaatcctatgaaaaactgtgtgaaaagatctagagttaagagtcttagtttttgtgtcggacactgatattagtgacccctatttcctttgagaaactttctatttttctaagatagcaataatgacactgctcaatccatctctctggttttttttttttttttttttttttgagatggagtctcactctgtcgcccaggctggagtgcagtggcatgatctcagctcactgcaagctccacctcccaggttcacgccattctcctgcctcagcctcccaagtagctgggactacaggcgcctgccaacacacccggctaattttttgtattttcaatagagacggggtttcactgtgttagccaggatggcctcgatctcctgacctcgtgatccacctgtctctaaggtttttatgtggatccagtgtcattacaaatatgaaaattttaaattttaaaaatgtacacaaaaacacacagttggattaccttttctgaatgcacatttttgtttatatgatttcaattatatgttaggggacacaacaagttggaaattcttacacaaatccatccattatggacgctctaagccactaattcccactactgcaaccaggtatacataaaaacgtgccttaacccccagttcaggtgagttgcaggttatgattctccaatgatggaatactctgagaaggcaaaaaggggcatcatttttctgggtggcatcataatcactaccaaaaaattggtcaaagaagcggggcatggtggctcacacttgtaatcccagagttttgggaggctgaggcaggaggattgcttgagtccaggagttcaaaatcagcctggacaacctaaagagagtttcttgacatatatttctaaggggcaaatgaatgaattctagttctcaaccctgtattgctgattgatatatgttgaccatgaatggttttctggtggccccagagagtcgacaatggtttgtcatcaagggcttatccagggcagaagctaataaaatatcacttgcacagattaaataacaccacatttcaggagaggcagtataaataagagggacctctggataatgaatggatttaaaaggtccagcctgtccaaatcaattttctaatctcataaaatggggttgaacccaataatttatgtttccttccacttccaaaatttaataatattatttacttgttcctttatttatttaaaaatatttatttacttaaaatgagaaaagtacctgtgaaagaattagatttgtttaatattctcatggacactatgatcacacatcatgtagtatttaaatgtgatcaacaaatagttgaaaatgtgttatgtgaaaaataataattttcgcaaacacttttacagcacttaccatatcttaggcatcatttcatgtgatggaagacaaatatatagatagacatggatatggataatgattgaggtaagaaatacaatggagacagagacagaaaaattcttttaatcattacaacaaccaacagctttagaacattaaccatgtgttaagtaattaacatgttatctatgatgccagataaaaaaggcacaataaatagaaaatgttccttatcgtcacctccagggtacgctttaggtaatgaagttctaatatcagagatagcagcaacgacaggatgctaattgtggtgaatattagaaaagaagccactgatgtagtctagccgacctctatgatcacttttatcaactgaaagttaaaaaataaataaataaagctagagtgggcacaatgctagatagcagagacagaactggcatatttggaagatctctcaattctacaggcagaatttttttaaaacaaaccaaacaacaataataacagtttactgttaggggaagcactgaggttgggctttaagagtttgctgagaagctgatttgcaaagataggcaagcttggaccccagtgaagtggtcaaataaataacagtgctcaaagagttatatttactgccacgcaagatgaatcatgcctctttggggaatgctttttctgaaatttcatttcccattttggactactggatcagtctctcagaagagtttggaatgtggccaattacttccctctgcatttttcatctgagacttaggctgtacaactccattttacattttcacaccatacatcttagatagtagggacttcattttgtgaagaataagacaccaaaaatatagtctgtttgtaaatatagatttgagaataaagaccaagaaacgcacgttagaaatcttaagaaatgaatttttactataattatctacagctctatgctccatacttatattttaaattataatactaatgaaaaaaatcactgttgagatgataaattagcagaccattaaaagcttttaagaatgaaaaccactctccaacgatattcacgtgaaaaaccagacagtaaaagaacaaacaagtaaatgtggaaataaccagaacccaatatgcaactgtctcaatcacatttaacctcagtattactagagcactcaaaagtaataggttgttaaaccgtttggagggcaaatgacattggcagatctaatggcaaaacaaacaaaatatcaaatatatttaaaatttaaaatatcaaagaggccaggcacagtggctcacgcctgtaatcccagcattttgggaggccgaggcgggcagatcacttgaggttgggaatttgagaccagcctgaccaacatggagaaaccccatctctactaaaaatacaaaaaaattagccgggcatggtggcgtgtgcctctaatcgcagctactcaggaggctgaggcaggagaatcgcttgaacctgggaggcagaggttgcagtgagccgagattgcaccattgcactccagcctggccaacaagaacgaaactccatctcaaaaaaaaaaaagaaattaataaacaaataaatttaaaaaaataaaagtccaaaccaaataaggtcctttaaaccactgacctacagcaatccattttacttgacggagcattgggtaggggaaagattacagataagttattttaaggaattaaattaggtgaatgttaaatattctagaattatataaaagaaattgtcttagagtaggcattgaaaaattagttcaaggtctgtacccacttacttttcctatgagacaataagtacaaacatgttttgtaaatatacaatgtaaaatataaaatacaatgtaaatattgtatttcatctacagaaatattacttgctttttgtaaattaaagaatcaccctcaatgtatcatgcaggagcaactccatttctgggtatcacataattttaaagcaaagatgtaaccataaacatgctaaattgactataaaaaataacatgcagagtgcaaaggaagagaataaaatgaagagcacaacacagccattagtggaaagaaagactgctgctatgatttagaccattcagggaaaaccaaagcagaaaccatagcttgtgtcagtctcattaagattaaattcacaaatatcccatctgctatggtttcctaagtggctacagtgaggacacaaagcttttccacacatttgaagaaactgtggcaacaaaaaactccatcatctctgtggaggtactgttgggtgggtgatgggggtgagagagtttgcaggaaactggaagatgggaactggaagataagtcggacacagcctttgccttcaagatgctgataattcatttctggagacaaaagtacaaactcaacctaaggtgggagagaggtacaagcagaaagctatggaagaataaagaaaggcagactacttcttcagtttcaacaggaaacacagtgaggatttcatggtggaggtatactgggtcttaaagaagaaacaggacattgataaataacgatgacagagagacatgagcactgactgagtgcatggaaagttgagatatatgaaatgactgaaaaggaaaggaaaacatgtcataaaagtaaatgaaaatggagatgaagccagagaattatgctggcttctagagggaacccatcagaaaatgttattctaggctaaactatgttgaaaatctttcatccttcttaaaactctgtacttctcagtatttattttagagtacttcttcttttactcttttttcttctttttaagagatgggctgaattaaactacacaaggtgaagtagatatagaatatttaaaatggtaaattatcgagcatgaaatctcatctgattcaatgagtgaaagtaatattgattaacccagccactgaccttgagtaacagacataagaatactgtaataaacacaaaaaagtgctggtaaagtatttgtcgcaatgccaagagctacaacctggattaacagtcacacttcacaaaatagacttctatgactttagatgtgcttattatgtctaacgatgaagaaggtgaaacaaactaaactgagagtggaagacacatgttgcccctcaactgtgtgctattttgatatcgtagagatgatcattaagtgatttatcataaaatgtatgaactaaagataaatatttaattatagaaagtatgtcttcatgtgtctttctataaagatttctatgggcttcaaacttcagttagagcccttttaaaatatttatacttaaaactgcaccataaattgcaatttgcaaatacttatgaggaagtaatattctctctgatgcaaggcaccaaaaatgtacattgcagaattgatacatacatttctatatctggttttcattaaatagctcaaaggtgtcattttaaggtacaaaatattataaaatatctcacaatacatgtttaaattgatctaaggacagaaagtaaaaatctgttttgcaatttaatacctactcaaatgtaccacctcattaagagatatgtataatttttttaagtgctgacaataatcatttggaagcccaagctcagtaagtacagttaaataccagtcctaggaaaactcttaatcaggaaaactcttcttgcatagtagtcttctgtggtcaaaatcattgtgtttacagttgtaagacacagcttcacaacgaaaacatggattccactctgtttccactacttcttccacttttttggtccatcaccagagtgttaaaatgttgtctcacctctccaatcgtgaagaaattcacacctctgtattactttaaaaaatgtaattcaattaatgtgtattgaatacataaagaacaatgattttatttcctgtttaatctcaattaaataatgattaaattgacattttagcttttgtttggacaaattatctttctaaataacagaactattaagacataattcccatacaatacagttcactcattcaaagtgtacaactaaatggtatttaatatattcacagagttgtaaaaccatcaccccaattaattttagaatatttttcttcacctcacaaagcaaccccacaccctttagctgtgaaccccttccattcctcccatccccattcagtgctatacaactgctttatgtctcaatagagttgctttttctggatattttacataaatgaaatgataaagtatatcttttgtgactagcttcttccatatcacataatattttcatggttcaatcttatcgtagcatgcatcagtactttactgctttttgttgccaaataatattccattgtatgaatataccaaactttatttatccattcatcagttgatggacatttgaattgtttctacttttaggctgttatgaataatgctactatgggtatgcatatacaagagtctttgtgtagacatatattgcaaattttcttgggtacacatctagccgtggaactgttgggtcatataataactctgtgtttaatcttttgagaaactgccagactgtcttacaaaatgcctgcaccattttacattctcactagcagtgtataagagttcccatttctcacctacgtgtgttattatcagtcttttttaatatagcctttgcagcgggtgggaggtggtatcttcttgtgattttaatttgcatttccttgatggctaatggtgttgagtacatttcacattgctattgactgtctgtctatctatctatctatctatctatctatctatctatctatctatctatctgttttcagatcatttgcaccctttcaattaggttatatgtctttttattactgagttataagagttctttatatattctagatacaaatttcttatcagatatgtggttttcaaaattttctcccattctgtggattgatttttcacttgattgtgtcctttgaagcacaaaagtttttaattatgatgaaattcaacatatcgattcttcttttgttggttgtgctttagatgttatatccatgaaaccactgcttaatccaaggtcataaaagtttactcctatgctttcttccatgagttttatggtcttagctctaaaagccataggttttagggctctaatccattttgggttactttttcatttaggtctgtgatccattttgggttactttttcatatgtcatgtgaaaacttagcctttaattttttttttttttctgctaccattcagatttcttaaggtcttcagacaatggcaacaagatcttttcattgaaataactaagaaagtttgtggaaaacccataagcatataaataaaaaagaaagcatttcaataagtagtacataaatttttagaaattaaacatcttattcttggattatatgtacaattagtcaaaacgcaaagataatacaaatacaaaacaaggaaattcatgagagctaatgaaaacttaaaatgttatgccgtggagcttgccgtgagccgagatcgcacaactgcactccagcctgggcaacagagtgagactcggtctcaaaaaaaaaaaaaaattatgccaagacacaaaatatttaatgtttctataaccctgcttctctctcttatggcacctaacaatttaaatattttattatagtattaacgtatagtgtttgcctttgtcttctaccatgattaaagcatctataatataacttggtacatgataagtaaaaatattcaaaattgaataggtgaacaaattaaaatgaatgaattctagaattggcactttttccctgttttgatgcataattttctctccttttcatcctttatgttttagcttaagtattacatccttaaagaaatttccagagaaattctgtcgaaattagtttcctctattattctctattacagaaatacatttcattctttcatagcactaatcctaaacagtaaatgtttacatttattttttttacatgttattgtgttctcccaatatgggagatggaaggtttttcattttacttccaatgcctaagacaatgtgtgacacattaataattttaaataaataggtggtaaatgatagtgtaaatgggatcatagacaacctgctgatccctggattttcaggaatagctatattgaaaccacaggcacaatgtcattgctatgtcctttttcatggtagagctttcagttcccacacaacctttcacacttccctgaagagaaaaccttttcccatctattgaaatcgaagaataaaggttgaagtagtaatgcttattcatccttgcccttgctacagaaattttagaggtaatatctagcaatctgcaatgaacactcatcaagcaataagcttctgtttccaaatcccagatgagttctaatttatttagacctgaataaaattagaggtaatctctcttccttgtagtctctacagttcaatatttggcttcccagtagaggttcataaacctgtcaactaatagttatggtgattagaaagataatatgcaatctaatgaagagactatgtatgcatatctatgcttcagtctactccctttttctctctctctttcttgccctaaagtcttatattatgcacagttaagtttttggtctagagaggtgtggctgctgccaggtgctatggactgtaagtctctattaccctcagattcatatattgaagcctaatgctcaatgtgatgcaatctggaggtggagacttagagaagtaatcaggtcataagagtaaagtcctcataaataggatcagtgtccttgtaagaagagacagggaagagcatgcctcctctttctctgcccaccaccacgtgagtgcacagcaagaagatggccaagtgcaaacaggaagagggcccttacaagaaacttggccatgctgcccccctaatcttgggctcaccagcctccagaactgtgagaaatgaatgtccattatttaagccaaccagtctgtgataatttgtcaaagcagcccaaactaaggcaactctggtttgatacacatggtaaagtatattgcttaaaattaaaaattaaaattaaaaaaaaaacaaaataaaagctaaaagaggcattaccctgtttttgtttctgtttttaacttaaggttcaccacgtgatgtagttttatccaaggattcataagtaaaatctactggaacttctgggaagatgttagctttcctgataaaggcaccatctcttcctctgtgcctctttctactgcctagaaagctcccatgttatctggggatttaagagccatccatgccaggaagagaagtccaagcaaatgtaaagaggccttggacataatgggcccgttgagtcaatcaatgaaccaataccgataaatgtctatctttagacttctgggtgtatgaggaaatccaaacctctgatccctttaaaccattgttatgggcatcactttcctcacagctagactcaattcctcattgatacaggaaagtaaacataagaaatttgttattaataattggtcttaggaaataaaatcagaagaggaaactttcttcttagtgaggttttgtgcacatattgacacctcaaattacccactgagttacatgtagaattatgtggaaggcatgtgtaaggtgactgcataattattgccaaaatctgaatccaggattctttagaaggttaaataggtgccaccaataattatactaagatactaggcataaactagaactcttctggatgaaccaggacatagagttaccccatgggagaatgatgttcacagtggcctcaaaataaagttctttcatttcagttgtagctggctgaaaggtatgtcacttaaattctatatattcccctaacataactactaggttttttgtttggtgcagaaataaccagtaggtataccataaatacagcagactgtgggcttgtggagcatgctgcactccgtgatctatctctgtctatcattgttcttatttgaccccatcacaggtgtttaaaatttgtttcgtcgttgttgttgttgttgttttatgtcttttttctcagtgctatatgttcaaagagccaacttctctacagacttgttcataagaatgacttgtttctgcttctctgctttgccagatctctattcctttcaaatttctactgaaaaatccactgatttcccctttgcatttaggacacataaattctttctcttttcctctccctgaaggttatgaaagtcctggactgtagctttattttatgttgtatacttccctccaagtgagttatataaggagatagttccgagaaggaaaatgcccagaagttgaaaaaccaggtcatcctagggggaaaaaataagtagccaatacttttttaggattttcttgttaaaaacccaataaacattcaaatatgaaaactactaatgtttttacattttgcagactggggtatagaacagcaagagaaagcagaactaataaagacaggagatcttttggaaatcagggtgaactgatttcctacagcaaggccataagctacagcaaggccataactcttcagaaggccattgtgtgatgctttggcaggaacaacaaggaggacatggactaaatggagcttcagctttttcagaacatgttactactctcaaaaattggttcactgctttatcagtttagcagttcataaaaatgtaacccaaaccgatttatgtaaaaagggcaattattggctcaggtaactgagagttttggaggtagggctggctttaaggataagaatgagaacttgttgctccccatgttttgaaccagacctcctgtcctctgaatgttggaatcattagcagaagggatctccctctgtggtattaagatggttagagtccctttatcttttctgctccaaatccagtttaaaaaataataatagatcattgaggtggagcaagatggcaaatagataacactccagcagctgtcctccctctgctaaaacgcaagaatgaataactacctacacaaaaaaaaatccttcataataaccaaacatcagatgaattatcacagtatctagttttaacttcatatcactgaaagaggcactgaagagggtaggaaagacagttatgaatcacctatatcaccactttcccatcccccattagtggctgcatggcatggagacagaacctgtgtgtttggggtaaggagagtacagtggttgtggggctctgcattaggactcagtgcttccctgttacagtggaaaacagcaaagtgaagaacttgccggtgcccagatagggggcacctagaccagccctagccagaggtgaattgtctgtcctagtggtcagaacttgagttctgccaagccttgccactgaggtcctaaatgaacttgaaaggcagcctagacaacaaagcctgcaattcctggacaagtcctgctgctgggctgggctctgagtggacttgtggtgcatgtgacctagtgagacaccagcccaggtggctaaggggatgcttgcatcacccctcccccaaccccaggcagtgcagctagcagctacgggagagacatcttccttctgcttaaggaaagaacaggggagagtaaagaaaactttcccttacaattgggataccagctcaaccactatagaatagagcaccagtcatgaggcctgcattccaggccctagctcccagatgaaatttttagacacaccctgggccagaaaggaacccaatgccttgaagggaaggacccagttctggcaggatccatcaccagctaactaaagagcccttggattgtgaataattagcagtggaggccacaggccttgggtgagacttaaagctgtgctggcttcaagggtgtcccagcatattcccacatgtagtggctataggaagagactccttctgcttgagaaaaggagaggaaagagtaaggggggcttctcttgcagcttaggcaccaccttgaccacagtggagtacagcatcaagcaggttcccagggtagccagctccaggccttggctcctggatggtatttctggaccagtcctggggcagaagtgagcccactgtcctaaagagcgagacccagccctggcaacgttcaccacaagctgactgaggagcccttggacattgaatgaacattggcagtagccaggcaatgtgtgctgtgggccagggatggtagtggccacaggaagagactctcctgcttaaggaaagggaaaaaggaagagtaggaaagacttgttttgcagcttgggtgctagctcaaccacagtagaatagaacaccagcaagattcataaggttctcaactccaggccctggctcccagatggtatatctgaacctacatgggggaaaagggaactcgctgccttgaagggagcaagcctggctggtttcaccacctgctgattacagagcccttgggccttgagtgaacataggtagtaaccagacagtgctcaccacagaccataaaggagacacagtgctgtgctggctttaggtatgacctagtgcagtcccagtggtggtggccacaggggtgcttgtgtcatctacctccagctccaggcagcttagcacagagagagagagagagactgcatttgcttggggaaaagtaagagaaaggaacaagggtgtctgcgtggtgatccacaaaattctcccaatcttacccaaaacaccaagatggtacctcttgtgagtctacaagacccacaacattactaggcttggggtgccccctaatgcaggtatggctgcaatagccaaaaacttagatcacaacacccaagtccttttgaatgcttgcaaagtcctccgaaggaggacaggtaaaacaagctcagactgcaaagactacaagaaatacttaacttcaatgcccagacactgatgaacagccgcaagcatcaagaccatccaggaaaacatggcctcaacaaatgaactaaataagaccccagggaccaatcccagagagatagacagaattcaaaataattgttttgaggaaggtcaacaaaattcaagataacacagagaaataattgagaatcctatcagataaatgaagagactgaaataatttagaagaatcaaggataagttctagagttggaaaacgcaactgacatagtgaagaatgcattaacatctcttaacagcagaattaatcaagcagaataaagacttggtgaacttgaagacagcctatttgaaaattcacgatcagagaagacaatagaaaaaagaattttaaaaaatgaagcatgcctacaagatctagaaaataacatcaaaagtacaaatctaagagttgttggccttaaggaggaagtagagagagagatcagagtagaaagtttattcaaaagaataataacagagaacttcacaaacctagagaaagatgtcaatattcaagcataagaaggttataaacatcaagcagatttaaccccaaaaaagattatatgaagacatttaataattaaaattttaaaggtcaagctaaagaaaggatcgtaaaagcaggaagaggaaaaaagaaatacaaaaaacatacaatggagctcccacacatctggcagcagacttctcagtggaaactttacaggccaagaggagtgaatggcatgacatatttaaagtcctgaagggggaaaaacaaaacaaaacaaaacaaaacaaaacttgtatcctagaatagaattatccagggaaaatttcctacataaaggaaggaaaaatgaagaccttctcagataaacaaaagctgagggattatatcaacaccagaactctcctccaaaaatgctaaagggagttcttcaatctgaaagaaaataatgtgaatgagcaataagaaaccatctgagggcaaaaaattcactggtaatagtaaacacacagaaaacacagaatattataatactgtaattgtggtgtataaactattcatatcctgaaaaggaagactaaaacatgaacctatcaaaaataataactactgggctgggcgcagtggctcacgtctgtaatcccagcactttgggaggccaaggcaggaggatcacttgaggtcaggagttcaagaccatcctggccaacatggtgaaacttcgcctctactaaaaatacaaaaattaggcgggtgtggtggtgcatgcctgtaatcccagctactcaggagactgaggcacgagaagaacttgaacctgggaggcggaggttgcagtgagctgagatcgcaccactgcactctagcctgggtgacagagtaagactgtctcaaataaataaataaataaataaataaaataactacaaaaacctttcaagacatggatagtataataagatattaatagaaacagaaaaagtttaaaggcaaggggatgaatctaacatgtagagtttttattagttgtctctttgcttctttgttagtttgtttatgcagcctgtgttgtcatcagtttaaaatggtgggttatattatttgcaagtctcacggtaacctcaagacaaaaatcatacaacagatacacacaaaaaaatagcaagaaattaaaatatgctagcagagaaaatcacctccactaaaagaaagataagaaagaaggaaaaaaggaagagaagactacaaaacaaccattaaacaaataacaaagtggccagaacaaaattccttctttatcaataataacacagaatgtaaatgaaataactatccaatcaaaagacgtagagtgcctgcatagatttcaaaactagagccaataatgtcttgcctataagaaatacactttacctagaaagacacacatagacagatacaaagatggaaaaagatattccatgcaaatggaaaccagaaaagaggagtagctctacatagatcagacaaaatagatttcaagacaaaaaccataaagagacaaaaaaatcatataatgataaaggagtcaattcagcaagaggatataaaaattgtaaatataaatgcacccaacactgagcaaatattatcagagctacagagagagaccccaataaaataataaccggagacttcaatgccccactttctgcattggacagatcatccagacagaaaatcaacaaagaaataaacttaatctgcactatagatcaaataggcttaataaatacagagcattccattaaatggctgcagaatatacattcttctcagcacatggattattctcaaggatagaccatatgctaggtcacaaaacaagtcttggaaaattcaaaaaaactgagatagtatcaagtatcttctctgaccacagtggaataaaaactaggaatcaataaaaaggggaattttgaaaactctacaaacatatgaaaactaattaaataatatgctcctgaatatttcttactcaataaagaaattaagaaataaatgtaaaaatttcttgaaacaaaagaaaatgaaagcacaatatacccaaatctataggatacagtgaaagcaatattaagaggaaagctgataggtataagtgcctacataaaaaagtaaaacatttctaataaacctaacgatgcattgtaaagaactaaaaaaacaagagcaaatcaaacccaaaattaggagaagaaaataaataataaagaccagagcagtagtaaaggaatttgaaatttaaaaaaatacagaaatcaatgaaataaaatgttggttttttgaaaagataaacaaaatcaacacacttttaagccagaccaatgaacaacaaaagagagaagacccacataagtaaaatcagagacaaaaaaaggagacattacaactgctaccacagaaattcaaaggatcaccagtggctactataagcaactacacaccaatacaatacctggaagacaaagataacttctcagacacatacagcataccatgattgaaccctgaaagagtccaaaacccgaacagaccagtaacaagtaatgagattgaagctgtaacaaaaagtctcccaaaaaagaaacttagttccaggacttagtggattcactgctgaataattttattaaacatttaatgaagaactaatacctactgtaacaatttcaaaaaatagaagaggagggaataatactcactctgtgaggccagtactacccctgataccaaaacctgataaagacattcaaaaaaaaaaaaaaaaccacacaaaaaaactataggctagtgtctctgttgaatactgatgcaaaaacacacaacaaaatacagcaaaccaaattccacaacacattaaaaaaaccattcatcataagcaagagggatttatcccaggtatgcaagaatggttcaacattcataaatcaaccaatgtgatatgtcatatcagcagaatgaagaacagaaatcatataatctttgtaattgatgctgaaaaatctcttgataaaattcaacatcctttcatgatcaaaaccctaaaaatgatgggtatagaaggatcatatcttgacaaaataaaagccatacatcgcagacccacagctggtatcatactgaacaaggaaaagcagaaagtctttctctaagattagggaacaagacaaggatgcccacttttcactgctgttattcaacataatcctggaagtcctagctagaacaatcagacaagagaaagaaataaaaagcatccaaattggaatggaagaagtaaaattatctttgtttgcagatgatatgatagtatatttgaaaaacctaaggacaaaaaaaaacacacaactcttcgagctgataaacaaattcagttaagtttcagggtacaaaatcaacatacaaaaatcggtggcattctatatgccaacagtgaacaatcagaaaaagaaatttaaaaaaatcaatttacaatagcaacaaatgaaatgtaatacctaggaattaccttaaccaaagaagtgaaagaactctacaataaaaactataaaatattgattcaataaattgaagggggcacaaaaaaatgggaaatattccatgttcatggattggaagaatcaatattgttaaaatgtccatactacccaaagcaatctacagattcaatgcaatctttatcataatactaacaacattctttacagaaatagaaaaaaataatcctaaaatttataatttatattaaaccacacgcagacacacacacacacacacaccccagaatggccaaagctatcctgggcaaaaaaattaaaaactgagagaatcgcattacctgacttcaaattatactgtagagatatagtaaccaaaacaacatggtagtggcataaaaacagacatgcagaccaatgtatgaacagaatagagaacccagaaataaattcgtacctctacagagaactcattttcgacaaagtttccaagaacatacattggggaaaggagtctctttgataaatggtgcttggaaaactggatatccacatgcagaaaaatgaaactagacctctatctcttgtcatggacaaaaatcaaatcaaaatagattaaagacttaaatctaagacctcaaagtatgaaactactgaaatctggcaaaagatctgagtaggcatttctcagaagaagacttacaaatggcagacaggtatataaaaaggtgctcatcatcattgatcatcagagaaatgcaaatcaaagctatgatgggatatcatgtcactctagttaaaatggctgttatccaaaagacaggcaacttcaaagcctggcaaagatgtgaagaaagggaaaacttcaacactgttgataggagtgtgaattagtacacctatggaaaacagtatggaggttcctcaagaaactaaaaatagaatgaccatatgatccagcaatcccactgctaggtatatccaaaagaaaggaaataggtatatcaaagagatatttgcactcctatgtttaccacatcactattcacaataccaggatttggaaacaacctatccatcaaccgatgaatagataaagaagatatggtatatatgcccaatggaatattatccagccacagaaaagaatgagatcctgtcatctgcaacaacattgatagaactggaagatgttacgttaagtgaaataaaacaggcacagaaagacaagcatcatatgttcttatttgcaggagttaaaaattaaagcaattgcacacatggagttagagagtagaatgatgcttaccagaggccaggaaagggggacatggggagtagggttggttgatgggtacaaacatatagttagatagaatgtttcagatcaaacgtttgatagcccaacacagtgaacaataagctaatgtacattttaaattacctaaaagagtataattgaattgtttgtaacacaaagaaagggtaagtgtttgaggtaatggatacttcatttactctgatgtgattatttatcattatatgcctgtactaaaatatctcatgtggcagggcatggtggctcatgcccgtaatcttagcgctttgggaggctgaggcaggcagatcgcctgagctcaggagattgagaccagcctgcgcaacacagtgaaataccatctctactaaaatacaaaaaaattggctgggtgtggtggtgtgcacctgtagtccctgctacttgggaggctgaggctgcagaattgcctgaacccaggaggcagaggttgcagtgagccgagatcaagccaccgcatgccagcctgggcgacagagcgagactgtctcaaaaaaattaattaattaattaattaaataaaatatcatatgtaccccataaatatatatgcctaccacgtgcccacaaaacttaaaattaaaaaataataataataaaatgcaactctctttcaacagataaagtcttgagcctgaagctaatttgccctaattagatgagaaatactcttcaagcaatcccccaagaccagagtgactaaagatatttgattaggcaaagcaggaaccagcactaaaactagcagtgagattaatcctacagaaactttatggattgatgctcaggagctgtttgagggtacaccaagcatctttttaaaatatatctactgctgctactgttactgcttatggctaacactgagtgttgagtacataatatacactgccctagggctttacgtgcatctttccatttaatccttacacaattctatacagctccatatcctcattattacccctgttttacacataagaaaacaatctagaaagttaaaaaactttccaattttttcacaaaggaagtaagttacagggctatgattcaaacacagttttatttctaaagcttacattttaaattactacttaatattccctgattcactgatgactaaagaaatacaatctagaaactttggaaatatgactacttgttggcctaatgtggctaatgacaagatggaaaagaaaaatataaaatctggcatcatattcaaataatttaaccaaaggtcctcattagtgctgctctcaaaagctgagccttgcttttattttctaatgaaaaatgtttctagaaacatatatgctaattttccaattaaggttagccctggagctaaagtattaacattttccataagttataaactcttagaaaaaaaaccaacactatttactatgaatacattgtaagttaaaaatggatgcttactgttaatccttactgaaagtataactaataatctgttgtttctgaaaaaagacaacctaatcccaacaaaaaataacccatgtcacatgtttgcaagcgataattgccaggttcttgggttgacagaattccatattttctttctttttttaactgaaaaaatttccagttcatttaataaatatatatggggtgaaaaaagaaataggcaaaatagataatccttttccaagtgctataccccccaatttttttaaaggaatgtgacaaaggtcaaggaaatcacgagcatatgagaagaaaaaattatgtaaatgatctaaactgaatatttaacaatctacctgttgaacaagcccctaagatttggcctttgacttttctctatttaggcatcattaagttcaaattctatgattcatttgacattaatagttaaggttcttgtttctctctctctctcgtctttcacttttctgagacgtcactcacttgctgtcccaagaaagagttgtgaatatgcctcagatttcagaactttccatgagaaagtacgttgataaggaaactcaaattccagagtgggcaactgctttgtacctctactccagatatgcttgttttataaagcctgcgtatctttttaggatggaacagaattctttcactgagagattaactgtaaaaaccaggtggcttcccaggaagatatcatggctaatctttacctctcccttaccttttataaacagtatttagtacagaaagaaaaacatggcaatatcagctcttaaaactacagcaccatatcagcctcaatagggaagcatgaacactaagattcctcgagtaaactttacatgcttcagtagaatagaaacagactactcaaaagtgaactagtcactgaactggaaagtgtgtagggtcatactcaggaaaattattataaagcccattgagtccagacagccagtgaattattgccaaaattaaactgtatgatgcctctatcaaccgattcaactagacttcagcagatgtctgaacattggaattacagttttcagtgccatgagagatattaatctatattagatatgatccctaacctcaaggaatttgcatctgataagatataaaaagcattaagaacaaattctaacaaaagaaaggaaatacagagataaatgtcccatcaaagtataaaatgtggaagttatttggggctgcagaaattgggaaaatgtttactgggtcctaaatgatgggagaaatttggatatctatgatagtgaggaagtaaaagaaattagaggagggaataacaaccactttctcccatcatctaccttgtggacataaaatagtcctctccttatagttaccaatagcggccctttcatttttcttccttagagatcaccacccccaactcatgtttctcaataactcctgacacagcttttcaatataaaatcagtatcgtcatctcacaatcttaacattgtctgcttgcaccaaggcaatactttaagggagaaattcccaatggtgcagaggacatgcatcaatcaagcagtctctctttcatttttgttgttggtgttatcactgtaataaagccatcacaaacaaggtgataggctgccccggttttcaaagaattatgctttttatattatgttggaacactgtagtatggcacatccttaattgcaacagcaaataggagaagcaatattgattaaagaaatgaatattgaactagaagttgctttttcttaacctgcctcacaatgctgagtgacctcattttagtcacatgacttctctgtttcccaggcatacttttgtcactcagcaataatagagttattgcaaggctcaaatgtgacagtttatgtgaaagcacatgggaaaatatgagaagcattccaatggaaaggttttattgcacataaggccaagagcagtatggtattatgaaaagctcatggttgtggacgtgaagacctagatttcaactctagttctattagtcaccagagtgggcttatttaagtcaagcacctcactaagcctcagctcttcatcaatatctactggttcatttccatccctcctcacagagttgcggtgaaattaaatacaaatctaaaagtccttcagaaacaacaaaaactaaaagtacactgtattatttgcactagcacagccattaatattgttaccatgattctcatggttacagctactctgataagaacttataatattacttatttattagaatatagactgactaaaataagcgtctttatcactatttcagcttcaaatataattggtacaggttaaggccctgtttaaacaaaaaactgtgttcgcacaatttgactttagtttatcctttagttaaaaaaaattctcatttagttcataaactacctaattcagatttggacaataaatagtctaagtttataaaaagtaaacaaatcatcgctatagtttgaaaaaaataaaccttttaaaaacattataaccaatattaaccactaaaatgccagcgataagtgtgctaagcacatcaaactattcattaaaaaaggtccaatgtttgcctagttatgcgttctagacatgtttcaaattatacaaattgctttttttgaggaagggttttgctctattgcccaggctggagttcagtggcacaaacgtggcttactgcagcctcgatgtcctaagctgaagcaatcctctcacctcagcctcctatgtagctgggaacagaggtgcatgctaccatccccagctaatttttaaattttttgtagagacagattctcacctcttgtccaggttcaaactgcattatttttaagtgctattctcctagatgcgaatgtcaaggctcctaagttatacaaagcagtaagttatatttttatttcccaagtgctgatatgccagatattacacccataaatttcttttctttcattattttcttcttctgagctggggtaagaaaatagacggtagtcagatgagtgagggcgtgggactggaagcagagtcacaggtacgtatttatggactatggcattcacttcacttggacattggacacataaagaacttgtccaaaaagaggtgcagccattgcccttggtttctggaaggtaatttgtgttttcctgagagccttcggctaaatagagaataacactatgatttagggtaggggctttgggtcacacaatatctgtggagtcagaggctgggatcaagcacatgcgcaatgaatgaatcctgcctacgtaacagacgccaatgacatctcttgacatagaggctcaggtgagcttcctgcttggcgacacttcatgtgtattatcacatgttggtacctgaagagtaacatgtcctgactcaacaggaagacgacaatagaagctcagtatttggtacttctactgaatcctgctttaggtatttcttcccatggcagattttaatctgtccctctctcaaagataaactgtaaccgtgagtataaccatggttttcagtgaggtctgtgagtccttctggaaagttatcaatctaaagatgattctgtgaggccataaacttgcagttggtgccagaagtgagggtggtcttgaggactatgccctctaacttagtagttggcctaaactccttatgacagctaactaattatgattataagagcaaactataacaagataagaattgtatctatttcattcatctttatatgctcagtatgcagtctggtgcctgagatgtggtagactttcaatcagtatgtattgaacaaattttaggtttactgagattgctttgaggacaaaccagcatttgtgcagtggtttgtaagactaccaattaaactttgatcaatgtaatcatagttaattgtgcaacaattgtatgaaatttgttccgtctatacttgaaataggcaattcttcaaaattcaacaagtctttactgagaatcttcctttaccagggaatgtgtttaatgctgtggttgggccaaatatgtggcccagatggcccagatagcaaagatgaatacgatgtaattcctgcccaccagcaaaataaaagtcaagtgctcagatattacagcagaagtagcatctaattctcatagaggatggacaatggagacaggtgacatatcaggtaagatttgagctgagctttaaggaaaattatgaattacataggtacagaagagaaaaaggcaaatataacagtatcagtgatagcactttagtaagtcttatttttactctttacatattttatcacatgtatcattctatcaagttacctaaaatattatatcactagtgttctaaccacaatttgaaaatctagctttataatatcataccaaatgatgtttatctacatttgctttatttatacaaggttcagttcaaacaactcaaatataaaaagatgtgagtcaatttacagaggatggtcgagggcttacttgggttttgtctttcctgtataaaatgaaaatatacctctccttcaccactcccaaccgaaatgcctttaagcactgtgatcatttgagaaaatttaggtggtcttacaagttttgtcaaaaacttttaaaactcaaaaagaataaaacattaaaggatattacattttaaatcaaaactggttaaacagcaaaatttttaaaaggcactgtctatgtataaggtaaaatttgtagaaaaatctgtttcaacagattgtaacacagaatggtatttcctgaactatcgaaaaaggtgtttcagaaacataagtttccaacatgcttaaccttcttttgtttgagaaagagatgcattaagaactttttatttactctattttttaaatgttatttaataccattaaaattattttggtcttcctttctaaaaggcactgtgagattaaatttaatcaaggagttgaaaaacttgtatactgaaaactactaaacattgtcaaaagaaatcccatgtttatgaatcagaaaacctaatattcttcaaatgtccatactaccggagacaatctacatattcaatacaattcctatcaaaatctcaatgtcgttttttgcactaatagaaaactccattccaaaatttatataaaatctcaaggaacctcaaatagccaaaaccatcttaagaaaaaataaataaataaagctgtaggtcgcacaccttctgacttcaaaatgtagtggaaaactatggtaatcgaacagtatggtactggcacaaagagacacaaacaccaatggaacacaatagagaggcccagaaataaaccctttaatatgtggtcaaatcatcttcaacaagattacacaatggagaaaggttagcctctcaacaagtggtgttggaaaaactgtatatccacatgcaaaagaatgaaactggacccttaccttacaccacatgtaacattaattcaaaatggattacaaatctctgcataagaggaggctgaggcaggagaatcgcttgaacccaggaggtggagattgcagtgagctgagatcacaccactgcactccagcctggcaacaaagcaagactccatctcaagaaacaaaaaacaaaacaacaacaaacaaacaaacaaacaaaaaacctcctagaataaacataggaaaaaaccttcatgacactggatttggcaactatatcttggatatgacaccaaaacaataagcagcaaaagcaaaaatagacaaataggactacatgcaactttaaaaattctatgtatcaacagaaacaactaacagagtgagaaggtagcctacagaatgggagaaaatatttgcaaatcatatatctgataagggctttaatagccagaatctataaagaactcctacaactcagtaacaacaacaacacaaaacaactcaattaaaaagtaggcaaaggaattgaatagacatgtcaccaaagaagatttacaaatgactagcaggtatgttaaaagatgcccattactactagttattagagaaatgcaaatcaaaacaaaatgggttatcatctcacacctgttaggatggccactatcaaaagaaacaaaaagtatcaagtgttagcaaggatgtgaagaaattggaactttcgtgcactgttggtgggaaggtaaaatgatgctgctgatagggaaaacagtatggagttttctcaaaaaaaaaaaaaaaaaaaaacaaaaacaaaaacagaattaccatataatccaacaagatcttgacatttgtacgctcatgttcattgcagcagtaatctcatatccaagaggccaaagtaacctaaatgtccatcagtagatgaatagataaacagaatgcagaatgcgtataacatacaatggaatatttttaaacattaaaaagaaggaaatcctgtcatattctacaacacagatgaatgttgagaacattacgctaagtgaaataagccagttacaaaatgcacaaatactgcattttcccgcctatatgagatatctaaagtagtcaacctctttgtaactataagtaaaaaatagtggttgctaggggctgggggaggagaggaaagagagctattgttcaatgggtatacagaattttagttttccaggatggaataaagggtctgtagagattacctacaagggaaagaatattaaactgatgagaaacttctcataattaacaacagataccagaaaccaatgtaatattattttccaaatgctgagaaaaatattggtctactcagaattgtataactaccttaactgcaattcaagaatgaaagtgaaaggaagacattttcatggaaaccaaaagcaagttcaccatccgcacaccttcacacacaaaacaattaaaggtttagtttagaagaaaagtgaaatcagagaccaaatttgatatacacacacaaacaaaagttctatgcataaaattattcaaaacattcattaatttaacgattagctataacataactaattgtgcatatgattttattttaaagtgcaactaatcaaactggcagcaagaaaggttgtgatatttactagcaagaaaacactgtaacctccataagctgttggaaaggaagacagaaacactaaaaaatatttagcaaagtatgtcgtgatttatgtatgattaaaaaaaataagactaaccactacaggaataaaaatacagcctgaggttacaaacttgcagaagaatttaataaaataaaaaaatgtgaataaagcaacagaattttttaaaaaagaaaagagaaacaaaaggaaatttaaaaaaatacaaactattatggtaaaaacatatccagatacatcaataatctcatcaaatatatatatggattaaactcatctattaaaacacaaaatttcagaacaactcttaaaactatagctctgtgctacctaacactcactccgtctttgacactctctcctcctgcttcctggtgaagaaatagaaatcaaaagtaacaagggaattacttcctattaattcctagcttaaaaataaatagaagccaggtaaatgacactagataaatgatactgcttgtgaatcttttgggttctaaattagcttatgtaggtcctcttagtttgcttcagcactctcctctctctccataaactgcagttatgacccttattggttgcccaactacagtgttgcctacgacatagaaaattgcttttcaaagaaattctagccttaatgcataccagaaacacctcaggaaagtcaaagttaacagatgacttttaactcacgaggcgaaagcattgtgattctagatgtgaggcaagtttgacttaagtcgagagaagaactgaaaatacagataccccaataggtttacaaaggtaaactccattacaaaagaaactccctcttttggctcaagattcccaccccctcgtaacctcagaactaagcaagaaggacagaaggaatgcatctctgaaaagcttcagaggatgaaaccacaacccagcaatccctccaaactccctccttcccttatacaattgtctcctgcttacaatactgttgtcaaactttctgtgtttttcttcttcatggacctttggggatcaattctagtctaataaactgaactctatagcttctgtggaattataacctgaattatgactttttaaatatacataatatagtctacatttagctgcttatttaatgactgattaaatctttaaagtaagactaactagaaatattcaaaataacatcctcttgccttttttaattttaattcttacatttaaaatagactcacaataactggacattaagaattgttagagctgtgacacactaagagagcccattattttgactgaaaatgtatttaattgttattttaagcagaaactttgaaaaaaggtatatgtacacatatagcatatttatagtgtaaatacaaaatatagtgtatattttgatctgaatattttcaggagtaaaaaaaataattgtaatacaaatgacagatgtattactaataagcaagtatgatgtacctgttggagctaaaggaaaattttcccttcactctctgtagcttaagtgaaaatcgatggacaaaaggctgattaagaggagaaaagaaatacaaatttattaatgtgcactggggagaattacagggtgattaccccaccatgcgaaatgtggtacacatggttatatacccttctttttagaggaaagggagatggggatgtgtggatgattttacagcgacagcaaatgattttgggggggagttcaatgaacttaaagaacatacaatgagctgggacaaagtcttttgggtctgcagagtaaaccatggtttgtgacaaaatgctgtctaggtgtattgatggacttctgtctttcttcctgtgatacgagttcagttaatgaaaactcagggaagagaccaaaggtaattgttttcttctttggcaggtccgagcttaggcagataagggaactccagagaacaacttcatcctgtgctttgggagagacaggattaagacacaggaggcagacggagttcagaggagacttgaggctgcttcttctgtgcagcatgtaaaaacaccatatttgagagtatcaatttctgagctccaaggtaccagagttttgtttaattgaacattggaagagcctaatgaaaattagtcaataactaatttagaatccagcagacatatggaaacttccaaaataaccttgtgctatttactgagatcataaaaagtaagggtggaaatctgtaatcatgattttcaaggaatttttttcatgaactacaaatagccaactctcttacaagaaagcggaaatacacacatatacacacacaccccattcagtgcagccacattctctcaacgcataaattattatcctgagagtgagacaagcatcataattgtgtttgctactttaaaatatgtcagtgctgataatgtagccactgatggctacctaattttgccagtttgggatttgaaagacatgatacaacattgtgtccaacatgctcatttgaaaagtccaaaattaagccaatgaaggtagataatttgcccaaagggatatcaagatagtaaatgaaatgcaaataaaactcaaatatccttgctcgtaatccagagctcattccataaattcatattgcctttaaattaaagttattctgagaatctgacatattagataaaacatagacctactaaatacaaacaaagccacaatctttcacaaattatgaacgtttttttctccatggtaggacagagactatttccagacaaattgaagaattttcctccctgagccatcctccatgcttaaaggagagataacaagagaaaagaaaaatgtcttgctctttgaattaaacagaaaggtaaaattccaaaaggagagtatcctgcagaaatggaagctagacacaaagaatttatatcgcatggagagtaactgcaatatactcattcaacaagacatggtccttaacactctaaattacaaaacctcaaaataatcccgaaaaacaggatcacaaaatataaaatgacttcaacttccaattttcttgcctaacatgatggttactccattacctctcagtggtagttcacacacatacacacaaatacacactacaatgtacttactgaactgtagagatagccttcaccattcatggccacatagaggctagccttcactccttggatggccactacacgcaggcccacgggaattagattgaagagagctggggggagaaaaagaagggcggaaaggatcagtgaccttttgaataaataatccttcttataatcattcttttgagaattaaaacctattaattgaacttggtagaaaaatggagagagaaataaagagaggtctaaaaacgagagaaattgacttcttgaccctgcaccagcattaattacctatgtaacttcaggtaaattacataaactctgtactaaaggggttggattagaaggtctctaaaggcccagctggatctgagatttcaggatccctgatccttaaaatgatcctcaaacagtgtaatataagataattttttctaacaaacaaataatatggaccgaaaaattctcaacaggagaaaacctatctgtagtcacaagaaataacaaaatactatctttaaaacaggccaaagcttcttgtttttagtattttccttgttgttccaaacattatattgaacacagaagaagaatgcaaaaattactgacttattggtgataacattcagacaaaacttttttcttgatatctcaattttttacatgtaaataaacagagataaacagatggacagatgattgatagatagcttaagctgtaatggatatattttatatccaggtgggaaatacacacacacacacacacacacacacacatatacacacatatatacatactatatatatacaaatatatatacacatatatatatgcacacacacacacatatactcaaaaccattaagaattaatttgacaaaagtaattcaacatcctaagatgaaatggaaacatgcttgcagtctttacatattcgagttgctcatcactcaaaatactcaatagtctatatgtccacttagagaaggaattcgtagatcagaaaaaaagatacctaagagaaccttctatttttcttccaacaatatttttctgtccttgggattatttcagttacttttgagatcacgaaatgagcataaacagaaaacactgcccccaccctgaaacaattcacattgcatatggaagaaaagcaatcatatagttaggctctatagatggcaacatggagatgaattaagtatctcacggctgtatgcataagagaatatctctgcagttcatttcagtatcctggcttaattagaagttcttatccactttttctgttgataaaattcctatcagttctcgtcttcttagtttttaatacaagatacacataaattaacccaagggctaccattatttagggatgcctctatttttctcggcttctctcaacctacaatagtaagctaaacacacacacatgcagacacacacactcacagtatttggctttcagtcaaatgttcaattgacagttgtagaggatcaagtcttagaccacaagtttagtagaacaggattccattcttagctgtcgacatcggatcagtccttttgcctctttgaatccatttccacattttttacgaaaactgagactagataagaaactgtaagtagtttcttatagattaattgttggctcaatttagatttgaactggttttatttcttgctatattcttaccagtgtccttgtgttactgaaacaacttaagaaatacaagaactagacaaagtctagttggggagaaaaagctaagacatatggaataatatgatacagtgtataatttacttctataattaaatgtaatatatgcattctatatatatattccctatgttacagaagttcaggaaaatggaagctctgtgtggcctgaagtattcatggaatgccttacacagaaaatggaacctgagttgacacctaaagaagcggaagttgagaaagccaagaacagaaaacattttagtgaggtggaagttaggtggttttgcagagtaatgtgtgtatgcagaaagggactggcagattggtggatttgatttatattggggggaaatgagaaagaacagcatgtaaataaaataaggataaataaccgagtctgtcactctaatcttagatatctggactttaccaaataggcaacaagacgtgtgacatatgaaaactagagcaacaacacagattatgagatttgcagacacatagtttctaaaccctccactcagtcacttggctttgagctattcatttaacttctctgccttagttttcctatctgtaaaatggacatgataatgcttattgcacagagttgatagaaccaaatgcattgtcatgtttctgaaagtgattcacagagatgtatcctctctaagagctatttgtcatgaatacctaattcttctgtttgtcagataaagttaccataagactattgtaaaaactgacatattacctcagtaatattttttagtttatattcagcagattgctttaaagctttaaaatctaataccttatatttgtgcaagattaattttcaaagtgctgatacattcattaattgtatttgatcctcaaccataaatgctatgaagaatttaggacagaatgattaccttaatttatagaagtacaaaaagatttagagttaacccaggggaaaatgcatctaaacaaaggctttcaggctccctaatgtggttacctgttcaaaacatcatatttcatctttttgttctttatttttcttttttgacagagtctagctctgtcatccagctggagtgcaagcaattctcctgcctcagcctccagagtagctgctattataggcgcctgccaccacaacccagctaatttttgtatttttagtagagacggggtttcactgtgttggccaggctggtctcgaactcctgaccttgtgatccacctgtctcggcctcccctttttgttcttttaatttcctctaatatccatttttgccttcttgcaaataaatagattattcagctacaccttctaacatatcctgcaaccagatgtaggtcctatggacccactactggccaatgagatgtaagtcatcacatcattataagcttgaggaatccttccttaaagacagcataaaggtgtcctttgtgccccttctcaacctttgcctattgctgtttgaatggggatatggtagctggatcatctcaaaccaaaaaaacaaggactactccccagcgggtgttggcaggtgagctggaaggagctgggtccctgagagctttgtggagcagtggcacaagtccaacattcaattacccaggtctggcttttacgtgagaaaataagtccttgttctcttagtctgtgcgatgcagagccaactctaatcctaactgatagagatgctaatgaaagcagaattaatatgcaagatatgaactagatgcaaggtacttcattttaaataaaagcagatactggaaaacgattaagttcactgataattactgtgagaaggagaaaagacttcccaggataaatgctaagaacactggtttatgtagctgaccatagaaggaaaagcaactataaagtttttcctacatggaatgagagaaaactgataatgctaggcagggacaaaaacaagaaacctgtttgaaagttttatatgaaccacaacatgataatggcctttagctggtttgctttgtgagacttactaagcccatttttaaaaatcagtaaacgatttgaaacgagactttattggtaaaagctaaacatagtttctctggaaaggtcctcatctgcctcctaaaagtcccaaaaggtggcaaatgacttactgttatctattaattatcttcagagtagcatactgtggctccagctcacaggagccctttgctactcctttcactactcctcaaagccactgtcctaactcatagtaactgggctgcttgactccacccactctttaagtcccttgcatcctcttaagccattttcctgcttacaacctgcagtgattcctccctgtctccaatgtcctttacaacctggctccaacccacatttccagcttatcacctgtcaccctttccatctgctgtaaccggcttcacagagctttttgccatttcctaagttccccctcgatctttaactaggctggagtttgtcctcttttgtcctctatctctttttggaaagcttatcttcccacttctaaatttggccaactcttttcatcatttaaggcctaccttgttgaactcccccatgaatcttgcccaaaacccttcagaaataatacttcccttttccagatggcttatttcttgtgtatatttcggtaatgatatttagaacatggttttagagttctttgtttatatctctgtctccatccctacaatgcaagactcttgagggtagttgctgtaatgtctagcccaggtacatgtacacagctttattaaataaatgttattatatgggttatgacaaaaacacgttatttccaggaatgtaggttttcttgttagaatgaaagttctttttaagataaaaatgaaattagaaacttaaagcatctcagcctgatactcaaagttaatctacaacatacatttgtgctacatggcactttcactccaatactgagtgcttctagtaatttgatcttcctcctcctaccttctaaactccatctttttgctaacttagctccctctgcttggaatgtcactctccctacatcttcacactgaaatccctgacatgcgtgaaatgacacaccaaatgccaagtgctttctttcacttcttagctgccctattcctggatccagactatatttatcacaatttatagttttattcttctaaaaaatctgtttcctctgccaaccacaaccagattgtaagctctccaaaacaaaactcacatcaaaactacacttgtataatacaaggaagggaggagacagatagagacagagaaaacaagagggagaatatgcagggtagtatatattctgtgtatattagcaatcccagtaaacatttgcagactaaataatactacaattatatgccaaatagagtccaagtatttaatctgacattcaaagatcttcttaaacttgtcctttccaaaaggagtatcttgttctacatctttttgtaaagttgactcttgtattttgaaaaatgaaataatggagctggtactcttggcttccataaaccaagctcattcataaaacttcacagaaaaaaggtaatggaaaaggtaatgaagagaaagtatagtctcttcaacaaatgatgctgaaaaaactgggtattcacacatgaaagaatgaaattgggcccttatgttataccatacataaaattcattcaaaatggattaaataattaaatgtgagacctaaaactgtaaaacccataggaaaaaaacataggggaaaaagtcaacattggccttagcaatgatttatttcttggataacgaaaagcacaggcaaatgaaagcaaaaactagacaagtgggattacattaaactaaaaagcttctgcagagcaaaggaaacaatcaacagaatgaaaaggcaacttatggaatgggagaaaatatttgcaaattgtatatctggtgggggttcaatatccagaatacataagaaactcctatgactcaaaaggaaaaacaaaacaaataagccaattaaaaaatggacacagggcttgaacagacatttctcaagaacaacaaacaaatggccaacaggtatatgaaaatatactcaacatcactaatcatcagataattatgagctgttaacctaaaataaacacttccaagttataaaatattaaaggatcactttgattaatcatgctacaggaaagactgaattatatttctctctacaagaaatgtataataaaattgttgtcatatggaaagacattcaaaaattatatatccataataatgggaaggaaatttatagacttgctgctatcaggcaattaattaaaatgttgtattattttcctgagttgtatcatctttgatagttctcagcttttcaaaatttaaactgttgtggtatattttctcagtctaaatactcaattttgcatctaattttcatttcattatatttattttttcgagggagaaccccacataagataagctttaggacctacaaaacctaaatcattctcatattgaaatttaagtggaaggagaagatgagagaaagtaacaaatgagaaaagaaaaactaaatagataatattcattgactgtctattttttcaggcatcctgctaggtaggcattttgatatgcgaaatgtcattttattataaactcagtatttgactacttaaaatagcttcattgaacagtatataaaagtcctaacttctttgaggggtacaaagtgaaaaaaattgagaaaatgtaaagcaccatcctaacatttggagttaacatacagcacttgtaaaaacctgacttagaagtcatttattcttaccataaatatttgttaggacttactgtatgccaaataccatgcctaggctaaaaaaagagtgacgaacataacagttgtggtctctagtgaaaagacttttatctgtgaatctttccgaggtttccactactttaagggcaagttgaaggtaccagaaacttttattatgatccccaatgcctagcatgatatcttggttttagaagctgttattcaatatctgctgaataaataaatgaattaggagtagtttctccttacacatgtttattcataacttttctcagtcatatttttataattaagcatgtaagaaaaaaatggaagataatatgtattacacatagactaaaggaaagccaaaaaacctacatggtacaaagtctgaaatggcagaatcatgggatgcataggcctggtaagggtaggagtatgtgtgtgtgtagagtgatgcaaggttggagggaattaagaggaaggaaagagtttggggaatctgttacaattgagatattaaacatcttgtcagcaaggcgtggtggctcatgcctgtaatctcagcactttgggaggctaaggcaggagaatcacttgagcccaggagtttgcgactagcctgggaaacacagggagactccatctctgtaaaaataaaaacaaaaataatttagtcaggtatgtgtgtgtgcctgtggtcccagctacttgggaggctgaggtcggaggatagcctgcacccaggaattcaaggctgcagttaagccatgattgcaccactccactcctgcctgggtaacggggcagggcatgcctctgtctcaacaaaataaaataaaaaataaacatcctgtccaatgatactgcaccaaaaaatgtactttctaaaagtgctatgttttactcagcttaatttctacctgtacacaccatattattccagtaagaaaaaggtaacagtcaatccaaaacacataggaaaacaatgtgacaaccaagaaagtttcaaagaaagagaagaagaggaagagagggagagagggagagagggaggaagaagggagggaaggaaggagaaaaaaaagctcattacaaattgtctttggaacatgtaaatccagtatctttccaagtaacttctaaggacagactcattgcttgtaacgaagaaaggtataaaagagtacagttgtatttagaaattctagatctattttgtcaaatggccaataaaaaagattcatcctgtgacccattaaaaacccatgtggaacatactgagagagaatggagatatttgggtttataatctgtgcattttcaatgttagatttccttgaaaattcaatatcatttcccacatctcaaaatgttctcaatcaagatattttattagagtgtgaataagatcatatcctacaaaatcttaaataaaaagttaagttagtaccaggttattttctcctacaataaatcctatagtctctcacaataatatctataattataatattcataatatttgcaggccactcaattggtttttcctcagttatgaaattaatatttacttctgttatttataatttacttaagtcaattattcaccctccccattctcaacaggaaaatgctattattgaatatacagcaaaggagtgagctcttaaatcttccaatacaaaagtggttatataaattatggtacaatggaatgttcacccaggcaaattaattattcattcccttaccctaattccacagcattccatacatagcacttatcacagtgcttattaatatttatatgtttgtctgagtttccctgaaaactagggattcatagaatataacatgtttttgttgttgttttgcatccagattgcatttcaaaataaagcctaaacaattgttgttactgaatttaaccctctaaaacagcatttcttacagacattaaaggaaagatgtaacttgccgtattcttttagcttttaagtcaaggaaataagtggtcttggtgactccaagtaatttaatgaggttgcaattttttgaatttctgcaatcagaccttggcgatgactttgagcagtaggatataaataactcccacatgcgtagtgttccaataatggaacactaggcataaatgagttaaccactttgagtatttcttggctctgaatgcttcactggattgttatgaagatcaatgagataataaaaacaagccactttttaaaccataaaggatacaaagcatcactatcagtgttgtcagtgtttttgttctcattgttgttttcatatctccacatctggagttttcatagtaggaggaacatggctgggtggtcattattccatagttcaacttaaattttttaaaatgttatgggagaaaaaaaaaagcatgtattccatcttctattattgaagttcccataagcaaaacaactatgtggttaaaataaaacactgttaagaatgtaaacatcaacatactttaagttatattggttcactgctttaagtatgatgtcctattttataagcaattggccaaatagtccaactgactgatttattttctcactgaatttatcgacttacagagctgactagtggtttgggacttcagagactaaaatttttcttctaagcattggctgacagcatacactgtgggttttcagcataacaaaaatgagcagcattgtgatctctttatttgataaggtagtagaaatatttgccttagctctggtaaaagtcctgtcattgacttttaatcctgataatatcatataacctttcctatgatagttcaaaaatgttcaaaaatttgcataattaacaagtcaattaaacgtgattattttttcattaagatgaaaaatgaggcatatcactattgataatgaaagcaaatgcctgtcattactcattctctggagccatttgtcttacacagacttgtcttggagcccgtctggtctgaagaattcagtgaacagcacaggtgacggtccataagatcaatgggcagaaacatcttccaagaaatctttgcatgttttgaagcttttagatttgcatcctctataaacctttcatcaaaaactatgttgccaaaatcaatactatggcctactaggtttattcattaattcatcacatatattccagacattgtgccaggcacttgcaatacagtggtagaaaggacagagatggtacctgccatcatagtagttaaagtctaaaatagataaaagtaaccacatgtgtaatatgtatccatctttacagaccaggaaactgatactcaaagatactgttttcccaaggttataaagtcagctagtgaaaaagctaagctgtgaacctagattctggtggctacaaagctgtaaaatattgttgctcttaagatataacataggccgggcgcggtggctcacgcctgtaatcccagcactttgggaggccgaggcgggcggatcacgaggtcaggagatcgagaccatcctggctaacacggtgaaaccccgtctctactaaaaatacaaaaaattagccgggcgtggtagcgggcgcctgtagtcccagctactcgggaggctgaggcaggggaatggcgtgaacccgggaggcggagcttgcagtgagccgagatcgcgccactgcactccagcctgggcgacagagcgagactccgtctcaaaaaaaaaaaaaaaaaagatataacataaaattctaatgataacaattcaagtagttgtgaagaaagtaggaaaaacagactataataagaaaatgtgaaaaccttacaaggaatgttttagccaagtagaaccatcctgctcaaaaggtaaaaaatctttagtttttcttagataaaattacacacaggcaacacaagcacacttatttgagttgatttagatatgctcaaagctttgcacgttgttatcattaatacctaaataagaaaatatgactgcctaattccaaaaatattaagtggatctatagaaataaacataatgtggaaagattttttttttttagaaattagggataaaaaaggacttgaaaaataaaatgattattttgtccttactattctctacttcaaaatctctcattcaatccatgtctactataaactccagttagaaaatttttctaaagtattgcattttactcattgctcaataactttcattggttccccatttcctacaacataaagcttacactcccttaagtgtcagttaagacactctaaaatatggccccatgatacttccaaataatctctttgcttcatgcaagctagtgggttaatttttcccttacatggtgggagctttctccacttcctgattttgtgcctccttacctgaaatacaactgtcctaatcttaatttatttattttgttcccattcttcaagaattgggttaaaaccaaacttgttgatcactatggcttttgaggatctgttagatctctgaaatctggtgattcttctaatcacttggtagtaccagtgacaccttttgttttacattaaaatgtaaaaccttttatgctctgggaaaagctagaaggcaggaattgtatcagattcatttttgtaatccagtaactagaacgcagttggccttcaatatgttggtattaatgaaaataaagcatgcatatggcaggcatatgtgaaaactcaatcattttgtggtagctgcctgaaacaatgtcttaaggagacatttgaagccaggcaacaatgaatgttgtgagaatttagtgatgtctgcagtgaacacaggaaggggtacttcagccattgatttgtcatttcccacttgagggcctccttttataataaaatagcatgaaacattccataaaaacagcgatgatttgcaccgtactttaaaatcaatatcttattgtataactttgactcaaagttataataatacaaatttggaatgcaaactttaaaaattgaagaaaaaaaccaactctccagaggtaatttagcttaatggttcacagactttgctgcatattaaaaccttctgaaaagtttgaaaattctgatgtccagactacactcataataattaaataaaattgcctggaattgaagacaagtactttttaactccccagattattccagtatgcttcattgttgaaaacaatttaatattcaatagtctgggatagttctagcaagctcacatgcgatactgattcttcccaaatcttaccagtcaatgaaccaaaccttgctgctcaaagtgtgaacagcatcaccatcatctggagcttgttggaaaggcagaatctcaggctgtatccaagaattattgaatcaaaatttgcattttaacacaattacaatgcagttaaagttttgagaagtgctgtgtgcttggttctcaaagtgtggtcctcctgcagacttcctgattcaaaaacaaagattttggagccattgttgagaacctggatctatgaggagcggctgctgtcttcctttacgtctcagtagggcttttctgcccagatcatcagtgtcaaagactgggaagagaccatatgtaactgtatattccaaccccttcagagggaaactccaagtgcactagatgttaatcttatctaaattagacttcgatcaattcttccaaagaaaagaaggttggtctaaggcctaaaagagtgctgaaactacagatgtggttcaaaaatggcttcttacccaatttgtcaaagctctgctcaagtccttcattttttctgaaatggctcttgatcactcttcagtcagcattgatttcccctgttgagactttccaaggcacttccttccataagagtacattttgatattattaacttaaatctcctacatattattcccattttgcggatgaggaactctggtttcaaagtgttaaactaattgcccaagtttatccagctggcaagtggagatactcatattaatatccatgattgtctgtccctaaaatcaaatggactatttataacactatcctgcttcctcaagtatgggaaatgatccctggtatatactatagaaacaataaaagtgatgttttctgctcgtacctaagtaggaaggagcaaggagttctctttaggatatttgtaaaaattcaactgtaatactgtggagtgggcttaataatgctgtgcatacatagtctcacataggtatgtgttccagattcggtctcaatgtcaagggaagcagatgtactaagtgcaacctcgctagatcttggctggatgcctgttcagtaccactctatctaggctgctgaataatacatgaaaatatatatccacataaagacacacacatcctacacacctcaaacttctcaaatcagatatatgaaataggcaaccaggttatttaaaatctttaaaattattgtataatggtttattatctctaaaaaatgttttaatatatattttaaatacgtcaaacacattgaagaaaaatccttgcaagttcactgtttagcctgtctaaagtaaacctccataatattttagaactaaaccacgttgccttcttaatgccttttgaaagtgttgtcagaagaatgcagaggtatgatttaagagattgtttattatacactgggaaatattaaccaggaaagataaattcgagatacagtgtaaactgggtgaaggtattaacattggaactaaacttgctgaattcaaatcctgggtctattatttaatatctttaaggccatggactaattatttaaccttcctgtgcctcaatttactcatcttcaaaatagaaatgattacagtaccttttatagggttatcacaagacttaactgagtacaattttgaaaattttcatagctgtactgaacatttagaaggtgttcagtaaacagttactattatctgatatgtccccaagtcatagattaagaaataatgcttgacacgtaggtgaccattttattttccaaatccttcattccaaatatgtagttcttctttatgcttcatggtagtatgccctagaaaatgctaatccatatgagtatacatttataatttataccttatttagctggtggctaaaaacagtgcttaatcaaaccagagacatataagaaactacactgcaattcattaagaatatggacaaatctatacaaccttgcaatcagtaacttatgttgaagacggagcacaggatatggatatagtagaaatgaattctacttactgtacttagagcaaatcaactctcacttcagagcctcaaagtaaggtaatgaatttcaggaattttaaagtgatctctaattctcactcatcaaaattttaatacccttttccactacttcaagaaaccctctctttttagtttcttattcttaaaacacctgagtgtgtattttctttttcctgcaacatatgtttaaatttatactgctgcccttagatgaataataaaagcaatgactctctctcttatgggcaaatataccatttgcttattttaagaaaatgatgtctctataattgtcaacatgaatatatatattcatgtaacactttgagaatatatgtaacactgcgaaagtgtcttcttttactattattgctatagaattcacttttccagactaagcatactcaattttcttcctattttcaaaatggaaataatttccttactcatcccttgaattctcttaaatcatctgtcattctcaagacaaaatgcaagcatggtcccattagcattaatttttcaagctgggcattgtcacgcaaagtcatattcatttttgatggggttgttctgtgaattcactttcattcatttattcaacaaatactgaatacctaatatgtgccaggtattcttttaggtgctggagacatagcagtacaaaatgcagataaagctcattgcccccatgaagcttatattctaattaaatcttttggtttcaatggtataatgattatactattgctactatcaatgaacttatccatatccattatcaaggcgttactcattattaagaatttattacaggccaacacagagataaagcaggtattgtcaatgcccttaagtagttcataaccaaaaagaagtcagccagtcatatacacaataaatacatacagatgaaacagcataaaatcataagagatgtacagtttgttcagagaaaaagtagaatgtacagttaaatcagaaacaggcttcaaagacaaaaggcttttagaggatggcataattagtgaaagaaataacataagcaagtataggatagaataaaaaaagtatggtatatataagtaatattttagtagtaagaagacataataaaacaagtaggtatattagatagtggtaagggttctaaagatgaaaacaaaattcaagtaggcaaaggagactgaaatattgaggatagggactgagatgtatatagattaactagaaaagatctttttgagaaaaggcttcccttttgagtggagtatgaagattatgagggattgagctatttagatatttggaaggacattccagaaagagggggatagctggtcccaatgccttcaggcaagaacatggttggtgtgtttgaggaacagcaagatggccagtggaaagaaagaggagagataatatgtgaggagggatgaaggagacaacgggtgagattatataaaacgttattggtcataggaaaaaggtcattggcttttaccccgaatgatatgtgatgaaagggattgagcaaagaagtgagtttatttcgttttatcttttaactgggtcactctggctgctgtgtggaaaataggctgatgcggggaagctttaagtaaagagaccagttagagagttattgcaagagtccatacaaagaggatagtagcttggactagggagtggcaataggggtattgagaattgctggaaatctgtatatgtatacactgaaagtagcagtgaattcactactgtgttccaattcaatgcaaaagctattgtactatttgctcttacaattttgccttcttttgtaatgtgtttaaaataaaaagtttcccatttttcaaaggtgaaaacaaaaatcattgtcatcttgtaggcttgcaaaatttcagatctatcagagatactggatattatcttttctaaacgcttcattttacagagtagaaaacaaaggattcattcctcagaggagaaatgaggggtgggggaagtaaaccaaggaacagaaagtttgtgggacttaaataagttcactcagctatttagagaaagaacctggactggaaaccaggctgtctgactcacagcccaagctactttgtcttacaatcggtgatatttaaggggtttgtactgttcgtttaaagttctgttctgttattttgatttaacaaacattgagtgaaagccacaggtatctcaaactgaaaagtcttcaggccctaggcaggtaggaagaaaatgtggggaaaaaagtagatgcatctgttgcttacatacaatcattcccccttcccaagcatgccagctaaatgaaacacatttgtagctctttggattttggaaaatctccattgcttggctaagcagaagggcaaataaggaagtcatactctaatagggaaaacacaaaagcagataaggaattgcagtatataatgtgacttgcgcagctgtaaacaaatgcataaccctcaaatacagcagagtgaagtgagtgagcgtggggttctgtatgggggtgacagttgagacaagatggctaaagaagacctcacatggacaaaagaaacaagagttgaggagggttttgaagggtgagagtggcttgcctcctggataagattggcaaagacatcgcaagcaaaataaatttgcatatgtaaaagctccaagacatacaaatctgtgatacaggcttacctatatcactacatatttttcatatttttttcttttttttttgtaatcctccaaacttatatttgatcatatatctgtccagaattgagccttgactctcttcaagtaattaatcaaaatgtaacagatttcacacattgtttaagatgatagaaagtttgaatttcagtgtctacagacctctgctttccctattatattaggagtcagatccccatagaaataggcttcacagtcccagaacagagattgctttcattagcaaatgtgagcacttcaaatcctgggggcagaggaaagatgccagttgtacttgctgcagtgcatcagaataatctggatggcttgtcaaaacacagattgctgggccccagcctcacagtctctgattcagcatgtctgaagtgatgctggaaaatgtgtatttctaacaagttctcagatacatagatgctgctggtctagggactagacattttatgaatcactgacttattcttcaatacccaccagtgtaaacaccttcaaattcttccatataataatagctgccactgctaagaattctatttctgttaaaatggtcactgtgtatgagctccttgaaaacaaggggtctctcatccctgttgatgaaaataatgacagcagatgacatttattaagaattactgtgttctaggtacttttaaggaatcaaaccatttaaactacacaacagccctatgatctaaatattattattattgtcatttaacaaatgaggaaatttaacagagaggggttaaataactaattcaagggcaaagaatctcaagtcagattacttggacccaaattctggttttagcatttatgtatttaactctctagatctttaaacacactttgagactatcacacagggatttgcaaactgatgatttcctgcctgctggtaacatatctttcagaacaaagggtatttagggaaatggaggctgtcaatcagtttttctgagcatacctttacttctatatcagaagtaaataaaagactatcaaaatcttagtgattcttggctcctctaatgttgtactatctgaatttgtataaatcagagaatgtttatgtgacttgcccacggccaaagcactagtcatcacacagagccaaaaacagatcaaagacaacctcagtcctcagctctttctaggaatacacttggttaaggagctccaataagatttttaaatactatgtattctgcctagaaatatgcccataaaaagtcacagagtaaataagaaagaatatcatttcaaatgactcgttttgctttactgaccagaaagatacatgggagcagaagtctttttttttttttttttttttgagatggagtctcgctctgtcacccaggctggagtgcagtggcacgatcccagctcactgcaacctctgcctcctggattcaagccattctcctgcctcagcctcccgagtagccaggactacaggcgcccgccaccacacccgcctaattttttatatttttagtagagacggggtttcactgtgttagccaggatggtctcgatcacctgaccttgtgatccgccagcctcggcctcccagagtgctgggattacaggcatgagccactgtgcccggctgggagcagaagtcttatgatcaaaaatatatataagatcaagaagaaagtgaggagccaaggctgaagaatctggaggagttatccccttatgattttatgtaagggggtaagccattcaagaaaataactagtgtttgctaaaattttccacaaatattatttggaggcactatctttaaaattaaaacacagtcaatgaaaacaaatttctaacaaatttagaacatctgtttaattttttgtagtacctgcatgcccttgtgataagaaatagatttccttcataattttcctcagctaaccatttggatcatacttctgttcatagtttagcaataaaagcttctgctgactttggctgtgtctatatacttgtgactggtggtatcaaaacatcatatgtttggtattgtatagaaaacataacgagtgactaaacttttacatttccaattggttttctgaaaatcagacacagaacattttgaaatgtttgttgttgctaaactcacagtgaatttagtacgttcataaaatctaatgaaagtgtatttgtattcataactgataagaacataaagtattagaagtctagactgagagaatcttaagaaataaattccagattaactaaatatcaaatataagaaaagaaagaatacgttacaaaaaacaaaacataggagactttttaaataattttggataaataaaggctttttaaattggaaagaaaagctgacggcagaaaagcacatttaaaataaacaaaaaagaataaagcatggcaaaaaaaaatatcggaggcaacagaattagaaaaaaaaggtaaatcacaacaaagaactgattttttaaatacagatttcctaaaaataagaaaagacatttcatagaatcagatatagacagacagttcatagaaaaggaagtaaagatcacccttaaacaagtgttcaacctaactcataatttaaaaaaaattaaaatttacattttaaggtaacaaagaaccaagttttttgtttgcttgtttgtttgtttttagttttcgagacagagtctcgctgtgtcacccaggctggaatacagtggcacaatctctgctcactgcaacctccacctccctggttcaagcaattcacgtgcctcaggcttccgagtagctggaattacaggcatgcaccaccgtgcctggctaatttttcttgtatttttagtagagacgggttttcaccatgctggccatagctggtctagagctcccagtgtcaggtgatccacccacctctgcctcccaaagtgctgggattacaggcgtcagccactgcaaccaactaaaaccaaaagtttgataacacattttgttgactagatgataaggaaacacaattttagagtaaatttgcataatggagagcaattaggtgacatctttcagaatgaagaaagcacatacccttgacccagcaattctacttctaggtaactatcctataaatacatttgcatatatgaaaaatgacttatataggaggatattctttataggattgtttgtattagcaaaatacctaataggaaattaagtatttaaattatccatttaaatatgtattatatgaaaaaatcttgcagatatacattttaagttaaaagaaggtgctgatagatcaatatagtagatagataaagacagatggatggatggatagatattgtacatgttgataagtgcatagactatatcaggaaaatatcaagaatgtgcccaggtggcaatggagggtgtgaatgaaaattgcttttgactgtgtcaatgacttccaatgaatatcataaacacacccaaggttgaacaaagtttgttttaataacactcggcaaggaggaaaaatacacaccagagcagaactggggtttcttggtaagaggatgtaagaaaagatttacaggatttgggtgtgtgtcaagtggttttaaggagggctcaaagatatgtgaatctgccccagattggatgctctaaggatgtgggtgtaattctatggctactatcttagtaattcttttctagaaggcaagaagaacagagcaaggttaaagctgtgtttggtaaagaagcagcagccacccacataatctaggacagagacatatttgttcattttgtaatttaggaaacatttttgttttcgtcgtgttcagacatgattacagggtcttgcttttatcttgacccatcatgtctcagtggctttgtctaattgcaaatgtgaaattgtctatattcaacagaaggagaccaagtcttcttgggagtgtcaagccacctgctggctgtcagggactgttttgctatttctcaactatacgcccttttgtgcctttataatttggtgccacatacttatcttacctattcaaaataatttttaaaagaatatcaggactaaatgagaccttaaaagtcactgagttctgaaaccatgcccctcccaccaccactctgcttcctcctcccacaccaagggggttttcttgtaaacctctccctttgcctcaagtgccaggacagcatctgcttcagtatctccagtctttccaccgtactaacttgtcaggcagcccattccatatcaaatgctcttaatattttattgttcagaggtaaagagaacaatacctttggttataatatctttgttgttttctccctagcgtttttgacctcttcaaatgtatcttgtcctatggtaactcaggaaacaaaataattagctttttaattttatgtaaaatattcctattaataccctccaaactgccattgtcttttttgttccagtgttccaacacagttttgtgctttttatcattacatttgcagagattcttatctgttcctgccgacaaatccatttgtgttttgtactcaattacatataattagtcttttcttcatgaacaaaagaacaggtgtctttatcaattctgtgaaatataccatggtaaggttggttagacctaatgatgtctagtgaaccaaacaacacatttctgacagatgctcatagtaacaagattcttttttcaaacaatcaactgcttctactcctacacacacaaagtagagaaagaaaagacattttaacaacttagaggtttataatttttctatgaaacaaatgagtagaatttaaatccttcttcgatattttgacttctaatccccactctgacaaagtatatgtaaaattatttgtttttatttgatattcttcattaaaatatgtggggaaagtgtcagaagaaagcacattagttgaaaaactggtaacattttaataaaagctatagcactctgtaaataatattcactagtgtcaattttctgatgttgatcagtatgttgttacgtaacatggtaccattagtagaagctgggtaaaaagtataaaggaattcacttttattactttgtaatttttctgaagtcttaaatgattttttaagttaaaaaatatgtggggccaggcacggtgactcacgcctgtaatcccagcactttgggaggccgaggcgggtggatcaccaggtcaggagatcgagaccatcctggccaacatggtgaaaccccatctctactaaaaatacaaaaattagctgggtgtggtggcatgtgcctgtaaccccagcaacttgggaggctgaggcaggagaatcacttgaaccagggagtcagagtttgtactgagccgagatcacaccactatactccagcctagtgacagagtgagactccatctcaaaaagaaaaaaaaaaatgtgggtaacagtattttagccaatgacctacagccactgaactccagcctgggcaacagagcgagattccgtctcaaaaaaaaaaacaaacaacttttctacatattgacggagacgttcatgcacctagtcattcatcattcactttgtattgagtgcttactatgtattacagaccattcattctaggttctaatgatgcatgaggcatcaatcaaaatcttttcactcatggaacatacattcttctgggaaagaagatcaaaaataaataaacagcaacaatacatatttcagaaagtgggatatgaaaatagagttccaaggtgagaagtgtaatttttaaaggactgttaaggaaggcatcttcaacacctataagacagatcttagcagcactatttgtaatggccttaacatagaaacaatgattatacacaaaaaggaaaatgaataaatatgtttgtatacattcatacagtgggatattttacaaaaatgaaagaaataaagcaaataaatatattaccatatacaaacctcacaaccataatattggggattaaagtacataaaatatatttatgataatgttctaacttataaaatattttaaaatatgcaaaacaatattatgaattaaaattttttcttaaattagatatatatgagacatacaaaattccagggagttattatatctggtaatgatgaaaagtaagattccatgagggaaaacacaacaagaaggttaaactatattgatatttttaattaattttaaagctagtggtaggtatccagataaacttgtattaatctatatattttgtacacctaaatgattttaaacacaatttattaaatttatcttaataaaatattaagatagtttatcttaataaaatattagtttaaatttgggagttcagagaatttttaaaagtacttatttgacacaatgtgtgccctatggtgtgtgtgtgtgtgtatgtgggtttgtgtgtggtatgcagaatgacattatgctaagatatatatatgcatggaggaaggtacaaatgtacacgtgggtgtagatttacactagcagttcacccagcgtcagcagagcaagcgttgtcaattattttcctagaaagagtgaaggaaggatttgtcctagcttgaccccacacttgcacttctacccttctgtctctgccccatgataaatgtcatgcatttgcaagatagttggctgggtaaaggtagcattttgtagattgaatatggctaatcgtcttacttggggattgattctatcttcatcaatttataatttttcaattttttttaaagttagatggacgatgctgacagggatgttgatatatcatcaccatctccagccattagattttatagaaattaaacctgagaactagtaatatcttggagttagtgcagataagtgacacaaataagtggttccctggttcttgcatctatatttgtagcctcactaaatcgacattcagttacagacgcaataaatgaaagtacatggagagaaaagtatcctgattcttctacactgagttgaaagctttaatcatttaaagaatgctttcacaaaaacacaagccaacaatgcaaaccaaaatcagccaatcaacaacttagcaaaaaatctgagagcaagaaaactgaaatgaaattctttataataagatcttttatttattgtaaattatattttaaatgtgtaatattaactgaacaaagaataacttagaaagggtggacaagggcattttcattcattagggattttaaatttttcctcaaatagttcttaataatttaaaagacgtttcactacaaaatatctagcttcctaaattactttatgcagtttggtagattatcagcctgatcacaaaattacatccatcagaatcacaacttgttgggacagatatcagtgagcatttattgtgtgctcaacactaaagatctagcagtgaagacagacaaacattaggaaacaatatggcaccatacataattttagaatgacatgaatttgccctcaggtatctgtatatgattatgcagaatttgaaagatatgacagctatcaatcttgcctctggagcttgtatttgacatttttctagactgcaaattcattttgtcataccgtgatgattgcatttaattttttaacttgtcaactctaaagttagagcacttaaaaactatatccagagaaattattattaatctttgaatgcccagcatttttatttccccccccaaaatttttaaattccatttcaggtctatcagtcttcattatcttcttactattatatatatttattatatgtaccatatgtaattataatatttaaatatattttccttttaaaatcagcaattttgcctttaacataaaataacatatatatatatatacatacacatatatgcatgtactcagtgtttaccttaagaggtaatttttgtctgtcagaaattgtgttctaagaaatatagaacttgttcattattgaactataacttgttcatcacttggttccgggatttaaataccatcttgtgttggaagatgtgcttgtattgttcctaggagtgtgtatcatcatgctgcctaaaaacactgtgatgggagtatattcttgcccattgaccaaatggacaagcctcttaccttctcttaagtgcataacctctctcctatactgtctttgctgtaggaaatcatagcaagaaggataaaggaaaagacactagcttactaatagttaaatagtttgaaaggcatagtttggtaaggcagcttagcaatgctttaagtataagatacactgggccctacatttgatttgtaatcagattgtaagaagctaatgtttcttactgtagtcgctgttttcgtccttggtcccatcaatggtaccatctgggtgcatctgcaggaagtatccctgctggctgaataaccttgtcacaatccctttgagctggggttctgcaaaacaaaataattattcaaatttttatttggcttacacaaatgcacacttacagattgttaaaaacatcctgtaagtaaatacgtaaatgccaatagcttaaatattgaattatgtatttgggagttgggtgtttcagtaacatatctatgcttttttttttccatttagaggtagagctttaacacttttagcagtaaactaaatgcaaataaataaaagctaattatgattgggaaaatacagagacatgctaaaaagtgagttattttcctcctttgtgcatctggtgtctgactgcaagatttcaccaactttatagtcccattccagaattattgtttaggccaaaatgcctctgtaatttctaagtttctagtagccataaccaggtccataagacttctatctctgcaggatgtcagctctccatcagaagttcctgggttttgaatttgtgatcaagttcagccagaaagaatagtttggagaagaaccacaggcaacagcaaaaacttccacggccatgagatgtcactggcaaatatgtggaaacgcaaatttcaccttcactaaatacttcatcagagaggagcctcagtgttccaaagttcatttctccagtacaaaaaaaaaaaaaaaaaaaaaaatcaagtcatacatatttatctaagtatttcaaaccagaattgctcaacttttaaaaaccctctaaacacaaatactttcaaactaacctttgtataacacatttgaatttttgtgcatcagctaatataaatatttaaagctttctcatcgcagtgctggctgccagcaacaatctagtttccaccgcatcaccatttttgtctctattgttgagcaaaaatgaagtattctagtgcccttatagctctaattatttcattaaaatgaggagaaaaagaaaaatgctgcttctggtgataaaaatggaggcaaagatggaaatcatatgattgctgaagtaacaacatggtatcctcagaaggacaatcgctgaatttaagctagtcaacttcatccttcatccatttattcaactaatgtttaccaagaatgtcttttttctgccaagcaatatggcaggcactgtgtgttacactgaatgcattattgatatttaggtctaaaagaattctagttaagcatttaatgtgattaattctttgagaattggcctacaccctataacaagtgtctgcagttgggacttttgcacatgtgacttgatcacattcacattatttgggaatatggggcaatgcctctatcaacacatctttttcaaagcagtcctacaaagcaaaagagatgtcaagaaaattgggaatgaggaagcagactaatgagcaaagaactgaactggaaattaggtattctaattaatagatatgtattatctttatgagttaaataaattccgttttttaaatttgtgaacctcaatgtcctcatcaataaaaatctggaagttaagctgaatggttgtttgttccttcatatgagtctctattcactttgagcacattagaatcctctgccttgaatggtgtcagaaatagaagaatggatttgtcttcaatgcatttcctccataggctcatctaatcccacaactatggacaagtcagggacacacttggctagctaacgtcactgcaaacaactctctcttttttttaaaattatacttttagttctagggtacatgagcacaacgtgcaagtttgttacatatgtatacatgtgccatgctggttggctgcacccattaactcgtcatttacattaggtatttctcctaatgctatccctcccccacccctccaccccacgacagtcccaggtgtgtgatgttctccgccctgtgtccaaatgttctcattgttcaattcccacctatgagtgagaacacgcagtgtttggttttctgtccttgctgtaaacaactctctgtgtgcctctgcctttggctacctggctgacaggcagcttctgatgtggtagactcacctatagatttgaacctcaaatgctgtgtggccccgatcaactcatctaacatctgagtttcaagtttttgtatctatatagtaagatttttaaaaagtcctactctataatccttgcaaatttcaaatgaatagtgacagagtacaaactagaaaacccataaaatatacatcctaattaaagtctaatgtttcaactatgaaaatcaaggacacggtataagggaggtaaaagaagcattctgagaaaagagtatgtctccagcttctgctttagtaaatattaactgagcttgtaaagccactaaagtaaacagtgggctaaaagtacaggatataaaacaatagaggggaggaagagggcaactgtcttacaattcacactgtatttctaataagcttgataaagtcactttaagaagtcaccacatgttctcactcataagtgggaattgaacaatgagaacacttggacacaggaaggcgaacatcacacaccggggcctgttgtggggtagggggaggggggagggatagcattaggagatatatctaatgtaaatgacgagttaatgggtgcagcacaccaacatggcacatgtatacatatgtaacaaacctgcaagttgtgcacatgtaccctaaaacttaaagtataattaaaaaaaaaaaaagaagtcatgtttttattggtaatgagatgcatgccagtttagtcgttaaagcctgtgaatgattgtttgttttctttgtgctcctctttctgtacctgtaattaaacacttcttttgccctggtggagccatcccctgttggagccctgggaattcgggttggtaactcctgctcaggataatgagcatcagactctgagcacccatctctgagagcagtgccagaacaggcccagagtctgcgttttaatcatgttgtgatatgtgaaaatgaacatcctgcattacagaagtttcaaaggagacttgatcatctattgaaaaaaataccctgaacatatataatatagatggggcacagaaagctgtgtagcctgagtggcatcttgtatgtctattaccatcgatcaagtcctaccaacctttccaggttcagctcaacatcaccttctccatgaagactcagctatcgtaagtgagaatctcctttacgatgaggaaaaccagaacatgttttgctctattttaaagaaaggaggtataaaatgagaccacttttcagcatatccagcatcctgggtacattcaactaacacacgtttatttatcagactatgcttggggacccaagatatgaagaaaacgaaaacctttgctgtcctcagggagcacccagtctaatgcatgaaacatatttgtgtataataccagtgtgggagagctgataaataaggaagtgaatcacagtgatgtgatgtcaccaaggagcaagggaccagttctgcctgaaggttgggataaggcacttcatctgtcacttaaagaatgagtaggattgccataggcaaggaaaccagagaaagggcattccacacaaaacatcacaactctgggaatgatgcagcctggtatagacagaatagagaaaagggttctcaaatgcagacatacaagtaagtacctgttctcaacaaatgttctagcacaacagtgacactaagacaaatagggtcaatggaataggttttctatgaagctaatattttccagtttatatgactccttgattttaaaattatgctcttccattactgtttttctttttcttaatgaaatgatgactatattattagatggtaggggaggaagggttggtttgctcccttttgtgctctaaagtggtgtggcaaatactgcaagcatttcactgaaatccatttcctcttttttctgggcacccagctagaccatatgtcctagcctcccttgcagttaggtttggcagatgaatgagtgtcatatggaatgtaagtggaagtgatgtgtgccattttcaggccaaggtttttaaaagcaaacattctcctccacactctcttttccttaacaccggccagattaagataacatagccctaggggctatagaaacaacagaatggaagaatgttgggtccctgaataacaggtaaaggaaagatgactgccattgaaatacctaccttggaccgtgaactgaataagaaataaacttccattggctgtgcataatgggctttggacttccttccaaaacatacagtatgcaaagggaaggagagagtaatattatggtggagaaacctaacaaacaaagcactacctcagtcaggcaatcaaggctaatatcatcaattataaaacatgctgatagtatgttctcttgagattatgtgatgagaatagcactttacctctgtgatcttcctccaaaaaacccacaaccccagtctattcatgagaaaaaaaaattagacaaatgcccgttaaataatgttctacaaaatacttgaccagtactcctcaaaatggattgttcatcacacaaagaagggataaatgcttgaggtgagagataacctatttgccttgatgtgattactatgcatcataggcccgtttcgaaatatcacttgtaccctacaaatatatacacccaccatgtacccatacaagttaaaagtaaaaaattaaaaaaaaaaaaaactatcaatgtcattgaagaaaacgaatgtctaggaaaaagtcatagataaaaggagtctaaaaagacataacaactaaatgtaatggggtattctgaatgagatcctagagctgaaaaagaacattatgtaaaaatgaaggaaatctgaataaagtatggattttagttaaacatactgtaatgatatagattcttcattgtgacaaatattgtacattaatgtaagctgttactatgggaaattggatatagggtatatgagaactctgtactatcttcacatctctataaattaaaaaaaattctaagataataattatattaaaaatactaagtacagctaaaaaagcaagtaataaatgttttcctcaaagaggctgagtgacaaggaaggtaaaggatgggacctcgggttcaatactgcttcccatcaggatgacatggcaatttcagcagaacgtttgaattcagagccactcagaaaagctgacacatgctggagctatctagacgttcctgccggcttgacagtccatctagtgctatgaagtatttcctaggtacacgatggaaacccagaacagagacagagccaaggggtcctggtcagaaatctcaggatgaatattcaattacaggaaataggatgaattttagacgtggaaaggatcgacactttacttcattagcttcaaaggtaaaaaaaaaaaaaaaaaaacaacaacaaaaaacaaaactctggctcggagagacagtgtcttatccaaggtcacacagctaacacactgatgagttcagacaagaactcagctcctatatactgaatggacatcatcctttcctttccaaagagcaaaatccttaccttaccaaaactgagggttggggagcaagaagggagaagagaggagagaataaggaggggagagtatctagctgtgaatcagttattaaagtacgtgttgatagaaaagcagttacagaaaattgtgcaagaaatatgtatctatataacctttgatactaaaatcttctagggccagcgtattcacatatacccaaactttagagaaaggttctgcatataaactccaatctaaaatgaaaactattataacaataatgaaaattatgtaatgggggccatatctagagaattaatagtacttttgataacaatggctgtatattgaacccatctccttcgtggcaggcacacttctgatacttttactgttgttttatttattatgcataacaactaactgtatgaggtactcttttctcatttttcattttttgttgagattcaaggaagctgcaccactttgacccaaagtcacagccactccctagtactgttcagtcactttaaaagagtactggcaaaacaggaacctgtccagaggaaaggagccaaataaagagggtataaatgactgtcatatgaagaatggctgaattaacagtggccgtgcagcctagaaaaggaagcatttggagggatgtgagagcctagaagagggaggatttggagagctgtctccacgttcttgaaaatccaaagaaataagaagcagccaatttgttctgagtggctccacagagatagacctagggccaatgggtgaaagttacaggaatatgcagattaaaaagaactttctgtttattgtattcaaagacagaacaggtcgcctaaggaaagagtgagttttctatcactggacataaccagaaagaagcagaaaaactacaggtcagagcagctgtgaaggacgtggacgtctccaaaggcggagacactctgagtgagaatgaaaggtcttttctaaccctgatgtcctggaaagctttgagataagccagatggtccactaaatacaatttcacttttctgtttccttagtcggtgcttaagacagggaattaaaaagactgtttaccaggcatccagaaaatgcaaccttctttataaatgttaaacatagattgtggagtagtttgacgggttcttttaatcagcctctttgggtttacaaatgtgccttctgtattaacatttaatgttgtccacttaagggaaatgagattgaagaagctgttaaatgtgattcttgtcaagggcttcgggggcattacattgatgcagacttcaaaattagactattagggttagaaaatgttcataagcaaatacatttctgaccaatcataactaaagggtatagactagggcatatttacataccataaaccaaagtcccaggcaaatcagaaatgagctacagtaagcatttgaaaagggacagaacttacctggacttttgaacacactgaaaaattgcaactctactgatctatggggattcagtaaaaatatatgctatttagtaaaggagaagcaggcctgaggcccctcattcactcaacagactgcagtgaacagacctggaggaacaccttccagaactgaaaggataaggctgaagacgtgtcactctagcctggcagaatctgctctgtggagtaaagtgagtcatgtcctgtccctcatcttcgatctccccattggtcaaatgaagacgagagacaccatcagcagctaccttgctgagggccgtgaatcaaccccaaaagtgctgatattccaagaggattctgtaactaagtgcattctatttcagttatcaatagatactaatggcacgttttattttttaaaaatgaatatttattgagcaacagcctttgtgacagttattcttctgggcaaaagggataatcggtgcatgctagtaaatcaactctcccccacctccctccccttccaaaaaaaaacagagcagaaaagaaaatccaaaaccagactttcatgggatgatttccacagtgcaactacttcaactatgactgctttaaaactactacttgacatcactgaacatagatgtgaagctggaaagaggtgagcaccatcagctccagctcaccaatgaatataactgaggataaaacataaagcgtgcattctagtaggaagatggaaaataaacatgtaaacaataaagtatataataaaatgttagtataagtgctatgataaaaattaaagcaatataaaaggatagagcatgcaagggatggatgtgctattgtggacagaacgaatagaagataacatcacagaagcctaaagaaagagaggaaggaaaccattaaggatatctaacagaaatacattccaggagcagggagcagcaagtataaagcaatcctaataatggtaaagattaataaccaacagattagaggctctctgaagatccttcctctatgccaagagtccacaaactatagccctgtggctgccaattttgttaataaagttttttttttcattttcttgctcatttaatctgaacagtattagagcatgaccatgcccattcactcatgcattgcctctgctttcatgctacaacaacaaaggtaagtagttgcaacagataccctatatcctgcaaagactgaaatctttactaacagaccctttaatgagaaagtctgccagccctttctctacttgctttctcttgcttctgtagacacctctgcctgaaaagcacaacccctgccttcctcctctgcccaggggtcctccagagccttctaagcacagctttcttccacagggtcttccctgacaccctgaggcaaaattaatcacttcctcttcaaagctccattgtgcataggttaggagagctgtgcactattttagaggtgcttgtttacacccctgtctctgctgctgaactatgaacctctcagggcagagaccttattcatcaactctatcccagcacctaacacagtgccaggcacaaggtagatgaggagtgtttgtatgctgaaggaatgaaagtaataagatatacctggcattttcctttgtcacctgtgactttcaaaggagcttctcatttgtacaaagagctgcttatagcctttgaatataatgcctctggcctctaatgcgtttcttccaattttgtcctgcacactgaacacagtctgacaagcacagcagcctcctccataaactgcacagtctccaaagccctgagttgcctcacatttcaacaggaatcgaatgaccttgagacaggcaatcctcaatcttcatattgtctcaaagctacatggaaagaaaataaccttcatttttggagtttcctcttcaccaaagcagtctgagctgtagaagacatgagacggagggcaggaaaactgagctaagatgtgaaatgccaatagggacaaggtttttgtactgagccagttttattcctcatagcattagcccccttcctcctagattcttctttgtaatatgctcatgaaaatttaaaatagttccagcaccatttattgacttccaacatgcactaggtgctgggtacaaagatgagtaagatgcaattcctgccttgaaggcacccacggcctgatcaaggagacacatacacaactaatcattatttccgtgaacatttaaagtgctgtcataaatgaacaaataaaatgccacggaatcacagaatggggatgctaattttacctgggatggcaggttctgggacaagaaacagttgaaaaaagctttaaagatgaagtaccactttatagttagcctagaataggcaggaggattttgctttgagcagcaccagcaggagcaagggcacagacagatgcatgtgcttagcatgtgcagggaccaggtatgtagctgggtgtggtcagggtgaaggaaatatgggggtgcatgcaggggctggaggcgacagcagaaaagaagcagggtccaggacacttgaggatctttaagcaaagctaataacaagttttactttattctttaagtcaatgatgtccaaacttttctaattatacatctctatcagtaaaatattttaaatctacagccttcatatatgtacatgtataatttatgccacgtgtatgtgccactctgtaaattttgtgtataatataacacaaaataggaattttaaaatgagatcaatgaaaaacacaaacaaaagttgtaattgccaggcatggtggtgcacacccgcagtcctagctgctggggaggctgaggtgggaggattgcttgatcccagaagttcaaggctgcagtgagctatgattgcatcactatactccagcctgggagacagagtgagaacctgtatctaaaaaaaagttgtaatagttttttttcatagccaatggctgtcatgccccacatgcttcagaggccaatgcattaagcaatgggaaaatttggaaggattttaagtctggggctaaaattatgagggtagtattttacaaagtcaaaggatactgtggttatgggagccagttagggagctattccatataagaaggaccttagataggcagtggcaatggggatggaaaaagctgtcagccagaggactgactgtgcttggtgtgctaacgtttcagccaccttaagaatgaaagtctcatttcagttgtaaatccaaatcccaaatccgaatccgaatcaatcgtcatcttcctaagggagcactatttaaatgtagaatattaatgaaagtgtgggtgaagaaagcttaacgcaggcattcccatgaagccaaataccttcttgccttttaagaatctctgttcatggaggggagtttgacactggtcaacctcactgggttacaactccctggtctttctcaaatgatcacccagagaagtagacctggaatgaacatggctttccaggcagctcaaaaatgattgctggagaatgccgaccacaagacacttcaaacatgaagataatcctaaaatcttaagatttcagagccagacaagccattcaggataatctaattcaaagctcatgttacatatgaagaaacaaaacaccagggagaggggaaagtcgcgtggcagcacatcttccaatccctggagtcagagctctttaatataccaggatcttccagttctgtgcctcccagaggtttcctgatcttatcccaaacgagctgcatggtatccagaaagccatttcatttcttcatgcatagccatactttgcttcttgtgaaattgtttagataactaagacccactgaactaaagcttgttctaagaaattaggaagacacattatagtgtgctctatgactaggaagccacgcttatatggtagatttaactttcagacagaattaatgtagataggaaaatccacggttagttaaacagtagcaatgggcaaattctcctgaggttcattcacagaaaggaaatgccaagcagttaacaaatgccaggcactttatgtggattatctctgaattttcactgaaataatttaaggcaggtactatcattgggcttttttttttacatctatattagggaactgaggcttacagaggtgaaatcactagtgctaaattacagagttaatccatgccagagccagggtggaaggtttttgctttacacctcattgttaatcatcagttgtcttttgaagaactctaacatgctaatacatctctctacttctttaactgtgatcagcccacaaaccctgtggaaatctataaagccaggggccaggaataaaaagcaaacactaaactggagttgcagacatagcttttggcctcctgtcacaaaaaaaagtggcggggctgtagacacttctatgcacacagaaagtgttctgtaataaaagcatcctcatttggcatagaaaaatcttctcagtgagtctcttttctcacagacacatcttttggcaccagaaataaatgaacaggacacattatttgggcgagcacaggcatgacagttccctgacatcaggggagctgcacaaatgttggacttgtcctgaaactgccttggatatcagagatctgtttatccaggttggcaagcctgaggaattccctcatgcagcccaaatgtaaattaccttcaggtatattattatggttgttaaatgtgacttttgtctatcatcttttcataccatcacacacacacacacacacacacacacacaatgctttgcctttgcagagtcaaccagagtgagttctagtggtgtaataatactttcggcaaaagagcagttgagagctccaagaacacatccatcagccttgatcctggtaaattcaggcaccgtggtgcaggggcatatgcagggcagtgggatccggacatttggggtctaattccaattgtttgcttctctccatccgcactgcctccacctttgttcaggccatcgagtgctctgggctagattccactaacagcctcctcactaacactctttctcttccaaaccacactacagtcaaggtaatattttacaatataaattggatcatgtcactcttctgcttaaactctttaacagcttcccatttcatttacaagaaaacgtcagacccttagcatggccgggagagctttgcaccatctggctcctgcccacagtttcatcatcatcttaattgactctctccctggctcactaagctctaggcacatgtgccctctttctattcagacctagggatttttgtacctgcatttccctctgcctggattgattttcttcctgaaataaattcaagtcactgcataaatacaatttcatagaggtcttgtctaggcctccaacctaaatctgccgccacgtttgtacagatattatctggcagcacactgttttttttttcacctcccttcattgcacgtagtcgaatttgtaactagatagctatttctctttgttgtttattatctatttcccactctagactgtagcatccctgagggtgaggccatgtaacttttatttattacagaatatctagttcttagcatagtgcccattaacatacaggaagcaaacattttttttttttttcagtgacctagtttcttctctctgggcttcaggtttcatctataaaacgactgtattggaagagttccgtggctccaagtctaggtcccagaaacctgagggactctcaggtcaagatagatacttacaagctatttttaataagttagaattaaaaatggagaaaacatttttaatagatatatcttttaccactgtaaatcaatgaagattattaaaatttcagttaaattataatctagacaaactatattaatacaattaatttattacttgatattacatcacacaaaagagcactgaaaatatttatcaaatgtggataacacatacactgtaaatatgtaaacatgggttgggtgctataacttagattcattttgggaggctcttagggacaagtgaaacacagatacagggaactgccactgtgactgataatgatggactgtgacatagaggctaagatctcatgaataaagaaatgaaccagtgttttcagacaaagtgccaggacaatactttcaagggtggctgatctgactgtagacatgatcaaaagcctacttctctcatggccgactccaagaagcatatttcaggattcaatacagcaaggattgatctacccctagctaaggaatctctcaaacttatggagacggtcagcttgactttaacacctataacctattttaaaaattgaaaacagtttcccatttacatgtgacacattgtattaagaaaaggcatgatttgtcaacaaataatttttaaagggcacacgtttgggagaacaattaacattaaaatgtatgttgcattttgtttaggtgttacagaatcaaaaatacaaaaacattgggttttttatctgatgcttcaaaatcttgcactttgttttataaaaactggtttaattttagaatctctgtgttttctttctagtgaccacataagatgaaaaaattgaaactcttcccaagtatgtatccacacataatccattctttccatggatcacctgtgtagtcataaatgggaaaacaaattagatacaatggtcataagattttcttctttaactctgatattgaggctctgaaaacatctatatgtaccacgtaggaatttttattcgtaattttaatttgctttgatgaagattatcttgattatgatttgaagatttattatagttttacctatccattaacagttttattaatttgaattatctttttagcatgaaatatttcaaacatgcagaaaacagaaaactaataataacctttttaacagtgcttaccatgagccagggactcaaatgatttctatgtctagtacttactcattccatctttgcattagctctatgaagttagtattttttttctcattttatagatgttaatactaaggtgcaagtgaagtgactgcccaatggctcacccaaatttcataagcagaagggctgtaaagatttgagcgcaggcagcctggctccagaacccatagaacagattatcattctcactgcctctcaaccaggtactcatcacccatatttaacaaatactagcattttccataattgcttcaaatcgttttatagaatcaaaccattacagtcatctctttaattccattccattactttgctaacgagatgcagacatatttctgaatttgggaggtagccttcctattcatatttttgtgcctgtactccctctgtaaatatccacaaaaagtacctactgccctttgtgtgttgtgcattttaacataaaaatatgccatgtatattatcaagcaatttgattatctcattcaacattgtattaacaccaaatatttggattttgaatcttcatctgatttgaaattcccataatagatggctataatcattttgctttaactttaattttctgatttagctgtttttatttctatcatcttcgtttgtggtttttatttattatgcatttctttgcttcattattttatccttatgttccttcaattagattgatttagtctcccttatactctctccaatttttccctttatcttgaattggaaattacagttctgtctctattattttagtagtaatccttacatatctaacataaaggtgtagtttaacaaaatccaagtctaactgttaattactaagcttttatcaaataatgcaaacggctaaaaactcaaatccacatattcctattactggctagtattttagttctggtttctttttaaacccaagaaatgctcgtcataagatttttttcgtttattatgatagatttacaaacatgtttaccatcttttttgctcatcattataacccctctttccccccagactcaaccccctctttgtgaaccaataaggaaccaatctattaaagtgtaaaaatgtctcagtgtttggcattacatttgtttatttatttctctctctttcttattgtaattaactggacacataacatcaaaaagatgcttactttccctcagcattctggaaaaaaatttcatcatcttctagcaactattattgctgacaggtctgcaatctatctttcatttgtagttaatctgtcttttctctctgacttcttttaaaatattgtatcttcatcataatgtgattttataacattactataatattcccaggtgtggattgttttaagaatccacatgatgggaaaagcccatatgaattttggggttctgcaaattctctatcttaatctctttgattatagatgatctgacattgtatcttttcttctttcccaggactccattgaaatgcatgttggagcttctttatatatatttcctatctcttaaaatctcactcaatgttttccatctattaatctctcagaagaattgatttgtctgctttcatctccaatttaatcattttctcttctattatttagagcttatttttgaacacacacataaactttctttcttactattgtcattgctatataattattaatttaattttatttatttatttatttatttttatttttatttttttgagactgagtttcactcttgttgcccaggctagagtgcaatggcgtgatcttggctgaccgcaacctctgcctcccaggttcaaacaattctcctgcctcagcctcccgagtagctgggattacaggcatgtgtcaccacgcccggctaattttgtatttttagtagagacggggttgctccatgttggtcaggctggtctcaaactcccggcctcaggtgatctgcctgccttggcctcccaaagtgctgggattacaggcgtgagccaccgcgcctgaccgctatataatcattttcttcaaaattcaccttttttcctatactgcccttttcctgtcttgtgatttctgcttcatttaattaataaacttttaaaacattatttttaaaatttattttagattcatcttaatatctacaacttgggggtatgaattattcaacttgttgagctttactcttctttttgatggtttatatccttgtatggtttcaattatcagactgagattttcctcagagaaagttgttttgtgtttccctggactgtgaaacacatggaaagcttttgtattggcctcttgtagtatttcacggatttccccagctagagagaagttcttacgttaacttctcagactggaattccaacttaacaaggagagtttgatattgaacctcacccaggaagtggtccccgtttgggtttctaattcctcatagacaacactttccacccattgccctaggtggacacatcaagttccttttagttttccttggcagatagaaaatttttctagatcaccatctctcagaaggagcactgtctctgtacaggcccctgcctgcctcacacgggtctgacacccagtctcctgtgcccacataaaggttaagcctgatgctcacctgttgatgcctatgccattctagtaatcgccacctgaagtacagaaactcagttcctgctcatctcgataaatataaattccctcttcttttctggcacatagagatttcccctttttggttttgagcgcaactatgcattttaatttttgttgttatattttctccagcagattcacctattttaagtgggaggcagagtcatttcgtaacagctcagattacaatagtcaaagtcttattttagcgtcaatgtttattatgcctctaacaagtagaacattatgggggtaacattaaaactataatattcaaaattatcattgtggttagaactgtgcaattaggacataaaaacactctgaatgactgagtcacgaacacatctgcctgatcccttccaagtgtcaggtatttagtaggtgagagtctcccagggccagacactatgcaaggagcttgggatacaataggcagcttattagtttatgttcccaaattttaaatcttaaaggaaaaataatttttaaatagttcattctattgctttaaggagaataatatatctgaacagatgttttccctagagaattgaaaaccaccagtgaggaaagctgttcttattaccactccttacaagagaaaaatagaaccctagtgcaggaaaaaatgtcttttctggtattacgcattgatcaaaattagacgagatccctttcttctgactctttcttttctttctttctttctttctttctttctttctttctttctttctttctttctttctttctttctttcttctttctttccttctttctctctttgtttttttttctcagtgtctcactctgtcggccaggctggagtgtagtggtgagatcacagctcactgcagcttcgaactcctgagctcaggagattctcccgccttagcctcctgagtagctgggactacaggcgtgtgctatcatgcctagctaatttttgtatttttgtagagacagggtttttgccatgttgcccaggctggtcttgaactcctgggctcatgccatccacccacctcagcctcccaaagtgctgggattacaggtgtgagccactgtgcctggtctcctctaactattaaaatagctttcccaaaaatgcaaagatatagacacaactacttttgtaactggaaatttaaataggtaaaccttagattattcataaacataattttagtaaacttaaatttaagatttccaaaagtaacggaacagggattcattttcgtcattttagcaaacagctcttcaagaatattctttggtataagtttacattctgatttaagaaaatcacatttatttgttgtttcttgttccattttaatcctttttctccaaactccaagaatcaaaagcacttttttttagggtccgggggtgcaggtgtggggttgtgggctatatctatattttaacttttattttaggttcagggatacatatgcaggttttttatacaggtaaactcatggattggggggctgttgtacagattatttcgtcacccaggtactaagcctagtacccaatagttattttttctgctcctctccctcctccgaacctccaccctcaagaaggccctagcatctgttgttcctttctttgtgtccatgatttctcatcatttagctctcacttataagtgagaacatgtggtatttggttttctgttcctgcattagtctaaggataatggcttccagctctatcaatgttcctgctaaagacacgatttaaattttttctggctgcatagtattccatggtgtatatgtaccacattttctttatccaatccaccatcgatgggtatttaggtcgattgtatgactttgctattgtgaattgcaaaagcagttattcagcttccataattcatacctacatttcccaaatgactgtgtgataaatacatgtgtatatgactatttaataaaaacattaataaatacaaataaaatcatgtattctggagataacctaacaaattgtcactgtgtatagggcaagggatacataagaaatccctacaccttccactcaattttgcgtgaacctgaaactgctctaaaaaaaaaaaaaaaaaaaagcctatcttttttaaatgtccttttgtactctgttatcttcaacaataaaaggaaaaaaatatataaagacatgagggacactaaaagagctctcaatcctttggggaatctttaacaaagcaataatatttacaaagtggctatttcccagaatgacatcgaaatttcacatatacgcgtgcacacacgcaatgcattcgcacacaaatagataattgtggatttttattaagtttaacatacctaaagatgctgccttatttactcaatttaacaataataagtcaccacactttggaagcaatatactctcaggagaagtccacagaaagaacactgctccaggattcaggagacttaagtcccagtcccagctttgccattcactccattactcagctttctaaaggagttggatcatcaagatcttttttacctcttttgttctatggctttaaaacaataatggtggtagtgataagacattgacttacgattttattatgttttagttattggataccataaagtacccagatttgaacacattcaaacaccacagcgttacataacacactttttatagctcactgcttggggaaataaataacaggaaattaataacaatatttaaattaaaggctatgccagaaatctctaagaacactaaatcagatccaactttaggcagtaataattaatatccactaataattaaatagatgatgtctagtttcagttccaggtgtccaagtttcccttccttgtctcattaagaattacaatttactgcactgcagataaacctttaggcaaagcatatttcatctgtttgcttaatggactggtgtcttcttaaaattcagagttctagacttaatattggttgtgagataatttatggttgatttcaacattttctatctcattggaaaaatttccaggcttatttcaaagcttgaaaccttaccaactttcatttgcctgaatgaaaacataacaaaccacattctagaatctagcaaagaaagtatagatggtggctaatagagtataagttcatgagagagaaaaaataatctaactataaataaatgctctacaccataaaacactatcaaatggtaacaattatgttatttcagaaatagtgtttatgtacagaaattctaatttctgatagcaagatagtaaggcaaaatcagaaaaacctgcccctgattgtccaataaaaagtagagtacaacttgttagatttcatagcacattgttgacaatagtcacctcatttcaccagaatggctttctctcccttggatctaatagcaagggaaagaatgctgagtttcatgcctaggccagtactatccaacagtaatataatgcaaaccccacgtaagtattttaaaacatttctagtactcatttttaaacaagcacaatatacaggtgaaagtgtatattctatttatatagagtatatatttatatacagtattctatttatatatagtatatatttaatgacttgttctatttaacataatgtatcccaaattagtagtgaatatagaaattattgcaatatcatacattcattttcttcatgctaagtcttcaaaacacactgtgtattttgcaatcacagtatatctcagttcaactagccactttcaagtgctcaaaagccacatgttgctagtggctaccatattatacagcacagacctaggtggttggacatcttgacagacacatttctccaaacagcacccgaccatctattatacaaagcaacaatgatcttgaagactttgttaatactgataacaacaaggtacaggtaatcaaagaccacgtacattctgaaaaatacgcaccaaataaggtgcaagcaaaaattatatcctaaacctactgcctgcctgccttcattccttccatcctaaccttgatctttccttccaccaataccctggtcttgataccacgccaaggaacacaactatgaacaaggcggtatggctagtgtcctcgtgaaattgaccctcttgtcagaaagaaactaaataaataatgccacaatcagttattataattacaaatatgagaagtgttctgaaggagtcctggctgctatggaggataaacctcaccaaaccctagggcgtcaaaaatggctccctcaggatagaacattgaagatgagtgtaaagaaaaagaaggaattagctagaggaagtgagtacgtgtcagaaaaaatgaggagtaaaaaataataacactccacacaaggacagaagtaaaagaaaaggttcaaagtcagaaacgactttttggtgaatttttttggtgaatttaaacaactgaaagtgtggagttcagagaccaagagtctggacagtggcccaaagaggagttcagatcattcagaatgttacagagcaaggcggaagaagcagtgtgaaagcaagggtcatttgggaaattctgaatggaaaaagtcagacacataggacatatagggagtgttatgtagactagcataacactttttttttttttcttttttgagatggagtctcgctctgtcacccaagctggagtgcagtgctgcgatctcagcccactgcaacctccaccttccgggttcaagccattctcctgcctcagcctcctgagtagctgggactacaggcatgtgccaacacgcccagctaattttttgtatttttcgtagagaagtggtttccccgtgttagccaggatggtctcgatctcgaccacgtgatccactcacctcagactctcaaagtactgggattacaggtgtgagccaccgcgcccggcctagcataacactttttattgagcttgtacatcaatcaaatgctatgctatagtccatctacactcaggctgatcaccctgtacccattttgccaatggtgtagaacttcaaatatatagccataaaacctaaacaccattgcacaaatgtagcctttgattttatctacctttgtcctagaataatggcctttcttcgcttaccaattcttagtgtggtcttctctattacctatagcaataaaaaaaaaatacgttggtataaaaaacaaagtcagtcacacaaaacagctggtttacccaagcaataacatgttttttccttcctttgctataatatagagcaagtaatcaaacaaaagagattggttctaaataaattaaaattgtgtgacagtcataattcataattatataaggtatattcatcatttccctttaataagttgtattaccccaaaatatataattattaaatttgaatgtaaattaccctgtaaaatgaatgcctatatttaaaacttttcacttttatgaggagtaatggcaagtcattgaaaagttttaagcataagaatgatatctaatctgtattttaaaagctcagtagagactgataacgagagaacagataggaggatgagcagggagacaagtgagaaagtaacaacacggccagtcaagagatgccagtgactagtttgtgaagatgtaaaattgtcttgacttagttattaattgcatgtgggcagaaagggaaatgtgtgggagcacagtaaaaatagaaagtggaagtatgtaatcatggcacagacagaatttccttagaagacagcaaagtagatccttcactgatctatttcccccaaactaacatatacaccccagcatggcatggaagacaaaacccagagtttatacttttctgagctaatgaacatacttctctccttgtgagctttattgactactgagctcagcatgcctctgtgagatattatggagccaatggggaggctgcacatgctataataaagtccattgtatccttgctgttgtgtgtaccctttataatattcatgtgctggtgtgacagtaaatcagagggggaaaaggcagtcaaggtggtcttaaataaaacaagttattctcataagtctttgaacccagataaacctttgaggtcagaactcccttaaaatgacatggttccaaggattctgatttaaaaaaaaaaaaatctgattaaaaaaaaaaaacctattgctataagtaatagagaagaccacactaataattggaaaagaaagaaaggacattattcttggacaaaggtagatgaaatcaaaggctaaatttgtgcaaaggtgtttaggttttatggctatatatttgaggttctacaccattggcaaagtgggtacatgcttgtttaaacatgataaccacattatttgaggagggaaatattagaagaggaacagatttagaaagaaacctacaaattaggtttaggatattttcagttggaggcaccaagtggaagtcggatttacaggtttagaactcaggagagaggtcttgcctgaagatataaatgtggcagtgttgatgttttgataaataaagccatgaaagtacaatgtgagtgtttaagatccaggactcagccttggatctctaaagatggaacagaagagtataaactgcttaaagagactaaggagaaaccagaaaaatgggagtaaagactgtttcaaaaacaggaattaaccagcaatgttgagtgctatcaagaagtcacataaatgagggctgaaaagtatccattagatttggtaaattagacatcattagtaatggtggcaagaacaggattgttagtgttagtgttgagtgtaaatgccagattagaaaaagatgaggtagaagtgagaggtaaagaaaagccaacagtgaatatacagaatttgttaaaaggttaaaaatcaaaaagaagaaatgtaggcactctttcagtcctgaaaaaggattggggactattgatattttataaagacttaagcatattaaattgaaaacagcaagaagctagagaagaggggatgaaaggtgatgtatcttccctacgaaggtgagagaggatgagatttagaacacaggagattggtcttagctggaagaaataacatcttcattctaacagaaggaaagaaggatagaacagatgttaatttgcttattcagatgcaaaagtgttgaggagctcccaaatgtgatgacttctctttataacaggtaattctcactcaagatttttaatacatatatgaaaattcttaaagagaaaaaaatacttatacacatacacacgcacatatacaatctctctaagactacactgaatatctgctgaggatgacttttttcctgagccaccacaggtttcccactttcaggctccgggggtgacattcactgatgtttgcatgagtgacacatcccaagaattgtacaggcaccatctgcacagatacactggatggtcagttacctctgtattccttaggtagagagagggtgaaaagtgactgttatgagggtcaggagaacttgcctcaattcttaactctgtcactctcatttgggtgacatctgtttctacaaagtcctcatgtatatacagtagcaacagataggtaaataagtagatatacagatatatagatagatttgagggaaaagggagatgacctggcttttcaggaagcaggtacatagactcggttatgaaattgcttgtcatatttgaatgaatttcagtgtgtctgtggcagtgcctaccatgtcctgagcactttgtgctgaggctctacgtgaagtaccaagtatctcttaatgtggagttctgttagtatttatttatatataaaaataataatatgttacaacatatcctaaatttatgtagattttttctaatttaaatgaaattttaacatatatatgttgtttgttccacagcacacacttttaaggtaggtagtattcaaactcagccctaatatttgtagggcttaaagcaagagaacaaatggagactcccatatcatatgtttaatatttaaatttataaatcaaggtaactgtcaaatattggatatttagttctgctacttgaaaattatgttttcctaattcaaacagatctcctgggctcctcagatctgatctttcacaaaacaaagcaggactgagagaattcaccccccccagctcatagttcagacctcttctcttcccactctgggctccagccaactgacactgccagggacccatagggattcacatataaaccatagtttatatgtccaagcaacatccacctccgtctaacagccttggtgaaccttcaggccaggggcgaatactctctgccatgcaatttgcccttggaagtacagccaaggaagacgagcacacagctcctggaagcaacctcagtaatgtctgggtaggaacttctgggatgccagagtgtggtacagaatagggaagcccaggctccaggtaaacatgcccccttattcccgtggactccttgccaccacagacgtggacatgcctggaggaaggcctgagtagagtccaggacaaaggcccctacctaagaattaaagcaatcattagtattctcattaaactattttaacatgaaggtaactggggctcagaaaggttaagcaactgttacttagcccaattgctagaatatggtaagttttcaatatggggtgaataaacgaggaataaatgacacacatctaattagtgacattgtctccaacatgaacacagtcttctctttctctctccagagctaattccacagttccacgctgacttcaatacatactgctatgctagtttttcatggtcttgaactctcttcttgatagctcattcactcatacatttatatctatgttggtgtgtaattatacatgtgtatgcacacatacacacactgtatgctagctgcagcttatcttgggaacaaatcttaaatatggcttgcagaaattattaagtctcatttcattatttgatttcccctacacaaatttcatctgtcataagttctggctgatttatgactcaggaatgcaatacttataaacctcaccatccaaaacagcattcaaattccatcaaaaattacttttctcactttaaaaaaaagtattataatttaaagttctgtctcccagctggaatccagaagaataaatatgagtatgaaagttaaaggaaggctctgataaaataattagagtaatttatataatatttatttttctatttttccttctacatacaaggcaatgcatgaatagaaacagagacgtgtctgaagaacacaaattgaaaatgatgaattgagtaggtgaagaaatcaaactatttctgacctacctaataaaaaggcaattgggagaggtaacctctggtaatataaagaacactggaattagagtcaaaagctggggaggcaaaaaagaaactaaaattcattgaacacttacaatgtttcaggtacagggctagtgcctttatatactttattgttaaaagtgtcaaaccttcgataaggttgacattcacctgtctgttgcttccttacctagaatatgaatatctctatacattgtacaatataaataacagtaatatgaacaaaaaaaggggcaattgctagcatggctgtgcactgtatttgagaaagaatatagagaaataaccatggtattcctgtctcactgcactgcaaatcctgggatcgtaatcagatcccgttactatcagtgaatcacaatgttccctggcatgcctgcatctgggaacaccctactgaggagctggttaatattctattatatctcacaggaagaattcaaatgacacctccttgttggcccttttatgatttcacagaatagatgtgacaaggggctattcggaagctcaaaattttaaggtttagataaaccaaaagtatatctagccatctagttatagaatagacatccaaacctgtcttctattttttaagttgggagaaagaaaatagcgtattaataaaataactcaaaaagccaggtatgcttcaataatttttagtaaatgtctaaaaatgatttctttttattactaatttcattctttcaataaagtagtatagttattttcagtaaaacaataacaaaacagtttggatgcggtggctaaggcctgtaatcccagcactttaggaggctgaggccagaagatgcttgagcccaggagttgaagatcagcctgggcaatatggcaaaaccccatctctacaaaaaaaatacaaaaaaaaaatacacacacacacaatatatatatatatataaattatctggttgtggtggtgtgtgcctgtggtcccagctactcagaagactgatgtgggagcatcacctgagccaaggaggttgacgctgcggtgaggtgtgatcatgccactgcactccagcctgggtgacacagtgagacactgtctccaaaaaataaaaagtaacaagatagaaatgtcatgactttgaagtttgattatagccactcttagttattttatataattgaacatacataaggccggaggggtgtctcacacctgaatcccaacactctgggaggtcaaggtaggaggattgctagagaccaagagttcaagaccagtataggcaacataaagacacccccatctgtacagaaaattaaaccaaatagccaggcatggtggcatgtgcctgtagtcccagatacttgggaggttgaggcaggaggatcacttgagccctggaggtcaaggctgaagtgagctgcgatcggactgttgttgcacaccagcctgggcaacaaagcaagaccctatctaaaaaaataacaataatacataaaacataagtgtctataaaaataagcaaagacaaagacaatccaaatcgttataatacaatgtaatatcagctacagtaaatgagtcattatattgaaggtatcataatttatattgcattttatttaaaatttctgaagttatagaggttgacatatgttaggtgctttttatttattttttgtctacagaaatataattatttgctagatattttctcagatgttgtagagatcacaattagaaatcatatatgtatcatgccctaaaagaattcagactattaagaaagatatataacttataatcacataaattcaatacagtaatacatggaataaaagttgaagatagaatatagaaggtaaaattaaaatttaaaaattaatgtcattttcttaaaattaaagtcatcataaattatattttaaaaacatttcacatttttgaaagcaacttgctatatgatgccagactgtggaattctataaataagtattcaagtttgaaaaatatattttaaaacatattcaattttaaaaaaaaatgaaacatatggaaaagaagaataacaaaataagcaaaaactttcactatgtcttatgaaatataaagtggtgccaaaattttgtcacttatttcctgatactgatgcctgtgataccaaattactgaaaaaaagaagccaaaaaataaaaaggaaactaaggtaaccaagaaaaaataaaaggatactcttacaacgaaacataattaatggctaaccaatgtgaaaagacttaaattaatacatggccgggcgcggtggctcacgcctgtaatcccagcactttgggaggccgaggcaggcggatcaccagatgtcaggagttccagaccagcctgggcaacatggcgaaaccccatctctactaaaaatacaaaaattagccaggcatggtggcacatgcctatagtcccagctactcaggagtctgaggcaggagaatcacacgaacctaggagttggaggttgcagtgagcagagaagatggcaccaccacactccagcctggctacagagtgagactccatctcaaacaacgacaatacatattccgcaatcttcccctgaggtctgggacaatctagatcaaacacttcctcaaggggaaagttgggaacagcatacgtgcattttaacgctatcctttcagcatgagcatttccatttgtctattccagattttaaaacagaaactaaacattcctaatctttaatgtttgatctagcaaaataaaaagaagcaaaaagcaaacaaaaatttagatcaactcaactttattttgattctacttaaaattattttaaaatctttatttgatacaaaacgctaataaaaaggcattctcttatgagttattaagtattagacccacttttcaaaatgtataatttctacaagagttgattaatcagaagtgtccaatataaactacagttagactagatgatggcacaaaaagtcaattcgaggaacaaatggtgaaataaatattatatgtctgactaagaccatcatccataatatctggacaacaaaaagaacttcctttacttaactatcatgctctaagtttctcttttcaattttaaaatgtttaatctaaaccaagaatggcactatggtaacccaggtatataaagaaaaagctgtcctgtaggctgactcatagtcgctgacttagttcacttagtttatgaaaaacattcaaatgtccatgggttttccttccttagaacatacaaaatggctgcttagattctagcacactatgtgaaaaatatcaaaatggagggatgtgggaaagcccttttgtgtcatatatttctgagtttcagtaactgctgagacatgcagccatacagtttcccatctctattcatttatttgttgatgtgtttaccgcctacacttactgcctattgaaattcttctcatcttctccggcctggctcaaatgccatactcagagtgtgggggctgtggatacagctaagagagaggatggagagattgaaagagataagatctcaccaaagtacagtcattttaaagccatttaaaggtgctcttgtaaggaactgggaacctttgcaaaggtttctataggaaagtaatgtgacattaaatatgttttgaaaaattatgtgtgaagaataatcagggattcaagaaaagggaggttgaaacaccaggtaggagattctacaacatttcaggttggaacaacaagccccttaattatggcagaagggatgaagaaaaggttatatgaaacagaagctgatagctatgtgatgaccatgaccatgctaattcatcttactgtcccttatagttcccagaaagtcctcagttagtacctgatgaataaacaatagagtaaaacgttacagagatacagtcaacgaggcgtgtgactgatatgaagagatgagtcaaagataagtggggtccccaacgtggcaaacaagatggtcagtatcagaaaactaccaatatttgctaagtgtctactaggtatcattagtagtgctgttgactaaaggggaaactcaagacacaaagcagattgggttctggaggaagataatacattcaaattaaggcaaattgcatttgcgttcccagtggaacaactaccaggaggtatctagcacgtagttgaaaatttggatgaggagctcagatgttaatctgtggctcaaaaatatagaggagacaagtgaagtcaataaaaatgagtttatccaaggagaaaccatagccgagcaaagagaaaagcatgagccgaaggaggacaaaaagatgcaccgcttggggattagcaaaatgtatatctcttcattatgatagttttcagactgtaacagtgaaattgtggacaacaatatgctcagaactcttaaaattaaacacaggaatgcctttgagcatatagtttacatgctgtgaaatctacctgcaaaagtgcctgaatcagttcagatgacgtctagaccaactggtgatttaatttagaatgcaagcaaaaatctcttatgaaaatcctaagagtttggttaacgttaaaaaataataaaatccctactgtgaaattatgaagttcttttctcaaagcacattataaacagcagttgcaaggattattaaccaaatattactgtgcagagggataaagtgatctcgtaaaggcctcacagaaattctaatctggactgaaggtattttactctgggtttatcagaccaaatctggattattatatttgattccaagcaacaccctctacaatgatattgataaactggaggtgaacaaatctcctatatgaaatacagtttcataataggtgctgtaaatccttcatctcaaataaattctttccatatttaggataggtaagtttggtgtcctgattttcagataagaaaagtgaggattagaaaaattcaatacctgaccatgtttctctgacatgtcagtttttcaatattacttctatagatgagcttaaagccaccttgtatcaggaagaactaagaaactaagtgagacttagattggagacggtaagacacagattgaggagtgggagagaggctgtattgcataagcaaagatttatgtttactaaagccttgctactcaatgtgtggtcaccaggccagcagcaatggtatcacctgggagagaattccaaagccactcccgacttgctgaatcagaatctgcatttcacaagtttgagaagtgctgatctgaggaactattatagagagaagggattacagattttttcctatgtttctatttttgtttctcagaagacttgaattaagaagcttccaaaagacagactttgaattaatattggggaaacatcattttataatcagagttgacaacatatgtcatccactgaagatcataagattcaagtagaaagctgaactaaggctgtgagcagtggctcacgcctgtaatcccagcactttgggaggccaaggtgggctgatccctgaggtcgggagttcgagaccagcctgaccaacatggagaaaccccgtctctactaaaaataaaaaataaataaataaataaataaataaataaataaagctgggcatggtggcgcatgcctgtaatcccagctactggggaggctgaggcaggagaatcgtttgaactcaggaggtggaggttgcagtgaaccaagattgcgccattgcactccagcctgggcaacaaaagtgaaactccgagagagagagagagagagagagagagagagagagagagagaggaagggagggagggagggagggaagaaaggaagaaaggaagatgaactacacatgtaatttttggtgttctgtatctcctctaacccacgacctttttaagataaaggcctttgtttttttctctattgacccatacttcagttctagacagattataagtagacaatggatgtctgtcaaataattgaagatgtaaatgaatgtacagtggtgttggagtcagtgggttcaaatatgaaggtaaatgacctttaaagttttctacaatatgaagactctgtgattacaatgttaatggggtataggtttgctttttaattctacctatatgcaggatagagcagaatcaaaaactttcacccaacaaactcaaatttcccgaaggttcatagtgtatgtgaagatggctctatttatgagtattcatagaacattgctgaggtctttcactctccctctccaccaggagtaataatttgcattcaccttgttttgttaggcctatgtcattggtaaggtgactcatccaacaaatatattttatgtgacatctacgtgtcaagcaatatgctaggctttgttctttaccgtgttctacgtaagggactaacctcaagaaatgactttattagcaccctgttctaatcaaacagtaaactagccagtgattcagtagaatcctacattgactctcaactcacttgtaaatagggagaaataatcctataggagccctccaaattgtttttgtaaaagtttcctcatgtttgacacacaccatgaggtggcctctaactgactgttatgacattttcctcaaaaagaaaaagcccttctcatggttaaaactgattttgtattatacttcaaattcagggagtaggccaagcttatttttggtgaagtaacatgaccaatggcacaaaagataaaactgaattttcctgtgtatactgtaatcatactgcacagataaagaaaatgggaaaaaaaagaaaaaggtcaaataccaatcacacctatggaaatagataatgtggataatatacatgaataaaattcacagaaactcttaagatatcattttaggatatattttaatcatatccttccttaccaagtcttctactattatcactaatgagcataaattaatttcacaaactgtccataatattaaacgtgatgattctaagagaatgtcaaggctgatatttagtaaacattgttttaaaaaaaaatttcataattgatgaagtcctggtggaaaacatatctaaaaggtatatcccaagtctgggaaatctaaaaacttgataattaaggcatgacttgcctctccacatccattccaatcagttcctatggcatcctatactttactacatttctattgcttaaaactgtcctgcagtatgacattacacattaacctacccagaaataagtctccagctttcactcaaaatcatgtggttcctttcctgtctgttttttaaaaattgttttattatcttcgagactacactagtaaataaacgtattttctattaaaacaaatactagttccactatattattaagttcttccggggctgaggtccaaacttatgtaatggtctaccttgaaggcctgtcaaaatgctagaaacaaggaaaatttagaaatacagtcaatttgtgtccagttgaatgaatctaagaacaaataaagaatatacaacagagaagctaataaaaatatatttgttaaatttgtgatattccatttaatatacatgtcaaaccttctagaacttcatatcaaacatatcattaagccattttcttatatctgacatacagatatcttggaatacatacacctgtcctccatgagtattagcaccataaatatacatcaagaataataaagctgaaaggaatttcggaaatcattgatagtaaccctttcatgctgaaaataaggaaactaagctgaagagaagaaaaatgacttccccaaggtcaccaggactctgactcctagtccagtattttttctatcacatcattttaccttagactgaatcaaaaacctcttttatttatatcttccttttaaaaaggttgggtttcaaaccaagcaaaagaataaatacagagaactgtagcatacacagaagacttatttaatgctgctatcaataactttaaaagtaagagaaaagaagaaaaacaaatgaggtaatcaagagttgacagaaagaaccttttccattaaacccaatcgatactgtatttccccatcacttagcgcttcaccagagaaagtgaacccagagtgaatatgttccctcaagggtatttaacactaagatgacttgttggtctcagctgtaaatataaggaccagacatgactaaatctgaaatcaatggcaaaggttattcctcattaacctaacgttaagaaacctaaaccagtcaaaatagaaatgggcccttttccatattggctgcaccacccactccctctaggtttctggggcaaagacataaatgaatataaagatgctccttctttcagcattcccatagaaactgccccctgcatcagtgggtgctctgataagaaagaggtaaagtttgaaggtgttaggcaaagtaaatactaagtataagaagggatggccattaggagttgggttggggaataagtaaagacatgaagttctaagtatttatcaaacaactacatatcaaattaaactggagtaacaatatttttggaatttaatatcaaatgaagagatatttgtattagccaaaaatactgatttattttctttcccaacattttcatatatatgcagaaattccctcagagcctgactatactgatgccataagcacattagtcaccaatggaattaatttcgttttgatgaattatttctgatcacctagtatgtagaaagcattgaaatgacagggcgcttgccctccaggaactcactctccagcggcagagacaaacaggtacttatagagtaattataagacaagacagactaaccgcagacaacagtgcagggtataaagcctggggcaggcagtgattcattctacctggaaggatctgagaagatctggcagaagagatgggagttgagctgggctttgaataatgggcaggactgcagcagagtggataaatgaagggttgtctctgggtaagtgaaggataggtgtggaggttaatggcatccctcgtggagaaataaaaacatctataaactaaaagaactgaaatggatagatgcagtaaatgttctatgaatgtcaagaaggtttgggtcggctagagtagtatgtggggaagggtggagaaagaaccttgattgtggagcctattcatattgatgatacaataataaactgtctgctcttaaccacgtattgagcccacacgtgtatttttaaaagacagattgtggctaagttttttaaattaagaaattactgtttttcttgaaatatagacattaaaggagaaacagtccaaaataatacagcaaaactataacttggaacacagtaacacaaatccagcaagagttaataaatcttaattatatactgccttacacaaaagaaggcaaggattttctcagtatttctatattccattcccaagcacatgatatacaaatactcaatgggtgtctagcaatataacttgactgtagatatttaaacgcatctacccaacatttatattgctccagacacagaacaggcagatagctcttgctaccagcattgggcaatgggccctaaaaggaggcagctgtggtgtagcagtaaggcataggcttatcgcaaatttcagtccttgctctgcctttcatagttgtatgacctaacacccactatgagtcttatttctttcttccatgaggtgggcaggtgtattgtaatgagctctgttttccaattcaaacccaccaacacttttcatatataccttaccaggtggacatctcaaggctaatgtcacagttagtcaaccccaagtgcaagatatataatggcctgggacgaaagtcttaatcaaggtgccagttcaaccagactttgaattcaaataatgaacccagctgcataaagcttgctgctcttcagccctaacaggtgtctgcataatcacaaagaaaaccagcttcagactgaatgtaattgctgagcatgaaaaagacaacaggcaggccagcagtttcagtgaaaataacaagagtcaggaccaaggaacctccatcttcaccagatcaaaacttaccctgaaggggcaggctcccaaccaagatggtagttccattagcaaaattataatgaatggaactctaaatcataaagccatgtggtaacccagaaaatgcactcgggaacatttcaaagaagggagttttgtggcaataccaggaaaagcataatttcaaagcaagtttccttcttggtcctgcttttctcatgacctgtaggtggagagggaggagtagatagaatgcctgggaaaccagagctgcagaatgtggaggcggcctggccacaatgctgccaactcctttcctgagcaaagctgcagaggataatggcccagggattgtcagggaaagacaggtgaggcaaggaggcaatgaggaatcctctctactttcccgaaaagaaaatagatctccagtttctcagagaaatatcctataagaagactacagaggatgtctgggtttctatcattgtgacttcctttcctagaattctgagcttctgaactatcacctcatatgccatctcttcttctcctagctagagtcgagttgcaaaaacccactgcaatatcctttgaagcaacaaagcatgacagcaacacatacatgactcgctcctcagtgagaaacttgggtttccatagaatttgagatcctctatatgttccatcattttctattaattactcagatatgaatgaaccttttctgttgcggcctctgtgggtgactctgggtgactttcctttctcaaatgtaatattgtatgtagaaggtatattgtgtagacagctagagctatttggctgaaaacagaacctgacacctattctaaccagaaaatttgaatatagatccctactttgggcacttatttaaattctgcccctgtttcttaatgatttttaatgcattatctgattctaggacactgtgaaggtgatctgggtcatcttttgagttcccaaattaatatacaacatttaaatcaccagtgcaatttaaaaaaaaactctttatgaactttttagtctattttatctttataataacttatacaacttatccgggtttatagttcttctttcatgaatttcactcttcccttcaaaccccctttaaaaaaaaatctaaaacactgcacacagcacactgatttaatttctaatccttgaagagacaaaataagcctaaattggtgtcaagagaaagactgacattttagacagatttctttattagtgccttgcaagtaattaaaccatgggatgcagttaggaacatccaaaacagcacactaagaaaatagttttgtccttcaagtaagaagcagggaaaagatctgtgtttcatgttcccagtcacaaatgtttttcctggggtgaggggagctacagttaatagcttttcaggctaaagaggcccttatattttcttttttctttttttttttttttctgagacagagtcttgctttgtcacccagactggagtgcagtggtgtgatcttggcacactgcaacctacacctcccaggtaggtgattttcctgccccagcctcccaagtagctgggattacaggcatgcaccaccacgcccgactaattttgtattttagtaaagacagggtttcaccatgttgaccagactggtctcgaactcctaacctcaagtgatctgcccgcctcagcttcccaaagtgctggaattacaggtgtgagccagctcttatatattcttatatatagctcccttgtttttcaaagacagaaactgaggtccatttccaggactggcagagtagaaagaaaagtagattaggaaaaacaaacctgagtctaaatccagaatctaaccagtcctgtgaaactgagaagccccaggctttgcaggacctcagcatccttaggtgggaaggagagatgctaccttcagaatccttcttcctctgaggcttgctcagtgagtcaggatgtcatttcctcattgatttaacagcaactgaagaactgcagtgacacaggcagtatactaagttctgagaaatctagtgctgaccaggtcctgtgcttaggaactgaagttttcatcaagaagacgaggcatgcaagcattccatatgatgatgcagctcagttttgggatatcattaaacacaggaaagattcaaatataagcaaaaaaaaaaaaagtggtgccttggacagaacgtttatgtgtccctccccctgcccaatgttgaaatcctaacctccaagatgatgttaggaagtggaagactttgagaagtgattaggtcatgaagcctctctcctcatgaatgggattagtggtcttacaaaagagaccccagggagctcccttgccccttctgccatttgaaaaagcagcaaagactgccatctatgacttaggaagcaggccctcacagacaccgaatcttccggcaccttgatcttgggaatgccagcctctcgaactgtgaaaaatacatttctgttgtttaagccacctgtgcatggtattttatcataacaaccagaatgggctgagacagaagagatcatcattataaattatattagtgtataaaatttctaggcataatggatgtgttcctaaagacattaacaaaatcattaattttgtttaagggccacaatttatgaaataaaggaattggaacaggttggggactctcaatatatgatgcatattagcatagactttctaggtgtttggcattagtacgtttaaaaactctcaggtgatttcattttgcagctagggctgagaaccagtggcttatataagctctaagtgctaacattttgtgattcagcatacagatcctatttgacccatgtcattctttacttctagggaaccaagtttggtcttaggccttagggccctctctactgactcctgaaaagtaacgaagaaaagactctatagagtacagtcatccctccctatgttcagggtgaggagtggtggttacaagaccgccaccctcaggatacccaaccggaggatcctcaagtcctttacataaaatggcatagtatttgcatagcatggttgtactatggttttcttcttgaatatttccatccatggttggtgaatcttcaaatgcaaaaccatcagtccaagtttcaattatgaggcattaacataagtgtggttacaagcatggagtctgggaggcctataaatactacaaacgaatcaaataactaacaataggcagaaaaatagaactttataaaatttgtgtttgtaaaatcacttgacgattcgaaggccaatgagtgtttcttgagagttcaagaataaagtaaacagccttatatatatgggtattgtaaaaccattaaacaataaataaaacccaatcttccaccttcacattcttttctttttttttttttttttgagactgagtctcgccatgtggcccgggctggagtgcaatgacacgaccttggctcattgcaacttccgcctcccgggttcaaatgattctcctgcctcagcctcctaagtagctgggattacaggcacccaccaccacactgagctaatttttgtatttttaatagagatggggtttcaccatgttggccaggctggtctcgaactcctgacgttgtgatccacctgcctcagccttccaaaatgctgggattatgggtgtgaaccaccgcaccccgtccccaccttcacattctatagtgttttgtagttgggtaattacattatttgacctctatcaaccctgctccttcaccagcattcctccatctccacaaacatgcaattcactatggaatagttcagccagggattatccaggcaccttcgactctccactcatagtctacctcttatgaagttctgctcattctacctttacccactctttttatatccatggccatcaacttcatttcaacatcatctatagcctagaccagtggttctcaaactttttgttttcaggatcctttacactcctagaaagtattgagtaccccgaagagctttgtgcttatgtagtttatatctctcaatatttactgtatttagaagttacaatgaaatttttcaaataattatttgtttattaaaacaataataagccccactgtgttaacataaatagcatgatttaataaaacttatctttattttccaaaacaaacaaaaaggaattaatgaaaagactggtttgtaaatctttttaatgtctagcttaatagaagtcagcttgttctcaagtctgcttctgcattcaatctcttttgatatcttattgtggatgaagtacatgaggataacctggcctcacaaagaaacgtggttgaaaagggaggaaatttttagtaccttttacagatgattgtggatatatcacacagtctctggaaaattccactggacacttgtgacagaatgagtgaaaatggcaaataactagtggtattaggaaatattttttatgaaaatcgttttgaccttctggatccactaaaagattttcaggaagcttctagggcctctgtactgtatggtactttgagaactgctggtccagactgatgccctagcctccttactgttcccttgcttctactctgcttccattgctatccattctcttctccaaaggcaaagtgcccaattaaaaatacaagtcgcatgatatcaccccatactgctgatctttctttggaccctagattaaaatacaaaattcatcttaggcttctcaaggccctgcggttcttgccaaactttccaacatcatctgtacccctctccccttgttcttattgcttcagctatacttcaatttcttcagaagcaccgagctccctctcacatcaatcttcatgcaagttgttctcttctgccttgaaggttcttccattcctgtctgcctgtttcatcttttggagctcagcttaaatgatttttcctcaaagaagcatttcttgaccaaaagctagaggtaatatcttcattttacaaatcagcaaactgaggtgcaaagatattaagaaacttgcctaatgttcttacaaataataagaccataatttgaattcacatcccactccgaagtccaggtacttaatcattctgctatgctatcacttaagttaaacaaacaaacaaaaagattaaatcttacagagctctctttaacttggtgttaacctctttactatccaaaacatctgaagcaatcatttatgtttatggttaagagagtctggccctctgggcccaagtctcccagtgggtccttaggtatcccatgtggcaccccttcatatcatcaaggctcccggcattcaggcaggaacatccgagccaggagcctaagcccagcacataacaacatagccatgggactgcttcttcagtcctgccctgaagatctccatcagctttccacttctctcctccactctggggactctagaccacacacacagcaaaacaaaccatgtaatcacgttccacatttcttgaacttttcatcagattccctccaacaatagtttcccagcttcctaaccctcagtgtggtgggagataaaagcagattatctgcagtgtggaactgggagccatgtgacacttactcatcttctgattccatgaatctgaacaagtctcattgccacttgaggcttagttttcttttttctaagatggggctatctcagcagactgctataaaaagtaaaagaagcaaaaattataaagaaattctataaatcctgaagtcaagttattattattaaaatttattattatagatgattaatttataggcattttgcatctaagccttctcccactcacagatgcttaggaggtagtcttggaatcacagccctttagatgtggtgcacctttctttagaaaataggaaaagttctgtaattccatgagtaagccagaagataaaattgaaaatatagcatatcaagcgtgtcctctatgtctaacaaggctgttttgtggaatcatcatacaatctataataattctatacatcaaaagcaaatatacatgatgatcatgcattcaaagaagagacaagaaaaaattgatcactattaacatatttccaaagcaaatctacaaaatttccagagcaaatttattctctcaccaagaataaaagcaatgagtttccatatgagtaagcccaggactttttaaaatacaattttatgagacaaagcttacatttctaaagatcttccaaaatattcctattgcttcctcaaatgcagagactgcctcacttcctataaattgtttttctacttctgttcaagaaaaacaaattcattaaaactttaaagacttaatctcgagttacgtcttgatgagatctctgtgggatgaaagaaatcaagagatcacaataactgctattttaaaatgttcctacaatggaaacataatttgttgttgagaatgcactgctgtagagagaaccgaattttaaaaacatgttcaaaatatcagtttaaaccctaaggtgggtttctgaaaagttaggggtcttactgtttttttttttttaacaaaaatcaagccaaatatcatttaattaggctgactttgtagttcagatatgagtcatactttcaaaagagaaaatgtaatcaaagtacttcctataaatgtaaaatatcacctgtcatataaatctattcttgacccatatattggccaaaactatttcaatttataaaaatctaactcatattccataaatcacatgattaaacattatttcacctttactgtcaactttcttcttgaagtttctatttcctacgatattttcttcctctatgcaaaaggatacgttttataataaaaatgttgaatgagtatactgttaaacactgtgcatctaccgaaacaatgtaaaagaatactgaaatattttgaataaccataatttttataacagcagaaacagggactcagaaagataaggtaaatgaaaatcaacaaaatcgggtaaattacaattactactttgatttattttaccatgtagtgtaattctactccattactttttaaagggatcggcgtatgaaatcaaatctttaaattgtaaaaaaattctgaagatctttaggttttaagatagatttttcctgattgattattcttttcatgttctggtttgaggtaagaaactaagttatatagaaatataataaaaacacccacatcacttaaaatacctagatttaggcttaatcaattgctttgctctttccagagagggtctcatttgaaaaatgaaagagtaatattgatgacctccaaggttcgtggccactcagacattcagagattctacaaacacctttccctccttgattatgagtgttaccctttgtctgtaataacttccgagtcaaaacatacatcattttgtagtcaatcatttgtactattgtttctactcaaaataaagctaaaggttggacatgaataagcgtgtaattcatacggatgtactaatagtctagatacaacaaattaagtggcatcaacatttaggcaaatattctagtgtgcctgactaatacagccttttcacacataaataatgactcaaataatgactataagtacactcttttctcattagaaagtgcacaaacagaaatgttctaaaggctttttcatggttcaatgacctcatccaactttccagttcagggtctccaatatttcattttcaaagatctacagtccacacagtgtctaaggggcccattaaccctagctgcctataggtcttcaataatgctatacggtggtcattgctgaagtccaatggcctccttagcctatgccttcttctacaagttacctcttctactctaccctatctctgttctaattataaaataacgatcacaatgataataataataccaatggttaaaactttgacagaagacatccagttatttacactagttgatgttactttctgctgtgttgcaaggaaggtaggaaaaaaagtcaactgaatctagttctagtctcaattttgacaaaacctagttgtgtaaccttagataaattacaaacttgcaatggctccaggatttctcatctacaaagacagagattttgctgcacaaaaaggatccaatgtgcaccctggccctgaaactgtgtgatgtgaggccatacctagtcatttcccatgttttcattctgtgttactgtcattttaaatctgagccctttgccatgataatttcaggatccccactgtatttatacagcttcaatactacacatatcagaacttggttagctaagaaaaaagagaaggagagatactcaatgtgtcagccctgaaatcagaaatacaaccgtggcctttcccatcaaacacttgccttagattcacttcctaagcctcactcccctagaaagtctggtcaatggaacatgtgtctcagtgacagaaattcagagtggaaattctttatcaggacaaattattccacttcaccactttaccatttgtgagttactttgttagttcacaatgatatggcttaggaaggctagtggtttcaagaatcagtcaaatattaagtgaatacaacatcaaagtgattataaaacagattcgaatagtttttctttttggtgtttagcaacttcctcccaatccaactaaagattcttctctggaactgatatgtggaaggtgctatctctctataaatagacttattccatgctatgtgaatcatggctgctgacagcaaatcaacagattaattatttggctttgttagtgaagataatagcacactatcatcttcccaaaatgtttttacacacaccacatgcccattcttctaagctaagcttcagaacaaactgaaatggtatacaaatacacgcaggttgcccttgcactgggaatgtcttaataggtcctgccatctctctgccagattgttattttgacactttagctaaaggaagtcaccagtcaggatcctctctgataagatgaacactgtgtagaacaaaaagggaggcaaattaaacgaacactgaagaaaacaataaactcagaaactgcctcaaatctctgttttctaatgagatgctaaggaagagcccacaggaagcagcaaatacagtccttccttcccatgcaaaatgaagccatgcaaaagtaacccattgatcatctccaagtcaactccagagatcaggatcagtttatgttacccgttcacatatatccacctatcattcttattatcttgttttttagaagaggctgactaggatcaactcaaaaacgtcatataattttcccaactagagtgcaagcacgtacttcagagattgagatataaaagtcacattgagttcagaaccttgaagtcctctgtagaccacataagccctaagaaaagaaggcctccaaattatccctccacaacagaacaggttattttattttccactaggtgagttactttgtagaggtaattcaaactattgcataaatcttcactttataaaatgaacatgctatactaattggacataaaataatagagactaatagctcctgtcttgggatcataattatttttgtatactcctgaaatttaccactttatcatcatcacaaaataagaaaatgagcctagtatggagtggacaatgtcatgaaaacccaacggaaaatgaaacagggtcgcttcttcacaaggcttaaccccaaatttctgagctaattctgagcccgacttgtccagacttcccaagtgtcgcccttcatccaatggacccaaccatgtacttcattgctggaaaccaacagcacgccacagtcagagttgcaaagagacaaactagccaacagattacagggcaggctccctttccagacagtatttccttccagttgtccacaataggggtagagtatctgcagaatgcaaatggctctgcagccacaacccagaaaaccaacagtctgatggaagcacagatctctccgcaattctgcttccattctctcaagctgggtacactggcctggcttgacctggaaatcatcatgtcaaaactttgggtatccaatttccctttgcaagtagagacacatccaaaagcaatcatctgcggtcggggctgcagaagagaattagcttcagaaagcccacgccatgaaaatctctgatcaagctgaagttttctttacactccttgaggccaaactgtgtatactgtcttgttccctcaatgtctcaaaagtgtgagtgtgctaagtatggtaataggacagaaacgttaatgagcagagtccttggaaacaatgagaggggttggaagaaaataataggaaaatgaagactgtgtaaaggaagtgaaagagcatgagggaaaaatgaagaggtgagaaattgacaagggcgtctgaaagatgcaatgccaagtgttgctggaggaagagttggaaaaataataaatttaagttcatctggtgtctactaggtgtctatcatggattatgagggataagggaagggctgtattaatctttaggtcctcagtgggcagcgtaagtactgtactctacagacggatggatgcatggacggatagatgcatggatggatggatgggagagcgggagagagagagaagagatgaatgaatgaattaatgaatgaagtggtcactcccctcaaggactctacaggctcttttggaataagtgcatctatacatgtaattcttctcctggtcaaaccccggactgatcaaagtagagtgtttttgctgaatatggggcaagaagctattaactgacagagtggttgaaagaagtctggaaatgagagaagaggggtcagaatgtaaaagaggaatcctggttcccttccacgggggtcccgaggtgctttgaggagggagaaagagggcgtcccctctggggagcccactctccgggcttctactgacctggtctccgcctcaccggcctcttgcggccgctgcagaagcgcactttgctgaacaccccgaggacgtgcctctcgcacagggagcgcccgtctttgctggggctggagcggcgcttggaggccgacactcggtcgctgttggactccctcgcctgccgcttctgccggatcaaggagctggctatcgccgcagccatagctgctcagcgagggcctcaggccccagcctctactgcgccctccggcttgcgctccgccggggcgagggcaggacctgggcggccagggaaagggcagtcgcggggaggcagtgctaaaatttgaggaggctgcagtatcgaaaacccggcgctcacaaggttagtcaaagtctgggcagtggcgacaaaatgtgtgaaaatccagatgtaaacttccccaacctctggcggccggggggcggggcggggcggtcccaggccctcttgcgaagtagacgtttgcaccccaaacttgcaccccaaggcgatcggcgtccaaggggcagtggggagtttagtcacactgcgttcggggtaccaagtggaaggggaagaacgatgcccaaaataacaagacgtgcctctgttggagaggcgcaagcgttgtaaggtgtccaaagtatacctacacatacatacatagaaaacccgtttacaaagcagagtctggacccaggcgggtagcgcgcccccggtagaaaatactaaaaagtgaataaaacgttcctttagaaaacaagccaccaaccgcacgagagaaggagaggaaggcagcaatttaactccctgcggcccgcggttctgaagattaggaggtccgtcccagcagggtgaggtctacagaatgcatcgcgccggctgcggctttccaggggccggccacccgagttctggaattccgagaggcgcgaagtgggagcggttacccggagtctgggtaggggcgcggggcgggggcagctgtttccagctgcggtgagagcaactcccggccagcagcact

SEQ ID NO: 392 - DNA, 588208 bp, Homo sapiens
tgaataatctgtgctttaatggaaaaatgaaacattaatttgtttagtttctcatacaacatgtttactaaacatttcagtgtcaataatttcttaagattgtaacatttaaccttgtattggagctaataccaattctagccatgggagtatgttttggactttttgaacaattttaagtaaaatgaatgtcactgtctttaaattgtacttggagcaaagacaaagaaacatcagctcattctttccaactaatagaacatttaatgatgcaatttttattacattattttaaggctattatcataatgttaaatattcttatttttttttgcttccgtctgttactaaagctcaatacatcattctgaacattattaattttcacttaacttagatttaagtattgaatttttaacttgggctccaggaaaaatcctgaaaaagaaagatcagcatctagcatccttttcctattctttcaccacaaattctcaatttgatatgacttaacatgaaatctgtattgggaagtatagatttctaagataactttttgtaactaaaaaataatttcctgtgcatcacaagggggattaaaaatcaccaaagtactgaaggaacacgtgctttgattattattcccacctgtttcttttttattataaagtggcaatttgtaccatcattagaaatgtacattaatgtataaagttttgcattcaaatctctttatttttgattacctatgactaaagaccacaaatcaaataaaaactcatataatatatccttatttcagaagcatatgtatatatacacatatatatttgtagaacaatccactgttttaaatgtaattttgacttaaaaaatgctatttacaattttatgacagagaaataacctcagccttttatggtattaaaatgagcagggaatttttatgtttgtgtctcatcttgtgcagatgaaattaagcaatatcatggaaaaccttctcaagagcaaggccttgtagactaaggtatgagggtgaaatcgatttgctatttctgggtctatgtttttaaaaaattactggcaacgtagtcatacttacttcttcaccaagaaatcagtgctcccaaattaggaattccaaacttttcaatatgcaacctttaagtctttccttgtccttactcttgtcttaatactctcatctcccactagtggcaccgcaggactaccaatctagatattagattgttgctattttattaaacagaagagtcttagttcttttaaacaagctttctgaattagaatgaggcccataaagcatcacattgcattacattgatatctctttattgcgccaatccataatggctaaaaatgtgctattaaattgtatgtaaatttcaaagccaaaacgattactatgagaataggatggcttgctgccctccaatttgcggaagcacaaaagtctctgaattagcaaatggaacttcagctccatttgtttctatactttattctgcgagcttaaaaatcaagtaaggtgtattgaccagaaagctattttgtgagactctcaaaagttttgttttcattcttaagctcgttgattttgaaacttattccaataagaactcagaataaacatatcttaatttatatctgcgtagccaattgcaaagcattactaaaagccatattttttcctgggaaaaatcccaatgcaactccaaaaaaaaaaaaaaaaaaaaaaaaaagcttattttacttaaaaaggaaaagtgacgaatgaattgaagacccagaaatcagaacaatgaaaatcaaagaattattatacttgaaataagcctgaaaaacaaagtacttaaactcaaccatatttttggatgaagttggatattatatgtttacacatggtaatatttttaaaaactcagtgaatactggcatattctattaaagttttcatgtacttgagaagtaagcaggagttaagcaaacattcaccctttgctctaagctacattttttgtcaggtttatgtgtaaaagaaatcaggtttccaattaattctctgaactaaactggaaataagacaaagctaatttccaaaacattttactgcagtgaacatttgcttaacataatacggagaaaaacaatatacaaattgtgtggttagaattttttcttaactgctatcaggaaggagacaaatgtgagtctagatgataaatgatgaatagccactgaaaatggaggaattttgttagtgattcatatctctatttttttcataacaaacttaattaaatatattttgtcatgaaatcataattgtaattgatttttatgatttgcatcaattgtgttatttatgaaaccatcgttttactgatgagtgtgtatgtgtatcatcactacaaaagctcaagtcatttcatgctaaaagagccagtgtcccatagtgttgaagtttcttttttatttttttcaaataaaataagctttgtgcttgggatttttttctttttttttttggttctggtagtgacaggtgtatttataatcaagttgaatcaagagtgacaagaagaaatacagctagagttatatttttgccccaggggtattcttttcctagaagagcaagtccatttttagaaaatttaaatgtctttatttgttactttccaaatattttggttaaacaaatatctcttgcaaatgtatcttcaaaatctttgcctacatgcatacaatttgttcttcccaactgcttagggaaattccttcatttcattttctgctaacctctagataacagaaataggatacctggtgaaggatatggtccactattgaagaataatgattgtgtaaagtgagggaaactatattgaccttgaaatacggcaaccaatggcaaggtttgaggtgagggcctagagcttctgcaaagtgtatatattttagggagtcatatttggaacaatacatgctggacagtagagatataggagaagttacatgctatgtcttctcattgataatatccataaatctgcatacattttttaacattctgttttgtgtttttttttctttaaatttggatgtctctacaccactcctgatttgtaggactaaatagatctatttattccaatgcaaattgtgtaacatttatttcttccttgatttttaaaaatactttagtattcttaactatgtatgtgccttctcttacactgagttcttttttgctcctttcagctgctcacacaatcctgtctgttggagtcatagctgctaattccatattatttctctacacaccttgaaaatttagtgtattactggtacccttctgtgttctaggaaacaaatgaattgcaaactggacttgtaacaggatcatacatagagcaacaaattagctactggctttgtaagatagtaagttaggaatttcacagtcatgtctccaaatttcatggcagagtttaaaaaacaatataagactgtggtaaggtacaaacgcaaatgcaatttgcgttgactaatttcctaggacttatttccttatgtaaaacccctgttctttctttcctgccacaagacagggtacaaagctttctaaaacatgctctcaggtgtccacacctgagacattgctttgtggatactctcaaaggtgtccacaaagcaaaaaaatcagaccaaatgctaagagcaagtaacttatacctcaccacctggacatggcactggcaaaagtcacttcagcattagaacagtaatgtttttgctaaattactaaaaaaaaaaaaaaaagaaagaaagaagaactccggaaataatatctttgataaaaatgttatactctaggataatttgaaatcatttttgtgaaagaattaaactcattaaggctattcgatgccatacaagattttccttttacataaaacaatcttaaattacatctcaaaaataatttcttacacttttcttgatgataaatggttcctggctatatattttataggtattaacatagtttataatttggaaatgttcaatttcatggttacaaaaaaaatcctgcaaacagaatgtaatggtgtgtcaattccagatgcccaaataaaatacaaaatcaagcaaaaccacacatcgcagcattatcatgagtttaagctattgagtatataacatcagtttgtgagttcaattctccaaatcctttcctttaaagtaataagtttatttcatctttattaatgtcttcattacaattagccttctactaataacaatacagtttaatttaatatttatggagttctgatttattttttcctttgcttttaagtgtgctaatctttgtgcacgtgaattttctaccacattgcaacaagcaagctttggttcaattttcttgtcctacacaaaggaagattttgagtgcagaatcttagccactaggtcttgcgttgtcattttattttcctctccttgggtggatttactggaaggaaatgggtaaatgggaaggaagggaaggggaagggatgagagagggaagaaggggagagttctcagctatgttgaatcttgattcacaactttgcctccattcatggttggtgttccagaacttttccttgaacgcccttgtttttctccaatttcatgtagcgatggttctctgtacatacacactgaaaggcaaaataacaaaaattacttatgacagtggacataaatttccttcaataagcttttcaaatttgattttacaatattcttcactctcatcacaagctcttcttctcattataaaaaaacagttttaacttgataatcagtgaatacacttaattttctttcagttctttcagtcacaaccttttaaacttttcttgaactgcagacatttaagtaagttgtttctgttctctcatagataaggcttgaatctttacagtttcctaacctagaaaagaggattttcatccagagtcagaggagacatgggaaatatttcgctttttggtccttagtctgcagtctaattcgggtaggtaaaaaaatattcatttacatgttgctaatctttaccctaccataggaaatataatgtatcaaactgaaatatttattgccatttccagggcatcctatgtaaaaaaataagggaggacagagaagaggaaaaaagatgaagcaatttccccgactgccctacatttagctaaagtaagaaacacagtccgtgactttgtagtttttcatcaatagggaacgtgattatgcaagcatgagacttcagttcatatctatataaaccgttcttttctcctctattgtattgtctggctgtaaagttcagtcatctgtgagccatcatggctattcctagataattgtttagaaagaacgatgttttcaaattattcaagttattcttacaaaacacgttaattcagcttcattacactcttgtgaaatagacaaatgtgactagataagagtatatgatatgtctcaggtaaatatcaggagttacttttatcctcggcttaggaacaaacaggtatctccacctattaaaccatcattacaaagatttgataatttgaatgttacttccaacatcaaatagcttcctcccttgaactttgagtggttaccgatttgcgaaccatgctacccggatccacaccctgactcagccatctcctagccttgttaatttggacacattttcataaatgaaaaattgcatatttatgaagattaaatgccttgcatagagcaagtaccaaaaaatgtttatgaaaattaaggagctgatttctttgtgagcattttgaataacagatcttcagagaatatagaaataaattgttttggctgaaagtattctaaatccaaaactagactaaaacagaatttagaatacaagtgagagtctcctgagactggttcagtgatgaggagacagatttcttccaacatattctattacagaacttcttaaatgttaccgtacatgggaatcacctaggaatattgttaaaatgcagattatgaatcagaaggattgtagtgagcttgagagtctccattttaaatagatctcaggtgatgttgatgctgataaaacccagactacactctgagtagcagaaaatatatgaataaaatatgtgtgttaaggctgttatgtaaattagccacatatattttaatgagatttaaaaatatttcaattactgcacggatggctcttccaacatccccaaaggactaaatgcccttggctgaagtaacagagtatacagaggaaaccagctcagagagtagatcatataattttcaaatgacacaagtaagtcattcaagtttgtctttcttcttctttttttgtttcaacaaatagaagatccttagggaatatcttgccagaatcttgaagttccctaagtctaatggtgcttacctctctttctattataaaaaaaattaaaaactccaaaattaaagcatagttttttatttgtgcaaaatacaaccatttacataaaactgctcaatgcacaggggaacgcaagaagcaacgaggtgatttagctggaacactattcatatgataccataaaatagttcttcccaactctgtcacctaatcagctgtgaaaacttacacatctgcaggtcaccccacagattgctaaatcagaatctcaatgaatttacaaaaatctcctttttcaaaaataatatattttgacctgcaaatccttaagcttcatccagggatacttgaggaataaattttctaattttcattaaagtgtatattttttttttttttttgagacggagtctcgctctatagcccaggctggagtgctttggtgctatctaggctcactgcaaactccgcctcccgggttcatgccattctcctgtctcagcctcccaagtagctgggactataggcaccagccaccacgcctggctaatttttgtatttttagcagagatggggtttcaccgtgttagccaggatggtctcgatctcctaacctcgtgatccacccgcctcgacctcccaaagtgctgggattacaggcatgagccatcgcgcctggcctaaagtgtatatttttatcactttttaagctgagtttcttagagttgcaatttcctttttagtttttttatgccacagattctacccaaaacattcacttggacttttatctttttttttgttttgttttctatttctcacttgcacataaaatacttcatttgtgtcaacacacaatgttactgttataattactgctgcagataacttttccagtaatttaaccctgctggccatccttatattgagcggtattgcaaattgacatctgaaaatatacagtgtttcaaaaagaccaaaagtcaccagtgccacagcaagatgtaaaatttgctctttttctcatacaactcattttctaatttcccaatctttgcactaaatggagtaataaaattaacggttttgaaaacctagttcatgtcccagttagaaaacgacaagtaaaaggtaggttttccagttcactgatgaaaactgcccccctcctcaataaatcaaataggtatttgaatttctatacttctgttaaccaaaataaaaagatgttcagagaaagcaaactaaagttattctagaaactgcatgcaaatacaaatacggagagcaaaaccttggtcaaagcaatagattaaatgtaatttcttgagcattaattttcattgttatttacaggacctaggattcagtaatatatctaagaagctgacaaatcaaggggaataagtctcaatcaaatttctgaattacaatataatttaaagaccataatccaattagaaagcaaagaaagaataaagtacctcccttcagtaatataactgccttactaccatccatagttgcattaacgcttaatgactgctattctgaatgtacatggtaaataatgaaacaaaattaaggaaggaaacaaggcgtaagtgttctctaaagtgcattatatgtgcaaaacgtaaacgaaaatcaccatgatgtatatagcagcctcaatatcatttcagagtattcaaagcaattttaaattgattaactaaattttacaattataacccagtgaatatagtaggtgagaaattatcacccccattttttttaaatataaaagaaattaagccacttccataaagtcagagagtgagtagtggcagggccaggatgaatatttagggtttcaaggtcctagttaagagttttgaataaaatcagaaataccataatttatccaacaaacaatgtaaaatgactgacatatcagtgtttgaattcttatgtctgtatgttaatcaagatttaagttggccttaacttcactaaatattcctaaagtcattcagaaatggtaataaaagaaaacatatggctgttataaacaaaatcaaaaaagaaagtaacaagagttggtgagtatgtggagaaattgaaaccctattcatttctacttaaatgtaaaatggctcagccaccgtggaaaatgaaatggtgattcctcaaaaaattaaatacggatgtaccatatgatccagcaattccaactgtaggtgtacactcaaaataaatgaaagcagggaccccagcatctatctgtacatccatgtccatagaaggattattcactgtagccaaaagatggaagcaccaaaatgtccattgacaaatgaatgggtaaatataatgtggcctatacatataatgaaatattattcagcctaaaaaacaaaattctgacacatactacaacatgaatgaaccttgaagaaattctgctaggtgaaataagccagttacaaggagccaaatattgattccacttatgtgagatacccagagtagtcaagttcacagaggcaaaaaatagaactgtacttgccaggggctggggaagaatggggatttcttatttaatgagtacagagtttcagttgggggagatgaaaaagttctggagttggatgatggtgatgtttgcacaacaatgtcaatgtacttaacggcaatgaaacatatacttaaaaatgattaaaatggtaaattttgtattatcatattttaccacaattaaaaagcaaacaaacaaacaacttgtcctgaattgtcctgagtataaggtataagaagtgactattaaagccagaggtgttccatttgcataggaagagccagcaattccccaataataaaaaacattagttttagaactgtattaaggaagagggagttgagatataactgaggaggtacagggcgaggaaaaggatagagaaatctgatgaaaatattctaggactgtgctgcctagtatagcatccatttagccatatgtggccactgagcacgtacaatgtagctagtcctaattcagatgagacataagtgcaaaaataaacactacaggactgggtaaaatagggaggtgatgacgaataagaaggataaggctaatttgtgtcagagcttgctgaattccaggccagaaaatttaaaccgtgaacatcatatatatcaggctcaatatgatagcaagtgaagagttaatatacttagttaattaagtgatatgatagcaaatgaagagttaacgtccatccgacatgagtgtataaagaaaaatctattaattcctttatgtagaaaaatgtctaggtttacgtgatatggatacaactagtcagtatagtcaagaaaaatcattcaaactgaatctcactgagtgaactctgtaaggaatgactggcagcatttgaaccttttttttattattatactttaagttttagggtacatgtgcacattgtgcaggttagatacatatgtatacatgtgccatgctggtgcactgcacccactaactcgtcatctagcattaggtatatctcccaatgctatccctcccccctccccccaccccacaacagtccccagagtgtgatattccccttcctgtgtccatgtgatctcattgttcaattcccacctatgagtgagaatatgcggtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatatgtctgcatgtgtctttatagcagcatgatttatagtcatttgggtatatacccagtaatgggatggctgggtcaaatggtatttccagttctagatccctgaggaatcgccacactgacttccacaatggttgaactagtttacagtcccaccaacagtgtaaaagtgttcctatttctccacgtcctctccagcacctgttgtctcctgactttttaatgattgccattctaactggtgtgagatggtatctcatagtggttttgatttgcatttctctgatggccagtgatgatgagcattttttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgactaggttgcgaaaattttctcccattttgtaggttgcctgttcactctgatggtagtttcttttgctgtgcagaagctctttagtttaattagatcccatttgtcaattttggcttttgttgccattgcttttggtgttttggacatgaagtccttgcccatgcctatgtcctgaatggtaatgcctaggttttcttctagggtttttatggttttaggtctaacgtttaaatctttaatccatcttgaattgatttttgtataaggtgtaaggaagggatccagtttcagcttcctacatatggctatccagttttcccagcaccatttattaaatggggaatcctttccccattgcttggttttctcaggtttgtcaaagatcagatagttgtaggtatgcggcattatttctgagggctctattctgttccattgatctatatctctgttttggtaccagtaccatgctgttttggttactgtagccttgtagtatagtttgaagtcaggtagtgtgatgcctccagctttgctcttttggcttaggattgacttggcaatgcgggctcttttttggttccatatgaactttaaagtagttttttccaattctgtgaagaaagtcattggtagcttgatggggatggcattgaatctgtaaattaccttgggcagtatggccattttcacgacattgattcttcctagccatgagcatggaatgttcttccatttgtttgtatcctcttttatttccttgagcagtggtttgtagttctccttgaagaggtccttcacaccccttgtaagttggattcctaggtattttattctctttgaagcaattgtgaatgggagttcactcatgatttggctctctgtttgtctgttgttggtgtataagaatgcttgtgatttttgtacattgattttgtatcctgggactttgctgaagttgcttatcagcttaaggagattttgggctgagacaatggggttttctagacatacaatcatgtcgtctgcaaacagggacaatttgacttcctcttttcctaattgaataccctttatttccttcccctgcctaattgccctggccagaacttccaacactatgttgaataggagtggtgagagagggcacccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaatggtaccagttcctcctcgtacctctggtagaattcggctgtgaatccatctggtcctggactctttttggttggtaaactattgattattgccacaatttcagctcctgttattggtctattcagagattcaacttcttcctggtttagtcttgggagagtgtatgtgtcgaggaatttatccatttcttctagattttctagtttatttgcgtagaggtgtttgtagtattctctgatggtagtttgtatttctgtgggatcggtggtgatatcccctttatcattttttattgtgtctatttgattcttctttttttctttattagtcttgctagcggtctatcaattttgttgatcctttcaaaaaaccagctcctggattcattgattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcgtcccagagattctggtatgttatgtctttgttcttgttggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttccaactatgtggtcaattttggaatgggtgtggtgtggtgctgaaaaaaatgtatattctgttgaattggggtggagagttctgtagatgtctattaggtccgcttggtgcagagctgagttcaattcctgggtatccttgttgactttctgtctcgttgatctgtctaatgttgacagtggggtgttaaagtctcccattattaatgtgtgtgagtctaagtctctttgtaggtcactcaggacttgctttatgaatctgggtgctcctgtattgggtgcatatatatttaggacagttagctcttcttgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcatgtgagatgggtttcctgaatacagcacactgatgggtcttgactctttatccaatttgccagtctgtgtcttttaattggagcatttagtccatttacattgaaagttaatattgttatgtgtgaatttgatcctgtcattatgatgttagctggtgattttgctcgttagttgatgcagtttcttcctagtctcgatggtctttacattttggcatgattttgcagtggctggtaccggttgttcctttccatgtttagcgcttccttcaggagctcttttagggcaggcctggtggtgacaaaatctctcagcatttgcttgtctgtaaagtattttatttctccttcacttatgaagcttagtttggctggatatgaaattctgggttgaaaattcttttctttaagaatgttgaatattggcccccactctcttctggcttgtagggtttctgccgagagatccgctgttagtctgatgggcttccctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagtgtcttccaacttggttccattctccccatcactttcaggtacaccaatcagacgtagatttggtcttttcacatagtcccatatttcttggaggctttgctcatttctttttattcttttttctctaaacttcccttctcgcttcatttcattcatttcatcttccattgctgatacccttcttccagttgatcgcatcggctcctgaggcttctgcattcttcatgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttcttctctcagctcgtcaaagtcattctccatccagctttgttccgttgctggtgaggaactgcgttcctttggaggaggagagacgctctgcattttagagtttccagtttttctgttctgttttttccccatttttgtggttttatctacttttggtctttgatgatggtgatatacagatgggttttcggtgtggatgtcctttctgtttgttagttttccttctaacagacaggaccctcagctgcaggtctgttggagtaccctgctgtgagaggtgtcagtgtgcccctgctgggcggtgcctcccagttaggctgctcgggggtcaggggtcagggacccacttgaggaggtagtctgcccgttctcagatctccagctgcgtgctgggagaaccactgctctcttcaaagctgtcagacagggacctttaagtctgcagaggttactgctgtctttttgtttgtctgtgccctgcccccagaggtggagcctacagaggcaggcaggcctccttgagctgtggtgggctccacccagttcgagcttcccggctgctttgtttacctaaacaagcctgggcaatggcgggcgcccctcccccagcctcgctgccgccttgcagtttgatctcagactgctgtgctagcaatcagcgagattccgtgggcgtaggaccctccgagccaggtgtgggatatagtctcgtggtgcgccgttttttaagccggtctgaaaagcgcaatattcgggtgggagtgacccgattttccaggtgcgtctgtcacccctttctttgactcggaaagggaactccctgcccccttgcgcttcccaggtgaggcaatgcctcgccctgcttcggctcgcgcacggtgcgcgcacccactgacctgcgcccactgtctggcactccctagtgagatgaacccggtacctcagatggaaatgcagaaatcaccggtcttctgcattgctcacgctgggagctgtagaccggagctgttcctattcggccgtctttcagcatttgaaacttttatgagttgttctggtgctttgcaaacacaatcacaatttcgtaggaataaatctagctgaagtcccactgtgtgtatagggcccactgtttatctaatatacccattccaagtaccataattctgaatgcaattgaaaggtgaggttcatttgggcgatctaaaacatgttcttttgttttgggggggagcttaagaagcctaaacaaacaaaaaataaattaagaattactaatgtcattgcttctggccttttggctatgaacaagtatggagaattactaataccacatagaaaatgggaatcacatgtactttatagtaaaatttattcatgatcttatataaatatcagcactagaatttggagttctgctattaatttctaatcacatactattaagcatttaggggaaacctttagcaagtatgtccagagaactgtctaggctctgaccttcaatagctacatgaattctacaactcttaaactgtggttctcaaattattcttatcctatgccagattaagtttctctcttcctaataatcagatccttattattaaccagaaagattcctagtcccttgatttgtagtagctcgaagtgcaatgtatttcaagagggactttttccatctctttctgttataatgcgcaatattatttcaccaggaatagatttgccatgctttaggaggtgctagaattttttttaaatctcttttttttcttcaaaaattattttcctgtttcctctgtgttatgcactggaggccacttcagctatgagaacaaaatttgatattttagttcttatgataagcagtaatttctagactggaaataacatgaaaacaaaacaaagaaacagaaactccctatctttcttgtcttcccagttccccaatcctgttccacaaaaactcagattcagtggcacttctcatatgaaattggaagcaaatcctctaatttagacaatatgggatgttactagttaactatgtctcactcaggaccttggggcaacacttgtgatatagattttattttcagcaggtatgatgttatagatagtacttagtataaaactgatttaaactttgtttctctctgattgcacttgatactatttttccaacacagtttcagtacccaaatttcaaggatgttcagtgtcctaaagatgcaaggcctgcaagataaataaacaatgttatttccctttcatctggcctgcaagataaataaacaatgttatttccctttcatctggcttttctgggttgtccttgatcaagccgcttgccctctttctattcatttgtcaagtacatagagtaggaaaagaaatatttgcttccctcaccccaggatatttctgagataaaatatcattgctcctctaatgcatgtatcatcataatagttttggacaaatggtaaaatacgatcatgttttgaagaggaagcatttctttttggttcttctgtactctttcttcaaatcaaagcacactcttatttcacttcttttcttcttatttttcctctattctgacttacatttcaattttcttccttcttcttaatgtttctttctattcatgcttttgacttttctagagctatcgtagattgaaacggagagatttaacccagctttctgagtgaaaataaggtagagatttggtgcgagagtgttcctccttattttcagacacaaggacaagcaggtttctaataacacagctcacagtatgtactactttaaagcacagtatttactagaaaccagtttaacccttgaatgtcagcagaatgcacttgtgagatagacagtagttaccaggtgacccagcacagtgaaggttttgattttaacagctgtctgagcatgcactgaccatgtagccatagaaagccctgcagttctggtaacacaaatacaatgcaacacttggtcagaacaggaccataatatattgactctgtgatgatatatggtatttgttctatttatttaattcttgcttcattttaaagtgaaaaatttacacttttagaaaagagaaatgtgaaatatatatcactgagctttgaagtattgtcaaaaacaatccattttctctttgtaggattaggtatggattttttccagggcaagctttctatttaatatttttctattacattcttttcatgggtgcctgtgttgcaaatgcagttaccagaatatgcaggctttccttgccatcgtgatggctcagattcccctatttacaacttctaacattcaacaataacttctattttagttataaatttcttctgaaaaaattacaatgaaacaaagactttcttaaaagtatgaaaaaagtaaaatcttgggcattgctgttatttataaagcacacagctataataaaccgggtgccaagtaccatcctatgagtactctcctattaagcattagtcatcctcataataatatctaacgttaactgagcacttactatatgcctgcacattatacatacaaacagttttttaaatgaccataaaaatagatacttttagtggcctgttttgcagctgagtaaactgaagaacaaagagggtaacctgtccaaagtaatatagcaatacagggcagtcagctttaaaatccatttgagactaaccctggtgcccctgctctaagctgatagcctaacagttgagtatgtgtaaatatgctgaaaaacataaaactgttttgactggtcgtaagtcaaaaccttgaccccaaacctcatggttgtacacagcactttctggaattctactacatctttctggtcaatcagctctctcatgcttcgcaagttacttatttcacaccttccccttgtacctcaagcttccaataccaccttagcccctccacagactcaggaaatagacctgcctgcttttcccttttctctttctttctttctttctctttctttctttctttctttctttctttctttctttctttctttctttcttttctttctctctctttctttttctttctttctctttctttttcttttttctttctttctttcttcttttttcttgctttcttgctctttgtctctctctcccttccttcctctctctttcctttttctttcttctttccttccctcccttcctcccgccctccctctctccctccctccctttctttctctttctttctttcttctcgtctttctctttttttcttcttccttctttctttctctctgttttttccctccctccctccctcccttccttccctccctccctctctctctctctttctccttccttccctccttccttccttctccctctctccttcttattcttcctctttattttccaagacaataaactgtctgactttgcatttcacttagaaaggagaattagatgagaaatgttttcatggcaaaaattaccaacctatggacatctgcccccacgtgttctgactcctgcttgttacaatgcttgcactgtgcagttcttacctaaatctagagcgccatggtgcactcagtcccagcccttctactcagtgttctttggtgtccctctctcctgtgatcccaatgtctgcttatcccagattgttcccatcagtatatgaatgtatgaaatagctttaaaaacaaagaaccctaccatgtaactgtcatgtttctcaccagctccctcctcatttctctacttcctttttatagcagcagttctcaaaagaactttaatattcaatattaccttcttcttttctttgcctccagttatcatttaattctttccattcagacttatttctcactgtttcaccaaaatcactcatgtcaagtcactactgaccacgagttacaaaagcaaagatcaattctcatttagcagcttgctagacactccagcagtgttggatacagttaattatttcctcctttttgacaagatgttttcacttggcttcttgaacatcaatcaaaatagcctagtctttctgcaaatcactggctactctattttattctcctttgcaggagcctccttttccaataaatgttagtgttccccaggagtaagtcagcaattacattcattttcttagcagtgtgaagaaactagggaagtattctccccatttcttgtcacaactatagtgatggaggtcaaggtggtattactaatattctataatgtgagaaagttccacacaatagaataatttttccaaacaagatagtctccccatttgaaaagtagtcatagaacctagggcagtggttgtcaagcggtggtgaatttgccttcagtgaatctttcgtaatgtctgagacatgtttgtttgtcaccactagagaggatgatttgctattggtatcctgaacatagaggctatagatgttgctacatatcctccaatgcacagggaagtgccccacaacaaggaattatagaacccaaagtcccaaaatgtcagtagtgtctgagttgtaataaccagtactaggggattacaagtgattttaaaatgtcatatttaagtagtgtgtgtgtgtgtgtgtgtgtgtgtgtgtgtgtgtacacatttcagcacacagacccattattcgcccagttcatcatgcctaacacctaaaagtcatccctgatttctgtctttatctaacaacctacatccaatccattagcatgctctatcaggtctaccttcaaaataaattcaaagtcattctctctacctctagttataaaaccctagagtccaatctaatactatcttgcttaagatcctggatgatttcactgcaattctgctcaaaatctataatgaatccccatcacattaaccataaaatctaaagtcctgaaggtggttacaagccctcaatttatagtctttcctttctctctaagttcatctcctaccttccattcctttaatcaatccattctagtcacattggctttcttgctcattattaggcatcctcggagtctataaaagcctttggaatctctcagctttgcctgcaaaaaccttgtgccacatctttgcatggtttactactaaatttcattcagattactgttcaaacatcatttacgtcatcttctctaaaaaatttaccttcatcatcctttttaaaatagtcccatatttttttcttggaactaatctctagtgatgttttaaaatgcttgcttatttttaattgcgtattttttacccatttctagacataaatgctatcaagtcaaaattgtctttccttgagtactaactgtgtccccattagtacagtgaaagacgcttagtagatgtttcatagttatgttccaaatgaatattcctatctactatgctacagtgactaactgaagaagtctttggttggagtaaagctgatttttctttcacctttaaagtcagtgaatctttactttatctaaggtcctaaacttgggctgagttccctgaaactgaccaatataaaggtaaaatagatgactttgacacaaatggagcaaggaatactatacggtagacaatatttatcaagctcctttagttaagtgatatttgaataatcaaataataagcctcatcttcacagaaataagaaaaatcaatgaaacagaaaataaaccaagaaagctgacgaccacccttacctttccttgtatatatggtgcattatagagtctagaaaggaaagagattctaaggatcattgcatcagacagttccctaaacttagtgattgtcaaggcatgacccctaaccaccaccaccaacagcaggaacgttaagaaatgcaaattatttggccagctcaaacgtacagaattaaaaattcaggagatggggcctagcaatctatgctttagtgggctctctaggtaattctgatgcacactcaacttgtagagttgctgtccttaattcttccatgagaaatacccggatgttctaagaatacacatttgtatctatgtcttgcctctgcagattctaattcataagaagttacacacaaatacacacacacacacaactgattaagtaactaaattgaataactttaaggaatgacaacgcctatttacacacacacacacacacacacacacacacatcacatcacatttgtagtaggaaaagcatgacatctgaagttaccaggtaacaattctagttttgcttctttctagctgtatacacctaagtgagttaacctctagaaatgacatctttctcgtgtttaaaatagggatagtaaatcttaaccttcatacttccaaggatttagtggctattaaatgatactttggttcagaaagcatgttgaaaggacaatatgccattcaaatggaatataaggtagtatagctgctactaattatcactttatattgttgctgtattcttgacagatcctttgaaatttgagagtgctagcagtaatttttaagtgtcaatgtcactctgtagtggagagttgaacaacctgtgtgtgggaacactggagttgttctgacaaattctgttttccaaataaaaacaatttaacttctgtttttaataaaactaaaacattaaactctataaagaacctccatcgactactagttaccatcaaagacaaatgaaatatgattaatcattttattactacaaatttaattgaattttccttggtcctctgtaatttccaagaagctgaaaggttagactgctgtgttagttaatgcaccattgaagatacttaattgtcttaatagcagatcatagaagggtgtgggaaatttacctaaagcaatttcacacctgaattaatgttacatgggatccttttggaactctgggagaattctaagtgctagtttggaagaaatgtattgccttagaaatgcattcactgtgctatacatatttactataatgagataacaactataacgttgtgaacaaaagcgtctgtatgttcgtttagaaagaaagaaaaagcaatatttgcaatgagggacaaagagagagaaagaggaagaatgtgtggggaagaggtaagagggttgtattaaagactacattcagaaaccagaaaaaactggtttgaataagttacaatggtttgcaggaggaaagtatcacaggctggcagaaacccaaaacacaaaagaaagagttgcagctattatcctttctgtaattaaaacaattactggcagagaggttcttttttgctccatctttctgcttttgtctttcagtatggttgggtccaaaagagaaccaaggcatttatttctatttccagtttattgaaataaaaatatcaaatttggcattagtgtccaccagttggagttttaaaacatcaggactcctgatttgctctgttctttggtgtcttattatgtagttttgaagggattgttattttccttccagattccattttcattgcctttaatttctcatgcaatgccacatctcacagcatttttccaatacaaaacacagtaagacaatgtccattttctaagacaaaatgaaaaaggcatttcatgtttgatctgacagaattctcttgaaaaatccaacttttttttacaatgtctaattttcatattattcctttgaagcaggtggaatttataatagactttatcttcagagatgactgaggtagaaggagataaattattttctcaaaattacttagcaaggctgctctgcctatggagtagccattcttctgtttcttgacttctccaatacacttgctttcattcaaacaaaaattgcttagcaaatcattgccaaattttgacccaaagaattagacacttctgtattcttggttacttgatttctattaggttgctctaagaggtgtcaatttaataaaataattggcattacctctactgacttcatataggaatttaaccctggactaaaacatacctgtcttgatagtagtagggaatgtaaaaatgtaacatatatagtatacttaatttcatgtcagagggacaatttatattacattagattcagtccaatatattgatcacaataatatgaataaatttaaatcatccatggccagatttgaccaaaaggagcttagaaacaccaaattcagaacactgcatctcaaactcaatgccatcagaaatcccctggacagcgttttaaacctatagagtcctaggtcatacataggtttcaaacatcagatcactttggagatttgctctgagaatctgttagcttctaggaacactacagatggttctggtactgatgtttgggaaatgacagtttacattctgctgagtcttaaatcagattctatgagcttaaagcaccaattctaacaaagaaaatggaaaccatgtatatggccaagtgtgtgtgagtgtgtgtgtgtgtgtgtgtgtgtgttagtactgtctccccactaccaaataaattgggagaaataaatcaatattcctttattccaagtttaatacttctgtatggatggctctcaaatgattcttagttatcttatttggaaatatatttatttctccaggtctcagctcttgaagcttaaatctttgcaaagtacacagactttttttttcagaagggaagaaccagatcctaaatactcagccacctgcagtagctgagcaatgtgcttcttgaaggaggagggaggagaaaaggaggagactatattttgttctttgtcaaagagtatttgactgctatatctgatgctaaagggggaggtcaccactaaaacactttacatctggggaagttacttatctgtgctttgaacaatactctgaaagggcagaattgagaatcaggaagcctgtgctattgtccaaaattccaggggaggggacccatgtaagtagaggtttatatgcaatgtacatagtaatgtgcttaaacatcaaggccatctatcagaataggtgaccctgaaacccctcatcaacgctcctgttctctaaacacaggatgagacgtgaaagagtgaagggaaatgggctggtgggtaattattatcatgttatcagtgtaggacttaaccatcctcaaactggcagagcttaattttgggaatcgtgacattcaaaagacaacaccagcaggactgggataaaggcagacatatgtgaaaaacaaataagcaggaaaaaacaaaagaacaaaagcaaaacccaaagccaaaaaaaaccctactttggcttttcctccctaagaggacaattcccttcacaaaggaagggctcatttaccgtgcagtgctggactctgttaggatgttaacagtattaccattggacttacagggttacaaagatgcctttaaacattacaaacaaaatagtcaataatttttttggttaacccattagcagcaagttagctaatctcttatgctatcattttctaatcgttttctaaaagtgtcatctagttatgtgctttatacctgccctatggaaaaatattatcgaaaactttatttatttatttattcacttatttttgggacagaatctttctctgttgaccaggctggagtgtagtggtgcaatctcagctcctggcaaactccgactccctgggttgaaagtgattctcctgcctcagcctcccaagtagcggggattacaggtgtgtaccaccacacctggctaattttcatattttttagtagtgatgacgtttcatcatgtcggccaggctggtcttgaactcctggcctcaagtgattcacctgcctcgacttcccaaattgctgggaatacaggtatgagccactgcgtctgtcctaaaatctatttaaatgtaagttatggctaggatgcctttcatcctatcccttcattaaaaaaaaaaatcacaaataatggaaatagctcataaagctgtaatttattttttcaataattcaataaagaaaatatgtttagaccagttttacatgtaaattctaggctaggttctatgaaggaacatggttttacagtgaagggcttataacgactgccacacaatgtcattgccaaagaactttagaaatcatctggtccaatttttttttttttttttgctgagtggaaataaaccttgttagaattcaccagaaaagaagtgatgcattgttaattctttcttgcctagcttgaacatggcattccattaactgttttatctgattgtttaccaatgtgtttctcatcatatcatgtattcctgtctcaattttgcatgatttaaaactagtttactattcaaattgcatcatagtataaggtttctgctttgctatcactgacttttctgagtatttgcatattcacaggcttacttcagattgaagggcaacatagtacagaggttacgtgacatcagggttcctggactgcaaccccagttctgtatttatctagccctgtggtcttggactggttacttagttactttaaattacgtttcctcatctataaaatgaggataaaaatacagaactattgtgaggcttaacagagataacatacgcaacctggctagcaaatagtaaattgataaactgcatacagaagtagtaagactagtaatagcagtaatggtggcagcaaaaataatttgagtatcccagcagcgaggagaaaggtttcaatgtccagtggattaatgcctgacacaacctcaagtgtacatatctttgatagtaatggtaacctgttaaaatcatttaaggatataatgtataactgcatggagaatcataaggtaattgttcacattttctgtattataaggacatcaaagcacataggaggcagaagagaaccaaccaatttcatgtgtttcatgtcagttacaagagtgtgatgatctccattaatctgcaagaacttttatttctaaggggtagggatatattgcagatttttaaaaagagaagcaattaggagacatttattcaagatcatttactaggtcccactatattgaagttacatctacatctttctcagacctcagactgtagcctgtcttaccagttttaaatggggtttaagaacttgattgttcaagtcagaatgctttggtttcatttctggctttgccaattgctagctgcatgatttaggacaaattactcaatatctctgtgtttcatttttcacatttgtaaatgcggataatactggaacctacttcgtacaaatggaatggaaagtaagagacagtaattgagacgtgcttagaatagcacctgcacagagtaagcatttataaaactgttagctaagattgttcaataaagttagttccctaagacaaaagataaagacatttatagggaatgagaaggtgtttggcctaaaaccaattaagttttttttttcatttttggaagtaattatcatcatattctatatgcttcacacctagagagacaaaaatccttggaagtgaatcaaagtattagtgaatctgatttagaatgcattttttttcccagaacaaaaagaaaatcattctaaaggatcagtcaataacataaagtaaaaacacgataatctaccaaaagatgtcaatcagaaaattaggaaatcagagatattctaaaattaagaggatggaagcctgaagcagagtttttagtgtctcaatacccattgtgccataacccctagtcacagaacatttatttggtatatggctatcaaaaaaaaaaaaaaaaaaaagactacattcttagcttctttacacctaagtgtgactacctgactaggttgtggccagtgcgataagtagcatatggcagttaccatggacaacttggaaagaaaactggccctggcttttccttctgtcttcttcacctctcctctgccctctggctggaataagatgctggttggatcatgggcagaagggcagatccagggccagcatgtgtggttgtgttccgggtgcagtgcacagttgtaaataagccgtagcaaaacactgggagagaggtagtaaaagctggatgcagccaaggccctaccaattggaaaagcacagtaccagctaggatagctggtctctagatttgttttgtgagagaataaaaaactttatatgattaagctgctgttaatatgagtttgtgttgtgtgaagacaaccttaattctaatccatataggaatgtccagttgtacacgtacatgctcatccagacccaagaggaaacttgattaaccaaagtacagatagcagctaaaattaggagggtaggttataggtatatatatatatatatatatatatatatatatatataaaatttttttttttttttttttttgagaaagaatcttgctttatcacccaggctggagtgcagtggcgtgatctcagctcactgcaatctccacctccttgattctcctgcctcagtctcctgagtagctgggattaccggcacgtgccaccacgcccggttaatttttgtatttttagtagagacggggtttcaccatgttggtcaggctgatctcaaactcctgacctcgtgatccgcccacctcggtctcccaaagtcctgggattacaggcgtgagccaccaagcctggcctaggtgtatttttaagtggggtcatgagggtgaagttgaatataaagggcattatccgtaaagggaataaacacaacacgtggatttcttttcttcatactttcctaaattttccaaaattgttaatgaccttgtactacttttataacaagaagaaaatcaatgtaaatgaacaaataaaaatgatgcaataattaagagcataattcatcaaacatttcatttttgagaatccatatatttccctgtgaaaatattacttacttctcaggtaccctttgcttaaccctaagaagcaggcactttcctgcctttattcacactgcacctggaatgtttttgtctgcctaatccctacctctcatctcaaattgcaggaacctggcctagccctgaaggtaagtttaaatattagcttctcaatgatatcttactttttgggaaaataatagcctttttctctgagtcccaatataaatcctatatattgcatcacttaacattttacttttgctctgagtaaacatatgtcacacctctaagaatatcataaagttctctggcgcatatattcttctttgtctttatagttttctattcattaattcattcacatgttcacttttcagacaactgattatcaaatatctctctatgatatgccaactattatagaagacaaagggagatatgaagaaaaataaaacatgttctgttcattcaaagagtgagctaaccatgaataagaggagacagagtggcattgggcaaatttaatgtcataatttctatgggagagaaatgtatgcaatgacaagctgaccgaatgtttagttctacttgaagaaagtcaagaaggccatcatggaagtattgactcttgaattatttttttccaaagactaatagacattttccaggcagatgagataaatggataaaaactaaaggagcaggggtgatgaacaaaatgagcccaataagaatgaaaataggccaggcatggtggctcacgcttgtaatcccagcactttgggaggccgaggtgggcagataacctgaggtcaggagtttgagaccagcctggccaacatggcgaaatcctgtctctactaaaaatacaaaaattagccgggtgtggtggtgtgtgcctgtaatcccagctacccaggaggctgaagaaggagaatcgctggaacccagggggcagaggctgcagtgagccgagattgcaccaccgcactccagcctgggtgacagagcaagactccatctcaaataaataaataaataaagtgaaaatatactgcaggaaagaaaagttcatttcatgtgctgaatacacagcatgtgaagagggtcctgagaggggctaggggctttgaatatcacatttcatccagtgcttggaacattggaagatagtattgacttaaatgtttgcagtcaccgtgctatgtactatgcaccaggcattgtgtacactgattgactgaccatgccatatgagatattcaggggacagcaagcttgactaagccacagagttgcaatgcactgcctcaattttctcatttcctcagacgaggatgctgagccaatgtttaaagtgattataatgtgactttcagaggagaaacaagcttactcagcctgtagtagaaagcttggctgaattcaggaaatgtggttacccaaatgatatgctctcatcctagctaaggaatttctgagggaacatagcctagctgccaaaaatcggtttcctcagaaaaaaaaaaacaaaaaagtttattctaatggtcagtttgaaataaatgaacagagaattaaatgattacgagagaaaaggttataggctcacctgagaaggatacagtgcaatacggtaaatataaaagtatcatttgtttttcaagggtgtatcttgagaaaggaaattattaggtttagaaaaggaggaaactgcatactagatagtaactaccacttcttttctactttcaaaatttttccggcttctatattcaggcattttttttaagtgccaagtatttgtaatagaattttccttttttttttttttaataggaaaagattcccagctactacggaggctgaggcaggagaattgctcgaatccgggaggaggttgcagtgagccgagactgagccattgcattctagtgtgggcgacagagcaagactctgcctcaaaagaaaaaaaaaaaaaaaaaggaagagatactattgtgttctctgaatatttcttttgaatctttcttctgatctgttgcattccaggcaaactctctggaccaaaagggcaagaagcagaattgatgtcaacacacagataagggtccaacaaagacagtcagttggtttcataccttcaataggtttcggtacaaaatgtgatgagggcttggttttcttcactctgttccccttcataatttgaccttctttattgagtcccagaaaccaagctcggcctgattcttgctggcggtacagtgtggaagaatagatcacatagtagttttcaaacacagattccttgaatttgcattctggagtgaaaacatcctgtaggaaaaaaaaaaaaagacacaaaaaagagaaatgatttaaaggtgaatcagcaaatgcttaaatccaataagcttgaaatccatgtcctctgttaagaacaaatgaaaggcaatgacacatagtttctattagcctttggttacaaagattcatcatacaaaatcaaaaaacatgattgcctttctagccaaccttcagcccagagataataacttgctcaggcttgaagctacgttaaaatcattcaggactgtggccaagtctgcgctccgatcctagcaatatgttttgtaaactaaagtgattggccattcctcatttactcacccttaacatgtaaataaggaactaaaatttatcctggaaatcaaaatcaaatataaccacagcaaacacaggcacacaaggtgcttttgaagagactattctgtatatacaaatgtattacacagccacagcttggtcaggaaaatcaccacttttcctaaagtcagtaacttcctctctaatttccttaaaacatttttttccttagtaatcaaaatctcaggtaaaaagcccaggaataatagaaaaaaattactattatattgaagaaaattactaatagtattaattcctattactattgacctcagtgaaacacagaatgagagttctagtctcagaagaaactgtaagatcctgtacttcaactccagcatttggtaagtgagaaaaccaaaaggtcacgtgattaattcaaatacacatttaagaaactactgagtcaatgccagagctcacattcattgcttcacaatcacagtctctcaggctcaccttttctgcctgagtcttgtttagtgacttataatgagatttaaaaatcaatacaataaaatcatatcctaacatgtcacatgaacaaaatgtattgtgtggaaggaagaaatttctccccttctgagatcagcagaagaaaaacaaatgctattgcatcttcttcagctgcaattaaacaggagtcctacatgtcagacatattcaccacagtcaccatcttcctctccatgaactggaagaatttcagtgtgagactcccatgatttaatgcaagcaaacctggaattaagttattaatgaatataggaatattaatgaatataggttggttgaagccatgtccttgtaggtgatactcccatgccaatctccttatttgtagagagtgctctctctctctctttctctccctctctccttttttttctttttctttttgtaagaggtggggtcttgctatgttgcataggctggcctcaaactcccgggcccagaagatcctcccacatcagcctcccaagtagctggaactacaggtgtgtaccactgcacccagcttgtttttgaatagttccaacattatagacgaagaaaaatgagactaagaaaactggagtaggctggggtgtggtagcttacctctgtaatgccagcacttcgggaggttgaggtaagcagatcatttgaggtcaggagttcaagaccagcctggccaacatggtgaaaccccgtctctactaaaaatgcaaaaattagctgggtgtggtggcagatgcctgtatttccagctactcgggaggctgaggtgggaggatgacttgaaccagggaggtggatgttgcagtgagcagagattacaccccacactccagcttgggtgacacagtgaaatggatctcaacccccccttcaaaaaaaagtccaagaaaacaccccccaaagaaaattggagtagaaaggtggttgtagatagtaagataatatgaatagcaataaattaatattatgtttatattaatactgaaatatgatttcttagagtactttgagttttaagtaaatgaactactagcttaagaatcaaagaaacaaatgaccatgagatactacttcacatccactataaaggctatagtttaaaaatggacatgacaaagtgtttatgaggatgtggaaaaactgcaactcacatacattgctggtggaaatgtaaaattatgcagaagctgtggaaaataggttggcagtgcctcaaaaggttaaacatacagttgccacacaatccaaaaattccacttttaggtatagttctaagattaatgaaaacatatgtccacacaaaaacttgtgcacaaatgttcatagtgacatcattcataatgtggaaacaacccaaacatctatcaagtgatgaatggataaatacagtgtgatagttctacagaatgcaactgtaataccattcaattataaaaaagaatgaaatactgatttatgtggcaacaaggatgaacctcatacacattatgttaagtgcaaggagccagatataaaaggccacatgtatgattccatttatatgaaatgtccagaataagcaaatccggagatagtaagtactgtagtgattatcaagggttggggaaggaggtgagagggataagggtggagtgactgttttgttggagggatgaaatgttctgggattagataccggtgatgtttgcaaaactttctgaatgtaccaaaaaccactaaagcatgcatacatttttaaaatgtaaattacgtggcattcaattgatatctcaatgaaaaaaaatcagataaaccaggtgattaaagaaagtgagggaaggaatgaaactattgcacattccttgcctggcagcacagggctatatgataacccatgtgaaggaaaactggctcttcgaaggccttgtctcaatattgccaggacagagtttagtcattgccaagtatatggataaaagtaactcagattcaatatagatgataatattaagttctgtttttttcctaggactaataaagtatttttaaaatgcttagatttaggtctgaattttaattcattttcttttaaaaacaaactaattaaaataatcccaaagctttttattatttttttttctcgatctagtccaatactagcaaacagtattaaccctagatgctatgctaaggaactctggaaagttcaagcaatacattcaatgtataagatttcagactttataaagaagttaggaaaaaaataattcctgttttgtgtaagtacatatcgtcatatatgtagatggtgataaaaccttcttccttatgaatgtacatcacagaaacatgtaaatttgaagatagatataaagctgcttagtgatgatagtacaatttggcacctttatctaacaaggtaactaaagctcatgacagcgaaataattgtccccagtgtcataggaagctagcggcagatccagaccctgtgttgaacaacgggctcctcgctgctggttcagtacttcttccaatgccacacattgctttcctactgcatacgcaatcctgcttttgatgccaagcttgatttgggcaagccttactcatattatagaaaccatatcagtgatgtataattactacattgtcatttatacatgagaaaaacaacactctcatttaataaataacgattcttaggtttctgtttcatactcatttaaaattccctcccggaacagcaaaaatcagagatattgcacagaagctggagtcctggggtcctgagccaggaaccgcattaggtaggaaccgggctttgaactactaaattgacaaatgggggatttcttgcacagcatccaggtcctaatcagcaatgaaaagccaagtggagttttccattcagtataattccaacagggctatgcagagtcagaatctgaaaatgaggcagctattaatacctgaccagggcaagacatttccggctggaaacatggcaggagtttgctgcaggcacttgtgtggacacaggcaggctaccctataaactggacgggaaatcttaatggcactgaaccagcttggatagtcattctaagtagaacctttacaatatatgtgcagtttcagtttcaatatggagttgggcatcaaagaatttacattgtatttgctattatgcctcttttttttttgtaatgagaaatcagagccctacacgtggagtaaaaaaaaaaaaaaaatcagggttttccttctggctccacacatattagctgtggattttaggtaagtgattacaattctctaaatttcacattttcaactgtaaattgagttattttaaggaaaatcatgcatatggacacatgttttaaatgtttagaatttaacaacctccaactcattattcacttttcacatagcaggaaaaatgcaatgaatcctataataaggcactcaattctggtttttgtcacatgtttatatctgctccaacatctaggaccttgtgccataagagtagttaaggcaggttacaaatatatagacattttaaaaataatctaaagcttttggtaaagacttagacaatcacatatattcagaaggggttctgtggttataaaatgtgtgttcagactgacaaaaaatctaatgtataacggaaacaggcaggcttggggtcaaaggtgataaaatcccaggccaccttgatccagtgcatataatagaaagcagagtaaataatcagtataataaggatgattttgtttctttcgtaagactaaccagtagtcatgttgtatctcatgagtgtttctttttcctatagtcttgagccctcagttcaatgtaggcatcagagaaaacttatagaaatctgctgaaatagaaacacccccgtgttctattctatgtcatgtgtgtagatatgtgaaatgataggtctatttttcacaattattactttaaaacctgcccattcttcaacttccactcactttgacttcagcagaaaatgaatattttgatagtgttccgaaattatttttgaatgctccctcttttatcagcatttgcagaactgagtttttgttctatcatggtataagccaatatttgaccaattctttttcacattccaaatacctgtccaccctagccttgcctcaaaagttaaaatctccaactcattttaatccagatgatgaatgaatgctggaatcctacgtaagcccaacatgatcactcaggaccccttctagtctctccccatcccatgggattccaacctcctctccctagaatgctccctgaccccagcttcatagtttcatactctaccttgattcctctccaacactgaatttcttcctgtttcttctccctgcacatagacaactgtcacacagtttctggcttcttagggtctaccactgcccaggaaaagtcctttcctctctagtcagcctctaactgtgtcagctttggcctttcccaccgccccctcatctgaatggaattccccttaagatataaacaccatcaaggataaatagacagaaatttagagattttaatgaatacttggataaaatgctgtatcttttcaggtttgactcccactgtcaacactgttttcatcacatgctaatttcttgcaatgcccccacttcctaaccctcaagctgtgctttgctcaagctgttctctctgtttctctatcaaataggaccataacagatgctctttcaagactcttcaggttacagcaaactttccttccttttgcttctcatagcatttgatatttcttttagtatttaatgtgttctgtcttgaatcacgatggtttttcttgctcctatagcagacaatgtgagctttagttcacagggacataatcctcttcaatgctttttatgaagccaagcaattcagcgcccagtttattcttgtttaaataaatgtagcaataatttaagtcaaggaaacagcaaaggttatgtggtgagatagaactgattgacagtactgattcagtccctttacctgtatgaacttggacatgctatttaattttgttaaaaatctctttttctattacattaaactgggagcaataattctcacattaaaaatgtttgaagattaagtaaaatgacaaaaattacttcccaaaaatctttgtccttctttcaatatcaagtttttcctacataattagctaacagatgatgtatggtaagtttaataacaaataacaaccattcatttataggttgcaagcaaattttgttcaagatgtaaatataacattgtggatcacataagttattcaagaaaaaatattttccattctgtctccaactaacacattccccttcttattttctattccacaccgttatattatacaacgcccatgcttacatgtttgatttactaataatgtttgtaaaactgtgtaagttaaaagtaaccacttacaaggtcctacagaataattatgtcaagacatcaaatgaacagaatagaaaaacagaattgtccaggacacatggagaaataaacagtaagtattttctggaaaatcatttgaattatctaaatttctgatttgtcattcactgacaattttctccctgacctttggcacgccagttaacctctctgagcctcaacttcctccactgtacactgaagatacgtttactatacagactaggagcattgtaatgatcaaattatttaacagatatgaaagctctttgataactacaaaggcctataaaattatttgagattatttcttttcacagacaactttgatattgtaactttaaaggcttctacattttagtatgacatctgctcagaataaagttcttgaaaggtaaagaatgttatgtgattcactcagaaccgcttttgctcccatgagctttacttgccaaatgcatgctttccaactcaagtaggaatacagcacttggtagcactgtatagttaatataattacacgataccataaccataattcatcttcactctgctctttgcagatccctgtttcctccttactgctctggctgagataacccatgggtgaatgtacagtcaatgagtgaatgctcgttgtactcagccactggtctccttgctgttactgaaacacaataagcatgtcccatttcaaatccttcacaatcaatattccttgttcttgaaaatgtcttcagtaacatattaacatggtttgatctcttatttcattcaggttactgcttaaatgtaactacctcagagaaagctcccttgactaccttacataatttagcactacggccactttctaaccctttaccttgcttttgttttccttcataacttgaccctttctggcattataacacatatgaatttgtttaagcttcttgaaagtagctaccatgattgctatattctcttcgtattctcaacagttctgggaattaaacaacaaatcgactccaacaaaataatttggtgaaaatacatcataaaatctgaattttttcttcctgtatatctctaagttgtgatcaaatgggaaaggcctctttctttcttaggctctcagtttctctaaatgtaaaaaagaaatgccaaattacacaatctcaaatgtcacttttgtcttactttatagctatattattcatattaaatacataatgtattaaaattaaagagcctatataaaatgttgtttcttcaaaaatagagctttcctaccaaagaaatggtggtaatatattattatttaataagcaaacaaagaaaaattaatcagagaaatagactttgctattgtgttagtaattatgactaatgactctccatatggtatgtagaaattattgaattttcaagcatatgccagataaaaaagggcctctgattttggttctatctttcccacttaaaaccccaaatctaaactcttttttttttccagagggagtctcgctctgtcacccaggctggagtgcagtggcacgatctcggctcactgcaacctccacctccctggttcaagcaattcccctgcctcagcctcctgagtagctgagattacaggcgcctgccaccatgccttaatttttttgtatttttagtagagacagggtttcaccctgttggccagacgggtctctaactcctgacctcagacaatccgtccaccttggcctcccaaagtgctgggattacaggcataagccactgcgccaggtctaaactctttttaatgtatataaccaccttctctgtttgctgtgccaccttgtggattcagttttgtgtaagaaagaaaggaatcaaaaacaactggggaatcttccaacacaatttatatccaacaactccagagacagagtcctttcggttattctcactggatatttggctgtgaagcttctgatttgctaacttcattaatggcctttagatggagagaacttgaaaatccttgctataatagctgctactttgctaactctgttgtcacgcataatgatattaaatcaagcaagagaaatattgttttccatcctgacaagaggcaaagaaaatgccaaattacattatctcaagtgaatttttttgaaaaaaaaattgggattgctttgactagaacaagtctaattttataacttaaaaaaaacaactctgcagatacggaaacctttgtctacacacttttgaaataatttttactggaaaactactgagctgattcctctaaaaataaaggttctttgttaacacattctttgcaacatctgacaaggaaacaaggtaaatttataccatcataaaataatgcaacctgtgacgtactggaaatgtaatgttggaggtagatggacacaactactcaatactcaaacccttgatttttgaccttgagcaagttacttaatttctctgaaactcagtttcacatctgtaagttaaggttaattatatcatcactgtaaggttgattttttttttttttttgagacagtcttgctctgtcactcaggctggagtacagcggcacaatctttgctcactgcaacctccgcctcccgggttcaagtgattctcatgcctcagcctcccaagttgcttggattacaggtgtgtgccaccacaccgggctaatttttatatttttagtagagacagggtttcattatattgtccaggttggtctcgaactcctgacctcaagggatctgcctgctttggcctcccggggtgctgggaatacaaccatgagccattgcatccggccaggttgtgattattagactagacaatgaaggtgtgtcaagcatgtagtacctgacttattactcactctccttactcctggttacaatttcaggggaaaactgatatcacaaatgagaatgcagtagcctgagcagcgggcagagaaaagtcactgtagttgtggatccacataacgtgtcatgaggatctcttacctgtgagaggttaattaagattatcttgcttaaggctcaacttggtcatctatatatagagaacacagagatatcagatcacttttctttctctggtagaggaatttggtgccatcaattggagataagtgatgtggtaatttcaggttcttgtcacctcctaatgaggcattataccacaataccactggactcagcctctagccagaagactgtaagtatagaagtgaggtgggagaaagccagtgggtgaggggtatattatattacaattcactattatcatcaaaataacttccaggagcttcaatgttttagagacgacatatctagagcagatattggaggggcagcacaattctccattgaaaatgcctttggttcttaccaagtgaacctgtgcacaatacgtaatcatgtgtcccactatgactgaacaggaaaatcatggcaagatatgtgcttctagtgcctcagcctctgtcttcctttcttgggataaggatgaaagtagggatgttgtcaaatgcacatatttcaatttcaacattcttctgctttttggaaagtcacatttcatacactaaaaggtacgagaaattatcaactaaggctaaaaaatatattttttacatgaaatttcctaacttttaaaacttctgtatcaactcccatgaagtcaaactaactgatatcaaacttaactttccgatgtaagcaattataaaactggacaaagtatatgaggtagaagtttccaggcacttgtcaactggaactgtgggtgtttgatctttgagagaaggcagatacacaggaggtaagcactgtgtatttgcttggctctgtgttggttttcttgctttcttcaagggacagcactgtggttttgtgaagctgaagaggcagaaactgtagttcgagattgctaaggtgacttgaatttgtggagcaaggtgccagtgaaaaagggctggatggaatgaggggcaggagactgtacggagatctcctgtggatcctgggtttacagagagaaaagcacatgctcaggatgagactcttcaaggcccagcatagaatggctgctccaggattgagagctgaatggagatggctgtggctgtgtagggctaggatatgataaacttccgggcaagtcagaaagcaggggcctcactaagcaaagagggcattcaatgaagacctcagaaaggccacaggttcaagttaatgaccacaccctaagtgagcacgtcctcatcccccagattaaagacagaaccaaaacagtcaagacaagacctacacgcacacacacagacacacacacacagacacacacacacacacacacagcatgacaagatcaagaggatttattagttattaatccaaatgccagaacaaaacacacacctgtatcagcagataatgtaatacactctacaatgttttttataaatgtctaacatacaatatcacaaaacatggatgcaagcagcacgatgtaactcatggtcagttacgcagatagtagaaaagatcacaaggtcgcctagatgttaaaattaagagaagtaatttgttttttttttttttttttgacacagggtttcactcctgttgcccagactggagtgcagtagcgggatcactgttcgctgcaacctccactgccccagctcaagcaattctcctgcctcagcctcccaagtagctgggactacaggcatgcaccaccacaccctgccaatttttgtatttttagtagagacagggttttgctgtgttccccaggctggtttcgaactcctgggatcaacccacagtgctgggattacagacatgggccaccatgctcagccaacagataagaactttaaaacagccactataaatatgttctagagaaaacatatctcaatgaaaaaaaagaacataatgaataaacaataaacagcagaaaaaatataaatgatttttaaaacccaataaaaatttaagaactgaaaggaaccatatttgagggaaaatattactggatataattaattataggctggatactggcacatataaacaactcggtatttgtgtgtattatgtatgattggaaaatatcttgaagcttacacaagctggtaatagtgttggctcctgggaagggatttggttggctagggagcagagatataagaaatagactttttttttttctacatgtattattacttcaagtaatgaatttaggggaaaaattctgggtcaagtacaattaatgtactagttaaatatagactacagacctccaattactaatagggttttatttcaaatcttataaaacatatattctgaagtgcaaatttacttacccaggctcacaaaacaaagatgactataaggatataccataagttttcctaatcccatataaaagaatggccccttcctctgaaaaattactgaaggaagaaaatcaatgaagaacccatgaaataggcaatctctaaatggactcgttgagtataggagggaatgagaataaatatgtttacttaccccatcgtctatgtcctgcttagaccaccagaactacactggacctcagtacaagggatatatattaaagcaaacaaactcatcattctttgaactctactcgcttcatttttcagtattttcatgactcagatcaatcccaacatccagggggccctgaaattcctcctccaacactacctaattttctaatcaaagctggaatgaaggatgtaggctctccagaagatgatgacatttcacctgcgaatatgcagtaaagggcttttattgggggtcttatgttcctgtaggcatgacataaaattatgcctacggccatggggaagaaacaactccagaatttgtttgtgttacttgtttgctcattgggtttaaattatacattcatctaaacatagacttcctgcaggtgattacaatgctcagtgactgaaacatttctcagtgaggagagactataatggtcaatgaaggagaaacgtggactgggacgcagcatgtggtgcagtattgctgagatattgatgtgagtacagcagacacctcaaatcctttttatggatctggagagcatgtaagattttttttttttagaaaagcaaagaagccccaacaacatgaagatacccagcagtgagtaggctgagatctgacatcatatccttagcagagctagaaacgcacatctcacaggtgttttctgctcagactcaatcaagcctgcatggactgtcactccagccacgttcattttaacagcctaaagagtaatctgctagataaacagttctgatggcactgaaaagccggggctgtgtttttgaaaaaaatctttgctgcaatgcttcttgctgtgatggtgtgtcctcagaatgagaatgcaaagtaaacacctgcaccaccaaagaagaatgaagacagagaggcctggttcactttatgctttatttctaaagtcccaggaatatcatttacctgtatcatgttttggatatactaccatttggacaaagagatcacaagtacacttgtttaatttcataaaaggtactaaaaagaaagttcataagctctgtcctcatcatagaatccttgaaatctaaaattgcaaatatgtagtttgactcttcactttacagatgaagaaagcaaggctgagcaggggaaggaattaacccgatcaagaccatggcgctaaataacagcagaataaggattagaacctgctctccagtccaggggtctgccctctctttgccacagtgggtgctttgcttatgatttatgcgctttcgtagattaagaatgattagctaaaatagacttttataatccaggcatggtggctcacacctgtaatgccagcactttgcgaggtcgaggtgggcagatcacttaaccccaggagtctgagaccagcctgggtaacatgacaaaactgtgcctctacaaaaacatacaaaaattacccaggcatggtgacaggtgcctgtagttgcagctactcaggagactgaggtgggaggatagcttgggcctgggaggcacgggttacagtaagccaagattttgccactgtatgccagcctgagcaacagagaccctgtcccccaaaaataaaataaaataggcttttacttttaattcagcatattttccattaatcaaatgactgaccaatgtgcttcggttaatataatagttgttttcactttgcttaccgattagagtgaattctctgcttttagacattttggctgcaggtaggaagttatttgctcttgattccataaagcagacactagtaatgtaagagctggcaaagggcaaaaaagggtgattctttttatatgaacaggataaaaccagagtaagcttgaccgatggtctgaattagagatggtgaatggagaaaatactgtatttttcaaagtagaattgccatgtgtgggcaaagggaacaatgggtgaaaggtcaggggaaggccaatccaactctgaaaatcaatagccgtactgctacctaatgatgctatcaatgcacattttgagttcatttgtgattcagaacttatgatttgatcctaaagtaattttctctagcaaactgaaagttggcaagtgccttcctcaaagcatctttgcagaccctacaaaaatggtaaagaaatgaaatcgttctccaaacgtgttttatctaccaattttcccatttacagtgttggattacaaatccataaaaagaattcagatatatgtggataatttacattctctatctttaccaccagattgctaaatcacctcatatatgtgcctccatctcattagggtacttgatatatatcttatcacttctcacagatttcattacaatttatagttatttcatttgttgttactactgctgtgctttcacatgtggcaattcctcccacctatatctgcaaatccaaatctctcctggtcttaaagatctagttcaaattcaactcccttcacaaaattgcctctgatcctgtcatctaaaattatctctttctcttctgactcccgtcatagctatttatctgtggctgtcttaacataatgatcactttgtattacatatcatgtgtatttgcaatgatgacatactatatagaactcacttgagaccccggcctctgtcttatttctcactgaaataagatacttgcacagtagctggcatctgacacccagtagctcctccataactgtttgtaaatgagctaatgaatggaggagtctagcctgttccatgtcgggagtagtttgatgaaatagcccttgtaacggcttatgaagcctattacagatagcttccagcagtagactttctacaaatcaacatagctaacaaaattcagaacttaactcaactgtttacattttctttttttttcatgaattttttttttaattgaaaggtaaaagttatagctaataggccaggcgtggtggctcacgcctgtaatgccagtactgtgggaggcctaggctggtggatcacggagtcaggagttcaagaccagcctggacaacatggtgaaaccccatctctactaaaaatacaaaaattagccaggcatggtggtgggtgcctgtaatcccagctactcgggaggctgaggcagagaaatgcttgaacccaggaggcggaggtggcaatgagccaagatcgcaccactgcacttcagcctgggcgacagagcgaggctccgtctaaaaaaaaaaaaaaagttacagcgaataattaatggatcagtagcctaaaaaataaccatttaatttttcagaaaatattcactcattggtgaaagagagagaaaaaacattaaaaaaatataaactgaagcatacaatctcaagaagcctataatatgagagaataaacacaggtatgattcaacctcctcttcacattctatgttagtttacaaaagatagtgattttatgttgagtgtaagagatactatttttttttcttgaactgagaaccaattgtgtagaaattcaaatatatgttaacttgataaatgtcattaacatgtatgaaccaaagcaaacagatggtattctgggacctggagagtataaggaaaatgcgaatacttcttttctgatgttaatactttgagaattacatgtgaatcacttaagagtaaatccattgttttgatacattctaaaatgtcagggttcctgttcagttcatgactacgtggtgccaccatcttgcataaagccttagacaaatgctgtttgataaatacttagtgacatgtacatgatttattcttatatatgtggttgtgcacatagtaagcctactagaaagaaggctatctacttcctttctatagactcattctattaaagttatttttcaggaatatcgaatgaataaacaatttcttcttcagatcatcaactacaaaaaccatcagttcattttctcttacatttgtgtgtgcgtgtgtgtgtgtatactgctactttatttgaaaggagaataattttgattcatttcctgttttgattttcatgctcttgcaaaaaaataaaataaagaactgcgttggcagtttcaagaacaactgaaaaatctattgtttagtatgagtcatgtctcctcttgaccttaaattcttttatctgcctaaacttcagttttgaagtttgaggttcaattgttgataagcagttagtatttgattttggttccccctgaaatgtaccaacacactcaaacatagtctgctcttttcagatattttgcagcttggcatttttaattctcttctccttagtagaaatctgtattagtacagatgaagctgaaaggaagcttggaattcttctaattggaatttcatcattttataaaaggaagccaacctcactactgtttctgttctcttaacttgaagccaagtagcagaggggtcacagcatctcatcagtttagcttgtattcaacatgaatagaatctgaccattttccctaatagaatcagcatgcaaatttctagcattcaattttgaaaagctgtatttaaaactactgtgtgggagagcagaacaatatgtgaaggagatattatgctagagtcgacgagttttagtttctgacatatatagtctttttttgagcaaaggcaaaatttatatagtatatcttataatttatcataaacaggtcagtaaaaccataagcatatttttgcctgcattctcaacttccacatatatttttaatgtaaaacagctataaatgagccagtccaggtagaaagagaaggttaatgtgaagttgaccaaacagcatttgctatttaattacacgatagacactaaaataattatgtaattcatgtagtcttttagctaacacttaaatcctgtccatgttctaactggttaatgataaagagattaataaacagtttttgcagtcaaagaatttgccatactgtgaggtataagattaagtgataatgcttccttcttgaataagaatcaggaccaaggagagcttcctgaagaggctgctttggattgacccttgaagaatgtgtaggaacttggaagcaaatgaagagagataaacgaaaggagagagagaaataaatagaacagatggaaagaaaaaagaaaaaagagaaaactaagaaaagaaagtgaaggaaggtgaagaaaggaaagaaaaaggaagggaagggaaaaggaagaaagaatagtaagttttcctcgacatggggggtcaactgtggttaccatatcacggaaataaacagtagcagatctatgtattaggaaatgagaacggaaagacaagtgaggtttagaaagtggagacattcctattctagtcccaggagtttcagagacattccagtgaaacagagagccaggaaagtttcctaaggagagtagtggcctcatgtatttattcatcaatgtattattttattaatccaacatcaatttataatattctaataatttcataatcatgtgattctaagaatgaaatctagaattcaaagaggtactagtgagacagcttgaactaaaagactgtccaatggcaggaattctaagcataggacctccatactctttgctccacaaaactcagcacatttcaaattatgttattctgtcctctttacaggttaatggggattacagattgaaactacgcacgtgtttttgtgtttccattttcaggttgctttcctgaggtggtacttaacctccaattagagaatgccgccactaggtggcggggtggtgacttggttccaagaggctacagttggtgggaccaagaaagggagggttatgggtcccatgattcttatatctatttcattttttctttcaaaaactgcagtggacagttgagaaataagcttcgataataagtttttagaaacaactaagtgtgtcatgtgatacctggatgacaatacattgtctgagaaatacagtaagacaaatgaaaactctgggctttgatgcaagacactgagtttcaattttgcctgtgccatttattagttgaatgaaaagcagaaagttccttcatttctatgagcgttggactcatttaaaacttgaatcatcatacttatttcacaagtctgttagaagacaaagccatgtggtgcaatgtgctttgaaaagaacgtgggtaaccacctagatatgatccacaaatatgcctgatccaatcccaagaggtttttcaagttcacaacatttcacatagaaatgtaatctctaatttcttatgaaaaagtctgaagttcaggtaacacttcatcttcattcctctgtctaagaattagctggagttacgtgacccaggctcccctccctacacatgagtgtgctaacacagatttaggggaaacttgcctgggactccggcacatcaatgtcaaagaactacttgacatttcatgccagccgcagcttgtaggcttcctcagcctcggtttcatggtatctccagtcctgtttaagccatctaaaaggggcttttttgatttcctttgatttatttattctcctttcttcctttacttcccatacttggaggaatccaatggagaaagacaatattaattagataatctttaagggagtcataccctctcctgtgacataggcatgcttctcagttccaaaataacagagaaatttgacctctccaaacagaaattagctggcgactgaatgcatttatgttagattaaaaaatgtaaagttgacgcacctctctcctctctttgccgtctgttacaaactaaactgtgccttctctcaccccaaaatttttttgttgaagccctatcctcccggtacttcagaatgtgactgtacttggaaataggacctttagatgaagtgaaatgagctgttagagtgggctctttccaagctgactagtgtctttatcagaagaggaaatttggatatgcacagaaacaccaggcatggtgtgcacagaaaacagccacatgaagaggcaacaagagagtagctatctggaagccacagagagaggtctgagggggaaccaaccctgccactttgaccttgaacttccaagatcaccataaccacgagaaaatttatttctgttgttgaaaccattccgtctctggtactctgttatggcagccttagcaaactaatataccgaccaaagaggattctggtttggctacccagtccctccctttcctctttcctttgagcaggatgttttaaggacttttgtgtttgacactcaggagcaaggggggatggtgggggagactatgtgaaacatagaaggtcaaggtggaattgtccactttttaatggatcaggacaaattgaaaaaagcatggaagcacttaaggtatggcacatagtttatgagagctaaggaaaagtttttttaaagttataagaaatataaaaaattattttgaaattatgttgcatagactttgcatttttatataacttctctaggatcaaacacagtggtcaaagctttatagttattatataacaatacatcttcccataacaagcatacaaacaaaaacaccttttataaattgcaactagtatgaagttttatgtttcaaaaattccttatgtttcaaaaactattttaaagggcaaatgattaattcattgaaaatattttaaagcatccacattttagaagaaaatttaatgaattatttaacagagctacaatattctttttatataaaccaactatacattgataattaaaatctgacaatctgtaagcccaatactctttttttttttttttttttttttttgagactgagtctcgctctgtcgcccaggctggagtgcagtggcgggatctcggctcactgcaaactccgcctcccgggttcacgccattctcctgcctcagcctcccgagtagctgggactacaggtgcccgccaccgcgcccggctaattttttgtatttttagtagagacggggtttcaccgttttagccgggatggtctccatctcctgacctcgtgatccgcccacctcggcctcccaaagtgctgggattacaggcgtgagccaccgcgcccggccccaatactctttttgaattattctttataaatctcaataggtcaacatctccccatgaaaagaatcagaatacaaatgatgtgataatgctcgtgaaatggtctttcaaattataaagtatcacgtatgtgcaacggattattatttatgacccttatctgaagaatgatgacttcttcaaaagaatattcattatttctgtcgatttctttaggctatcctaagagtgagcctaaaagaaaacaataatagatcttgtataattagacaagatattgtaaggacacctctgtaatttttcttgaaggtacatctttcccatcagtacttttagtattggtgactaccctgacataatatggagaagtattttcataagtaaaataatgaagttctacaaaactatgaggacaatagaaagatcagtggtggccagggatcccaggggaaaagtcaggtgaatccatgaaaaatagaaaatttttagggcagtgaagctactctgtgtgatactataatggctgatacatgtcattatagatttgtccacactcgcagaatgtaaaaaaccaagagtgaaccctattgtaaactattgactttggttgataatgatatgtcagtgcagggtcatacattgtaactaatgtgccactaatgcagaagatgctgataatgtggaggctatgcatgtgtgtttcagggagtatatgggatatctttgtaactttttctccatttttctgtgagcctaaaactgctctaaaaatagtctttaaggccaggcacagtggctcacgcctataatcccagcactttgggaggctgaggtgggaggatcatgaggtcaagagatggagaccatcctggccaacatggtgaaaccccgtctctactaaaaataacaaaaaattagccgggcatggtggcaggcgcctgtagtcccagctactcaggaggctgaggcaggagaatggcacgaacccgggaggtggagcttgcagtgagcagagatcacgccactgtactccagcctgggagacagagcgagactccgtctcaaaaaaaaaaaaaagcctttaaaaaactaataacaaagccctaaacaaatagcagggataaagaaagatacacagagtaggggaaaggttccccagaaaataagagaattacactgaataatttttaagttcattttatgtgtttgtcacataggcatgggataacatcgtgtgcctttcaacacactaagcatacaacagtggtaaaatctggtgctctggcataaaccttcaggacaaactctagagaaatcattcttcaatctcattggatccaaaaactttaacatgctaaatgaagatctgtcataattagagctggaagtcttgctctcctaactttcacttaatggagaaataataaaattattactagcttcatacttttcttacaagttgatcaaaatggaactatttagctgttgattatggactttttggtagaaagggaaattatctttctctcattgtctcttaggcttacaaaaatttataagtattttattttattcaaattatatatacacatttacacatatacttttcatagaagaaaatttgtaagattttttgttcaaatcatatatgtacatataattatatatgataaatatataattatattacatataataaatatataatataaatatataattacatgttatatataaattatatatatacacacacagtggggcaggaaacaagacagatcttcgcacttgaaacaggtttttaatataactagtaataacttttttcttctctccacacttttattatgcattctttccctgtggaattatagaatcacagtattttcaaacttaaaagggagaacatttgatttttacaaagaaataggtcctgagtgagacaatgaaaaataaaagaagtgtctttaattctatattgttgcattaagtctgccttcaacaggtatttatgaatacctgcagttattttttattcatataatacatcagcgcatacatagcatatcattgtgtaaatacagcattgagatgtttgttattttaagtaggaagcattttgcatcatgaactgtcaataaaaatgaaattaatgacaatatataatcatgtaagcagcagtgtcaagaatacttttagcacctatactgagtgaaatattgttgctgtaattgtctttttgggaggtaggaagaacatagagcaggacaagattcgatccaggtagaacagaagttgggtatcagtggtctgggttctcaagctcacttctttcagagaccaaaaaaagtttcataaatgccatgtgtattcttaaatattctaaatattttaactctgcccatgatatggtttgacttacttcctggtctcgcttgccttgctctagatctgttctggattgtcaatgttcctattaaaatatgactccaataaaggaatacatactttagatataatctgatctgaggtgacaagagaacaacttcaactcttatgccttggatatgatactgccacgatcaccccatcactgtcttggactccaacactggactgcacagaatactcagaagggtgctcattttcttctacaggtaataaaggactcactcctcagcagtgatccaagtttcttttccttttaagtaggttctcataatcagcttcctttatcagcagccctaacattataatcatcaaatttatttgacattctcttaccaaacatacctcttctcttgaagattaatgattagagttactttggttaaaaatcaagtatcatttccagaatacactctatagtctcaccctatgtcatcttccattttcaacatcactggtcaataacatgactctatacctatcttggaatgattccccagtccttactgaaacacttttaaatactagaaagcagccactgtcttcttttttttttaaggatatttttattccaaatgcattataatttgtatatgtaccatcagcgtgattctcaggaatacttctggcctgtcctacaaagcaattacagtcggctcatcttcgtgtacttgagtttgactgtgaataaatagctttctcaacttttctttctaccaaatatacatactgggccagcagggatgtgtagtatgtagaaaaaataaaagcaatatttttctagctaaaacaacgtcacttctccaactcatacagccctgtatttctggtcctaacataatgttcaaaaataaatctgagcggttttaaatgtaggcacatattttataaaatgcatagctttctattccttcaagcagctgatttatataaagcagaaatccattcacataggtcagaaatttgtaaaatgtatgacaagagatttagctcattatgcttatcttgtggtctgcccaaattgttaaagcttgtgcctcaaagtatgctgagcctctttggcacactgacccagtgattagtattttctcacccagtgcaaggataatgcatacctcagaggatcaggtggtaactaaaatcattgaatcaggctgagtgagagctatgaaactctggagattctcatttctccacttacaaaatgaaactgtggcttagagtctaattgacactgataataccatagagctatacattcatattactctggatgaaattttcattcacagcactaaacatctgggtatttccacatggacttattttcatatatatttagatgtttgacaacctaaaaataaaatagtatatacctggtggaatttttctttctgtccatgactatcatatggatggattcagagtgtgtcaagtttttcctgataggatactcatagaaatgtaactttattaacagtttaaaaaccaatactatctttgaaacattgtggagtctattcactctacctaactataataagactttttaaatgtacgcttttttagtaaggaatttgatcatttttataacatatttttcagatttctcaccaataaaaaattaaaatacagtgcaaccaatattaaatgttaaggcttaatttaactaatttatatagcaaggatttacaagatacctgctttgggtcagatatcgtgcaaagggttgtggtaaaagaagcatgctgactgactttgtcctcaagtggtttacagtttaatggagaaaagcatctccaccaagtattctgtctcccattgtggttgtcttggagccagaactaggatgcagattggcagtcctatacgtagcccggagggcccaccaattgcttacctctttcaacaaaggcatcgtgaactctcattttgaagtgggaacaaaacaaattttttttatatgtaatgtatcattggccttttgtgttatttttcatgaggattttatttcaactaaagtcgttaccatttaaatgatcaaagagaaaagtcagagtccatgatttttgttacacgtttataatgacagatacagttatacgtatttatcgtgtacaacatgatgttttgaaatacagtcatgcacctcaaaacatttaggtcaaaaacagagcacatgtgcaaatggtggtcccataagcttgtaacactgaagtttttactgtaccttttctatgtttagatacaaaaacacttaccgttatttacaattgcctacattattccataaatggacaggtttgtagcctagcggcaataggctgtgccacatagtgtaggtgtatagtaagctataccgtctagttttctgtaagtatactctacgatagtcacacaatgaacttgcaataatgacaaatttctcacaatgtatccccattgtaagcaatgtataactatatgtatatacatatacacatttcacaatgtgtgtgtgtatatatatgtatgtatgtgtatatatgtatgtatgtatgtatgtgtgtatacacacacacacgcacacacacacacattgtgaaatggttaaatatacctaagtaacaaatgtattacctcatctagttatcacttttgtggtaagaccacttaacatccactttgcatttttcaagagtacaatatgtcttctttaactacagtcaccatgctatagaagagatctcttgaacttaactcctcccatctaactgtattacatacactttgaggaacatttctccattcccccttcccccaaccaccccagcctttggtaaccactattctattctctacttctatgagtttagagtttatagattctacatgagtgcgataatgtggtatttgtttttctgtgtctagcttatgtcacataatataatatcctccagtttcatccatgatttcaaagagattggcactcccatgtttattgcagcactattcacaataaacaagataatggaatcaacccaagtgttcctcaatggacggatgaaaaaagagtccatcaactttaaaagacacaaaagactgttccaaatattaccttaaaaattgagatttaaaaactaatctgggtaaatagcacattttttaattccttgggcaaagtttttaaatgggagtgttagaacacaacaaaatgtaatgctctgaaatgtaaaagatcattataaacaatagagaggtgagatgccacttttcattttttagccaatacttagagcttattagataagcatatctgatgggacagtagagctttttaattgcctgggagacaaaaaaaaaatcccatctatgccataaagctgtttagcaacatgtttggctgtaaagaatgtgaaatgtagataaaattaataactaaaatattctagggtgtaaatttctaactttccgtcaaaaataacactctaaatgtgaaccatcaaggtagacgtgacagcattttgtagcattctttccaccatttaaatctatttagtttttgtgtgtgacaatttgacagtcttgagcatacaaatgaagacacagggtaaaattatagattcagttttcagagaccatatttgcaaagacaagtatttttttttttcagcaagaaatcaactaagcagtagttacagaaaataacttaataagacagtgaacagaaaaccagtatctacttaacagactcaggaaagagatcggttatgagatgcttggggtttctgtttttgttagataagatgtgcagttaccagaaatctaaggaaaggtaagagccccctcaaagatttcccttagaattaattatctaaaaattataatggattactgttcctattgattgcttagatttggcccaccacaatctctgattcggcagtacatgtgcaattttctataagtctttctggaaaatcctagtataaaaatgtatttttagtgatgtttgttttacactctgtattcttctcggtgcctacatgaaactctatagacagttactgtgaacttcaagatcaggcaatcagtttcaaacacgtatcgtgtgtccttctgtactcatttttaaagatgtttaatattcagtgtgaggtttttatattggggataaaacgaagtctgcgttatatgaaatttaattttgaaggtaacgacatttgaactgcagtgttgtgttgttatatctccttttttgtctagcttttataaaatgatctagattaagtaccataaagatcataaggaccttataagtccctctgcatttgaaacagtgaagggaaatgtgttgctttcacatttccatcctatccaaggggcctctacagtgcctgaactcaccaatgaggtaacagatgaagggagaatagtgatggcctttacaaagccctcctgggggccggatgtggtggctcacgcctataatcccagcattttgggaggccgaggcgggaagatcacctgaggtcgggagtttgagaccagcctgaccaacatgaagaaaccccgtctcttttaaaaaaatacaaagttagccgggcgtggtggtacatgcctgtaatcccagctacttgggaggctgaggcaggagaatcacttgaacccaggggacggaggttgcagtgagctgagatcatgccattgcactccagcctggggaacaaaagcgaaattcctcctcaaaaaaaaaaaaaaaaaaaaaaaaagtcctccgggggtcccgagtgccaaactacaaagccaactttttttttttaacttcttctctcacaatatcagcaaatttgctgtcaacaaacttcttaactttatagttttgtacaaattttgaataaaagaaagaccccaaaggatccagaacggtgcatccattctaaaggcagagagctgagtattttgtattctgataaaaagatatgaaaagcaaatgaatcacataaataggattaggagagaatgttcaacttttttatgaccaaaatgttttcaggcacttgaaaattagaagcaaatgttcactgatggcgattagggaattaatggcctttaaaactgacaagatttttttcattgctttagttaatatctattttctaacctttaacctgagtaaaaaagaatctgtacattagattgagcataaaaaccactgagcaaatgaaaaaaaaagctaaaatcagtaataatgctcactaaatttgtaaatgttgaaatgctgctttacctttcatgacctcacttattcagccatgaaaaaagggtgagagaaggaaggcagcaagataatttctatatctgttctctaggtataagtgcctatgagtctaaaatagactgctgaggatattagaaagatttcatgaaaattaagatttggggaatataaaaaagcttacaaatctgatgttctccaaattcctgaaatttgtaattaccaatatcatgacccaactggttagaaatatgtaaataactaaggaatgttttgaaaagtcctaattattacagtgaagaggtaaataaggtcaacatgctagtgtccaccatcaaaaggaaatttcatgttgtttactcagcttctctggacactaccagagacacagctcttagtggcttttaaggtagtttcttcatcactgggcaatagttcattaacagactatcccaaacttatataatcttttcattctggaaaattttacacatgtgttgtttaggttaatcaggagaaacaaagactaatcagaataatctttagtagtaagctaatttagctcttctcagcaccgtttcaaggaagatatgtgcaagatgtgtgaacaaatgggaaagagctgaagtcagtaacaatgctaactaaagttgcaaatgctgacatgttacttcgtctctcttggcctcacttattcataaaatggggcaaggggagaaaagggatgagataatctcagatctgttctatgtctaagagcctatgagcctaaaacagaatgctaacaaaattgaaaaggaaaactaagtagtaagtgtactgagttgtgctcctgttcagtctttttctattcaacctccctaacgtttcactcaaggatagcatttcatgtaagacatacatcataacagttcagatcagatgtcctccgtatttgagatttcttactttcttgagagggaaggagatgattaggacaaagaaacagcattgtctgcaaataccaagtagcttagtgaagccagctaacaaatggaggccaaatgtatatgtggccttctttcacaagcaggccaataaatgtagaaacctcacctaacctgcatttggtttgagagccagtgcatgaagtttaggaataaaggataattatttggccatctgagaaaagctaaatcttgtaagtgggtattaaaagatgcaataaatgatattccttgccaatctgaaaaggcaaaaaataaaaaggtagtctagctgtttatgagatctaactcctccctcctcctcccactctgaaaacagtgaagatgaaagtgattgtatcatacgccactcttacgccaggaaagctcaagaataaaaccatcacagttcagatggactaaagggtattttctaggtttatgaccagaatgattcatatatcaaaggccaatcatatacatgtacttgctcagggattttcaagtcgatttcttagagatgaaacgtactgctccctggctccaggaaacagagcaatgctaaagaggtaaatcaaaacagcaatagaaaggccgggtgcagtggctcactcctgtaatcccagcgctttgggaggccgaggtgggtggattgtctgagctcaggagtttgtgaccagcctgggcaacatggtgaaatcccatctctaataaaatacaaaaaaaaaaaaaaataattagccgggtgtggctgcgtgctcctgtagtcccagctactccggaggctgagtcaggagaattgcttgaacccaggaggcagaagttgcagtgagccgagattgtgccactgcactccagcatgggtgacagagcaagagtccatcttaaaaaaaaaaggcaatagaaattattcatgtttgggaacatgaagatattaaaatcataataaaatgagaatgccaatcaaacaggaataaaaacacttgctgtgtactgtttctccttctccagtttaaaccagaaaaacactagatccaagagataacatgtaatacattaagaaagaaactttcacgtaggaagccaaatatcctcccacattgtttcccccatatgtgtacactaattactggagcatcttcacatgccagcgattatcaaagcctcacaagtgtagactgcagtgtcagtgagtgcttggtaagacagaccaaactccgtcagtaccttgccatgtgatcctggacaagacatacttgtcctctcatggtcattaaaatgggagagggaatggggacaagatgctatctcgactctttacagcaccatagatttagtttctctagcaaggcctatgctccttaagtttatggatgtcacaaagtggttctgtattttatattatttgtcagaagattagtaataggctcccattagaaccagaagaaccaggcttttgtgtgaaaaaaaaaaaatgagtgagtaggctacctcagtactttaagagatggtaaaagtatcctgctttgacagccaggtgaaaaagctaataaaagcacagaaagttttcataaaggggtacagcttcagatgtctccagataatccctctgttaattgtgaagggtcatctgtagggggccactggtatatatctctttactaagttagctggttaacactggatccttagggaatgagatgatgtatgaatatggaaggagtcaaggtgctaagctgtactttatgttctaaatgtgtaatttcctctgctttcttgattgatctctttagcattgtcctgttttctaaagtcaaattttgacacatattggatggacaacagatttcattatatgtgtgggggaatggaaatggaacacaacaactgaaatggaaatattcagaaaggggcaggcaagggcaaagctttatcaagaaggtgtgagtggacacctactctacaggtctttaaaattcatttttatgcatttaattaacacttgccattttacaaaatacaatgtcaatgtgagttatttgacattatcctcaccacatctccatgcagtaagcccagagactacagtttagagaactgatatagctccaatcaggccacacatcttgtaacccgcagagcttgaataggaacccagtcttatattcatccctctctgtataccaccaccatcagcccataactgtggaaactctattagcctaggaactcattaaaatcatgtttacacttttactaacttaaaatcatatttatttaactagatgtctcattagcttattgaagtcattactgcctgtcagtcagagaaagcaaacgaatgaatattcttcataatagaagagcaagcaggactgtaattaatgactttgctaataacagccccgtgtttgtgcacattgattttcagatatggaatatacacataaacctctggggaacaatgttcttctatttaccaagaacaaatctactaatagttattaacaatacattctttaaaaggctttatttctaataatctcttacatatggatgtttcttcaatgtgaattaccaaattgactttgaacaatttatgctgccaaatttttccatttatctcattcagatgacaaaagtaaatacaccaaagattatttctatgcaaaaatgtcttaagtggagtggtatttgagatgggaccctgaaaaaaaaagtaaggtatccaacagaaagttccaatgcagaaggaatgcaagatgaaggaaacagcaaaagaaacagacagattgaggaagtggcacagttcccaagaacagagattggcccggtagctctaatgaaagcattagaggaaagatctaaacagagttttgatgtcaggctttggaaggtcatgagtactttgtctacatgatagcaaaatccaaatatttaaagccacagataactgcccaagatttttgtctccatttgtgtttggtcttaggcacagatttattatgtgcctgttctaattaatgtaggcaaaaacactgttttttaattgaaataagcactttctgttttcatacaacactgaagcaaatgctaagctggaagcttttatttttgtttttgacaacggtttctttaattgtaagggaaaatcaagaaaatatttaattttgtctcatatccgaatagtagaggaaaggccatattgttggaatgcagtgatgggagctctattattctccctatgtgaatttgcagcattagcatctctgaactacgggttctatcaccagaaagttgaggataccagtaattaccactttacttgcttagaggaatacaaattataatgtatatgacaaggctttgcaacttaaaaagtgctataacacagtgagcagctctctacgtgaagctgataaagactgaaaaaaataaggttaagaacttgtgattattttatatttattttctatatttctagtgcttgctcctgatatcaatgaagaaaagtgggaaatacagcctgctaaacagtgcttgatggtaaaaatacaatgctaaagcatttcattggctcagctacttttattttcaaaaacttcagtctatatataatattaggaggaaaagactagtcaaagtattgtttagattttttttaaaaatgtacttaaaagcattaaatatttgtgtgtgtgtgtgtgtgtgtgtgtgtacatgcacactaggtaaaaataatgttcttctgtagtttagaggactgatagaactaatttggtattttctttccttataagttgtagatttcatatgcatttgtcttataacctgttttttaccttgacctagcttaatgatccttctaaacaagatattctctagttaaaaggaattagaattatgtgaaattgacttgggaggtaaaactttattttcattcatttgcacatatccttattgaaaagtataaacaaagttaagatttggaaggccatgctaaactcttctgtaaatatcacatgtctatatgtctaaggatttggatacatgttgcatttgaagtagcttaggtgtctctaataaatgagtcagcttacaagcttacactcttttttctttacttttttttttttttttttgaagatagggtcttactctgacaccccaggctggagtgcaacggcacaatcatggctcactgcagccttgacttcctgggctcaagtgatcctcccatctgagacttccaagtagttcagattatagattatagattacagacttccaagtagttcagattattagctgtcacgcccacctaatttttaaaatttttttgtagagacagggttctcactatgttgcccaggctggtcttgaacttttggccttaaaaaatcctcctgctttatacttccaaagtgctagaattataggcatgcatcaccatgcccagcaatttactttctttactatgatttcaattttagacatgtcaggggcctccctgaataactgcactttttagaaataaaggccagtggttcattggccaaaaagaatttgtcgttaaaaaaaaagcaaatctgtccgatttattaattatgattgtgtgatttgatccaaccaatgatagatggcaaatttcacttttcaatttgtctaggtattagatgaaggtcacccaaaaactgagttggaaaaaaaacttgaaaaggaatccatctaatccatgtcttttagccccacacacggcagatctgagcaaaaagatgaaagaaaattccattttctttatcacagagcaaataagagtctcaacatgcaaagctgtacagcagaactttctctaatgatggaaatggtatacctctgcactgtctaatacagtagacacataccacatgtgactactgagcagtcaaaatgtggttattatgactgaggaactaaattttaaatagccatatttgtttagtgtctactatattagagagtgccactaaatattttagtcacactttactgaagcaagaattgtaaagtgccacaatccaggcagataaatatgctgcattttaataacctgtgaagtcaggttgttgccttttatgcaggtcccataatatcaggagttcactttcagatttgcacttggagccaggagtggtggctcaggtttgtaatcccagcactttgggagatcaaggtgggtgaatcacttgaggtcaggagtttgagaccagcctggccaacgtggcaaaaccccatctctaccaaaaatacaaaaatgagctgggcgtggtagcatgcacctgtagcctcagctacttaggaggttgaggcaggagaatttcctgaacctgggaggcagatgttgtggtgagccaagatcgcaccaagactgtactccagcctgggcgatagagtgagactccatctcaaaaagagaaaaaaaaagaaagtaagaaagaaagaaagaaagaaaaaatttgcactccttggaagaagtatgcacagctctgcttcattatctctgcatttctcttccttagacttggtcactattgattttctactctcctaagtttggactgctcattcctcctaatataaatgctgtctaagcatgtgttgtggaagaagtatcctctgttatcttttgggaggacaaattatgacagccattagaaaaaaaaagattaatctaatttagaaaatctcttagtgtaataggtctttaagtagatttttgtgtggtcccagaattgtagctaaatccaagattaaaatattcaaccttatccaccccacattctaaataagcttcctagaattagagacatctaccctttatagcactttctaagagattaaagaaataccgccaactaccataccatatcctacccccatgttaatataagaaaaggatgagagatgagagagggttttcttggacctaggtctttgagagacgcagcgttcctgaggacaatcaattcccttccctccttgtggattagttaggggaagggagaatatccctcctgcctgaagctaagtgaaggaagctccaagaatattatgcataaaacttaagtgcccagcaagaagagactagcatcttatccttagactgggtgcttgataaacagtagtcctgttggtgtaggcagagtagggagtgcttaagaagttcttgtaaaaatgtgacttgtgccacctcatgttttcggcctttgagaacatagaaaatggtgcccacttctgatgaagagatttggaaatcaggctccctgctataattgattatgggatcatagaggaggccttgaagtggtgtgataagcgtggaagaagatgagaatgccagctattccactccagtctttacatccctgcagggacacagaagaagacctctggattccgcatggctatgcatattgaaggtccagttcaaagaatgtggtgctctacacagaggaggtgttactattgtgcaccattgatggggtaatcagagacacagctccttctctgagagggtcctcaccaagagaaggtcacaggaagttgaagatgactccaagaaaaccatgcatattgctaatatggagacaattacatcacctgaagctttagcagcagacagaaccaggccaatccagagcaatgccatagacatcactccactatcttcatgtgcctttataaggagatctctgcctttccatccttttccctttccctgaaaaactgaaggctctaggcccagaagcagcaacggaaggggaaatctcagagaaccctcttctctttcactctacccaacaaaggatcatagatcatagctctagtctccaaaagggaagatcaatagcctgaaatcagatatgagattaaagttttttgctaaattagaccaagtggttggagaataatagaatctactcagtacgttgttaagcaggaaagctggatttgacaaagtacagttaaaagtaatgacaggaagaacaaaacaaagcgtaataggttcatatttatatccaccaagttgagactgctcaattacaaaagaaatattaatgcacttctgtgtttttggtttttagtccagtttaacagcactcaatctacattagtaaatgaatatttctaaaccatatcacacattttgaaacaaaacccactcatattttcgggcactttttcaaaaaagaaaaaatatattttcgacaagatagggtggatgatggggaccctacctataagttttatttcttcaaaagttgccttgctgtcattgaaacaaatggtgagcaaaacgaagttaacagtttaacattttattaaaagggtgtctgtatccaactctaaagcactgccctgactctcaaccctcctggagggccccctggaagctgcccctgaagcttccttcacactgacctcaatagtgggaaatcttattctctgggggtgaatgtaaactttagagttaggcagaacataatttcacacattttttcatgtattagacatcagtcgtggtgctaagtcttgaggaggaaagatattatattgggaaaaaaataactaggctttggcatcagaaaatgggatcaaatcaaagctataggctttattggcagtctagtcctgagaaagccccttagcatttgaatatccatccattcatcagtgaaacgaaaataatacttcataattgtattgaaagtccttaatgatatattatttgtagagcatatagtttctgggatttagtaaacatccaaatgttatcaaccttcaacataaaaagattatgatgtcatgcctcctaaacttaaaggccagttgtggagacatataattacaataaaatgtaatgagttctctcagatgtgagcagattgctatgacaataaagaggcagatgactaactttccttggaatgctggaacagtgatatttgagctgaagcttttgcagaaggagggattcttcaggtacaaaagttgttggacacggagcgatcccggcatagccaaaggcaaatgcagagaagtatgaaatgttcagtgtatttggagagtggggagaagtgaagtgtggctagagcatatggcatgtagggggaataccaggaagtgttgctggaaaagcagtcagggccaaaatgtgaagggtcatcgatactttgctaaagggcttggcatttatccagcagaggatgaagatctgcaacggggatccagcagaggtttttagcagggcagtgaaatgagtggatttgtttttcaggaaatatttccttggcatcagagtggctgatgaattagagttgagagaaactggtgtcaagacttacagcaacagcctcctacctgggctccctgccaccatttcagacacgctgaagtggaggtgcctgcaggacactcagtgtaaaccacactcacaaagctaagcagaggaaaatcctacttagggccagataaattacagggtaattatttccactgcagaaacattctctgcttcataaaaggattcattttaggatcccagagttcctctaaatagcaagtttcttagtgcatttaggcatccctttacagctcattagctacttgatagaggcggagaaagtcaagaaaatcctaaagatgtactttcaagtgttcttattaaaaatcttcatggatgaaaataaaatgtttgaagttatcatttttcaatgaaaaaggaaatttgatttataaaagcacttcgatgtgatttatagaaactagaataagaagaatgtctgttacgatattccatagaatgcatttcacaaatttcagccaccataactcaaaacactgtagggagtgtgacaatatgagtagtcagattaatagaaatagctagaaatacagctgtttagccactgaataagaacctctattgtctttaagcctgaatctcatacatagttttatgttaagtgcttctctctgtccacagtttctcatcagatgaactatgtcctttgctacataaattaaagaacatgttgtaatttggatattttatatatatacaccaaattataaaagaaaaactattttaatctcattatattgaattttcttgtgaatagatatttcacgagaatacattattaatatcaacggagtcacttccagaatgcaaataaatgtagaataatttcaattttaaaacaaaaaacactgttgggaaccctctttgaggaatgctttcagagcattctttgacctatctttactgggagcaactcctttgtagtgaatttactttttcaaaatagacaaatttcaatttgagccaaatgcttctcagttgccacgtgagaggtatctaacttagctactgtctataagtgtctcactcggcataaagtgtagtattagtgttccttgtagtaccttcagttgaactagttcagagaattccttgttgataaaagcatgtggcagaaactgacaactgtctttcagtattcattcttttctaatgtgtttgataacaacacacgtttttatacttggctacattacttaaaaagttagacaatatttaccattcttccttgtagctatatgtagtcatctgactaaattaaggctaatatgatataaatgaatatatattatgggactttcagaaaagctgatttaaatgagttgatttggcttagaggaaaacattttctcccctacttcttccagctattgccactaccaccaccaccatcatcatcattttcatcatcatcatgaaatgtggatgtaatggctagaattccagcagccatcttgaatcaagaggtgatgaaaattatcaatgaggatgggaaaacagaaaaatagaaagctgggttcctagtgtcctctgggaatcctgtgctagctatggactgtagacattcagatccctttttataatagaacaagcttctgccttgtttaaaccacttttagtttgtttaaagtgaaaattaatcttagctgacacaggttatatcaaaagagaatgtattcttgtctacataaattatcaggataaacatgcacaagatgaattaaggtgaagtgttttgtcattctgaattttctagcttcacaaataatgatgatgcaaataagaatatcccctcacatcagtacaggattttagagataggatacaggattttagagataggaatttttatatctgtgaccacatttaatctttgaagtaactctgtaataaagcagaaggacttccatttcccatacaaacagatgatgaaattaaggttgagctatctgcctcaggtcaaacaacagcagttggtacagccagaaaccaaacgttcttgacttaaaatgtattgctttcctattgataacttgcaggttctacacgtgaacattagtcacatgttgtataccattcactacctgactcacttacgtgctcctttgattaaagataaaaaaaatagctttcatagtttttcactgggcttctgtttttgccatggtgcagtaacagtgactagatttaacttcccactttaaacaaccaaaaattataccatatatgaaacaatgattttcagatgttgggaaacatgcagtgtacaactgtgatccttgagagaaaaaaacatagtgagcattgccccagaaggaaatgtctagacagcggcacagaaagaaagaacacaaacagccaaggagattcactgagctgaggaaacagaaactggatttcagggagccaggggaggcaaggtggctagaagttgggtgtcagtgtatcagattaaaagaagtcagtaatttagacgaatactgacctgcatatgtgtgagaggaaactacccaaggctatgggagaaaaaaaatacacaagaaaaaagccagataattcttggagctcacacagagccaagagtagttcatgtccccacaaaggtggacagacctggtaatatatggggctttggctggagctctaagaagggtataactagtttaataaaattctaggaaagtcaacatagagtacacagaaaagagatggaagaatagaaagttacacagtaacctaggattttatgaacttgaacataaatgacaattgcagcacttctgtttgacctcggtatttgtcatagaattaaattaaatttctacatatcggatatagcaaggaatagagataaaagtctttaccatcgcggagcttatattctaacgagagtagaagagagagacagtcatgtaataaatattatattggaggaaatgagtgctattagaatataaatgggggtaaggtgttgtgagaaagaatgtggcaattttaagaagttcataaattcatcaaggtagatgagaccaaagacagtgatgaggccagggtggctggaggcaacgagaagaacaacaggagagaagtcagagatgtattgatgggttagatcctgtaagccattgtgaaaacaggagagattgcaaggtttaaagcagaggtatgacataatgtctcatatctcgaaaggatactcttcctgttgtttggattaggctccaagggtgcaatggtggattcccaccactaaggaggatattacagtattccagaggagaaggactgaaagcttggatttgaggggcactctggacaaggtgagaaatggtcagattatgcatataattgaaaaaacagagccatgacaatgttcaaatattatatgtgggatataaaagaagagaagaatccaggatgcttttgagagttgtggtggtttttaagcaactaaaagggtagagttgccattaacgacaaaggagaacactttggatggagcatagtagaagagaagatcaatcctggacatgaaaaaatcaatggcggtttagtgtgtgataccacaatattgtgatttatttgtttatttttttgagacggaccctcgctcttgtggccgaggctggagtgcagcggcgcaatctcggctcactgcaagctccgcctcccaggttcaagcagttctcctgcctcagcctaccgtgtagctgggattacaggtgccccccaccacgcctagctaaatttttgtatttttagtagagacggggtttcatcatgttggccaggctggtcatgaacccctgacctcaggtgacccacctgcctcaacctcccaaagtgctgggattacaggtgtgagccaccgtgactggcctttattttttgtaaacataaaaatattgtaaaatattgttattttaacaatacattttaaagaaggtattagatctgctgcatggtcatttttaaatgctttaaaaaagacataatacaaaatagctttccctttcaaataacataataaatcctacataattgcatattttagaagaaataggaaaacacgaaagtttagactcttgctacaaagtgaagtctctcccacattaaacacaggaatgttaaacagcctatagcgttctcccaaatagcccattgtgcaacttgaacaacatgtatttgcaatttaacttctgttttgcctaacttctttttcaaatgcatcctctctgtgttgcaacactgtcacttatacagacgtgcacagcagggcctacctttaaatactgaaatctctgagaagttgattgctcttccaatcacttatctggctgcaaaccgctgagttgttgccatgattaacagttattctttcatagacaataaaaacaggaaggttatatagtgaagatttaaagctagaaacaaatatattgataatgaatacgaacactgtcattttgcagctatgaaaactgaggacagtgtagggaagagatttcccataaaacgtcaactctgatttagttcaggcagttagtttcaggaaaaaaaaatgtattaaatgtgttatgtaaaacggtgtggggagaagaatggttaagtttaaataacttgttatttagaagatggtaggtgaaaagaaatacatatatatttgctgctgtctgtctgccccctatactccactgtgtgaaaatgcagtaaactgggctaataacttatagcacaatttgcacagtcaaaatgaaggtttctgctagataccattaaactcaaaggtcacatttaatataaaccttttatcctgcctggactcaaagcagtttcaggatttgtcatttaacagtcataaataatgtgcctcattttgtggcatcctggagactgagaatctctcatattttcttctcaacattaaaattcacaaaaatggggggggggttaaaaaaagaaataaaaagataacttggtaatttctgttgataatttcaaaagctggtccttgagctttggtggagacaatctcgttagcatcagtgatgtgtaatacaataaagagaaacacacaaaaatcaaacaccctgtctggagtggcagctgctcttgtcagagctatctgtctcgtgccagtcccagaagtgcaatggtaccaatggtctttgtcccatgttcttcctgcagcaaaacttgtcaggttatgatgtgccaatctttatcaatgtctacagttctgcacaagaaggttcctcacagaacgtgcttacgcttctgggcaagaaaacgctgtgtgctgtcactcttccttcccccttgtaagcacaattgtcccagcaagcgagcgccagagcagctgaaggcgaaggagagcatctgcctatttctaagtcttggttatctgaaagcgtctccaattcttttttttttcccttttttttggaagctgcttttgtagtcagtagggagctctggatgaatcagaataggaattacccttttaagagggaacaccttctacttgtttgaaactctaaatccaataacactatttccagacatgaattaagctctttaaattgataaatgctcatatcattttattttctcatttataaatatgcatctcatttcattcgcacagccatttccagagtaagtattatttttccactatagtgatgatgatacagttttcaaataagtcaagtgacttatctgagatcgcccagcttagaaggggcaagactaagtcttagatccagtctagctctcattttacttcattttaactgcctcatttcaggaagttacagtttctatcactataggagtttatcctccagagagttgaagaaccataagaactgtctctctccgtggctcaacagatagattgaacacagctcacactactcacaggcctgtgattcagccaaattgttccttatttcatgtagctgtggtgactctcaatagattggatcttcgtggcccatttattccaatgcagctttcagtttcactgaccgttgtggaagctgtgggcatttgactgtgagtgagctctgattccagggttggggaacttcctggagtaccagggcatgaaagacccaagtcaagaaaagggaggggcttttttttaaaaaactgttacttttctccctgtgtgtccatgtaatttacaaatattataacgctcgttactagaatgccaaactgaattaggtcatttctcaatctagaagatgcttttccttcgacagagacgggaactgtaacatttaccaagaaactatatgattgtgtgtcacgttttacatttactaattcatttttgtttattcttcacaataaccacgtgagatcagtgttatactcattttactgcttaggaaattcagagccagaaaaggcaagatattttctcaatatttcatgtttaataaatgagagaacccagaaccaaagctagaaataataacagtgaatctctgagtaagcacagtaacatttcttccatgaatcttggtgtgttttacttttttatttgcaaatgttctcctgggggaggtaatggtactgtcaaatatttttgctaacagaagatgtggaatgagaagagacaagtgacacataggtcaccatcatcagatgctccaaataggtctatatgtgtgttacagtagaaaaaaggagctctaactacaaactggcttccagatcagtcacattttcctgtgttccacatagtttcagttgttatgatgaagcaacttacccacgagcagaaataagcatggagaaggcaaattggtaattgacatgttaaaagttgttaaaaatgccaactcataagcattgttagtccaaggccaacagctgtcttaaatatcaacattaggatgaagctaaatagcacacacatctttgatcacataagaatgtttggagaagaatgattttaggaacttgcattatgtaaagaataatatttgtcaacttaaatgtagttacatgaaaacaattgttttaggtactctcacatgtaacccagttgcctccttaggaatgaatttattccacagctgctgggagaactgctggaagaaattcttcatgctttcagctccccccagatctgcttaagagagctgccttacaatgactaatcgacatggaggtataggggccaatcctcttcagcctaaatcagaggatgcttacgttgtcatcggctcttcccgaactctctacaggagtgaatggctgtgttctcccatcaaagcttcatccttactcacaattccctctgctgaatcctgtttccttgtcttccctttcctggctttccctcgaaggtgttgatatcattttcattctcaaataacccccacctgcccattagactctgcactaatctctgtctcagagtctgtttttctgagccaatgaagaagggagagaggagaaatacttggtactcatcacccagcaatttaaagaagtctttcttaccctcacaccactactgctggttgctaaaccttagcactataattgatggacctcacatggcaattattcattggagcaatggtgcttcttcagttaagatttttacttactacacattatctgtagcattgggcccaaatgtaagtgcttggctaatggttatatgggtcttaaaggccaaaaagccataaattcaatactactttaaggctgacagcttctccacaacactcctgccgactctgtacctattatctcctagcaggtcttctgttaggaagttctcattgtctctccaaatagctcagagccatctctgtacagattagactgctctctcttatttcctccaaaacctttttcccctgtagaagaaattctgccaatcttttactggtggtagacatataaaacaaagccatttctttgatataattcttcaatgacataaaaacaactttctagtttccctaaaagtctcatctaacgtccagctttttattattctttcctcacaggaattaattttaagactcctccttcttcactttgctgccctcctctctatgcatcccactatcttatctgtattaaaatgttgaatatagtcatgattaattcattgtacaagcacgtgagtttctattatgtacaaggcaccttgctagaccctaggaatatagttcacaaggagctcagataacacagtaaatttaggaaaatttactttcctctgaaaccaatttccagaccattgttacaaagacaatgtagtgtattgttatattcaatgacagaaaaacaccatctcctcccatttacatttctccaagtgactatttcttttattttttctcctcgcacaaagaagtattattaaattattgttaaccagaattttatgaattggacattgtcacacatccagccatttgttatctaccccctggtaatggaggttattccctgccacccagatcttgttttactatccattgtctttaacaacaaaatggaaattatttttccagctcttagtctgaaatcaaaacaagatcactcttgcatggaaagtaaatgaatttgcacatcgttccatcaaatgaaatacatatcataaaatttgtatgtgctaaaaaacttggtttccctttatataaaattttttataacgtgtaataaacaatacctttaaaatgctacataatcagaaacttctataaaagatttataaaaagaaaattattgacatttggtaggatttggtaggcaatagcagggtagaaaacaatctctaaatagttctctcattcctttttcattttatctcagaaatcaagtttaattcacaaaattgtggagctgaaaataatctttaaaactaccattttcaggtgagaaaactgaggcccagagaaatgcaatatctgtttaatctacagagagtgtggagcaaacacgggcttaaactctggtttccaactcttatcactttatttcacaacaattttttctttgtactggtaagcatcttaataattgaatattaaggatgtgagaagatgaattaatcgaatcaggaaacttgatgtttctaatgtgtttgttttatttataatctgtgcagcaaggaaagcatgtttactgagtggcacttgctatacatacagtatgcaagagcacagtggttaagaacatttgctttcagccagataaacctggcttcacatccccacccagccgataactagctttctggcactgtgcaagtcaattaaccacacaaggccttagtttcctcatccctaaaagagggataatgaaggtacctctttcataagcttgttttgaggataaaacgagttaatccatgcagtgcacataaaactgcccaacaccttaagcgctatatgagcgtctgctgttgtttttgttgttgttactatttttaaactgaataagtactttttccatattcttctcaggttcagtttgaatctccactcttttcactttgtaccagccggtaaccaaattcaagctgaagcaaagaggtctaatccaggggaagaagtgggcacaagagtttgactctattactgtgggtaaatgctctttattagagagcaaagaggaacgtagacaacaaaataaaaacacatggagctgtaaaacacctgcaggcaggtctcaatggctgccaagtctctttgccatcatgtcaataatggttttatgaataacttagaattaagctttagtattttattaggaaaaatatataaaatcaaatttgaagatgtttctctgaattgctttgctttaaatagttttgtaacggtacacatgcatttagttcttttaaaatcctaatttaaaaggatcaagggctcatcactgccatcagtaattcatgatatatgacatactaattaattcttgtcacttttctttttttcttttcttttcttttcttttttttttagatggaatttcgctcttgttgccaagactggagtgcaatggcatgatctcggctcaccgcaacctctgcctcctgggttcaagcaattctcctgcctcatcctcccgagtagctgggattacagacgtgtgccaccatgcccagctaagttttgtatttttagtagagatgtggtttctccatgttggtcaggctggcctcgaactcccaacctcaggtggcccacgtcggcctcccaaaatgctgggattacaagcgtcagccaccacgcctggcccttcttgtcacttttctacgtcaggaaatcacgttctattaatggatctaaaaagtgaaatttataaagataaatggagaactttaaatttgagttcatcttgtggcagggcatttgtggcatgtgggaaataagtaaggagatactggcatcttttggggccagttgatctggattatatgtgatatggcttagatctgtgtccccacctaaatctcatgtctaattgttatccccaatgttggaggaagggtttgttgggaggtgatggatcatgcgggtgcgtttctcatgaatggttaaatactatccctttggtgctgttctcatgatagtgagtgagttctcatgtgatctggttgtttaaaattgtgtggcacctccccgtctctctcttcctcctgctctggctatcacctgcttccccttcctatgtcaaccataattgtgagtttcctgaggcctccccagaaggagaagcctatacagcctgcaaaactgtgaggcaattaaagctctttttctttataaattacccagtctcaggtacttctttacagcagtgcaagaatggactaatccaatatgattcacaattgcatacacaacaaagtactttgactaaaaatgagccaaggcggaaaagaggaagagcattttaaaataaccattttatttggacaatatcaaacttcataatttccatttgattgctagatttgctccacatttaaaaagttacaaatacatacctagctctatgaccacaacacaaatgtatcttccaggtcctgaccctgcctttcggctgcctattgtgacccctagctagatgttgccctagttgtgtagctgggttggcaaacttggaagtccacatctttgtttatttggtaaatgcaatgttataaaaattagaaacatttacttataaatatctatttttattttttttaattatttttaaattgagatggagtcttgctctgtcacccaggctggagtgcagtggtgcaatcttggctcactgcaacctccaactcctagattcaagcaattctcccccatcagcctcccaagtagctaggactacaggcacttgccaccatacccgactgatttttttatttttagtagagatgggttttcgccatgttggccaggctggtctcgaactcctgacctcaagtgatccacccaccttggcctcccaaagtgctgggattacagatgtgagccactgcgccaggtcattttaatttttaaatatcagaagaactgactagtggtttttggcctggctgcctagtgggatcacctgagatacttaaacacgaaaaacccccagaaatattttaatataatagatgtggtttgaacccaggtattggtatgcttcctttaagctcctcagatgattctcatgtgcctcatgctacagtgagctgggctacagtagcataaattcccaaagtggttgactaacagcaccaacatcacctgggaatatgtgagaaatgcaaattatcaggccatatcaagacctacacgatcagaaattctggggtgagactcaggaatctgtgtttgaacaagtgttccataaatgtgcatgtgattctgactcacactcacatttgagaaccactgcactatgtagaccctgcacatctctattagttattgcttatagttattgttttcactcagttaactgacttacctatagctgtgtttgtatttgaagatcctctaactgagttcattctcattttcccagacctaatttttcttttgaaattcctctttctgattatgacaaaaagacaccaaccaagcttcaggcattgttttcttttccagtgctaattcaaccctcttaatattacaatcatttttttttccttatagtcctactgccattgttccagtccaggccctcattacttcttatcttgacaattgaatctgtttctggcttccctgcctctagtacctactcactccagttcctcatatatactgttgacagttttgtcttcctgaatgcaagccaagtcataaactcattcagtttagaattcttcagtgacttgccattgaatatattcagtctactccacctagcatcaaagaccctccatgacctggctcctccttgcatttctacacttctccttcaccattctacttccctattaactttaaactctaaataatttactattgcctaaactttcctactccatattgacttttaactttatgtttcaacttatgctttcattccacttggattgaccaaactttgtcttctgttaccatctcctccaaattctcctcacactataattgtcccaaacaccatttccttctgaagccttccttgatccatcaaatcttaagtagttttgatccactctgtactaccttaggtttttattccgcctctcatacatcactcgacatactgagataacatgcacacacagacaacatattagttgtcagttacgaactatcatccatctagttggttaaccaaaaaaataataactgacttctataagataagaactgtgctaagctctatatgactggtaaatattggttcattgaaaagaagccttagaaatttgggggtataaatatgttttttaaaagtttctttgaaggatttttgaacaaatggaaacatgatgttaaatattccaatagtctactgaagatgataatctgtgaatcctctcctttccatcttcaaggcaattcctctattattactctctttattagatgaaatgagacacaaataaatcctccaaatattgtatcttaaaagcatcttgcaccaaccatctgaatgacaaagaggtgagttaatgtatttgtgtgactccatgagaggatggtttaaagggaagagtactggtaacaagataagactgggtctcagccaaacatggcagcttgcctacctttggtgctgcttggattttactcaaaacacacaattctccaatttcctctttgctagagttgggtgaccttttctgtttgacaaagcctcacaaggctaacccacacacacattcatacatgattggtatttctttttattttaagtgttcttcatgttccggagccttctcaccttaaagccacaaattctgcacattctcttaggctcttatatgcaagccattaatctgacagatcagccaatggaaaaatggtaactaggttaaaatgctatgcatacgtagtactaattagaatttaataaggccttactcaaatgagagacactattatacctgtaagcaccatgacagcgcagggatgtgatcagtatctttatactaaggtacgttaataaacaccagtggtgctggagggaggaagagatagccatcatgaataaccaactgcttggacctttagaacatcataaatagtcctttaaatatctacattttggacgaagtgacttaggaaggcttaaagctggggcaaatcaagagaacaatatgcatgggtaatataaagaaagaaatatagttcaagtcttggacatctaaaagtaaaatgtaattcaggtcaacaaagatttactgaagtataaaatatagaagaaaatatcacgaaaatatttaagatacaatcctgtctctagttatgactggcagtgtaaaggtagaatataacaagtataaaatgatcatgatataaataccaccaaggttatatggtgtgaggattcgaagaagcaaaatataaacaaaaacaaacaaaaaatagattagcaaaagaaatagagaaacatttgatagagatttgccttataattcaaattacatttttaccaggaaaggtgtggtatgaagaggaagccacaggaacagagaacatgacaggtgtgacatgtattcagatactatccataaatcaaatctagagagaatacaagtaaatggggcaagaagtgggagacgagactgtaaaacttggtggggtcatcctgataaggccatgaacatgggaatgagtacttagtgctgagtaggtgaaaagagatggatgaaagccaggtttcttattctcttaggttcaacaaagaacgctgaaatacagcattcttaacagccgactctattgaagagactctattgaagagactcaaataaggttcttcggctgtaacatgtccttagaatgtccagaggaaaatcagtttccatatcagacacctttacttctattctgaaaaattctgtaaactcccgaacatgattattggattccagattaattttttcattgttaaaatgttagcatctggaaactcaaaaggaaagaataataattagtatttttcttgcacatcagatttcaccttgctctagtgtggtgttctttaggaagctcagttggcagataccaattgaattgtgaaaatatgtctctcctccacactcaaagataataagagtgtctgggaaacaggctgtatcaatacatgatacttttattgtgtgtgaaaaagggaaaaattccaaattaatcttaagaatatactgactgatatctatcaagttaacccgatacaacaggctggggaatggtaaatctattccatcaaaaaatatggccatgagtttcaccaaaccgagtgctcatcctggctctttgtaaatgcaggatgaaactcagcacactttcattacttattctgcaaaaacaactgttcattagaattctgagaaatgagtgttgaattaagactcagtgtctccatcaggatgcagttgagaaactcccccacgtttcatgtccttcctcttcagttgcacgtattccgcactgcacctctgcccatactttacccaaggttagatataacttagtaaagtgaatttaaaattattaatattttcaaagcaaataaaatcacatgaaagggatcttgcaaatgcctaaattaaaactcttttcttttagctatgtaccttcaacacattttacttactagaggcgcctgaacactgaatattacaggttacctaggaaacttacagtgactacacttaaaaacaacacaaagccctctaactgaagcagaataccattttagaaaagtctattttgggaatggcaaaaagaaatggttaacaagtaaatatcagtgcatagctactgtcacatttgagtttttcttcctcacattattcttcaatttctttttatgtctgccactgagttgttcctgaaataaaataaaagctaaagatataataatgaataaagggcaattatttctattatcagctataatccagatcatgagatcttactccgtggctcctcagataatatggaaataatgttatgcctttttagcattcattaatgatggtgaccatacatccagtttgtctggtatatttccagtttatgcctatggttctggcaaaattattcacggtatctcatttcacttgaaaattatccaggctcggatgataaattatgtttgccgtaactgtctattacaggtatatgcagaatgtattgagaaatataaaactgtactaggatagtcagtgcccttggggagctataaatgtataatctaattgaaaaaatataaatggtaacatattctttaaaatattcactactaaacaatataatgatattattatatcattcactatgactaaattgacaaaaatacttgtttccgcaaactctcctgcctaatgtaataaattacaccaagaaggcacttccccatagcccataaaaagaagaaagacaaagtgtatagagtgagttgtgataattctgcaagcctcagcagctttgttagcagcaaaatcaaggtcaccttggctactgcccaaatctaatactaccactgagagattgcctcagggtagggattttgtaagatacctggagagttgttgcagtgttttctgaaatccaattacaaaatccattattactactagacaaactgatacagcatttctatatttgcaaggtgcagagcactcacagctcagcaaaacggtgctggagaacgctttctgtattatgatgatagtggtgatgatgatgatgataatgacatacaattccatttatttaaatactttctactccagtccttcgaaaacaaacgtgaaggatttcctacacaaaactggaagaagataacatttctttttccttttctctagccaatccttgttttatatagtaaataaaaattataccaatatggcttgataaagtgaaaagacattttagtgttcaaatctcaattctgcatctcttagatctgccattttattatagaaaaatctgttctgggactaggaaaagaaatggttaacaagtaaatatcagttcatagctactttttttttaatttgggcttttcttcctcaacttattcttaaatttcttcttaggtctgccattgagtcactcttaaaagaaaaactctccaaggctcaatgttttcatttttataatgaggattatcatagtcctacctcagaaaattagttagaataaaaggaaagaaaaagtgtgaagtgtctggcatgatgtcaataaaactcgaaactgaatgttctcaactgtacataatcctcagagtagttcgagttgccattgccactgagattcttgcagtgacctcttcttacgctagtaggttacagcagtagttttaaaagtccagtatgtaaatgaatcagctgaactacttgttaaaatagaaattcctgataccatacccggaattctgacgtaatacatgtgagagaggccccaggacttagcatttcttaccagcacctgccttgcccatccttactacaggccacatttacacaaacacaagtcagagaaaatgaagacttgccacaacttcaaggctgaaatttcacattaaaaaaagtatcattagccacttaacatctccccctggatattctgccagcaagtctgtatcccaagctgaatttaacttaaaccttgaaattattgttgcttctcttaatgacccttcaatctcaaaacctcagtatgctcatcctcctgctcactagccatcatcgctctgcactcaatattttgcatatttctcctctattccatcgtcattctctgccccaccatcccttgcctgacttttataatcatctcgtctttgatttttccatctccattctctccctcatgctaatcaatcctactcttgctaccacacatacattcttaatgcataattataatcttaaaactccttataagcctccaatgaggatgtaaaaacactgaaatcatcatatgttgttgatgggaatatataaatgtgcagccacattggaaaacagtttggtaattcctaaagttaaacaggttaccacattaccaacacttctactcctactttatatatatataagataattaaaaacatgtatctacacaaaatgtataaacaaatgttaatattcatagcagcataattcataacagtgaaaaagtaaaaacaactgaaatgtccatcaactaattaatgaataaaatgtgatctcttcctacaatggaatattttcggtcataaaaaggacacgtggacacatgttataacatggatgaaccttgaaaacatgctaagtaaaagaagccagccataaaaggctacatattgtatgattctacttacgtgaaatgtgcaaaatagacaaatccatacagacagatagtaaactgatggctgccaggggctgggggaaggatggaataggaagtgactggtagtgggtatgggatttattttgggggtgatgaaaaccttctgaaattagatactggtgatgaatgcacaaccttctgaatatgttaaaacacactgaagtctccaatagctcctcaccacctgcaaaaaaacaaaaccctaaatttcctgacttggtatatgagacccattcttctatagcctctcttcatgcgtcctatacccaagactaagtgaaccattgctcttttgaagtcctggtatgcttttttccccatggcttagggcattttttgaatatctttgtttcatgcatgattaccataatatgtcacatagtatcggtactctatgcctgaatgcccagtaaaaaagcaaactatttttttcaaaacacagtatcctttaaattttgtatgtagcaatctccatttgaaacatgaacatgctgagatccttaaaataagaataaggcagaattgtgtgtgttgcaaagacaacataaaatgccattactgcagccattaataagtaagcacacatctatgtataatgcacacacaaaacccacatatatacatacacacatactgctatggtctgaagttttgtgtccccctcaaattcttatgcttaaatcctaacccctaaggtgatggtaacaggaagtggaacctttgcaaggtgattaggtcatgagggcagaacactcctgagtgggattagtgtccttagaaaagaggttggagagatctaatgtacaacatggtgaatatacttaactacaacatatcgtatactagaaaaatgccaagagactgaatgttaaatgttatcaccacaaaaatgatagctatgtgaggaatcatatatgtcacttagctagatttactcactccactatacatatatatatacttcaaaacatcatgttgcacttggtaaatatattcaatattgtgtgtcaattaaaaaaaatgaatataatgataaaaagaggtttctcaaaggagcttgtttgccctccttccgtgggaggatgcagcacaaaagggccgtccaagaaccaggaagtgggcccccatcagacattgaatctgctggcaccttaatcttgagctcccagcttccagaactgtgacaaataaatttctgttgtttacaagccaccaagtttatgctattttgttacagcggctcaaacagacttaaacacatacatatacaataaaggaatgatcatatcttataaagtcttactactctgtttcctcatactgctatcagcaaaatcactactttagcagcaatctcagaaagaaaaataaaacccaggaagcacagttcttgtacttatgcacagacatttaagccttaactccgtaccctgtgcctctcaccttggtttatgagatatcctttcctttgcttttatgaggatgccagttcaatctttttccagaagtagaccattaagcagtcaatatccgaaatgtaccctaaatgcttcctcatatttccctttatctgactaatggaatatggaaagcaatgtttaaccagggaaaaaacatttacttctacctggtaaagcttaaattccatttagtgctcagaacttaaagtaaaaaaaaaaaaaaaaaagaaaaaagaaaaaaaatttctatcacaccatagtaagtgagcaagaggtaactagtaagtatatgaaattgaaggaaaaattgactgaaagtcaaaacatagtctaggaagggaaactcactcccaacgaaccatcattgacaaacgcaggtcaattacttcttattgaactctatgatacatagtcatgattttccatttgtgctcaaaacagaagcaacttcagcaaaaaatagaattgacaagcattgaaagagaactgcaaatagttgaagcaaggggaatgtttttcaaaacaaaaaaatgttttgtttcctctttctacttttctgtattttctacaagaggacctattactttaaaagtttgtttgtttagaagaaataaagataagtcatggggggatgaggaaagaggagatgttggtcaaagccaacaaagttttgatcagacaggaggaataagttttagtgatctattgcccaccatggtgacgatagttaacaatgtgttgtttaattcaaaattgttagaacagtggattttaaatgttctcgccaaaaaaaaaagtatatgggtagttaatatacaaatcagcttaatttaattattccacaaatgcatacacatcaaaacattacattgtactccatacatataaaaaattatttgtcaattaaaaaataagtgattatagatgacatgaggcatgcattacccatcacagtggtaaaaatccagcttccctgtgtcctgacctcttattctgttgagcaagcatatcacatttaatcatgacaattgcattacagatattagcgatatataaaaatgtaaataggctaaatgtaactaactttgctcttaccacaacagtgttttatctatgtagcaaagcttccatgtcaacttgtcaaggcgcgtcacctttggacagtatacacagacaagatattaaaaataatggaaaatttatcacaatcaccatgccctcgggtgatttttccctcagaatgagaaatgatgcatttttacagtgttagagataaatacagaatcatcatcactattttaggaaagaaacaatactcagaattgaatgtcatattctcaaggaatccacaagtcatgtttccttagggcatagaaccattaagatgaatataaaagaatatcacttgctccactgatttacattcttgctttagttacaggatttaagaaattattccgtacaacttttaatactgcgtctgaggaaaaacagagggaaactagacactacgagagccaatacatttgcagtcacagagttcaattacgtttttttaaaattaacttattcaatcctcacaataattttccgagttacatatgtagcataatcctcatgttacagttgatcagataatttcaggctatggtagagcttattatattgtgagattcctcacctcatgattggagctcattgagagtaaggacattctatactaaacctaagttgtctaacttctgggacatggctgatgcactataaattttatggatctaagtgaataaaattttaaaaaaaaaaacctgagttcttggagggctatgcacacagaaggaatagatgaaagaattaagatgcgaacccaagaatgtctttccattttaccaagccatactggtaaaatgtttatttatataatggtacaaaacaagcatttgagaaaagcaaagaaaaatgattatcttcctccagtgataggtgggaatccttcacatttgttcctttaactgacttctctcatagggaaagtggaagagctaaaatttagatgcaggtattctggcccctgtgtttctctaaaacctcataacctactattggctaatcaagtgtgtgttgatcattgcagatttttatttttcagaaactctaaaattgttttttagagtactgctaccaggttagaggtcaactatcactattaagtgatacaatacaacattttgaaaattaattacagatcctggagactaagaagatccatgttatgtagtttaaaatgaggtaaatgtatatttctatgagcaatttataaatggctattgtaagtaatttgaatggtcatggaaaataaactagctgaactacatgctattcctatacagctttggaacattatgtaaatgaaagcgatctactcatggaatccgaaaaacaaagctcttgcactatgtttactaattagaggttcatacacctgaaaagcttgaaattgtcacattcactttagttttctcatctgtaaaataaacaacttacttttcatgctttacataattgttgtaaaaatggatgatacattatgtgagaaagatgttgtaaactttaaagtgtaatgcatatgacggagcttattacctaacatctttctacttaagctgtggtcacagcgcaatggcatcaacattcctaggaagtgaactgatccaaagaatctcagaccccattccacacttactgaatcagaatatacattttacccatattgccaatagacttattcacatgtaagttggatggaaagcagtaatttcactactttcaagatccacttttatcattcaatattaaaaatgttttgatatcccaattatgtgatgtgaaacttcagcaaatccatgggcacttatttagacagatacatatatggtgttactgtttcatattctaattaagcattcctctacataactgttttggcatacacatatactcttgatgtatttgttttttgcatcactgaagcaaattttagactgcacatttctggacggcaaggattgccttcaaatacttagttcagtgcctgataaatatgtaaactgccttgagaaacagtgatgacagtatcataatctgacaataattagagaaaaaatgctttggatgcacaactaagagtaggaaattctcagaaacattaattccaactcacctggaaataacaattcacagaatagaaaaaaaccaaaaggttgctaatattcttgagcacccacacttcattttgatgaaatctaatgtcagactaacctagagtttcaggtggaagtaatcattcttttttttaatctctttattttttactgtcatagggtaacagtctccatgtataattttaataggattagaggacaccttgaaatgtaaggaatgatcaatcaaattcatatagtgcatcagcaattgtgatctcccaggttgtggaaatcaagttgaaaaatatagatggtagacatagtcctggaattttcaaaacaagaaatgaaagctttaataaaattaaacactttaagctaatgatgacctacttaagaaaatcatttacctttctaatttttaagcacttgaattagtttagatttatagtctctagacattgctaaatttgattaaatgtgaaaaacttaaagttcacctgtaaaaatgtccttgattaattttatctgttaagggaaaacctataccatcctctctggccttggaaatatctctgacagagttccgaattcttctctgtattttaaatattgttgatatattattgatgcaggtttcagtcatgctgaacaaaccttaaaatgcatggaaaatctgaaaatgcctatttagataggtcacaggcccccctttttttttactaagctaaaatttaaaaatcaggaatcacagaacatcaacaacgagaaaagaggttgaattagaggtgctctgtagaactccaaataaacactttacatttgtattttcatgcatttaaattagggctgttaaaataagagcaggtggatataaaactattaggttggtgcaaaagtaattgcagtttttggccaggtgcagtggctcatgcctgtaatcccagcactgtgggaggcagaggcaggtggactgcttgaggttaggagttcaagaccagcctggacaacatggtgaaaccccatctctactaaaaatacaaaaattagccaggggtgttggtgggtgcctgtaatcccagctacttaggaggctgaggcaggagaatcgcttgaacccaggaagcagaggttgcagtgagccgtgaaggtgccactgcactccagcctgagcaacacagcaagactctgtctccaaaaaaaaaagtaattgcagttttagttactacgttcaataggaaaaaaaaacaatacttttgcaccaacctaatagaaaaccatcgactagattaatcagctcataccatgtgaattactgaccagtaggaaacagagatcaaagtcagtgctgcctgctacttaggagatgcaaaggtaattcctctgatggacttctacgttcatttcattgctcaacgacgtagagataattaattcttaacgaatattcatttgaaataaattctgacaagtgctccataatccttccagaattcagtaataaatcaaatacacctttttttttcttgtaacttcccattgacaatgtcatatcattaaaacccaggctatatgtggtagctctttcccactacagtgaaagacatttcaatgggaaatgagcttgtctattaaaaatatcttcattgttgttttctaccaatctgtatcaacaggtcattttctttcctttctttttaaaatagtaaataaagaaggaatgattatgatacttcttgctctctaggagccacgtcataaatgcttaattaggtatgccaaagttattttttctaatagagtacagaaaactcttaataaaagatcagattcattgatgtatatgcacaatatcaggaaagagttctcataatttgtataattccatagtcaaccctagcaagtgaagattaatcaatggtgggctcccatgcacgtgtatttatttatttatttatttatttatttatttttcttttccactttcttttaggtccagggggtacatgtgcagttttgttactttagtacattgcacatcactggggtttggtgtacacatgattttgttacccagatagtggcatagtacttgataggtagtttttttgactctcgccctcctcctaccctccaccttcaaataggtcccagtgcctactgttccattctttgtatccatatgtactcaatgtttagctctcactgataaatgagaacgtgtgatatttggttttctgttcctctattaacctgcttaggataatggcctgcagcttcatccatgttgctgcaaaggacatgattttgttatttttttatggctgcatagtattccacgacgtacatgtgccatgttttctttatccggtccactgttgatgggcatctaggttgattccatgtctttgctattgtgaataatgctacagtgaacatattactatgtgtatctttttggtaggataatttatattcctttgggtgtacattcactaaagggattgctgggttcaatgatagctctggtttaagttctttgagaaatctctgggctgcttcccacaatgggtgaactactttacatttccaccaggagtgtataagcattcccttttttccacaaccccaccagcatctgttattttttgactttttgataatagtaattctgactggtgtgaaatggtatctcattgtggtttttatttacatttctctaatgttagtgatgttgaacatttttcatatgcttgttggccatgtgaatgtcttctttggaaacgtgtccatttgtgtcctttgcctattttttaatggggttgtttggtttttcttgttgatttgtttaagtttcttacagattctggacattagacctttgttggatgcatagtttgcaattttctcccattctgtaggttgtgtttatgctgttgatggcttcttttgctatgcagaagatctttagtttaattaggtctcgcttaatccatttttgtttttgttgcaattacttttgcagactttgtgatgaaacctttgccaaggtcatgtccagagtggtatttcctagattttttttctaggatatttataatttgaggtcttaaatttaagtctttaattttgagttgatttttgtatatggtagaaggaagtggcccagtttcagtcttcggcatatggctagcgagtgatcccagcaccatttactgaatagggagtccttttcccattgattgttaatgggcagctttgtcaaagatcacatggttgtaggtgtatggctttatttccgggttatctaatattggtctatgtgtctatttttgtaccactaccatgctgtattttactgtagcctactactgtatctattactgtcaccctgtaatatagtttgaagtttgatagtgtgatgcctctggctgtgttcatcttgtttaggattgctttggctattccagctcttttttaggttcatatgaattttagaattttttttctaatgctgtgaaaaatgacattgattgataagaatggtattgaatctgtaaattactttgggaagtatgatcattttagcagtattgattcttcctgtccatgggcattgaatgtttttctttttgtttgtgtcatctctgatttctttcagcagtttctgcaattctcatagagtactttcccctccctggttagctgtcttcctaggtacttgattccttttgtggctattgtgaatgggatcaaattcttgatttggctgccagctattgttgagctactaattgttgtacatttattttgcatcctgaaactttactgaagttgtttgtcagttctatgagcttttggatggagactatgaggttttctaggtatagaatcatatcatctgcaaagggagataatttgactccctctcttcctatttggataccttttatttatttctcatgcctgattgttctgggtaggaattccagtacaatgttgaataggagtggtgagagtgggcatctttgtcttcttccagttgtcaggcggaatgcttccagcttttgtccctccagtatgatgctggccatgggtttgtcaagatgattcttattattttgaggtatggtctttcaatggttagtttgttgagagtttttaaaacaaagggatgtgatgttgaattttattagaagccttttctgtgtctattgagatgatcatgtaatttttgcctttagctctgtttatgtgatgaatcgcatttattgatattcatatgatgagccaatcttacatcccaggactaaagcctgctttattgtggtggattagctgtttcatgtgctgctggatttggtttgctgatattttgttgaagatttttatatctatgttcatcaaggatattagcctgaagttttctttttccctcgtgtctctgccaggttttggtatcagaatgatgctggcctcatagaatgagttaggcaggagtccctcctcctttattttatggtataatgtcagtaaaattggtaccagatcttctttatacatctggtaaaatttggctgtgagtccatctggttcagggtattttttagtttgtatgttgtttattactgattcaatttcagaactcgttattggcctgttcaggatttcaatttattcctgattcaatcttcggaggttgtatgttttcaggaatttatcaatttcttctagatttctggttgtttttttgagacggagtctccctgggtcgccaggctacaatgcagtggcgcaatcttggctcactgcaacctccacctcccaggttcaaatgattctcctgccttagcctcctgagtagctctttccatttctttcaggaatgacaggtgcatgccaccacacccagctaatttttgtgtttttagcagagatggggtttcaccatgttggccaggatggtctcgatctcttgaccttgtgatctgcttgcctcagcctcccaaagtgctgggattacaggcgtgagccactgcacttggcctcttctaggtgttttagttggtgtgcagagaggtgttcataatagtctccggggaatttttgtacctctgtggggtcagtagtaatgtcacctttgtcatttctgattgtgtttatttggatattctttcatttttattaatctaccaagtggtctatcaatcttacttatccattcaaagaaccagcttttgggcttgttcatcttttatatgaattttcatgtcttaatttcattcagttcatctctgattttggatatttcttttcttctgctagctttggggttgggttactcttgtgtttctaactcctctagttgtaatgttaggttgttaatttcagatctttctaactgcttgatgtaggcatttcatgctataaactttcctcttagcacttctttagctatgtcccagagattctgtttgttgtatctctattttcatcagtttcaaagaaatttttgatgtctgccttaattgcattcttcacacaaaagtcattcaggggcaggttgtttaatttccatgtaattgtatggttttgagagattttcttggtattgatttctattcttattttgctgtgttctgagagtgtagcttgtatgatgtcatttttttttgaatttatagagaattgctatatggccaagcatgtggccagtctaagtgtaagcgccatgtgctgatgagaataatgtacattctgttgttgttagatacagtattctctagatgtctccgaattccatttgataagtgtggagtttacatttgatatatctttgttagctttctgccttcatgatctgtctaatactgtcactcgggtgttgaagtctgccactattattgtttgattatctaagtctctttataggtctgcaggaacttttatgaatcttagtgttccagtgttgggtgcatacatatttagtatagttttcatgttgaattgaaccctttatcattatgaaattcccttatttgtcccttttgatcactgttggcttaaagtctgttttatctgaaataataatagccacacctgctctttcttgctctccctttgcttgatctttctccatccctttactttgagcatatggatgtcattgcatgtgagatggatctacagttgggtcttgcttttttatacaacatgacactctgtgtcttttaagtaggggcatttagtacctttacattcaaggctaatattgatatgtgaggatttgatcctgtcctcatgttgttagctggttattatgtagacttaattgtatagttactttatagtgtcagtgggctatgtacatatgtgtgtttttgtggtggcaggtaatcatctcctgtgtttatatttagcactcttttaagaatctcttataaggcaagtctggtggtaacaaattcccttagtgtttgcttgtctgaaaaagattttatttctcctccatttaagaagtttggtttgtctgaatatgaaattattggctgaaatttcttttctttaaagatgctgaatataggaccctgatctcttctggctcataagggttctgctgaaaagtgcactatagcctggcggagttccctttgtacataacctgccccttatttctagctgtctttaagatttttttcttccacattggtttcgaagaatctgatgactacgtgtcttggggatggtcatcttgtatagtattttgcaggggttctctgaatttcctgaatttgcatgttgatcactccagcaaggttggggaaattttcatgaccaatattctcaaatatgttttccaagttgcttgttctctttccatctctttcaggaatgacaacgagttacaggtttggtctccttacataatctcatatttctcagagcttttgttcatttttcaaattcttttttatttttgtctgcctgcattgattccaaaaaacagtcttcgagttctgagacttttttccctcagtttgatctattcagttattaatgcctccaattgcattataaaatttctggagtcaatttttcatctccagacattcagtttgtttctttcttaaaatggatgtgtactctttcaactcttggactgtttcaccgtgttcttgggattgggtttcaaccttctcctgtaactatatgtggttccttgtcattcagctcctgaattctgtatctgtaatttcagcaatttcattctggttaagaaccattgctggggagcaagttgtagtcatttagactcaagaagacactctggctttaagaatcattagagttcttgcactagttcttatctgtgtggactgatgctcctttggtatttgaagctgctgtcttttggatggggctttttgcttttctattatttgatgctcttgaggttttgactatggtataaattgggtttcatggattggtttcaattctgaatgcttttctggagccaaagctcacctcagcactcttgggctgcatgctgtaatcctgggggatgggggattagtcctgtggctttgctctctggccccttgagattaagcacctgctgtgctggaggtgctgaggtgttcccagttcacttgcaacaacactctggcaggggctgctggcaaaattgctccagtggggcagtgggagtctccacacacatgtgcaccaatggaggaggctgcaggcgagtacgcatcagtagggggaggctgagggtgggtgtgcactggcagggaaagactatgggcaggtatgcactgacagggggaggatgcaagcaggtacgtgctggcaggggaggtcatggttggagtgtgccagcagggggagacaatgggtggatgcataatggtaggggtccaccaggtcgttttcttactccaagtttcagttttgttaacctgtactataaaatgactgaactgtaatttttaaagttttcttaagcagaaagacttcaattattttatttgatgtgccactggacagacttgtaaatggaagctcaaggaattcagtgagttgtctctggaaaagagcagagcaggtaatcccaggcttttgtgttacatgtatattgctctttccatcatcttatggctgcttcaaaggttcctcacaggtccaaagtttactctaactcagtgaattcctttggtcattccacatgtaatcctcctggagcacattatcaatggcaatctttggacagtgctaggcctatcaatggtgaacctgggatggctgaagctcatgctgagtcaagtctatactaatctaattctcccaaatgtgatgggaagtgcattttccacaaacagtactcatcttggaaagtagaccagcatcctaataaaagcagagattttagtgtaatacaggttaacattccaatcccacagaatgggcttgcttagtgtataacttttcctagtcttcatacttacgaaaagacatgaggtctatgtgtaacatgtagaagtgtacatggcccaaaatataaattgagcccaaaaaatatctgcaggatacataaaaagctagctcttttctattctctatttggtttgcatacaaatggtagcatccatgcactttaatgttattcaaaatgaacaatagaaaaatccatggaaacttgtccattttgtttgcattgatgtttccagaactactgattttgatagatttgtttttccattaaagaagtaggaacaaatccctgatctcttacactgaattgtggtgaacagagtaagatgggaaattgctcttttaataccaaattgggacaaagccgttaattatgtgaagcttattctaacaatagctcttcaagtgtgtgatggaccaggggcccccaactcctgggccacagactggtactggtctgtggcctgttaggaactggtcacacagcaagaggtgagcagcgggtgagtgagcactactgcctgagctctgcctcttcctgtcagatcagcagtggcattagattctcataggagcatgaaccctattgtgaactgtgcatatgagggatctaggctgagcgctgttggtgagaatctaaccaatgcctgtaaatctgagatgaaacagtttcatctggaaaccatctccaacccccaactagtctgtggaaaaattgcgttccaagaaactggtttctggtgccaagaaggttggggactgttgtgatagactactaatcctgctaatggggtaacccaagtcacaactaagtttaaggttggaaagccccagtaaatatctgaggtcttagtgaaacagggtaagatgaaaggtgagaaaaagttgtattagacactatgggtgcaggggggaagatcccagaaataatagtctttgaatgaaagtccaagatatgaccttcttggtagagaaaaactcaaccaggaaagttgtcttatacatttttcatagatgttgtgcatgttgaatccccacccttatggtaatccattagtatgctgaaggctcagaggaaatagtacaaaacagatgcattcatgcttcatttttccatatgtttgttattcaacaccacacgatgactgatagatcccatatctaattaccatatactggagagctttctggatttttccagcccagcagtgacaataattgccattcaagaaaagataaatcaatgttataataataatacaatgacttatctgatttcccctgttattttttttggaatatcaacttttcactgaatttaagatgattttctgataaaattattatttttttgctctgaaaaccaatataaatatgtttatctgctacaataagaatgataacatgcaacaataaatgtaaacttagctgttatatgcaaaagattttgctagttgcaagaaataaaaagacatcagaagtagttgttgacttcaaactgctcagaatctggtaaaatagatgacctagtgcacagtgattatctcacccaatgtcccattatcacccagctgtattctgttccttttccagtcctcatgctctaattatttaagactcagcttaaatcctataaatatcttggtctgatattttgtcagaagacatatctccccccaatttctcagaggtctttatctctactttgtatgttatttgtaattttttattttatgatactatcatgcttttcaccataacaaagcaaagcctctattttttcttaagttgtatcttattaaagcaactaacctaaagggtaaggaaaggacttctttgagctttcaggaaataagaacaagccaattacgaggagggaaaaaataaagctgaccttagatatctacacagcaacatttaattctagaatacagtgaatcaatgcccacaaaatattcaaggaaagaaaaatataatccaagtctttaatatctagccacagtgttcaagtacaaatacaaacaaaacccaatttttaacatgtaagaattcagggaatactattcccatgagttcttgctgaagaagaatttcactgaacagaaagatatttttggaaagactatataaaaagattagtactgaaatttgaatctatacatttgttgaacaatgatttaaacatatgcaaggattaaggtgacagaagagaatgtaaatgttaaatgactgggtgggagagtgataagtatggtaattttctcacttataataccaggagttaaaggatattttcaatacttcaaaataagtaatgtgaatataaatgtatttaatatctcaaaggaaaacactacaaagattatgtaattaaccgaaatcaaggggataagaggaaaaagcagtataaagaaaaacaaacatactaattccatcactgattatagtggagaatcaaaaacagtttgaagaaacaggggatttagggtataaaaattatattagatcaagaataccaactttctaatgagcagaagcagcactctctctctctccaaagtaggtaaaaaggaaatacaaaaagctttaaagatgggaaaggataacatgaaattctatgctagaattaaaattaaatacatctcccctattgatagttccatgagggaaaggatgtctgcttgttctgtccattgctgtgtcccgagcacctggaacattgcctggctcatgactgcaggcaaaaatttctttaaggaatgaaattcatacggctaaattcacataataaagaaaaaggctttcaagttacttcaaataacaaaaccaactgttcttgagtatatcttcaatcaaaaaagagatcaagaccaaaattacaagacttttagagacaaataataaaaatacgttgcatcagtatttatggggtacagctgaggcagtgttcagaaaaacaaatcactgcattaaatatttatgtaagggaacaagtaaaaagaaaaacacattaagcattcatattcagaaattagttaaaaatcatgaaacctaaggaaagtagaaggaagaatattgcaatgattaaaataaattgatgaattagaaacaaaagagtaggactagtaaataaatacaaaagtaggttctttgaaaaaatataataatataaataagttttagctgccaggatatttccacttcggtacttaaggaagataatttttgttgtgggagctgtcctgttcattatgggatgagcagcatccctagccagatgccagtagccctccccttcctagttctagcaaccaaaagtgtttatgaacattgccaattttccccttgggggtatcaaaattgttccaattgagaaccaaattgttccagttgagaaccactgaagtagcccagtcaaaaaggaaaggaagaagcacaaacacccaatataagaaataataagcaagtaatgatcagtcagggaaaattttaaaaatcaaaggctattttaataaactctacaaattaatatgaaacctgaatataaagcataatattatattaaagtaaaattaacaaaaatagaaaatgtaatatatgaattaccaaaggaggaaacttgccaaaatccaatcatctcaaaaaaaagttaaaaccagtccttactacaatgctatttgacccttccagatacacttggccatataatttagtaaaagaaaataaccttagaaaaagattaagaagacaaaaattagtattattgtttacaggtgcaatttaattttgctgatattattgtttacctggaaagaaaagtatattttactgagcaactatgaaaaatagtaagaaaatttagtcagttagctcagtataaaattaaaagacagaaatcattttcctttatgtatacaaataacctctattatatagaagatcatggtggaaaaacacataatattcaggaataatactgatagttaattttcaggatctatatttagagactatcaaaatacttctgaggtaatcaaaacaataccaggtacttaaacaggcagattcaacttcataaagatgttaaccttaaatatatctataaataaaataccaaaagaaaatctgagagaactgaaaaacctaatgctaacattaatatagaaaacaaaatcagaaagaataactaggatgatcatgaaaacgaagagcaatttggtgtgggatgtggagattaaaagaagaggtagacttgctgttattaaaaaataaagtaaagctacaataattaaatcagtgtgttattggcacatgaataaacagtcataaaattggaacagcctgggtagtacagaagtccaaataagtaaagcatatatgtatattcaaggtagcatttaacactaaggggaaaaagatagtttatttaaaatattgtggtaaaacattagggcagctttatggaaaaaaaaaaaaaactcaagtaaattccctttacagtatatccaacttaagcataaaattttaaacaataaatttacttcaggcattttaatgactttaaatgacaacggaataggaaggtattcctcagtaggagattttaaaatctcagaaactataaaaaaaagattaataaaatgttaacatcattatgttgttgagtctgtcaaacacacggtacttatgaaaatgcaaaaatttttgtattacttaaaatgccataaaccaatcaaaaggtaaaaagtgggaagcatttgcaagggctaactttccgaatataaaagggttccttcagaaagataagtgaaagaccaagatccaaataagaacaaaagcaaggataggtgacaagtaaaacaaaattaaaataaaatcagctattggctattctcctacaatatgctaaaaccacatatcataaataaagtaaaaattaaaactatgatgaatagaattttttatccatcatattttttaaaattacataactcactgtgctagtgaaagtgcagaaaaattggcactgtcgtgtcatatatttctttattgagtgtaaatactatatctagggagatcgatttggcattatctagcaaacttacaaatattctgctttctgctctacttttagaaatttactctgcagatatactataaaatgtgcagaatactgatgtataactatattatttataatagcaaaatattgaggcaaactttcagaaatatgggactgatgaaatcacgtatgtcacagtctatggtataataccacatagcttttaaaaaatacagaaactccctgtgtactgattcggaataatctccaagaaatattaagtggaaagagcaaaatggagtgatagtgtggacagtggctatcttttctaacaaagagaggtaaatagacatatctacttatatgggtataagcaaaaagtaataataataataactccagctgacaaataagaaaattgtaatattgatagcctatagaaaagtggctatagataggcagaatgagattgttcaatttatcttgtatcttatggttgtgagttaagtgaatgtattatctgttcaaagggaaataaattgtttcaaaatagttgacaaaagattattatgataaacctgaaagaagatatgcacagtatgatcaacaaatgctgattttgaaatccagaatactatcccacatgagtcatattttgttaatttaaaattcatgttgacagatgaacacaacagatgaagctattaatgcagctttaccttactgacccagagcccttcgagtctgagtttcctctggaccaagtggttatcttctctatacagactggggattctatctcccaagcatgcaattaactgccccttttgaatattctattccaagactcattgcaactatgatactcttttcttttaagtgtgagcctcagaaacaattaagcaagaaataatcgtgcatttgcataagcccaacttactgtgtttttttgttagtttgtttgcttgggactttctctgagaagcaggaactcgttttgtcatccaggctggagtgcagtggcatgatcaaatctcactgcagccttgaactcctgggctcaagcaatcctctcatctcagcctcccaggtagctaagaccatgagcacatgacaccatgcccggcaattttattttgttttatttatttatttatttatttttcagaaaaatggggtctcgctattttacccaggctggtctcaaactcctggcctcaagttatcctcctgccttggcctcccaaaatgctgggattacaggtgtgagcccccatgcccggccaaggacttactgtttactcagcaaacatttattgggcatcaattagctattggcataatcataacacttcctcctacatgtgagcatcagaaatatttaatcaggaagtaattatgcatttgcataagcacaatttactctttagtcaatgaatatttaatggccatcaattacatgccaggtagcatggaaggtactggaaacagagaaagacatgttccttgcccttaaataatttgcatggtaatcattattcagggagacaagaatataatagaatttaatacaatttggtccatgttagaatagtagccacaaatcataagaatggcaagaggctaggagaaggaggcagtaacaatgcctggggagactcagagagggctttacaaaacagaggaagttttacttctactagactgtctagaattataagtgacagacaacagagtccttgctttttcggaccctaatgctaaaagactgaataaatgtaatagtaaaaaagtgattagtaggacaattaagttttaagttcacattaaactttaaaaaacacttaaaaacttaaaaaacattaaaattaaaatggaattcctagttcgttgatatctcatcacattacaaaattctgtttttaataacatcagaacataaacataacttcaaaacatttaccggaaataatagctttagttttaaaatgcttcctccaaaagcatgttccaattcaaggcaaggctcataaactaaatgaattttaaaatttatattttagaattataattacatacttgattacatatttagtatgagtttataaaaaaagaaagcaaaaggatcactgtgacaacaggtgacatcaagaaccacttggaacaataaaagggaaagaaattaatctttaacataagtggagtaaatataaatgggccaaacattatactgaatttagtggtgctgcccatggaattctggaagtcttaagatgttgtagatagatatacactttccttgactcaagatagcataagtacttattttttcagatagtatgcaggcttttccaggtaggacctggttctaattgacataaatataaaagtgataagaaagcctaaagctgccgggtgtggtggctcactcctgtaatcccagaactttgggagaccgaggtgggtggatcacctgaggtcaggagttctagaccagcctggacaacatggcgaaaccccatctctactgaaaacacaaaaaattagccaggtgcagtggtggacgcctgtaatcccagctactcagaaggctgaggcaggagaatcgcttgaacccgggaagcagagattgcagtgagccaagattgtgccactgtactccagcctgggtgacaagagtgaaactccgtcaaaaaaaaaaaaaaaggagagagagagaggaaagagagagagagagaaagaaagagagagaaagagagaggaagaaagaagaaagaaagagaaaaagaaagaaagaaagaaggaaagaaagaaaaagaaaaggaaagagagggagggagaaaaggcagggaaggaagggagagaaagaaagaaagaaggaagggagggagggaaggaaagaaggaaggaaggaaggaaggaaggaaggaaggaaggaaggaaggaaggaaggaaggaaggaaggaaggaatatcctaaagcaactctcaggaaacaaaacagaatgttgaggaaaggagactggtgatgtgcaatggtgctaagacttgctgatgggaaacatttgtgtagcacaaacccaaatctgtaggcatgcttgcagcctaatcccaaatagtcaacaagcagatgcactcatctgccatccccagagacttcagcactgaagagttgtttcgtcactgtagagtatcaaattggtgagtaattttgcccttctacctggctaaaaaaacattcattcagtttctactagcttaaaggtcactgtattttgcagtcacccatgcatgcaatcagatatggctcaatggactctgctcacctcacaatcatgaatacaatatgatttaaaggtcagccaacttgcattctgtcaaaagagcataaggagagaatttcagctatgtgggtctatatgatggcacatattttgctgacagttttctgaatccacacctagcgatcactggcaggagatgacagttcaaggtcaataatttaataaatcatttcattatatagttattgattctaccacttttaataaggaatgtatgcaaaattgaagacgttaagtctgggaaagatttatagaaaaaacagtcaacagcttctgtgtggcttccaggagagatgaaggccaaaagagtgaggtagaattttgctctaaataagactttaccaataataagggatattgaaaatgaaaagtatttagcttctgaaagtagtgttcctgacatatggttaagccagatggtggattaacacatattgtaatgtctaaaaaattaggactttttaaattggggcccacatactgcttaagaaattgagctatctgacccttcaagactttcttattttattctctatgatcagccatgagagttctaaagggggaataaatggttcagcaaattttatcttgttccaatatactatctagaatcaacggaaccaaactatgaacatctacttcctctaggacaaatttcatcaaaccattagttataatacacatgttcaaaggagctgagataaaaattacaaatggcaaattaataaaacagccattaaggaacttggacatagttaaagtgtacattgaactgaaacatgaccatggagaacaaccttgacaatatgttatttgaagctattttcagatgtatagatgtggcccaatatggcacttttcatattctccatgcagctgctttcacctatcctgacatcttcaagttatctgaatttaagaagtatcactattcatgttgcacaattactaacactgaatatacttatcacattctctggcatgtggctttaagctatcctgggtattcagacagttaagattcttggatgatcccaaagtttccctttaattatttgtagcagtcttctggactaataatacttataaaaccttgggaatagcctatgcaacatagtgagaccccgtctctacaaaaaataaaaacaaaaaattagccaggtgtgatggtacacgcctgtggtcccagctactcatgagactgaggcgggaggatgacttctgccccggggggatccaggcagcagtgagcggtgattacactactgcattccagcctgggcaacagagagagaccctgtctcaaaataaatacacaaatatataaaatcctaagagttaattctttagaaagcattttattttagcttaacacaattaatttgatctatcagaaaaccctacctgcttgatgagccatatttactatcatcactctctgtctaccattacaatcagtgattattgattgggttagtgaagagttttgaatagttttaacaactgttttggcgctcaaattgagacttgattaacaaatgcaaaactagtcaaccatgactaaaatgaaactgcttcaataattacataatgaagatggtagcgagtttttattataagggctatgtaaatgcagcccactgtactattataatattaatcacaagttttttgaggaaaggtatgtgatataactcccatccaaggtccctagcagaatgtctttcacaaagcagatgttcattaaatgacagctgaataataaaacactattatagagaactcaagtatgaatctagtatttcattttaaaaacttgtctgattatacttacatatacaatactgcatgcagcagctactcgataaacgtgtgtaaaagattaagtttggtcaaacaattgctctgaatcaaatttgtgatataattcctgactcagcccccacagaatatttaaaatatagtaatacagtaaaataatttttccaccacttcatgaacagtcagtagggtcttgaatgctacctttcaatatgcaatatggtggccttaggaagagaggagttttttttttctcaacacgtagaatcagggtcttaagaatgactttgtgaaaactccagctttcgttgctagggaacattgattgttttccatggtgcttgtaaaggcattatttgccctgattcttttgatgagttgagactgttcacatagtaacttcagaatggaaagaacaaacccctctcttcctctggtggcactttgcctactgtcagactacaaaagggagaggcatgtgaggtgaccctctcaatgttgtctgaacaatgaggcaatcattacaactcacattctatcagtttttatgtgacactgaccaaaggcaatttggggctcctttcaagcagtttgcatcaaaaaaacgttgaatggcattgtcaccaggactacactacaacaaaaagcaacgattgagaaaggctggtgtctaactagaagacaagagtgctttagatatggaagccattgctctgatattttaaaatacatttttaaaacaaccttattatcgattcatttatacagtcaactccattctgcttagtactcgaagtgtgcactcatgtggataatctaaaacattgagaattcaaataacatttatattaaatctgacataataacctaacgttttagggtatgcctaaatttgcctttctatttctgtttattctggtaacttttgaatttggttctctggccctggaaatgccacatttagccaaagaaaaacagttttgattaggggatagcattaatcattagctagttaagtgtacactaaggaaaaattagagtcattattttgatgagttgtgcataagttatggtcagcacaagaaaacagggcacctgttcatatttggtcaccaaagaatgttctacatttaattaaccacttaatatttacaccttgagaaaaaattatgccacaatacaagcataagtgtttttgataaatattcaaatattagaaaaatatattaagatttaaatatttcaagtttgtttcagccataaaattctgatcatactctccctatctacctaattgctgctaacaataattcaaatgccaataatgatatatttagataattgattttaaagaatttatcaaacaaaaaatagaggatacctataggtatcttctttttctggagaatcaaaacatagtataaaatggaagctttctttgtgctgtaaagaattcaatacattatggggcaaataaatctattttgaaggtttttttttaatttctggtagactagaaaggaaggatccaactcggatgttcatttatttaaaatcaaacatagaagattaaattcatacaagccaaagaacatctggcccttccagaaagagaatagagttctaaatgctgaaatcaggtgaagcatacttaattactggtatccagaaagagcaaaagtgagacatcctattatatttattctaggacaaaatataccattgcctatgattgtgggttttggataagaaaaacttacagtcttaagctgatcgtgagtcaataatggagctactgggacacaaatctgtaccctttgtcactctatggaaactcttctgtctcaccacaactcacttttgtctgttgatcaaatatttcagggccttcaaactcatataacatgtttctcctagaaagagctgcttatcttttcctaactaagagcagggagtgcgccatgaaaatgttgtcattgatgagaacccactttgattctgatagagagtaagttgtgctcttttgctttagtcatgctgtgtattgtctataactctattgtactattacattcctaaatttggctataacaggtgtatcagttgattcaccaactttcaagaaatgtttgacactatctactaaagctaaacataggtagcctatgactgtgcaattctattcttatacaaagtcccaagacaaatgactgtacatgtccaccaaaagaaaatgactagaatatgtttagaaactttattcataatagctccaaactgaaaataacccaaatgtctatcatcaggagaatgggtaaagaaattgtattatatacaatacaaaggaatactacattgcaataataatgaatgaacgaagatgtacaaaacagcatgaaaaagattagatatttttagttgcatgagaaaaaaaagccagatacaaatggcccatatagtatgatcctatttatataaagttcaaaaacagaaaaaaaaataggtgtagaaaacaaaatggtagttaattcttgatggagagctttgtctgtgaaggggcattaggaatacttcggggagtggtagaagggttccaaatatctggatagtggttacacaggagctttacacattagatttgagcactttgtccataaatcattcctcacaagaaacacgtatcgttatttaggatttagtctatgctaggtatttatataagaacaccaacaaacaagatgacaggtaattgcatgcttaatttttttttgtgtgtaagtctttttaatatagattgagagtaacgtgaagtcagagacctgtctgactaaattttgtattctctaggatgcgaaatattcaggctcttaagaaagaatataagccgggcatggtggctcacgcctgtaatcacagcactttgggaggccaagatgggcagatcacttgagctcaggagttccagaccagtttggccaacttggcaaaaccctgtctctactaaaaaatacaaaaattagccaggagtggtggtagcgtgcctggaatcccagctactggggaggttgaggctggaggatcccttgaacccaggaagtggaggttgcagtgagcccagatcatgcccctgcactccagcctgggtaatggagtgagaatctgtctcaaaaaaaaaaaaaaaaaaaaaaaaaaaaaaagaaaagagaagagaagacaagagaagacaagaaaagacaagaaaagaaaagtcttctccaactctacagtgaccgaggaaataaaaatgtatgtacctatgttggttgcttctaactagaatcaatgtctctgtcaaagtactttctgccgccaactctttgacaaataatcacttgtcttcaagtaacacaaggatcaccttaattttgattaatgtcagctatggtagaaaagaaaaaaacttactggatagtcaggaaaaatactctgaaaaatagtacttaattcacataagatatatatctcagtaaaattaaaataaagagcccctaaaaagattaattataataaaaagcattatatcaagtgtgcttttcacattattgccttttgaaacattgctctcattataccctgggggaactgatttggtcttaatgccaaggaaagaaacaataagaaactaaatcacatcagttgttgaataaaactgttgaaatgcatatccttgaaaatggatttatgaattgatcaatggatccagaggttatttctgaccaatggcatataaaatgtatcaaaaatcgttggatctctctacttttcactgaaggaaaaatatgttctgactctggatgaggagatatggtttgattttgcaggctcctaggatctgaactcaccctctcaattgcatactttacaaaagtgctcagtcacctcctttcaatctccagaagataatatttcttagagcagagagaccattttattgatgttggatttttgctcctagacatggaactaatcctattaaagaaaagggaaagggaaggaggaaataagatgacattgagaaatcatgactcctggcaagagtaacgcatattacataagtacttaataaaaaatatggcaacaaggagagagggaggaagggaaaagggaagaacaaaagtaagaaagaatgaaaaaaatggaaagagaaaagaaattaatttagctttagttaacagtaagaaatgaagattgaataaaaattaggatgttctcttgcttttctgttaaatgtgtccagaattacagaattattttaaaaaattgaaaaaagaaaaggctggatgtggctaaagtttgtggtttggaaggggaaatggtgttattcaaattatgtttggagtcttgccctctcatatcaatccagagaaagtcggatgttttcctgagactctcggcataaaaagatgcaggaaattttccccacagaatgatttaggctatgaaaattattcactttagaaaagaaatgaatcatgtattattgttaacataagatttgtcattcatttataactggtttaaaacagctatttgtaaaaccaccacagtattttaaaaattaattaactttaacttgacgaataaaaaatgtatatatttatcatgtacaagatgatgttttgaaatatatatacattgttgaatggctaaatggagctaattaacatatgtatctcacatacttatttttttgagatgagaacacttaaatccactctctcagtgattttcaagaatacattgttattagctatagtcaccaccttgtaccatagttctcttgaacttattcctcctatcaaactgaaattttgtatcctttgaccaatatctccccaacccctcctctccccaagacccaggtaactaccattctactctctgcgtctatgaattcaaatatttagactccgcatatagatgagatcatgtggtatttgtctttctgtgcctggcttatttcatttaacataatgtcctctaggttcatttatggtgtcaaaaatgacaggatttcccactttattaaggctgaagtgtatttcattgtgcatatatactacattttctgtttctattcatgttgatagccatcttaatattgtgatgcattataaataaaatatgtattcaatttcctattatgttacagccattctctgcaatattgacacacaacataggatatttgataaatttatcattgaagataaattcagaggctatgtaggaaaatgtacaaaggataactgcattgaatgtgatactggactactaataatctgtaatttacctttaaactaaaaatatttgattctacaactaggcaaaagccaagattctcaggctaatgtataaacattaaaagatccaatgggaagacattaagtgcttacataacaatgatgagttaaaattctctgtcactttgcactataaaaagtttaacaattcaatcaaaagaagttataacaagttaaaagtgtgtttatataacaaatagatccttccttaatatttattttataatgaacacatataaaactccttcaaattatttggaacattaggtaacattatataatttttgctaagtttcaaaatgttcactctgcaaatgcatatcatgccataggtctagagagatgagaggtatggatgtgaactagtaggaagagtattaacttaggaggcacactgatcagggtatgaattgtgattcccctgtttaccagctgtgagatcttgagaaaaatactttaattgctgatgcctcagtttccttatctgtaaaatgtgaattaacagcacagctctctcataaaaggctacaggaaggattaatagaaatactgctcacagcattgtatcaaatagctgagcacattataaaacctcaataaaaggtaatttattattaatgttagagaaaagtttaaattattaatattataaacattgtcaacttttcccattacaatcgttctaacaaaagccaatgaatagggctgggggagaggtatactaattaaaattacaatctaactggggagagaaaacatttcagagttttacttattaagtgcatcctgagtaagctgagttggggaagaaagtgttatggtacctagaaagtttaaattatcaatgcacagtagggatcatgttaaaatgcatatcatagcataaagttttccaatctattccaattcacgtttggtataataaaataattagatatctgttttacatatcacatgtaagcacaacctaatcctctactattatttctttattatttgcaatctctgattagtcatcaatgtaaacctaactttattaaaacaatatttaaaatggtatttgccaaagcttaaacatagtttctcatgtcggacccccaagcagtttttaacatgaaagaaatatgttacatttactaaacgtagccatgcacatacattttcctagagatgtgcctattattaagtctatggaacatctccagtagccattaatgtctttcccgaagttatatggcatttcatgaatgtacccacctggcaggcctctggttggcattccacaacaaagagttaaaacatcccattaatgaaatttatagtgctttttgacatcatttctggtggggagggaaactgcaagtcacttctgttatggtttaacttgttatgctattccagaagatgaattcattgtcataaatattcagcttcacgccaaagaagagtgaacccagctggttggtccttgtcctgtcctcatcttctgtcataattcttacaactagctacaatgaggcagagtcttacttcccatgcaaattagtcatttactttgatttccagcttctgacttataaatatgcataattttataattgttaaataatagaaactttcaataatctgaccaagtatacattgttccttttaatcttttgatacttttgcaataattcattgtcttattgatttgtaccctctatgcaaatctacttccccattactcataccgcacacacacacacacacgtaaacctataagcaacatacttgttactgtatagatatttacatattttatgtttacttataaatataaattgtacatattttatatatttatatattttaagtaaaatatgcgggtttactttctttagaaatgatgtgctctatactaatttgcatgttatttggtatggcatatgccatatatttaaagcatttaatggcaaaaaaactttttaacatcaagtttctcttgctcccttaaaaatgctctttgagccattttaattagactgaaatgaaatagattccttaggcaacagcataaaaatagtaaagtaggttttaaaagtcttattggagaataatttcaagtatggttttatttgatgtaattatttatggattaaacacacagatagcagaatagatgaataatgagcattccctcaactcaggcaatttaaactgaattttcttgagcttttggactttcctttaattagcttggatctggttagtgactatatggaaattaatatttgttttcaccatcgctagtttccaagtctggatttcaagaattgtgctcctcagaaaacctcacccttcagtaactttttcccataagctcataaattgtaattatgctctcacagactaaatgtaagatcctactagtgtttggtttttgtaaaactgtaagagcaatctgtgcaaataatataacgtgacttggttattcttcaaaatattaaaccagtaccattattgctacatgccttttctaattttcccacattttatcagattaaataagtaccttcccatatcttttgggggtaattttatcagtatcaaaagccctgtcagagtctcagcattagcatttagctatagaaccagaattttgaatttatgtcctagttttgccaccgtgttatttagacccaatttcctattcaataacaatcaaaatatagcctgtccatcacccagatgatctctatatcaacatcagagagtggcagatgaagctctaatccctatatcagttgcacacatattgcttgtaatcgtgcacatccctgacttttgagtaatttctcggaaacccttacccatcattatcttgggattttgacttcttaaagaatagatttctccatatcttctcttcagagccattttaacttccacttatggtgcagtggtggctaagtgtagttcatctatttcatgaaaaatattttggtgctgattttgctgattggttgagttaaccaaatgttctagttatttgactagggagggttttttgtttgtgtttttactcttaagcataaacatactactttgccagaagtctccctttgaagagtctttccatggtcacaggaaaattggctttctcctgatttcataacaaggaatacaaatttacactttatacaagattagggtgagcaaattctaaacgatattattctatttttgaacttcggcttgacttctgagagggcttgacttctgagagggcttgacatgcagcaaatgtttgagaatcaaactcttaaattccaatccttacggtaccctgtgtgattcagaaccagtgaagcttgcatattggtaaggtagtggtaaaatttaaaaaaaaaaaaaaaagcaaaacgaacagaaatgttacaaagtaaaggttgtttttgtttgtttgtttgtttgtttgcaggggagagaggaaccaggaaaattttgcatgaggaaaaatataagacacgacaataaatataatttaaaagatagggctgggtgcaatgactcatgcctgtaatcccagcaatttgggaggccaaggtggatggatcacttcaggccagaagtttcagaccagcatggccaatatggcaaaaccccatctctactagaaatacaaacattagccaggcgtggtagtgcacgtgtgtagtcccagctactaaggaggctgaggcaggggaatcacttgaacccgcgaggcagaggttgcagtgagctgaaatcacactactgcattccagctgggtgacagagtgagaccctttctcaaaaaataaataaatacataaataaaataaacaatagcagttaaaaacagtatagtttgtttataataaaaacgtatttaaagcataagcagtatgtagttgattcattttctttaaaattggagaaggttaatattggataccttaatcttttgctctgttgtaatccatatgaagatttaaaggtttttgaagcattttatttttatactattaaagaaagtataaaaacttttgggtgactcaaaagcagattaacacaaatgggcagattgatgactagaagttcctcaagtaatgatatatgaaagaaattcatgttccacataaagagaaagaaagcagtgaacgacttgtgaaaatcgtgtttctataaatctttgaatatgatatgctgtcatcaatgcttagcaactgcagaaatatgcgtcactaacgaatcagattttattaaatgtatgtgtgatgtgtgtgtttgcatttgcacgtatatttatcccccttatctgcacagcatcactattacttacgtaactgcagttactcagttaaacacatcctaatagagaatataaaatcattctcttgagaatctaagcaaattgcttggttgcatttaagatccatcatgagtagcttttcctgtgtcaattcattatacccaagggcaattcctctatttcatcctttttcaaggtcatgggttgagcttgattaatatgactggaaaacagaatcataagtggaaaatatcggtctggtatcagaaaaggttttgctaagaaactgaataagggaaagcttcataatgaaaatactgcatcataagataagagttgtattggaattttaaaaattattttgggggtgatgaataagaaccataacaatagatgttaaggctatggttcaatggctgtaaaacaactttctatacgtaaaaatgtagctgacaatatatccataaaatagaacaaaaaatgaattgagctgagcacaattatgttatttaaaaactccagaagcattagattggaacaaggaaagtctaagtgtatgggcaaaacgcactaagtctctgacatgccatgtataaatattcatggcaataattttcccatgagaggaaaaaaatgttttaggaaatgtttgtaagtagaaatagggtggttttatactttcttcactaaagaaatctgtagattgaggggagtttaaaaatatttcctcaaagaagaaacaatcagaaattccctctttttttataagatacaaaaagacaataaatatgttcttaccacaaaatagtggaaatagtttaactttaggtaatggttgaaggaaaagtttgctgaagcataggatgtagcaatgaaaataaacgaggtgtgaggtttcacgaccaatgattcacacctaggattaatgccagaattcttaatagctgatctcgtaggtgggattatatgtggcattctcatatatgtctctaatggttgaatgtcttcactgtggatgcttttgctgacagaaattactcagtaaaatctgtgggcttagcctaagtttataatttgctgttacatattttttcttccccaaccggatcttctgtcacttgaagcatctctacgataatatcaataacctcaccaatctccaaaccaaaatcatcatgccaaaatgttcctatgcctagcaaactagttttccctttgccaagtacaaaaccttctgacttgacaaactacaagataccataccagggtagtttaggcaagtgtatatcacagccgtattcatctatatttagctatttacagtgtatctggctttcccaattaggttgtttgccaatgaagacaaatgttatattttatacatctttgatctcccaccaaatttttactgtgccaactaatagtgtttattcagtggctaagaaatcacactaaattggattctgttcatccccaacttgttaaaatatgtaacaaatccttggactgggattcttcctgcctcagatttcactgtagaatcaacccagcggataccataatacaacccgcgtattacacaaatctccatatgcagaatttacacatgtgatgtgggagaacatattccattactcttggacctctcagttagcataaggtataaatagaggtccaagggtcagaaatagaattttggagaaagcctgttatcagatttctccagagaaagttattgctgtgttgtaagtcccctttcctgcttctatggagggagggctgagaggtgttatctctctgcaatggaaagacacagaggacaggggcctgactcatttcttaaaaagttaaactttactaggctctaacccatgccagagaaatatatacagagactgaaagcctgaccagctgctttgatagcagaaacagataggagagtaccgctgtattgagatagggcacaacccccagaagttgtgagaaccaaggatgtatagggttttatctggatcagatgtaggccaagacagatgggggtagggagtcacttcggataagctaaactggggtacaggggtaaaggaacctcaccacaaagagaccggccacacaccacagggtacgcaggggctgaggaaggagccacaaaggaattatctgcaatagaaatatcagctaagggaactgcaggtgagagaatccagcaaggaatctttaaagattccatgaaaacactcatgaaaggaaaaaaagatggcttttatattggcctggtctacctgaaaacctcaacttcaaacgttggccatggccgagggtttatgaagccacccagataaacaagaactgtactatttttacacctcctctgctctacacatcactttggtcctggtagagctaacacagcatctaggtagtaagagactctaagaggagctaatgctatacttccgtttccaaccacaggcttctgcactaaagcaaacctcacctgggagaggatttaactgttgattacacaagcttttaagtttggattaacaccttggactccattctaattactgaattggcactatgtttgtgatctaaagtgtctgtagagctgtggagatgtcatggctccgccagaggttatgtccaggaacacatgaagatatgccacactgtaacaaagtgtaaggaggacagagagagagaaaaggaaatcttttttgcttacatcatgagcttacatcgaacacagtggttacaaatagatgagttttttagttagtaaaatgaattctccctacctaaagtaattttatgtagagtcagacgaggaaaactcaatacgtgttatctccagcagcctgtggcacaatctgaattgttcgtgctttatggggaaagaagtgtgtgaagaaaaaaatagtagtagtagcccatgaaaattctctcttatgggttgttttcctgagaatgtgtccagctgattttattaaggagggggactgactgtcaaagacaacagaggtgcccccttagtactcgaagaattagaaaatgtgttcagataatagcttgaacccctaggtgtgccaagagaaagggagacagcaggctcttaaacagtgttgttaaaattcacatttatttaaaacacagcaattagctaacaaaccttggtgacagactgctatgaattttgtgctgactccgtacacataaattaaaccattccaagttccccacgtgcagcttttgacatttgtttcgtacaagtatgctggccgtggggaggcataaactttgcttttaattcctttggcaacagctgtggatcattttgttaaatttcttgtaagagattcaaaaacacttttctgaagacaaaaaatgttgtctccattgcatgttaagctctaaaatgtattctatatgagtagttttcaaaatggtttttagatctgactgcagacagttaaatattatggaattatggtatatatagttgtgtgccacataacgatgttttggtcaacaatgtactacatataagaagatggccccataagattagaatactatatttttaccgtacctttctaggtttagatacacaaatatcactacgttacaactgcctacagtattcagtaccacaccatatgggtttgtagcataggaaccagagtctataccattcagcccaggtgtgtagtaggctctcacatctaggtttacctacgtatactccatgatgtttgttcagtgacaaaattgcctgaggatgcatttctcacatgtatcccaatcattaagtgacacgtgactgtaattttttttttccaatcaagtgctcctctagttgctttggataaacccatcaaaaaagtagataaaaacccctaagaactactcccccatacacacacacacacgcatcctgcagaaagggagagagaaagaaaagatgtcagatttcaataatttctaaaacgtaagaaatctctctaacaaaaaggcataatacctcaaaattaagtataaaatcaaaaattttacttacaagccttttccttttaattatggtcattagcataaacactctgattctctgagctatttaagcataggatttctatttttctactctgtacattccctgcaagactagcaaaatagtaagtatatagtaggtggtcagaaaatataggattgaatcaagcaatatggcagtaaaaatggtccattgtaaaatgttgagtatgacatcatttcgagtaatcaagtaaacattaattatttcataaacaattatttagtatcaaggcattgattgataaaatgttttctaactacattgggccttagcttagacctttcttactgaaaatatggtctttgactcagcagcattaatcccatcaatgtcccatcccagaactacagaagaatcagaatctatattttaacaaaattcccaggtggtttatacatgcattacaatttgagaagtgctaatttataccactggttttcaatcaaaactactcgttaaaatcatctggtgttgttttaaaaaaataaaaaaaaagagggaaaaaaaaaaaactattcctgagccacactccaaaccaattaaatacgcatatgagtccagggatgaagtttcttttttaatgctccatgaagttctcaggtgcagccaagttgagaaacattgatttaaacaaaacaatgaaatatcatgctggctatgctggaattttctgaaataaatgaaattgagttttgaaattaaatcagaggaaataaacttctaataccatatatgaaaactccagtaagacattacttaataccctacagattttaggatcaaatggaaagacacattagtctaaatatgccctctaaggctcataaatgcagtccaacaaaatatcttattcttattcttctttgactcaaaatcatcttaaacagttaatatcagtatgcagaataaaactgaactttaaagttctgcaaaattaaagcaaactttccttactgagcctaaagaggatctaatgtgtcatatttcatctttaaagcctgaaacactgttttcccctaggaaaaatcaaatgaatcaatcctcccatcaagtaaactaatatctcattatgacttagattcttgttaaaaatttggcagagtattccgatttgttttcatatatcaccataactatatagcacatccagaaatctccagaatgaataaatattctccaagcacacgataactaaattgacctaacattttgtgttaattcacaccatcaataaaatgactttcaaaaaggaagacttttcctaaaagctaaataatacaattgcctgggtatatcatatttttttgacgatattgatgaacaaaaataagagatgattttttttcacatttaatgtggaatccaaaagcgtctaagcaaaaaaagcttgcattcataacagataaatcaggaatgtagaaaatatgaattctatttttaattctggagaaaagggtaaacaaaaattcaaagagcgtaattaaaataatttaaatgatttattttcttatttagtcctctattcaacctaaggaagtagctattattacccccactttccagaagaggaaactgatgtacagagaggatagaaacgttgccaaggtcatactttatactttattgagtagaatcttatgatgatttgactcttagagtctttgcagtcagacagacctccatgaaaatctctaatatactcctggttatcaagactctacttctcaaccaacaagagtggaattccagaagtctagccctagaaacttacagcaaatgtctagtgaaccttaaaacgtctctgggatccaccgtctgatgccaagtgctttgcctctgtctctctaaatgttctggtctacatcaaggccattcaggtgtgttagaattcactaggtatattgaagtatacaggatatcatcaatgctttctaaggacataatcaggcttgcatcattttcactttataagtaagtcaaacttcagggactttttcatattttttaatcaaaaagggaaccattgaagataaaggagaaaacataaaaagcccttgctgtgtaaagattgacaaacaaggtaacttaagtatgacataactttgctcactttaagagttggcctggaaacatttctttgttcaataatagagtcaagtcttatctcagatgatttttttaacctattatttttcagcagatgcatctgtgtaagaggtagtaacatccgatgttatattcctccgtgttgggagttcactggtcactcaaactgcagagaccacaattgcaggcagtgctattcagatggactaaaaatcaaatgaagacccaggagttgtgtgatgcgatggcctcatataaagggtaggtggctctttctcccttaattatttctcatgataagtattgataaagcttcaagggtcagcaaagtatgtcctacaggacaaatccagcccacctcctgattctgtagagccatgagcaaagaacagttttaacatttttagatagttcagaaattaaaaagaagaatatttgatgaaacctgaaaactgtgtaaaatttaactttcaatatctataaatgagttttttttttaacacagccatgctcattcatttacttatggtatatggctgcttttaagctatacaccagagagtctggtgtataccatggcagaggtgagtaattgtgacagagattgtgcagtgtaaaaagcctacaatatttactatctggctctttaagcaaaggtttgccaacctctctctgacacaataatgaaaaaaagaaatgtctttcagcttagcaaatatggcagtgactctgttacttgctctttcttttggccagaaaataaactgaatctctgcaagcttccgtttccttctatgcattgtggggataaagaactggctcataggaaagaattcatttagcagactgttttgcacataaaaagcacttaataaattaatgtttcccttaagttggaagcacttagcaccttttctcctcctctatctgctaaaatcgtactggtccttcgaaggcaaaacaaaatactgtattttcatacaatcttctctgactgctcaggttaaattagttgctccctctatgtttccacagcattctgtttaccagtctgtcatattatgatcctcaatctaccttgtactttggttatgtctaagacccttcttaaatgcagatattatttcttatgaatttcatgacttgcataatgttaagcacagatagggccttatacacaggggacattcaatgtttgctgaacaaatgaaaagctgaatgaagatgaaaatgaacaaccaactgggggtatttaagtaggtttactgccctcccaaataataggcaacatgttatctaggaggttcagtcaaaggaatgtcagggaaaggctttctccaaccagtatcaaatattagactgtctaatttatatcttgctatattttacctatgaagatatatattccacttggctttagggtataaattaaaatatgtcatagcaatagcaactgccagagtcaaaagaggcatttagtgagaaaatggtagctcataaaatgaatatgttaattaggaacttttaatactttccatttttttctgctgctcaatcagtcttactccatcctgtattactaacccgaatggctttattaaccacgttcttttcaaaagtcaatttgctctatctttaaacaccacacacacacacacacacacacacatacactacctcacacatgaacaaatacacttttaaaaagctaacaaaaggaaaagaaactcagggaaaaaatctatgaagtgacttatatctcaaaaagctcttattaaagtaaaagcaataaaaacctgaattataggagagaaataaatctcttctcattggttatctgcttcaaggaactgatgccttgaggaatcagatgtttcatgctaatttaaatttttggcaccttcgattacatgaaatctaaaagattgctttctaaataatgacaacagatttcctgacaatgcgaacaacagatgtcaccaaggtaagcaatggaggtttaattgagtcttagtccttggaaaggtgatttcgtctgagaggaaatcacaggttacatagttgattaatgcaacttagataactatgcttgattggctggcagcacagcatctccaggaagaaccccagtctatcatctcaatgctctgattcatctttatgccaaaatacaatgtgcaaggtatagctgcagcccccgtctaaaattcccatgcattacgcttttcaatggccacagattaaaggtatttaaatacatgttagttatttccatttccaatgagagtttaataaaagactatatcttctctttttaatgagaatattaacaacattagtaggggccaagaagattctccaagtctatgcaagagattatatttatatatctgtttttatatctatcatcaatctatctgtcatctatctacctaaattaccattcagtcctctcttttcccgtaacatatcagtggagatgttatagtagtaaatgtggcattgtggacatttataaacatttgattaaaaccatggatttcccttcctgaaaatattcatatgcacatacatcaatttgctgtataatttccctaaacttattcatggactcccaatgttaaaaattttataggacattttaaattataaaatatgatttctgtgctattcaaaatcataaaaacccactatagataattttgcatcaaaaatcacaaatttctaacaacgcacctttaataagtttaacacaaatcatagttctccttccacatcacatattctctattctataagttgcttgacctcccactttgtaagaatcctttctgtttctatttgagtattcttgttctcccaagggatggatatctcagatttaaagataaagcttttattttaaaacatgaatacacaacccagcacagtactatgaaatctcagaagttcttcctaatgtttaacgtaaatatttcctatgccagatgtagctattttccttgtcacttttgcatcataggctagaggattacaaactgattacccagactgcacttctctgccctacatactagcaaattctgctgcttccaattttccacgaagagctcatccttcaagcatctactccatctggggagctgtggtggcctttatctaaaactagatttaacaccagaactctagatgtgggttttcaaatggaataagaggtcatgtgggatagagagctcttttctttcatactatgtgatggatgatatcgtttggatatctgtccctgcccaaatctcattttgaaatgtaatctccaatgttggaggtggggcctggtgggagatgtttgaatcatgggagcagatgcctcatgaatggcttgggtcatccccttgatgataagtgaactctctctctgagtttgcatgagatctggctgtgtaaaagtgtgtggcttctcccctgcattgctcctgattttgccatgtgacatacctgctcctcctttgccttgtcatgattgtaagcttcctgaggcttccctagaaaccaaggagatgccagcaccatgcttcctgtaaaacctgcagaactgtgagccgatcaaaactattgtcttcataaattacccagtctcaagtatttctttatagcaatgcaagaataatctaatacaatagcctactttaataaagtttgaactttgtatgcaaatgttacacattactaaaacatttttatttttatttatttattttttgttttttatttttttgagatggagtctctcactctgtcacccaggctggagtgcagcagcatgaacctggctcacagcagcctccgcctcctgggttcaagtgattctcctgcctcagcctccctagtagctgggattacaggcgtgtgccaccacgcctggctaatttttgtatttttagtagagaaagtgtttcaccatgttggccaggctggtctcaaattcctgacctcaagtgatccaccagccttgtcctgtcctctcaaagtgctgagattacaggcatgagctaacatacttggccctactaagacatttttaaatagtgaaagccacccactagaacataaaagaaaatttaaaaaaatgcctctcttccaaatttcagcagtcttaactaattttatttctctatattctcctagctttttaacctgcactcagtgttaccagatgtaatcaatgtagatacagccatttgttgatcgtatacacagtactggttaaatgtgaactctgcagacagactctctacatttgaatcccaaacccaggggttatcagccctgcaatcttgctcagttccttcatgtgtaaattagggaccataatagtactacctaataatattactgttaggcttaataaatgtaaagtccttcaaaagtgtttggcacattaaaaggacctaataaatgctatatttattatgactagttatttagttcctctatataacactaggttggagccaattttctgcagttgcagagtctacccaataactcttaatggccacacaatatttctttacctcttggcatgtaaactcatttaataatttctataccattgggtatttaaattgtttccatcttttactattatagctaatactacaaagaatatcttcagacatacagctcttttttttctcctttgaagtgattttattaagacaaatttctgagtttaataaatggctgaaaagctgaacattgttagtgagccctgtgttataaagagaaacaaaactgacatccattcaggttagtggcaaggtgtttcattaaagaacatggaatatttgtaatactgtagtattactgaaaaagagtaactttcatgggccacaatttcaattttgtgttccacatcctcctgcattctgaggtcaatggagtcaggacctagcggtttttcagtagaaatctttcacatataaaattcaaggcctttttgctctgatgaccatagagctatttttcacagaaataaagcttttcctgatggtcttgaaacaacttcccacagctcaatgaaaagcaaaagcatttttcttttctccaaggagcctcaggctacatgtaatacagcacttaatttcctgcaccttagttggtaactgttaaatcaattcatgagcaaagaactgaactttcttgaaattctccactcatgctattccactatatcaacatttcataaaacccctcatttctcccctactattactgggcaaagtgaactaagaagagaaaaagaaaagaaaaataattcaatctaagttactatgaaccacagcagatctcatgaagggtactggggagaaataagatgttaagtacattgcaggagctgacaaactaattctggatgagccaagtcacaaaaaattaagagaattattgtatcttatacgttatgtatccttcactatttcagcaaaggtaaactaaaatgacaaatatgtttccacacttacataacccatatattcctccagattgtagaagaaaaatgctatgctgaaatttttaaaaagaaggaaaaaaggtaagacagatgaatggatggagggaagaaaagtgggaaggaaggaaggaaggaaggaaggaaggaaagaaggaaggaaggaaggaagataaaagaatccactaattcaatgggaagaaaatagggagatataatgggtgttggtggatgttagaattccaccaaaaacacctcaaattccatttaaattgatttgatatgtaggtttttcttgcccttctgagtttctcagatagtatattggcaggcagcctcattccctgcagtaaggatggttcttaaaaaactggaccaaaatcaatcaattagacattgccaaagatttctctccaagtgtcatctaaaaatcattaactgtggcatgaaatatcatggacattgtataagacatccatgcatcatttttggttaccaaggaagaataagcctcatgtttgaaactacagagcctccttcatgtcatgtatttagtaacatccagtacatctgctggctttgtatgaattcagaggttcaagcactcttcaaattcttttctcctgtattctgtgttattcgcccattaaactttttctgagtcgacataagtatctgcattgttgaatgctgtactgtcaaccagaactattgtgaatctgattctcagcccatttgctggaagttacagtagcaaggctgaaacattacaatagcaaggcaaagtctgatttggctcagaattcctgatttaaactcccatcagcgtatcccacccatctttgaaatccaacctacaaagcctaacttaccatttcccacctacctgcctatctctagctttccctatcacctctgccttccttctttctactaatggtatcttccaacctttacttaatttactcctaatttttcctttagatatcaattcaaatatttctgtttggggggaagtctttcccaaccctcatccccagattagatcagtccactctcatgtatcacatctgaatgttttataaacaaacacaaaggcaacttaatgcaggagtctgaaagacatacaatatgtcccaaggaagaggtagagaagctgaggacactagttttgcagcactgtaaaaagaagtatcccaaaggattcagaatttcccaggctacagactgactccttggtttactgagacgtcttaaaacggctcttcaaagctgatctcctaattgtgattcttgcctagaatctgatctggtcctactcatttctcttatccagttctagggttttctgggaagacaggagagggaaaaatattgactttcctccaagtgatattaggaatgactaataaaaataatggtgagtcctggaaaattcagagagctgcattaaaaaattaatggcccgagttccttggagtcatctgaaaattaaacaatcacccagagacaaatccaaatttttttaaaaaagcatttcataaagacacagtttattctaggaattttcagtaactgttattgcttttttgtggtagctatgcttcaagtaaggctcatttcgtttcaagcctaacttagttccattgcagacaaggaaaggggacggggaggttatattttcatattatctgattttgtgaaattgctatgtaaaaatgtaatccatttcatgaagataaaaaactactttaaaacatttttaaataaaataaaacgtaaccagtgaaatatggctgcatgattacggggcacagttgaacctaattaccagcaaattacaaaccactccactaaatgaatataaatcctcaacaatggagaagggggctctatgactatatgatatgcttggtactcttttaaatgatacttccctatttgagtaaaacaaagaagaaactgcaaagggatgaggcaggataactgcggctcatttgtcacaaggctccaacttgcttgatttttccctgtgtgtcagagaatgtgcacattgaaagagagggagctctccatcaccaagagagcccaaaaatagcccaactgatcatagccattgtaaaaatattcatggatgtaaggaaagatcctttcccagtctgatgctccttgacttgtgatttgctaaatttgagaagccatcacttacacaacctgttttatagacaaatccttccagtttcagaagaaaaaatgtcatctatctcaacctccatctctttttcaaacttcgatagatgagaagaaaatggtgaataaatttttagaatcagttttgcaagattggtttcaaggaaggaagagaacaggtgaagtggatagagccacacttcccacataactaagggcaagttagttttatcacttttgggtaaagtgttccctatgaggggatttactcctttcataagaaaatcaatctcttcttccaacaaaagctactgaaccacttatgctgttacataaatgtgttaatggggaaatccattcaaacatctgcactaagcactctgtatttatacatatgaatgagattgagagacactgccattcctactgttttagcttccactatagtggaaaagggaaaatatatacaatatactctgatccaaggagaaagaagaaaacttcacaaaatacaaacttgttaaaaaataaagacaaaaagaccaagtttccctggggctgaagctgggttatgggcacagacaaacatagggcctctaagagagtcctgcatgctaggcaatatttagagttcttcctcaccagtagctcaggatgcattcagatgtaagctcgaggagtcacgcagcatctcttggcattattggttgtttgcacatccatgtctgtagctggactgcaaaccattctcaaggtggtaaatattcttccctggggctttgtgcatggtacaccctcagtaaatattaaatgaatggatgtatatctgacactgggcgtgtcaaggcttcggaaaatttacttccactcccataaaacttcttctttaaaaaatgcttgcaaaaataatagataggaggattcaatttgtgtttgcaaccttgagacagcaagctgaggaactggtttgtctgcttgctgcccgtgtccttcctgctcagtggactgattcaaggatttgagtcttcaggatgttaagtgagtgaattaaaaaaaaaaaaaagtagaactgaaaacagtgaaaaatgcctgtcatcagcatcgtaatgactgatcaccatcagccagataattatacaggctgaagatgatttttacaaacataaaacctaaaatagatgcctcaaggttaacacatcctaattatcttttgtataaacatcgtataaacactctatactctatttttaaaggtactgctaaagaaaaaataaaaagaaatagagttaataaagattatttgctatatccagagatatactgaaattccagaataaatcttcctattacattattacctatcaaggtagagcagagtaaaaattccaccaatacaagcatctttgtaaaataacatatttaatatgcacacttaccaaaatattacagtgagaaaatcagtgacaagtatttatgtatataaaatgtgtagagtaagccataccaaaaataaataacagagaaagtacttcaaaaattccatatttgcctactgtttatatacctcacaagaactatacctattaacacacttgagagaagatacatagtaataaaaataggaacgtggtcacactgatggctaatcagaaaaactatttggtgtaaaccagggtcgtcagagtttaagaatttggcaagaaagagaggaagagagaggagagagaagaggggaaagagagagagatagaatatagaagaaatggtttctacttacagctactatctaatcccctggcttttctgaagttgaagccaataatatgtgaatactttaaggatacgtaagcatttgtccaaattagcatgactgatgttcagataaggacataacaaggacacagtgtggcactaaagaaacaaagttgctaataacatacagcttttgcaagtaaactggtttccttcatatcaatcactgtggaaggcttcacattttctttatccaacgatgccatcagtacaaagtccatggtttaggtgtttctttaaattatgctttaagaacctaggacaggtccttcaactgttttcaaagggaaaaaaaatacatcctaacaaagtgaaaacagatctttcaaataatatagataatgaagctgcatattaatgttttagattaaagatgattagtatctattatttcttttgttcagtacctggcatgagagctatctataagtaatcagactttatttatagataaataaaatttataggaagccattcgtttagactgagctcctgcaccaagcccaacagaccaaaccaagatggagtcactcatgctgaaattcctcatcaccaagccaaaactaagttgtttatttgaccttttaagcaatcaggagagactcacatccccaaacagtccagttttaggtactacgataaggaagttcctcctgcattaacctttgcaagtaaagtaactttgaaaagaccaatttgctttttgttttctatatatgttttcctctacccttttctgtttgtaaaaccaaactctgttcagctcattgaaatattcattctattttatagaatgcaaaattgcttgactctagaatggtaaataaaaaacaattaggatcttcaaactaaaatctgttgtaattttgtctttagaattatatctacctgttgggactagaaaaggttttgtgaaggtggtgttttctaagtgggaactaaaaagattggtagaaacaatacaggaaaacacaatagaaaaataatgaagagagtttgcccaaggaatggtaagatatcctttttagttaagtaaagtataagtaagataaacaactagaaatgtactttggggacaaaatgtgaagaaatatgaatgtcaagccacggaatttggactttactcattgttctccaggaaattatgaaagattataaattacgagattggcttgaccacattgttcagataactccacattccaacctcccagctaaggatattgcctcactgtcacctcactgagatggattggaacccctttccctgtaatctgaaactaacataaattatattaccaacagcatcttgtatgtatcacaacactccatataaaaccaacacctactgataagggatggaataacgttacttacttttctagattatcaatgttaacagtcagcgattcattaagaatcatcaaaccttggagttaaagaggctcatatatgcagtgttcaaaaagcaaacgtggaaacaaatgctcactggcaggagagctgattcaccagtcgtacagtcactgcagaaaatatagtccacgtgtttaagcactaaagtttcttttccctcacaagagcacaacttcaagaggaaatgcatgggtaaaatggataaatcccaggcctacacaacaacctagatgaagtctagaaatttagtgctgagtaaaatggacaagtttgttcaagtcatcatccagcgcaaatcacaatgttctgaatgtgttctgacaaggttttagagtgtagattcactacttttttggttacagcttattttaaaatttatgatttcttataaactcacagataaccaaggtgccttatgagaaaatgattctcattttaatgttgttgttgcaagttagaaaacaatacccccaactgaaggcctcagaatccaatctttttctgtccttttcctgtcctcctgcctctcagttccaatttttcctgaggttagccatagaaactagaccccttctttcccaaggtgggtgatagaaaccagaaccccatttccctgaagccagccaaaaaccttaacatattactctaacttgccccctctacctttctgtacaaaaattggctatgaaaaaattatctgacctaccttgtttaactgtaggtaataagattccctttccagagagggtcctcaccacactcagaagaaaggaatacgtactcagaaaggccaagaaaaatctagacagacaggtcttactgagtttccctactcagtctattagcattaaatcatattcgttttgtccaatcatatttctacaggatactgtccatactttgttaaacctaagaataaaaagggacaaattattcccctgcttctttgggccttcattctgaaaggcttcatgtcatgtaaaactgtgatcaaacaaatttatatgcctttttcctctcaatctgcctcttgtcaataattttcagtgaaccttaaggcagcagaggaaaatttttctcttagcccgtatactctccattcattgataaaatgattcactgctgtccctatcaaagaatagattgtttctaagtgaagatattatctcaagtttattcagattttagagatatgcctaggccagaagagagaagccagaagttggtaagaggagccaaatttgaggagcagtcataaaacacttattacttttattgggctgaatgagaaagcattctgtaaagatttctgtccatatgcataactgctgtgattgcaaaaccaagagacacagtaaagacggttttcaagggaaaccaaagaatgatgcttggtctgcagtgggggcagctgtttgatcaatctctatagggtattcacatgaagtttttggtccacaagaggcaaatctcttactatttttaactgggtaactatgagtattgcttgcagaacctacaactgtgttgcagtgctcactactgcttgcatgggtctttacagtgaacattctttcctccttgcgtgtattcagagcacggaagtccaccgcccagcatctgtatgaggatctggctgtcacagtccctgcagctcctatcccgtacacatacatttccctgttttctttttttgagacagagtctcgctctgtcgccctggctggagtgcagtggtgcgatctcagcccactgcaaccttcacctcccgggttcaagcgattcttctgcctcagcctcccaagtagctgggaatacaggcgcctgccaccatgcccagctaatttttgtatttttagtagagacggggtttcgccatgttggccaggctagtcctgaactcctgacctcgtgatccacctgcctcagcctcccaaagtgctgggattacaggtgtgagacaccgcgcccagccacatttctcctttaaaggttttacgctgttaccaatcagtcagcttacctacgttaaagactgaaaatcatcactatgttaacatatattgatgaatagacattatgtatgtaacaggatttttttaaatgacaaactttgactaaggcatcagggaatagatatgaactctaaaattttattccagaaaatatagaaatctgaaaataggtaacacagaaattgattacactgctctaaattctacaaggaagacatagaaagtttaagagtagggcttggtaatttcttcatctaaaacctagagaaagggcttcaatagggccatggagagtttttgatcttcttcccattgtactgagaagcacagtacaccaacgtcaaaatatagtcccacctaggaacgtagaaagcaagggcaaggagctcatcctatattttgactgaacggcattcccaaagctggtcaagacagaggagaatgagtgtataatacttctagaatagatgtgggccacatggcaaaaaagaaccagcctagagtcttttaaaactccaatgcaagagaacagggtaagaggaaacgaggctttaataggaaaagcctacatatggtagaaagtggaaaaccaagagctgatggaaaagtggtttgaaggtgagaagtcatcactgaccggacagagtttcagttggagagcccacaaagggaagtctctaaaaaacccttaactacagtaggtaagcgctacccccagattcttactgaagtaccaatcaagtaacaattctctggttcccttcctgctcctccctctccatagtctaactagtcctgaagatatcagtcatggtggttggtttgggcagtgggggtgactaaaatttttggtggccttcctgcaagaatgtcacagttagggcctgattgtggatgagagtgtggaatgaataacctttgaataacgaaggaagtgtttatattatattgagctgggaaatttacttattaagtgaataagtgttttacaacttgaagaaaaatgatgagtttcatccatggacatgggaaaatttttcttatgcataaatttttaaaggacagttaaagaaaatgatcagtttgtatactgattttaccttataagtcatgcttggttaatgtatgagtatatatatatatatatatatataaaatgtacattcccatagagaactttatttaacctagacagccactctgtgagataaatatgtctctcatttcataggtaaagaaaatgactctaagagagagcatttaagacaatcaatagcttgcttgaattgaatgaactgccagacatttttctaagcatttcacatatttatttcatttaattctaataacaaccctatgaagtagtcactattatattccccattttatagatgaagaaacagaggcatagagatactaaagttcacagccagcaagtgatatggtcagcaattacacctgtcagttgagcttcagagcctacagtcctatccaggaggcacatgatatagtgagtgagcagcaaagccagcgtctacaccagaaatcctgaatgagatttcccctagatcaatttgtgaggactcagctgtatcataaacaataaaacaaaagttaaaaaggaaggagggcagcacaacaggtctgtcactatcttgctgtgtggcatggggtaaataacttacattttctgggcttgagtttccatgtcgattaaattaaggaaatggactagagagtctccagggtcccttccagatttgaatttgatttccagctctaaaagaatatgtgtgtggtgggtagctaatgcatattaaattatgcaaacaatttagccttgcatttgactgcagggctgatgaaatatttttaaaatttacatttacataagagatagttttgaaaaaatgctatctgaacataacatgcaatcaaaaatatgttttataacatgtcaactggatgaaaataaaagacagtttcaaagatcaaagaagcctaaatgtgtttttttaaagagagtgtgatggggttatacatagattcattattattatttttagaactgcacagctgttttggcagcttgttttgtaaatcctactttgcaaatgtaatgaggtttttttccaaacaaatgttagttaatggagcagataacacatttatttccttgtcatagcttagcattaaataagaaatgtaacaagaattcagagtttaaaatatgaaacatggtatttggtctctttacttactagttacaaaattagaaaataactcaatattttactttctctccatatatattataattatctgtaattataaaatatttttcataacttcatttcttgtcacataagtcttttgctactgtaaaatcaatagttgtattactagtgcctcttcaaagcaaatctcaagtcgctgagcagaaatttttatagtatctgacatgatttaggcacttcttatgtgcaaaatactgctctgaatgctttacatttatgatattatttttttctcacaacgaacccatatctaggaactatcatcctcatttgacaaatgaggaaactgaggcagaaagagtaacttgccaaagttaatcagttagttgaagagctaggatgtgacaacagaccgttgagaggtgcagaataaaaccagaaacaacaggataaatagcaataatataagctaaaatattgtaatttttagttcaaatgtttgaggctttgatgtgatatcttagatatatttccacagaaggtctgtcttaaaaatgtaaaatttaggccttttttgaagccttatttattcttgaaaattctgtttcattacaaaaaggatttgacaagagaaatgctgttctccacttactcactacactgaatgatggggcctcagaaatttgtggtgcagttttccttacactttctgcagtctctcacattcagtgtgtggggtatattagtttcctggggctgccactacaatcaccacaaactgggtggcttagacaacaaaaacttattatctcacagttctgaaggccagaattctaaaaccaaaacgtcagcaaggccatcttccctctgaatcctctagggaagaatcctagtttgccttttcctagctttggggggttaatgaaaatctttggtgtttttggtttgtagccacatcacttcaccctctgcctctgtcttcacacggccttctacctgtgtatctctgcatctctccttcttttataaggacactagtcattggatggagggcccactctgaatcaagtatgacatcatctcaaggtccttaattaattatatatgtagaaagcctatttccaaataaggtcacattctgagattcgaagtacacatgaatttggaggacactattcatgtgtggagatactgtggcctggcattaagttgacattgacatacacctctgagagaccctatattaaacacataatctctgtaatgacttcacagatgtctccatgctgccgaaggtcgcactgtgacctcagcttgggcacttagcaacacatgggcaaacagttttcagcgatctcaaaggactgaggtgaaaggattaggggtaatcctctgagtacagtgcatccagggcttacctaaaacataacaaatatgtgcctcagccctcccaaagctgttccctatagcccttatgcaatcctagagtgcaaaggcttcagtgtttcaaatcctcatacttcctgtaatcgtttcctgattatactgcagatgctagtatgaaaatgtctacttggagatttcctgcaaaactgtttccataaatctccaataacagtgtaaattagaaacgagaattaacctacactcatctgactgccatgacatacagagaacacactactcattcatttgctgtaggtagtcacttcatccacttgaagaacattcgtaagtgataggtggtgtttttaatcataagttagtaaaatgtgtattttattggtaggttatattttcaatcttctaaatatttctgaacaattgtctgattaattccttagaatgcaagctccatttgttctcagatttcttgccaatatctaggtgaacatctggtacatagtaggtactcaacacaacacatattttttgagtaaatgaatgaatgagtgaatgaacttggctgaatgaatgaatgaaactggatgacaaagaagagaatgcaaaattactagattcttaaatacacaacatgcccccttattactctagtcaaaaaataatttatgctaaaagagctattttgttttggattctcttccactgtgtgccgtccctccatactcccactatgagatgtttgaaaattttctttaaggagtggctaagtgtactatgtaccaaaatcaaaaagtaagtatgtaaatgactatatctttgttttcactgtggcttccaaggagttctaggtcaattaattgggtcaaatataaaagctccataggcctttatgcctacagattctgtatatctaatatttatctgatatatgtatattagatatatatatgtatatattagagagacagagagagctgtaacacatataacaatatgacctcgaattaatattttactcttgtttcccacattaagaagttcattcttttgaatagtttcaggtctacagaaattgcacagagagtgcagagagtatatactataaataaggcaccagatgtgattactcaggaagagcgaagagacatgtagagcttaatttctgcccatgaggtaagtggacgtgagagatatacacataaacagataaaatggatgccttgtactgttgaaaaagggatgaccatgttttgcaggcagtattacagtgtttcctagaatcaagaaatgctgtatgtgagggaaaaccgggagggacttcccagatgaagtggctcttggactggcctttgaaaaataatgtaaaggtacaacaggtatgagaaaaattttcgtgacatgaatggcataacacatatttttgaatgttatctaaaatattagatgaatgtaaccaccatagtctggggctagaacatatggaaccacagtctagaagaactattactatttatgttatttataatagtaataacagtatgaaaagttctttgtcagttgtgattcactctgggtaggacattgtgattcaccttgttttctttccaaacaaaaacattattatctttaataattttttgacatcagagaggcaactaaactcttcgttaaaggataaggttgagcacaggcatttatttgatcatttatattcagctctattcataaaaggattgaaaataatttccacacacatataattaaatagctataggatttcagtttttaggagattttagttagaatagttatttgtgtacacatgttatcactcctggttgggagagaatatcattttaccttagaagggtaaattgtcacccctttatttgccacaacagagaagccgattttcagtcactcctcctacatctttattccatatgagatgtaggtaatctcattagtcaaaacttgatgcactgggccatgtaaaaaatgaatagggctatttaggtttaaaaggtggtgggagagtggtcagtcggggaagcactattttatatcactgcctgaatagtgacaaagaattcctctcctatttccacgtggtcagcacttctaaaacagagcccaggttctctcaatctcagtgcacacataaaagcctgaaattctccttctttcctgctctaccagagaaattccacaaagctgaatgcataagaacatttgggatcacttacagacacagctttctccacaggtaggctctgaggtctaattcagatactcagaaataatcccacactctgtcttagagcaacactgaattctgcattgcagcttttccagctactagacacttgccactaataataaaactgtactttgctccccatttgcactcttgtccctattttctactagttagaacctagaaaatcattactccaaacctcaacgttctttctacactggaaagttcttgatgaggaggatcatggaatattcgcattttacctttggtgacatgctgatgatcacagggcaccctgcccattgtggatgttcaattaatattcttaaatgtaaatctggttaatataattctttgagatatctgctaaaatatgccccaattgctgctatattctactctgtccttcaaataatctttacaccagaagtttccaacacaaatgtaaaaaacatagtattacctttgcaatttggcttcccaatgatatgagactctagctaaatgcaggatatggggacagaagggagaggagattttcaaaaaaataggaagaacaaaatgtattgatctatttgatttttgagaagcaggtcacactgcagaacagccttttatctagcattccacagggagagagtaatgtttgtcatgattctcaaggcaaatcaatagagctagagaataaaaagaacaaaactccaaatctcaagttcccaattaactcagaaagcaatgaaatctagacaagctctaatgtaatgcactggctttcataaagtcatagaatcaacaggctggaagtgttgaaataagttcctggagtcacctagaaaactactggggaagctggattttaactcattggccctggtgttatgcagcaagcactaggctcttatcagattgctggtgactctgaagttatgaatgttactgggatttacaacaagctgattggactgcccaggagctactttagttaggttccaccaaggtacaagtacagacatagcctttattcggatacacattacagagacgtataacaagctattgtagtatactaagtactatttgggatttaccatgacctgacaaatgcagtgttcaagtcttgagtatactgctgccctatgaaatgaaatgtaatataaatcatgttctgccagtttaatccccatgacccttagtagttgataagcaatacctgtgacagtggaattattatctccattttacagatgagctatataagcctcaaagaaataaagtaacttggccataaccacattatttctaattggccaagccagtactaaaattcaagcctcctgagtctaaaccttatgctcttttcactacaatctcaagcaaatatcttcacatcaagaactgattttctagatcaatgacttatgaagaatatcagcttattacagggaatgcaacatgagtaaattaaatatcattcatatagtttgctcctgtatttttttttcaaaaatggcctatgtaaataagcatttttctaagaatctctcatgtgagtgtagttcagttactgtcattttcttattataacttgaaattcttttaaattctgaagctctcgtttcactttctaccctctgtaataaaactgaaatgtccaaaaaactaattatactttcatttttggtgtttatgctgtgaaccaccttttaggtcaaactaaaattattttcatggctgcctttagtaattaaaacttcttgcatgaagtaaaagaaataacatcctattgtgagagtattctagactatttcaaggttatcttgtttttggtggaaataaccaaagataattgagtgaacgaatagtgtgctccttaactatgacagcaaatgtttgcatatttacaatgtgctggagatacaaaaattagcacaacctggtgcctgtccctgacgagactgcagtttaggagagatggatacacaatcaattaaacaaaaatttatcaaacttagtcatataagcaaagaatggcaggcttagagaaggccagtcattcattcatgtgatgcaagtgaaaattccaataaggaggtgataactgaaccttgaagtaacagacatacttttgctacaatatgaactttaaaaagctaaggagtaaaaggatcaatcctagagctctgaattgtatatcatcggatttctggttaagttttccattacatgtgctgttggcgcccatcagagagaggttaattttctgatggagctatgaagcctcccaaaggtccttaccaaatcagaaaaccctccaactcaaatatgcatccatggtagactctgtttggaagcgttcccactcactgtttgcattcactgttactagtgctgagtactgtggtgttactgagttatggagaatttaaagcagccagaaatctgtaccctctttttcagttgcttagaatgatctgcaatctgactgaattgattgatttctgggatcatgaccagttttggttgtttcacatatgcttacaaatggtagatacagaggttttcaacaaggaaatgttaaatcgtctcccaaaaaggcacaaaagagagaatggaatgaactgattcttaatgaagaaataactgaatgaaaaagaaatccttttatctattgtgttaattaatattcacaaaacttttaagacaatggtttattgttgttctgagtatactcttgagattgatttttgtttaattatcttcatttttatcaacaagtgatcaaataacacaacagttccatgatagcagagggttttgaccacttatgggaaactttaagacactatatatctgctgctaagccatggcatgcacacttacaatgtacagaagtgttgctgtaaaatatgtcagcctttcaaaatgttttcttcagggtttacatcctatgcaattctaagataataaggcaatttacaaacttataaaaaagccaaaatagaaaattaatgatcaaacataaatggaattgtctgaatgactcagaataaattaaagactaccaggcctaaaataagaaaaatatagcatttgactatactaaccttttttctccaaataaattttgtcaatctccctgtttctttttgattaacgttcaatgtttagatctaatcacatcgactaccataataatttatgaaccatcctttatttactaattcccttagtgttacttccttaaccctcatctgcacttaacaattcactgctggatatattatctcattctccagttgtattccctttttgcctattgtctctccaagtaaatcagggaggaaccgtgtcttgtactttctttgtatcttaatgatacttaacacaactctatgcatatacctttattcagcagttgttcagaggttaacagtccgtgaaatttagcttattgttttaatgtgtttagctatctggtctgttgcatcaaagcagactagaagcagcaaccatgagaaaagctccgaaagctagcacagatgagaagagattacatttaaaaagccagccaaaatagtaaaaccactaaccccaaagtagactggggtccttcagtggaggggcaaatgattgcaaaaccttcagtgactctgagaatgtaaatgaaaagggtattcatctagattccaagttcaacaactatttatttaatacttattgtgtgccaagaactatgccagaatttgagtttacaaaggttgacacggcatctggatcatttgcttttgagatgctcactgtctactggtggaaagggatacattatcttattttcaaaaaaaagaaaaagtggcaaatgcgatgacaaacacaaacacattagagcagaagcgcagacaaaagatacttctttaacccagcctaagccaaaaagggcttcctggtgtagtaacttcccttgataaactcagttgccaagaaaatgtagttattgtctgttattgtttaataaggcactaatcactaatcactcctagaaataagttgaaggaaaggctttagaataaaaaaaatcttccaaaagtgcttcaggatttggggtgttcactataggcataactttgggtagaagtgacaagttttcaagcgatgtgtgggcagggaaaaacttagtttgtgaattgcaatgctactctgtgtgacaaagatgcgtcattcacaaaatacaaacaattacctaacagaaaaataaattcacagcaggaacaagagtgatttatagcaattaatgcagaatacacttaacacagacatcaagaaatactatcaaagctgaagcacaattacataaaccatctaggtatcgtttaagagaaagacaaaacatagtatctattctcccgaaggattcatgaatcttccttcaaaattagatttatacctgtgattaatttttttaatttttactaaattatggtatgctcttttgttatagctgatatccagatgaaatttatatttaaaatacaaatgatacttgtatcttaattgatgattccacgtttccacttaacagcctgaaagttcatccatggccatcctattttcttgaatcatcaactataaagtgttcataattaggattttggcaatgataaatgtacttaagcaatggagctcaaactaattcttatttaatggcttttcagtatcaaagtagacaaaattttagtctatcccaaaactagtttgtgctggttaccaaggaacatgggacctggttataaatccatttttctatttgaaatgacactttaaagattggctgcaaactgtgcactcaagatataaacactatatttccattttaaatgtcttcaacattacctaagctctcatgtgcaccatgccttttatgcttaacttttatcacagaactaccattcatgataccaaaaaaggcctcatgtccgagtgcccttgacatcctgctacaagaggaaaccactcactgatactcaagtctattatcaccaagaaatctttccaggaaattagatgacattcaaggaaaacactgataatcatgcaggaacctgaaggttatattttaaatgatttgatcagcctctgacgataggaaatagatttggggaaatagctgagcatctttcattcatttattcaacagttattgattatgtattcacaatgccaggctccattctaagtgctgggatgcaggacccaacaaggtagacaaggtccctggtctcatggaacttacattcctttgaatgagtccatcagtgcctagctaaatacatcaataatttcagacagtggcaagtgctgtaatgacaacaaaataggtaacgtgactggtgatttggagcaacaggatagcgtctcagcttttgtgccaaaaggaaggtaagaataaaacgagaaggaacactcactggaagatatgaagaaaaaaataagtagaggattcaaatgcgaaaatacaatgaccattctaagtcgatatgtgtgaggaagagactggaatcttgctgggtactgcacagacctggctccagcctacagaagagaagagcaaacaatccagagtgggattatcgactgcatctcttattttcattatgtgggagagttaaccacttttaacttttgtttattcactacaaaattagaggaacaacatcaaatttctaagtttgtagttaatattaattagtgtaaataaagcacttggtacatattagatgtccaataaatgccagttctctctttatcaggggaataagtagaatttacaaaatagggattacaaggagatatgaaacccagttataataatttattttataacacagctgacagtgcctcattcaaccttccagtaacccttcagaaaaggttttatcatctttctcttatggatgagaaaactgaagctcaaagagatcaagtgacatttgcaagatgattgctttgcatgggagcttggagttagacccaactaatatctcctcttggctggggatggaaagacaaagttgttggtcaaagggtacaaagttttagttagatgagaataagttttgagatcaattgcacagcagggtgattataatcaataataatatattgtgtaatgcaaaattactacgatagtaaacttccaatttcttaccacagaaaattatgtgagatgataaatatgttaattagtttgacttattccactttgtacatatatatcaaaacatcagtctgtacctcataagtgtgtgcaattatgatttctcaattaaaaataacaatttttaaaaagatttggctgcactacactgcctactgatcgtatccctatgataaagtaatacataagtcacagcttcagataaaggcgtaggagcttttcataaagtagtgaaagaaggggaagttgtaggagttacaatctgtctatagagtacaattccaagttacaatggttaagggcaagcctactgaagacagctaagcccagccctgtggtgtgccatttattagtcatacatgcgaaacacctagcatgctacctgacactaacagagtattcatttgcccaagttgtgctgctcgtgagtagcagggatgggacttgacctctcaagtttccaacacatcatgatacttatttcttcatgtaactagctgggaaattcacttgctacacagaaaagacaggttcttaaattatattgtattaaagtgactctttgttaaaacacaaaaatatcccaatagttacatgcaggttgtatccttgttaataacaatataggaatcttagaatcaattctggtctggtaagctataaagttatttacttcaaaaaaaaggacacatacaaaaaatatgtatataacatacatgtatatacacacatacatcgaaaaacatctatacatacaagtgtgtatttttcacctctatgcatatatgtgtgtgtatttatctatctatctacatatacaatgtcactatcccttgtttattaaataacattaaattaccatgtctccagttcatggactgtacatgtatttgtgcataaataaattgcttttcttattatcttctggtgatttactactattgagtaggagagcttcttgtatacgaagaacatctgatatatgtgtatatatttttataaaacacttttcatttattaattattctatggacataacagtttgagaatcttatggatgttactttttaaaaaattatcactacaggccaggcatggtggcttatacctgtaatcccagcactttgggagggcaagggagaaggatcacttgaaaccaggagtttaagaccaacctgggcaacacagtgagatctcatctccataaaaaaataaacaaaattagctgggtgtggtggcacacacctgtggttctagctactcaggaagctgaggtggaagaattgcttgggcctgggaggtcgaggttgcagtgagccaaggttgcaccaatgcattcctgccagggcaaaagaacaaaaccctgtcttaaaaaaaagaaaaaaaaaaattaccatggccagaggtttgttccagaatatcacccaaaaatattcctcaaatgaatactctgggaagtactggcttactaatacagagcaaaaggtatatattaatagaataaatgtgagaaacctatggaaataagtaggggaaataaatatatggaaacaaatgagtcatagaaatacattctttctatgttttaagggaaatactaaagttatgtaacctttgacacaacttgtggagcaaaagattgtgaatcttaactaaaaggaaaaaagaactattttcccaaagtcctcataaaagcaaagtgtgctatattcaacaatacgtgtatcaaattggcattgggatcatgcagctaacccaatttgaaatgccatttaagtagaaataggaaggcaaatcataataattccacaatcaaagctcaaaacatgtgttgacactcaaccaaaatatgaaaatggctaacattcacaccaaattttgattacactcatagtaaatttaaaactactcactaatattgctcagaatcagaagtttgttcagcgtgttataagcgactttctaagggcaagttactttgttcacatatggaccaagtagctattgacaaatcacgtggtttcttttcaaatgctttgtgtttgtggcattttattggtcattgtgtcaggaataccaaacaatttttttttttttagtgtttgcagaatattatacagtacaaacataaaataatatgttgcaatgagtcagcatccttttctaagttttataaagagaattcgtgataatttactttaggacagtgaccttgattgctttaaaatgcctttaatcagtgctaatttctcatcttaaaggaaaatggaaacatctgagtcaattctatttctacattgtcttacttataaaataataaaataatgagaggatattaaaggaaaaatcattcatttattcaaatatgcatacaattgctttaagtctaagatattgaaataaacatggcaccgttaaaaatattttaacggtctatacaattttctggcttgtaaagtcagtctctctctctgactggctcactttctatctaaaacatacctatctgaaacaacaaacaacacacttcaatacaaacataccagttgaacaagggacttcttatttattttcaattttttgagacaaagtctcgcttggtcacccaggctgaagtgcagtggtatgatcatggctcactacagcctcgacctcctgagctcaaacgatcctcccacttcagcctcctgagtagctacaggactacaggcatgtaccactatgtccagctaggctttttttatttttttaagatgggggtcatgctaagttgctcaggctgatctcgaactcctggcctcaagcagtcctcccacttcatcctaccaacgtgctgggattataggcataagccaacaactgacttcttgagaggtaattttgatcatatgatctctcagaatttcatttaaatttctttcatagacatctgagaaagagatattaaagaaggaaagagagagatttcatttaattcaatcaaagttttctctggttaatctaattctgtgccttagtgatgtttactgaaaaaaaaatggtggaatttagaggaagaaaaacactttctcttgggaaataaaagaaaatcatatgaaaatttacctgttacaattcgttaacagaagagaaaatgaagtgtatgtatctggagatttccaatcatctttccagtgctaaatttgaacctcattctcaagggttttctaaaataaaacttaacatacctttccatcgtcacatcctcatgtcctcaaggctaatttgatttagggattattctagtgtttcgatttgctatcagtttgagagcctttgtatcaaaaagaagtgccaaattttgtgaggttcttaagagaataatgcaggtgaataaagcctcagtatactgggcttctcaggaatgtagcactgactgccatttataattaattaaagatttagagattctgtacctttcaaacgttccttctttttgtgtggaacattttctaatatatattcaacatttgcctgccttttcttttgattcagggttgtttctcctagttcttgcttatcttcatctgtttgggtagttgtagccaatggcttataaacaatataactttatttcttacagttccagaggatgggaagtccaatatccaggtgatggcagatttagtgtctggtaagtgcttgctcttctggtcgatagatgaggctgtctgtctgtgtccctacccaaatctcatcttgaattgtactcccattattcactcaagttgtgggaggcacctggtgggagataattgaatcatgggggtggtttcccccatactgttctcatggtagtgaataaatctcatgagatctgatggttttataaggggtttccgctttcacttttctctcattctctctttgcctgctgccatccctgtaagatgggacttgttcctccttgccttccaccatgatcatgaggcctccccagccatgtggaactgtgagttcattaaaccttttttcttcccagactcgggtatgtctttatcagcagtgtgaaacagactaattctcagagtccttacttggaggaaggggctaactagatctccagggtctcttttataaggacatttatgacatttttgagagcccttatgacttaatctcccaaaggccccatttcctaaaactaccaccttaggagttaggatttcaacatatgaatgtaggggggcacaaacattcagtcatagcactgttccctgtcatcgctgtcactcttttctttttctcctttttaagtgtagcttcctgtctccttaggcaaagaaacaaaacaacctaggttggaagaagcacagatatcagatcatataaaagcagaataatttctactcttacaaataaagtgcatgagattgtatagaaaggcatcacaatttgtctttttaatgtttaacatgcttttttgctttcttcctgatcttccaacatattttggcttatagggaaaagttttgcaactataacataaaataaaagataagcaacagcaatcttctaaattgataggggtaaataaactttaattagattaggtaactacttttagaaaaatataatatctctctataaagacatattgtttaacactaagagggctcccttgagtatataaaactaagaagtcatcaagaggtttggtttcttgaaacacaaactctcagaattttgcccataagaccctaacttaaaataataccagtggactctagcaggttaattatcctaccaatcaaagacagttctatgcagatgtaaacatattgtttctagtgacaaaaaatgatgaggctttaagactcagagtgatggagaagaaacggtatgaatcttgcctcattctcttgctagcattcagtcacctccccacctcctactctctctggcttacaaaagccgacctatctaagagaactgcctagagccttctggcaatacattgtactttttggtgtgggtcagtggcaggattggaactagtaattggatttccgcactcccagttcacttatctatccactacaaaacagcatgttaattttggaaatatttataccactaggtcatcatgacctttgaatataaccactggcaccaattatataccaggaatctccttatgcctcacctaactagagtcattgcccatggcagtatggacttcagatgccttctctcctggataactgttcgacatatataaaacctcaaaataatgtgttatatttaagaagaattcgaagacagaatatccaagtgtggatatatcaaattaatgtctacatttctctcttaattttctatccaaggaataagagctaaatataatcacagcaggaatcctaatgaaatgtttcaacaggaagcaatattaaagtatatcaacctagagtgattgttttgatagactgtcttaaaggtaaatctagattttctctttaaagaatactgaatctcaaataaaatcaaatctcttccctgaaatatctgtcaaaatcaaattggtatagactatttttatcacaaacactcccatttttcatagctattccaatacaactctgatttaaaaactgcaatagaaatatttaatttaattaatttatttttaaattttattttattttttttgagacaaggtcttgctctgttgcccaggctgagtgcagtagcactatcacagctcactgcaacctccatctaccaggctcaagcgatcctcccacctcagcctcccaagtagctggaaccacaggcacacaccaccatgctgactaactttgtttttctttcttttttttttttttttttttttttgtggagacagggtttcaccatgttgcccaggctggtcttaaattcctgacctcaaccaatctacctgactcggcctcccaaagtgctgggattacaggcgtaagccaccatgcctggcctacaatgttttcattttattttatttttttttttttgagacagggtctcactctgtcacccaggctggagtgcagtggcacaatcatggctcactgcagccttgacctcccaggctcaagtggtccccccacctcagccttcccagtagctgggaccacaggtgcacaccatcatgcccagcttatttccatattttttgtagagtcaaggttttgccatgttacccaggctggtctcaaactcctgagctcaagtgatagccccgccttggcctctaaaaggggtgggattacatgtgtgagacactgtgcccagcctcattttatttttaaacaaaatcttcaaaaattgtcctgatttaataagaaaatacaacatcctaaaacatgatattaatatttaccatctttagttgtacagattctttatttctttgtaaagaacattattaggtcttcataagaaatgaaatattgctctttatgagtttaatgcacataagtaatctataattctgtatgaaacttttacaatcccttaagaaatgtcctgcaaatttgataatatcaaatttaaaaataaaatacttttaaggtccaaactttagatttcagaaaaaaacatgtggagtacttagtttatacagcctaactctgttctatcatttgcactgataacattattcctgaacacattttagcccaaacccagggaagataggcttacatgcaagtttacaaaaggaataaaatccaggtagtcagcaaagtgcccacaaatgagaaccgaaattcttctaaattgctttgttcaagtttcattatctagacttgtttttggcacaacatggttattgctcaccctttactatcccttctaccagcacatgttgtgaagaacaataaaagtactagggtcaatatataggtatgtctgctcaaaaaaataataataagagaaaaacctatttggttagaatttcccacgatttgcgtcatagcccacaaacaagaccgattcattcacttttctggaaatatgctatgaagcaaaaattttaaaaattaaaaacgtcttctggattgctagactggttcagtcgcaatactttgtttgaaaagggaagagaaaagtatactgtttggtaattggaactcaaagaccacatcctgtgttgttaaatgcagatttcttgattggcatgacagagtatgcaatataattatttttaattgccaattcacatatctaaagaaaagaatatataagactcccagaggcactgttctatagcaggagtttaatacgtcaatgcaggctttagcaaataagggcttttgtcaatatttccctggcacatcacccacaacataacaataccacttagaatttatataggcccttcatttgcaaagtgctttaaaataattaatccccagaatactcatttgtcaggggaatgagcaattgattataaaactgaggatttcaagcaagaaatggtttggataagttcaaaaaggaatctcattttgaaatagaatctctatttgaaatagaatctctaacatccccaaagttagcagtgctgttttgatatggttaacatctttaatatttttaggcactgataagttgaacccataggtttctttatgctctctatatttctcgaaagctcacttctgtactccaacgtgtgtgcagtttttaagagccacaggtttttccatacattctcaaaaatggtagaatgtctatatttctgaatataacactgagaaggcatttgtaaccgctattacaatattagaccattagcgctgtggtggcaagcacaagttcactattgtatacccgagactgaacacagtgcatggcacacagcaatcactagtcatcccaacataaaaagctaatgttctctcagcttcattaactcatatctttatttgttcattcatttaaccagtcaatcaatcatcatttgttgagctctgctatctgcaaatcactgaatgatttagcaagaagatgagaaaaatgttatctgtcccttgatctcatagagtttacaattaactagagatatataggtaagtgaaaaatgaagatgattaaagacaacaatagaagaacaggaaggtcggagaacaaaagaagaaagaaatatttctatttggtgagtgtcttagtccattttgtgttgctataaaggaaaatctggggctgggtaatttattttaaaaataggtttattttggccagtcacagtggcacatgcctgtaatatcccagcatttcgggaggccgaggtagacagatcacttgaggtcaggagttcaagaccagccgggccaaaatggtgaaactccatctctactaaaaatacaaaaattagccaggtgtggtgcatgtctgtaatcccagttactcaggaggctgaggcagaatcacttgaacccaggaggtggaggttgcagtgagctatcgtgccactgcactccagcctgggtgacaagcaagtctctgtctcaaagaaaaaaaaaagaggtttattttactgatggttctacagactttacaagaagcatggcaccagcctctgcttctggtgaggactcaggaaacttctggtcatggtggaaggagatgtgggaggtggagtctgcatatcacatggtgagagagggagcaagagaacaaacagaacatgtcaggttctttttaacacacagatctcattggaactaagagtgagaactcattcaattcctcaagaatggcaccaggcaattcataaaggatgtgcttccacgacctgaacacctcccaccaggccccgcctccaacagtgcagatcaaatttcaacacctgatttgaaggggacaaatatccaatcaatatcagtgaggattcaaaacaatgcttcacaaaagatgtagttttacttgggttttgcatgattttgataggcagaagaaattggagaagattgttgcagactgagggaaggccaagaagtagaaatagctttcctgccaccaccaatttggagaaatttgtagctgaaattatatcacttttgactacactctgtaaattcaaatttgatttgtgttgctgagaaattctggatgagattggcctgtgattaccatacaaattggttgtatgtaaatatgtgcttctatagtgtttgaggacatgacttattctttcatatatctgaaatattcctcagattgtttcctctcctaatgtatattgtatttaaaaaatgagaaaatgtaagtctcttttgaataaaaggctgaaagacttctatggcatactacaccataattacttatatgcaaacatacaataagtctacagaaactcctcaaatacacatttaactttgttctaggcattatggaggatatagtgttgttcccaaaagaatgtcttaacagtgctgatacattaaaaatgttctataaattcttgttaattaaatattacctgatgagtttacaatttgaagggaggacgagtgactccagactatgaggagaacgactggaatgccacatgaagtcgtagacagtgctctctgtgcaatgagtaaggcacaaaacactgagccagtcattgaactcaagtcttcccgatcccagtctaagatagtctttccacagatacattgattctattagatatttcctcattagaaggacttcatttcagtactgaaattacaaagctgcctcaggtatttatgcattttatttttcttcccctgtgctcatgtgatgctccacctgtcccactggggcctattttctctatggattgtgttcatctcccacaaaagccaatagaaactctggcaaaacataggggagcacaggcaatcccttctgccacccctagggcatgctcaggaagacactggtatcgctgctaatagcacctaccaggtgtcctgggttggaaaatcttacctactctgtcacatggcagccctcctcccagagctagccaccagtggtacttactaaattataatgatctactttaaatatcagtaaatgatggtgcaactgactttaaaaccaatttggatatttgctggacatatctgtcattgaggccgattatgaaaggttatataaaacttaacaatggggctgtccagatgggacctaatagtttaccttaatttttagcttaaacagagacagcccaatattacaatcctggactaccaatctattaccttccaaatgcctggggccaggtcctgggggaagcatggtaggtgccaattttggtcaagtcaggtctttcttgggggcggtcatgagaagtaagagtgaagagttgtagataattatatttcataataattcattttctttataatgttatgtatttttttatatataaattaaaaagtattattctaaaaagggaatccctagacttcacaagactgccaagttgatccatggcacaaaacggttaagaatccctgaaggctcacctggcgcagtggctcacatctgtaatcccagcacttgggaggccaaggggggctgagcacttgcaactaggagtttgagaccaccctggacaacatggtgaaaccccatctctcctaagaaatacaaaaattagttgggtgtggtggcacatacctgttaccccagctacttgggaggctgaggcatgagaattgcttgaatccgggagtcgagatcaccccactgcactccagcctggaggacagagtaagattctgcctcaaaggaaaagaaaattcccgaaagattgtccagaaatcagttaatgtgcaagcatagcaaatgcatgggacaaagaagagtagagaggtcactttccataaggaaaacacaatgaggtattgaaagtccaaagaaacatggacttaaaatattactgtgaaaaaaaaagggcaatagaaaggagtttgcaatatctggaaggggatgggttaagactaggtgaagataaacgaatcaccgggcatggagaaatcattccaagacaagcatcagggagaaaaccgaatactctctttatcttgcaagtagtgtcttaaagaaacagggtcccactaaatagtcacttgggagaaatagccaagagctactaattattgtttagttactcaattcatccagtaagtaaaaatgtattgaacacttattatgtgtcaggtaccacatgctaggtgatagatatccaatggtatagaaacaccacaaatggtctttgaccttgtgaagcttacagttgacttggagagacaggcattagttaagtgagtaagaacccaaaaaattatgataagctctacggaggaaaagagtactgtggcaacaaaggcatgcatagtctcgtggtcagtggaattgaagttttgacctgtaagatgagcacaaattggccaggcagagtggagggagggtgttccagatgaagggaggagcatgtagaaaaagagggtactgctgcttagtattttgaattatgacactcttcaacacactgcagaaattgggtagattctccaccttgagaagaagaaaagagagtatgggagtagaagtcaggtaaggaagggagcagggaaagaaacaaggaggaggaggcaaactttcgccatctaatcctttgactggagcccgagcaaccacctcttcttttatttactctccaaatcagagccatcttttctctcttacaccttttgccatgaaaagaatatgatgaagagaataagagaaaccctatttcattttaatatttaccaagaatccaaaatgtacaactgagacggtgttatggagaatataaaagtgagcacaacacttgctttgcagaacaatcaagtgacagggagaaaaaaatctaacagaacgcctgctaggtgttgaagtagagccaccagccctctgggtggccttaggcaggtcatgtctcctctgggagccttcctttcacatctgtcatagagcttgtaggcaactgactttgtgaagttcctgccaggttaaacagactctgctccatttttcagactgttattagaaaatgctcaaatacatctgagtttgtgtaggattggaggcagttaatatatttaaggagtcagacatataattaagattttgttgttggggtgggatttctcccccttttaagtctcacttttgagaaactggaacctgaattgagctgttcagagatgaagactaatatatcataatgtgcacttactaattcactaaatgtctagatgttgatgttggggatttaaggaggggtgtttactaagaccaggcacgggactaggtcccaggaattccaaattgcataaaatgtggtccttgcatattagtcattcaacgggctcagaatggaaatggccatgcagaaaacagtgagcataaagagtttactgctgtatcaacctggacatacaaaggaagaactctgagaccactaagaaggaagtaagtgttaatgggagaggtacatgtggaaagttttgtcacaagtcttgcattggtgcctgatcttaaggagtgaacaggagttagctaaacaaggtgaagaacattccaggcagacagactatgataagtaaaggcaagaagggaaagaatgaacataatgcttttccttccccagcatctatttcagtcacattgcagataaacaggattttaaacatgggaagtcatccaaatcagacaattctcattcttttatcaaaatcctaaagggaacatttttaaatctcttttgtaattgctaggaaaatgatgtgtgcccagagtccttatttagaaaaaacagtccttattttttaaatcaaacaatatatcaattttccaatagagctggaaccaaattctgcatttcatatgttaattgcaatgtactttttcttttgtaaggtgcatgaatatggtctgtcagccattacacaaatttaagtatggaaaaaaaatgggcttcacaaaaagcaatgaaatgcatcaacatcagagattttgtcacgttagtagacaaaaacatcgacttgaaggatgtccttgccaggttaggatacgtcccttttctagctaatgtcaacctagactcagctccagtcagaaatgcctgcttggttggcagctgctgagagatagcaactcctcctagcaacagatggagccaatcaaaagccagcagcagtgatccttgctgttaagtgcaatgacatctcatttatctggcaactccagtgaagactgtatagtgcacaagataattactaagagactgaaatttacattcccatgcaccagggactattagaatttcaacagcatgattggaattttgcctaaaattagatgtctgtgtgtttaaattatgaacaggtatcagagtgtggtggattacgcttaggttttaaagacacctaaaggtgactgttagttttatcacttactgcccatgtgttctgaggcatgatagtttccctgagttttaatttttccatctcttaaaataagatacatacattgcctggcctaacatatctcacagcagtgttgtgctaatcacaaaatatagcagatctcaaagccctttgaaactgtcaagcttcatgtaaataaatactaactgacattttcctactattagagaaacagcatttaatatagctaatagcttcagctcccatctgggtaatctccagtaagccatttcatctttatttcctcacctgcccaaggaagataatgctaggacgtgattcagggactggctgtgaagactgtagtaagcactcaaaaatgttaactaacaattattatcattccatcatttaatgctgcgagaacttgaggtgttgctaaattggagacagtttttattcctactaaatgacccccaaagcaatattctatagaacccaaaaacacatgtatccaagggatcttgcacaaaactctcttaaccctccacagctttttaacacattcatgcatgctagagattatttccaagacatctacttcccctgttgggcaccgagcgctttacttttgctgtctcctcctgatgacctctccattccatgaaattactattctcctgctctacatataactaaaaacttgggatagtccatggtttatttgattaagcaagtgctaccaagcttatagttcctcacaggtctgtctaaacagagtatctactttttatcttattatcaaaattctctcctgcatagaaaggaaagaccaggaaatttttttaaaggacctacagtagtcagtttctcaattctcactcaactccacttgcttgcggtaatatttaatattaaaaaggtataatataattatcgcatataccatactttacatgttataacacgtgaatctgttatacagttaagaacaggtcacaatggccagtattctgctggacccaaatcagtaagacttactgacaagaactacagttttaagctacaattttaaaatatcctctctgcttcataatgcttattccatactcagaactttagtagatcccactttgaatgtcttaatttttgtactgtttagctttcttgctgtataagctcctttgagagcagaatttttgtttcattgtttgtagcacacacacccaaagcatctagctcactttgtacacagtagtacatgcttaacaaatagctattaaagaaatactcataaaaacaaaaaagaaagggatggagaaagaggaggaggattggaggaatggagcagaaacaagagagattaacagagaagggagaggaaggagggaaataaggagaaaggaaagatggaaacagaagaaagaaaactaaattgttataaatgcatgaggagagatatcaaagatgtttgactactttaaatacaactcttagaccatttttcagatacagtataacactgtttctcattgccactcttgtatgtcacctcttagtccttaggatgactgatgctactacagggtgtcaaaaaaatggaattttaacaggcttcattttcatacaaactcaaaaagctaaatgtaaaaaaaaacaaatttttaaacagagatataatacctttgtttgtgttttacttttcttcccagaaatacacgtcgagctgccctttctctatatacctcccactccttctctgcctcccagccagattctacacgtcagtttgctcgagtccccagctctcacgtcctcaaaccatcgccgtctctcttccagacacacacctcagccaatattctggcttccagtgaaacacaaatgaagaaataaaagtcttaaatagaaattctaaactcctgcacatgatagaacatttacttttctaataagggagagaaaggtggcttaggaaaaaaaaaaaaaatatatatatatatataaatatatataaatcctatgaaaaactgtgtgaaaagatctagagttaagagtcttagtttttgtgtcggacactgatattagtgacccctatttcctttgagaaactttctatttttctaagatagcaataatgacactgctcaatccatctctctggttttttttttttttttttttttttgagatggagtctcactctgtcgcccaggctggagtgcagtggcatgatctcagctcactgcaagctccacctcccaggttcacgccattctcctgcctcagcctcccaagtagctgggactacaggcgcctgccaacacacccggctaattttttgtattttcaatagagacggggtttcactgtgttagccaggatggcctcgatctcctgacctcgtgatccacctgtctctaaggtttttatgtggatccagtgtcattacaaatatgaaaattttaaattttaaaaatgtacacaaaaacacacagttggattaccttttctgaatgcacatttttgtttatatgatttcaattatatgttaggggacacaacaagttggaaattcttacacaaatccatccattatggacgctctaagccactaattcccactactgcaaccaggtatacataaaaacgtgccttaacccccagttcaggtgagttgcaggttatgattctccaatgatggaatactctgagaaggcaaaaaggggcatcatttttctgggtggcatcataatcactaccaaaaaattggtcaaagaagcggggcatggtggctcacacttgtaatcccagagttttgggaggctgaggcaggaggattgcttgagtccaggagttcaaaatcagcctggacaacctaaagagagtttcttgacatatatttctaaggggcaaatgaatgaattctagttctcaaccctgtattgctgattgatatatgttgaccatgaatggttttctggtggccccagagagtcgacaatggtttgtcatcaagggcttatccagggcagaagctaataaaatatcacttgcacagattaaataacaccacatttcaggagaggcagtataaataagagggacctctggataatgaatggatttaaaaggtccagcctgtccaaatcaattttctaatctcataaaatggggttgaacccaataatttatgtttccttccacttccaaaatttaataatattatttacttgttcctttatttatttaaaaatatttatttacttaaaatgagaaaagtacctgtgaaagaattagatttgtttaatattctcatggacactatgatcacacatcatgtagtatttaaatgtgatcaacaaatagttgaaaatgtgttatgtgaaaaataataattttcgcaaacacttttacagcacttaccatatcttaggcatcatttcatgtgatggaagacaaatatatagatagacatggatatggataatgattgaggtaagaaatacaatggagacagagacagaaaaattcttttaatcattacaacaaccaacagctttagaacattaaccatgtgttaagtaattaacatgttatctatgatgccagataaaaaaggcacaataaatagaaaatgttccttatcgtcacctccagggtacgctttaggtaatgaagttctaatatcagagatagcagcaacgacaggatgctaattgtggtgaatattagaaaagaagccactgatgtagtctagccgacctctatgatcacttttatcaactgaaagttaaaaaataaataaataaagctagagtgggcacaatgctagatagcagagacagaactggcatatttggaagatctctcaattctacaggcagaatttttttaaaacaaaccaaacaacaataataacagtttactgttaggggaagcactgaggttgggctttaagagtttgctgagaagctgatttgcaaagataggcaagcttggaccccagtgaagtggtcaaataaataacagtgctcaaagagttatatttactgccacgcaagatgaatcatgcctctttggggaatgctttttctgaaatttcatttcccattttggactactggatcagtctctcagaagagtttggaatgtggccaattacttccctctgcatttttcatctgagacttaggctgtacaactccattttacattttcacaccatacatcttagatagtagggacttcattttgtgaagaataagacaccaaaaatatagtctgtttgtaaatatagatttgagaataaagaccaagaaacgcacgttagaaatcttaagaaatgaatttttactataattatctacagctctatgctccatacttatattttaaattataatactaatgaaaaaaatcactgttgagatgataaattagcagaccattaaaagcttttaagaatgaaaaccactctccaacgatattcacgtgaaaaaccagacagtaaaagaacaaacaagtaaatgtggaaataaccagaacccaatatgcaactgtctcaatcacatttaacctcagtattactagagcactcaaaagtaataggttgttaaaccgtttggagggcaaatgacattggcagatctaatggcaaaacaaacaaaatatcaaatatatttaaaatttaaaatatcaaagaggccaggcacagtggctcacgcctgtaatcccagcattttgggaggccgaggcgggcagatcacttgaggttgggaatttgagaccagcctgaccaacatggagaaaccccatctctactaaaaatacaaaaaaattagccgggcatggtggcgtgtgcctctaatcgcagctactcaggaggctgaggcaggagaatcgcttgaacctgggaggcagaggttgcagtgagccgagattgcaccattgcactccagcctggccaacaagaacgaaactccatctcaaaaaaaaaaaagaaattaataaacaaataaatttaaaaaaataaaagtccaaaccaaataaggtcctttaaaccactgacctacagcaatccattttacttgacggagcattgggtaggggaaagattacagataagttattttaaggaattaaattaggtgaatgttaaatattctagaattatataaaagaaattgtcttagagtaggcattgaaaaattagttcaaggtctgtacccacttacttttcctatgagacaataagtacaaacatgttttgtaaatatacaatgtaaaatataaaatacaatgtaaatattgtatttcatctacagaaatattacttgctttttgtaaattaaagaatcaccctcaatgtatcatgcaggagcaactccatttctgggtatcacataattttaaagcaaagatgtaaccataaacatgctaaattgactataaaaaataacatgcagagtgcaaaggaagagaataaaatgaagagcacaacacagccattagtggaaagaaagactgctgctatgatttagaccattcagggaaaaccaaagcagaaaccatagcttgtgtcagtctcattaagattaaattcacaaatatcccatctgctatggtttcctaagtggctacagtgaggacacaaagcttttccacacatttgaagaaactgtggcaacaaaaaactccatcatctctgtggaggtactgttgggtgggtgatgggggtgagagagtttgcaggaaactggaagatgggaactggaagataagtcggacacagcctttgccttcaagatgctgataattcatttctggagacaaaagtacaaactcaacctaaggtgggagagaggtacaagcagaaagctatggaagaataaagaaaggcagactacttcttcagtttcaacaggaaacacagtgaggatttcatggtggaggtatactgggtcttaaagaagaaacaggacattgataaataacgatgacagagagacatgagcactgactgagtgcatggaaagttgagatatatgaaatgactgaaaaggaaaggaaaacatgtcataaaagtaaatgaaaatggagatgaagccagagaattatgctggcttctagagggaacccatcagaaaatgttattctaggctaaactatgttgaaaatctttcatccttcttaaaactctgtacttctcagtatttattttagagtacttcttcttttactcttttttcttctttttaagagatgggctgaattaaactacacaaggtgaagtagatatagaatatttaaaatggtaaattatcgagcatgaaatctcatctgattcaatgagtgaaagtaatattgattaacccagccactgaccttgagtaacagacataagaatactgtaataaacacaaaaaagtgctggtaaagtatttgtcgcaatgccaagagctacaacctggattaacagtcacacttcacaaaatagacttctatgactttagatgtgcttattatgtctaacgatgaagaaggtgaaacaaactaaactgagagtggaagacacatgttgcccctcaactgtgtgctattttgatatcgtagagatgatcattaagtgatttatcataaaatgtatgaactaaagataaatatttaattatagaaagtatgtcttcatgtgtctttctataaagatttctatgggcttcaaacttcagttagagcccttttaaaatatttatacttaaaactgcaccataaattgcaatttgcaaatacttatgaggaagtaatattctctctgatgcaaggcaccaaaaatgtacattgcagaattgatacatacatttctatatctggttttcattaaatagctcaaaggtgtcattttaaggtacaaaatattataaaatatctcacaatacatgtttaaattgatctaaggacagaaagtaaaaatctgttttgcaatttaatacctactcaaatgtaccacctcattaagagatatgtataatttttttaagtgctgacaataatcatttggaagcccaagctcagtaagtacagttaaataccagtcctaggaaaactcttaatcaggaaaactcttcttgcatagtagtcttctgtggtcaaaatcattgtgtttacagttgtaagacacagcttcacaacgaaaacatggattccactctgtttccactacttcttccacttttttggtccatcaccagagtgttaaaatgttgtctcacctctccaatcgtgaagaaattcacacctctgtattactttaaaaaatgtaattcaattaatgtgtattgaatacataaagaacaatgattttatttcctgtttaatctcaattaaataatgattaaattgacattttagcttttgtttggacaaattatctttctaaataacagaactattaagacataattcccatacaatacagttcactcattcaaagtgtacaactaaatggtatttaatatattcacagagttgtaaaaccatcaccccaattaattttagaatatttttcttcacctcacaaagcaaccccacaccctttagctgtgaaccccttccattcctcccatccccattcagtgctatacaactgctttatgtctcaatagagttgctttttctggatattttacataaatgaaatgataaagtatatcttttgtgactagcttcttccatatcacataatattttcatggttcaatcttatcgtagcatgcatcagtactttactgctttttgttgccaaataatattccattgtatgaatataccaaactttatttatccattcatcagttgatggacatttgaattgtttctacttttaggctgttatgaataatgctactatgggtatgcatatacaagagtctttgtgtagacatatattgcaaattttcttgggtacacatctagccgtggaactgttgggtcatataataactctgtgtttaatcttttgagaaactgccagactgtcttacaaaatgcctgcaccattttacattctcactagcagtgtataagagttcccatttctcacctacgtgtgttattatcagtcttttttaatatagcctttgcagcgggtgggaggtggtatcttcttgtgattttaatttgcatttccttgatggctaatggtgttgagtacatttcacattgctattgactgtctgtctatctatctatctatctatctatctatctatctatctatctatctatctgttttcagatcatttgcaccctttcaattaggttatatgtctttttattactgagttataagagttctttatatattctagatacaaatttcttatcagatatgtggttttcaaaattttctcccattctgtggattgatttttcacttgattgtgtcctttgaagcacaaaagtttttaattatgatgaaattcaacatatcgattcttcttttgttggttgtgctttagatgttatatccatgaaaccactgcttaatccaaggtcataaaagtttactcctatgctttcttccatgagttttatggtcttagctctaaaagccataggttttagggctctaatccattttgggttactttttcatttaggtctgtgatccattttgggttactttttcatatgtcatgtgaaaacttagcctttaattttttttttttttctgctaccattcagatttcttaaggtcttcagacaatggcaacaagatcttttcattgaaataactaagaaagtttgtggaaaacccataagcatataaataaaaaagaaagcatttcaataagtagtacataaatttttagaaattaaacatcttattcttggattatatgtacaattagtcaaaacgcaaagataatacaaatacaaaacaaggaaattcatgagagctaatgaaaacttaaaatgttatgccgtggagcttgccgtgagccgagatcgcacaactgcactccagcctgggcaacagagtgagactcggtctcaaaaaaaaaaaaaaattatgccaagacacaaaatatttaatgtttctataaccctgcttctctctcttatggcacctaacaatttaaatattttattatagtattaacgtatagtgtttgcctttgtcttctaccatgattaaagcatctataatataacttggtacatgataagtaaaaatattcaaaattgaataggtgaacaaattaaaatgaatgaattctagaattggcactttttccctgttttgatgcataattttctctccttttcatcctttatgttttagcttaagtattacatccttaaagaaatttccagagaaattctgtcgaaattagtttcctctattattctctattacagaaatacatttcattctttcatagcactaatcctaaacagtaaatgtttacatttattttttttacatgttattgtgttctcccaatatgggagatggaaggtttttcattttacttccaatgcctaagacaatgtgtgacacattaataattttaaataaataggtggtaaatgatagtgtaaatgggatcatagacaacctgctgatccctggattttcaggaatagctatattgaaaccacaggcacaatgtcattgctatgtcctttttcatggtagagctttcagttcccacacaacctttcacacttccctgaagagaaaaccttttcccatctattgaaatcgaagaataaaggttgaagtagtaatgcttattcatccttgcccttgctacagaaattttagaggtaatatctagcaatctgcaatgaacactcatcaagcaataagcttctgtttccaaatcccagatgagttctaatttatttagacctgaataaaattagaggtaatctctcttccttgtagtctctacagttcaatatttggcttcccagtagaggttcataaacctgtcaactaatagttatggtgattagaaagataatatgcaatctaatgaagagactatgtatgcatatctatgcttcagtctactccctttttctctctctctttcttgccctaaagtcttatattatgcacagttaagtttttggtctagagaggtgtggctgctgccaggtgctatggactgtaagtctctattaccctcagattcatatattgaagcctaatgctcaatgtgatgcaatctggaggtggagacttagagaagtaatcaggtcataagagtaaagtcctcataaataggatcagtgtccttgtaagaagagacagggaagagcatgcctcctctttctctgcccaccaccacgtgagtgcacagcaagaagatggccaagtgcaaacaggaagagggcccttacaagaaacttggccatgctgcccccctaatcttgggctcaccagcctccagaactgtgagaaatgaatgtccattatttaagccaaccagtctgtgataatttgtcaaagcagcccaaactaaggcaactctggtttgatacacatggtaaagtatattgcttaaaattaaaaattaaaattaaaaaaaaaacaaaataaaagctaaaagaggcattaccctgtttttgtttctgtttttaacttaaggttcaccacgtgatgtagttttatccaaggattcataagtaaaatctactggaacttctgggaagatgttagctttcctgataaaggcaccatctcttcctctgtgcctctttctactgcctagaaagctcccatgttatctggggatttaagagccatccatgccaggaagagaagtccaagcaaatgtaaagaggccttggacataatgggcccgttgagtcaatcaatgaaccaataccgataaatgtctatctttagacttctgggtgtatgaggaaatccaaacctctgatccctttaaaccattgttatgggcatcactttcctcacagctagactcaattcctcattgatacaggaaagtaaacataagaaatttgttattaataattggtcttaggaaataaaatcagaagaggaaactttcttcttagtgaggttttgtgcacatattgacacctcaaattacccactgagttacatgtagaattatgtggaaggcatgtgtaaggtgactgcataattattgccaaaatctgaatccaggattctttagaaggttaaataggtgccaccaataattatactaagatactaggcataaactagaactcttctggatgaaccaggacatagagttaccccatgggagaatgatgttcacagtggcctcaaaataaagttctttcatttcagttgtagctggctgaaaggtatgtcacttaaattctatatattcccctaacataactactaggttttttgtttggtgcagaaataaccagtaggtataccataaatacagcagactgtgggcttgtggagcatgctgcactccgtgatctatctctgtctatcattgttcttatttgaccccatcacaggtgtttaaaatttgtttcgtcgttgttgttgttgttgttttatgtcttttttctcagtgctatatgttcaaagagccaacttctctacagacttgttcataagaatgacttgtttctgcttctctgctttgccagatctctattcctttcaaatttctactgaaaaatccactgatttcccctttgcatttaggacacataaattctttctcttttcctctccctgaaggttatgaaagtcctggactgtagctttattttatgttgtatacttccctccaagtgagttatataaggagatagttccgagaaggaaaatgcccagaagttgaaaaaccaggtcatcctagggggaaaaaataagtagccaatacttttttaggattttcttgttaaaaacccaataaacattcaaatatgaaaactactaatgtttttacattttgcagactggggtatagaacagcaagagaaagcagaactaataaagacaggagatcttttggaaatcagggtgaactgatttcctacagcaaggccataagctacagcaaggccataactcttcagaaggccattgtgtgatgctttggcaggaacaacaaggaggacatggactaaatggagcttcagctttttcagaacatgttactactctcaaaaattggttcactgctttatcagtttagcagttcataaaaatgtaacccaaaccgatttatgtaaaaagggcaattattggctcaggtaactgagagttttggaggtagggctggctttaaggataagaatgagaacttgttgctccccatgttttgaaccagacctcctgtcctctgaatgttggaatcattagcagaagggatctccctctgtggtattaagatggttagagtccctttatcttttctgctccaaatccagtttaaaaaataataatagatcattgaggtggagcaagatggcaaatagataacactccagcagctgtcctccctctgctaaaacgcaagaatgaataactacctacacaaaaaaaaatccttcataataaccaaacatcagatgaattatcacagtatctagttttaacttcatatcactgaaagaggcactgaagagggtaggaaagacagttatgaatcacctatatcaccactttcccatcccccattagtggctgcatggcatggagacagaacctgtgtgtttggggtaaggagagtacagtggttgtggggctctgcattaggactcagtgcttccctgttacagtggaaaacagcaaagtgaagaacttgccggtgcccagatagggggcacctagaccagccctagccagaggtgaattgtctgtcctagtggtcagaacttgagttctgccaagccttgccactgaggtcctaaatgaacttgaaaggcagcctagacaacaaagcctgcaattcctggacaagtcctgctgctgggctgggctctgagtggacttgtggtgcatgtgacctagtgagacaccagcccaggtggctaaggggatgcttgcatcacccctcccccaaccccaggcagtgcagctagcagctacgggagagacatcttccttctgcttaaggaaagaacaggggagagtaaagaaaactttcccttacaattgggataccagctcaaccactatagaatagagcaccagtcatgaggcctgcattccaggccctagctcccagatgaaatttttagacacaccctgggccagaaaggaacccaatgccttgaagggaaggacccagttctggcaggatccatcaccagctaactaaagagcccttggattgtgaataattagcagtggaggccacaggccttgggtgagacttaaagctgtgctggcttcaagggtgtcccagcatattcccacatgtagtggctataggaagagactccttctgcttgagaaaaggagaggaaagagtaaggggggcttctcttgcagcttaggcaccaccttgaccacagtggagtacagcatcaagcaggttcccagggtagccagctccaggccttggctcctggatggtatttctggaccagtcctggggcagaagtgagcccactgtcctaaagagcgagacccagccctggcaacgttcaccacaagctgactgaggagcccttggacattgaatgaacattggcagtagccaggcaatgtgtgctgtgggccagggatggtagtggccacaggaagagactctcctgcttaaggaaagggaaaaaggaagagtaggaaagacttgttttgcagcttgggtgctagctcaaccacagtagaatagaacaccagcaagattcataaggttctcaactccaggccctggctcccagatggtatatctgaacctacatgggggaaaagggaactcgctgccttgaagggagcaagcctggctggtttcaccacctgctgattacagagcccttgggccttgagtgaacataggtagtaaccagacagtgctcaccacagaccataaaggagacacagtgctgtgctggctttaggtatgacctagtgcagtcccagtggtggtggccacaggggtgcttgtgtcatctacctccagctccaggcagcttagcacagagagagagagagagactgcatttgcttggggaaaagtaagagaaaggaacaagggtgtctgcgtggtgatccacaaaattctcccaatcttacccaaaacaccaagatggtacctcttgtgagtctacaagacccacaacattactaggcttggggtgccccctaatgcaggtatggctgcaatagccaaaaacttagatcacaacacccaagtccttttgaatgcttgcaaagtcctccgaaggaggacaggtaaaacaagctcagactgcaaagactacaagaaatacttaacttcaatgcccagacactgatgaacagccgcaagcatcaagaccatccaggaaaacatggcctcaacaaatgaactaaataagaccccagggaccaatcccagagagatagacagaattcaaaataattgttttgaggaaggtcaacaaaattcaagataacacagagaaataattgagaatcctatcagataaatgaagagactgaaataatttagaagaatcaaggataagttctagagttggaaaacgcaactgacatagtgaagaatgcattaacatctcttaacagcagaattaatcaagcagaataaagacttggtgaacttgaagacagcctatttgaaaattcacgatcagagaagacaatagaaaaaagaattttaaaaaatgaagcatgcctacaagatctagaaaataacatcaaaagtacaaatctaagagttgttggccttaaggaggaagtagagagagagatcagagtagaaagtttattcaaaagaataataacagagaacttcacaaacctagagaaagatgtcaatattcaagcataagaaggttataaacatcaagcagatttaaccccaaaaaagattatatgaagacatttaataattaaaattttaaaggtcaagctaaagaaaggatcgtaaaagcaggaagaggaaaaaagaaatacaaaaaacatacaatggagctcccacacatctggcagcagacttctcagtggaaactttacaggccaagaggagtgaatggcatgacatatttaaagtcctgaagggggaaaaacaaaacaaaacaaaacaaaacaaaacttgtatcctagaatagaattatccagggaaaatttcctacataaaggaaggaaaaatgaagaccttctcagataaacaaaagctgagggattatatcaacaccagaactctcctccaaaaatgctaaagggagttcttcaatctgaaagaaaataatgtgaatgagcaataagaaaccatctgagggcaaaaaattcactggtaatagtaaacacacagaaaacacagaatattataatactgtaattgtggtgtataaactattcatatcctgaaaaggaagactaaaacatgaacctatcaaaaataataactactgggctgggcgcagtggctcacgtctgtaatcccagcactttgggaggccaaggcaggaggatcacttgaggtcaggagttcaagaccatcctggccaacatggtgaaacttcgcctctactaaaaatacaaaaattaggcgggtgtggtggtgcatgcctgtaatcccagctactcaggagactgaggcacgagaagaacttgaacctgggaggcggaggttgcagtgagctgagatcgcaccactgcactctagcctgggtgacagagtaagactgtctcaaataaataaataaataaataaataaaataactacaaaaacctttcaagacatggatagtataataagatattaatagaaacagaaaaagtttaaaggcaaggggatgaatctaacatgtagagtttttattagttgtctctttgcttctttgttagtttgtttatgcagcctgtgttgtcatcagtttaaaatggtgggttatattatttgcaagtctcacggtaacctcaagacaaaaatcatacaacagatacacacaaaaaaatagcaagaaattaaaatatgctagcagagaaaatcacctccactaaaagaaagataagaaagaaggaaaaaaggaagagaagactacaaaacaaccattaaacaaataacaaagtggccagaacaaaattccttctttatcaataataacacagaatgtaaatgaaataactatccaatcaaaagacgtagagtgcctgcatagatttcaaaactagagccaataatgtcttgcctataagaaatacactttacctagaaagacacacatagacagatacaaagatggaaaaagatattccatgcaaatggaaaccagaaaagaggagtagctctacatagatcagacaaaatagatttcaagacaaaaaccataaagagacaaaaaaatcatataatgataaaggagtcaattcagcaagaggatataaaaattgtaaatataaatgcacccaacactgagcaaatattatcagagctacagagagagaccccaataaaataataaccggagacttcaatgccccactttctgcattggacagatcatccagacagaaaatcaacaaagaaataaacttaatctgcactatagatcaaataggcttaataaatacagagcattccattaaatggctgcagaatatacattcttctcagcacatggattattctcaaggatagaccatatgctaggtcacaaaacaagtcttggaaaattcaaaaaaactgagatagtatcaagtatcttctctgaccacagtggaataaaaactaggaatcaataaaaaggggaattttgaaaactctacaaacatatgaaaactaattaaataatatgctcctgaatatttcttactcaataaagaaattaagaaataaatgtaaaaatttcttgaaacaaaagaaaatgaaagcacaatatacccaaatctataggatacagtgaaagcaatattaagaggaaagctgataggtataagtgcctacataaaaaagtaaaacatttctaataaacctaacgatgcattgtaaagaactaaaaaaacaagagcaaatcaaacccaaaattaggagaagaaaataaataataaagaccagagcagtagtaaaggaatttgaaatttaaaaaaatacagaaatcaatgaaataaaatgttggttttttgaaaagataaacaaaatcaacacacttttaagccagaccaatgaacaacaaaagagagaagacccacataagtaaaatcagagacaaaaaaaggagacattacaactgctaccacagaaattcaaaggatcaccagtggctactataagcaactacacaccaatacaatacctggaagacaaagataacttctcagacacatacagcataccatgattgaaccctgaaagagtccaaaacccgaacagaccagtaacaagtaatgagattgaagctgtaacaaaaagtctcccaaaaaagaaacttagttccaggacttagtggattcactgctgaataattttattaaacatttaatgaagaactaatacctactgtaacaatttcaaaaaatagaagaggagggaataatactcactctgtgaggccagtactacccctgataccaaaacctgataaagacattcaaaaaaaaaaaaaaaaccacacaaaaaaactataggctagtgtctctgttgaatactgatgcaaaaacacacaacaaaatacagcaaaccaaattccacaacacattaaaaaaaccattcatcataagcaagagggatttatcccaggtatgcaagaatggttcaacattcataaatcaaccaatgtgatatgtcatatcagcagaatgaagaacagaaatcatataatctttgtaattgatgctgaaaaatctcttgataaaattcaacatcctttcatgatcaaaaccctaaaaatgatgggtatagaaggatcatatcttgacaaaataaaagccatacatcgcagacccacagctggtatcatactgaacaaggaaaagcagaaagtctttctctaagattagggaacaagacaaggatgcccacttttcactgctgttattcaacataatcctggaagtcctagctagaacaatcagacaagagaaagaaataaaaagcatccaaattggaatggaagaagtaaaattatctttgtttgcagatgatatgatagtatatttgaaaaacctaaggacaaaaaaaaacacacaactcttcgagctgataaacaaattcagttaagtttcagggtacaaaatcaacatacaaaaatcggtggcattctatatgccaacagtgaacaatcagaaaaagaaatttaaaaaaatcaatttacaatagcaacaaatgaaatgtaatacctaggaattaccttaaccaaagaagtgaaagaactctacaataaaaactataaaatattgattcaataaattgaagggggcacaaaaaaatgggaaatattccatgttcatggattggaagaatcaatattgttaaaatgtccatactacccaaagcaatctacagattcaatgcaatctttatcataatactaacaacattctttacagaaatagaaaaaaataatcctaaaatttataatttatattaaaccacacgcagacacacacacacacacacaccccagaatggccaaagctatcctgggcaaaaaaattaaaaactgagagaatcgcattacctgacttcaaattatactgtagagatatagtaaccaaaacaacatggtagtggcataaaaacagacatgcagaccaatgtatgaacagaatagagaacccagaaataaattcgtacctctacagagaactcattttcgacaaagtttccaagaacatacattggggaaaggagtctctttgataaatggtgcttggaaaactggatatccacatgcagaaaaatgaaactagacctctatctcttgtcatggacaaaaatcaaatcaaaatagattaaagacttaaatctaagacctcaaagtatgaaactactgaaatctggcaaaagatctgagtaggcatttctcagaagaagacttacaaatggcagacaggtatataaaaaggtgctcatcatcattgatcatcagagaaatgcaaatcaaagctatgatgggatatcatgtcactctagttaaaatggctgttatccaaaagacaggcaacttcaaagcctggcaaagatgtgaagaaagggaaaacttcaacactgttgataggagtgtgaattagtacacctatggaaaacagtatggaggttcctcaagaaactaaaaatagaatgaccatatgatccagcaatcccactgctaggtatatccaaaagaaaggaaataggtatatcaaagagatatttgcactcctatgtttaccacatcactattcacaataccaggatttggaaacaacctatccatcaaccgatgaatagataaagaagatatggtatatatgcccaatggaatattatccagccacagaaaagaatgagatcctgtcatctgcaacaacattgatagaactggaagatgttacgttaagtgaaataaaacaggcacagaaagacaagcatcatatgttcttatttgcaggagttaaaaattaaagcaattgcacacatggagttagagagtagaatgatgcttaccagaggccaggaaagggggacatggggagtagggttggttgatgggtacaaacatatagttagatagaatgtttcagatcaaacgtttgatagcccaacacagtgaacaataagctaatgtacattttaaattacctaaaagagtataattgaattgtttgtaacacaaagaaagggtaagtgtttgaggtaatggatacttcatttactctgatgtgattatttatcattatatgcctgtactaaaatatctcatgtggcagggcatggtggctcatgcccgtaatcttagcgctttgggaggctgaggcaggcagatcgcctgagctcaggagattgagaccagcctgcgcaacacagtgaaataccatctctactaaaatacaaaaaaattggctgggtgtggtggtgtgcacctgtagtccctgctacttgggaggctgaggctgcagaattgcctgaacccaggaggcagaggttgcagtgagccgagatcaagccaccgcatgccagcctgggcgacagagcgagactgtctcaaaaaaattaattaattaattaattaaataaaatatcatatgtaccccataaatatatatgcctaccacgtgcccacaaaacttaaaattaaaaaataataataataaaatgcaactctctttcaacagataaagtcttgagcctgaagctaatttgccctaattagatgagaaatactcttcaagcaatcccccaagaccagagtgactaaagatatttgattaggcaaagcaggaaccagcactaaaactagcagtgagattaatcctacagaaactttatggattgatgctcaggagctgtttgagggtacaccaagcatctttttaaaatatatctactgctgctactgttactgcttatggctaacactgagtgttgagtacataatatacactgccctagggctttacgtgcatctttccatttaatccttacacaattctatacagctccatatcctcattattacccctgttttacacataagaaaacaatctagaaagttaaaaaactttccaattttttcacaaaggaagtaagttacagggctatgattcaaacacagttttatttctaaagcttacattttaaattactacttaatattccctgattcactgatgactaaagaaatacaatctagaaactttggaaatatgactacttgttggcctaatgtggctaatgacaagatggaaaagaaaaatataaaatctggcatcatattcaaataatttaaccaaaggtcctcattagtgctgctctcaaaagctgagccttgcttttattttctaatgaaaaatgtttctagaaacatatatgctaattttccaattaaggttagccctggagctaaagtattaacattttccataagttataaactcttagaaaaaaaaccaacactatttactatgaatacattgtaagttaaaaatggatgcttactgttaatccttactgaaagtataactaataatctgttgtttctgaaaaaagacaacctaatcccaacaaaaaataacccatgtcacatgtttgcaagcgataattgccaggttcttgggttgacagaattccatattttctttctttttttaactgaaaaaatttccagttcatttaataaatatatatggggtgaaaaaagaaataggcaaaatagataatccttttccaagtgctataccccccaatttttttaaaggaatgtgacaaaggtcaaggaaatcacgagcatatgagaagaaaaaattatgtaaatgatctaaactgaatatttaacaatctacctgttgaacaagcccctaagatttggcctttgacttttctctatttaggcatcattaagttcaaattctatgattcatttgacattaatagttaaggttcttgtttctctctctctctcgtctttcacttttctgagacgtcactcacttgctgtcccaagaaagagttgtgaatatgcctcagatttcagaactttccatgagaaagtacgttgataaggaaactcaaattccagagtgggcaactgctttgtacctctactccagatatgcttgttttataaagcctgcgtatctttttaggatggaacagaattctttcactgagagattaactgtaaaaaccaggtggcttcccaggaagatatcatggctaatctttacctctcccttaccttttataaacagtatttagtacagaaagaaaaacatggcaatatcagctcttaaaactacagcaccatatcagcctcaatagggaagcatgaacactaagattcctcgagtaaactttacatgcttcagtagaatagaaacagactactcaaaagtgaactagtcactgaactggaaagtgtgtagggtcatactcaggaaaattattataaagcccattgagtccagacagccagtgaattattgccaaaattaaactgtatgatgcctctatcaaccgattcaactagacttcagcagatgtctgaacattggaattacagttttcagtgccatgagagatattaatctatattagatatgatccctaacctcaaggaatttgcatctgataagatataaaaagcattaagaacaaattctaacaaaagaaaggaaatacagagataaatgtcccatcaaagtataaaatgtggaagttatttggggctgcagaaattgggaaaatgtttactgggtcctaaatgatgggagaaatttggatatctatgatagtgaggaagtaaaagaaattagaggagggaataacaaccactttctcccatcatctaccttgtggacataaaatagtcctctccttatagttaccaatagcggccctttcatttttcttccttagagatcaccacccccaactcatgtttctcaataactcctgacacagcttttcaatataaaatcagtatcgtcatctcacaatcttaacattgtctgcttgcaccaaggcaatactttaagggagaaattcccaatggtgcagaggacatgcatcaatcaagcagtctctctttcatttttgttgttggtgttatcactgtaataaagccatcacaaacaaggtgataggctgccccggttttcaaagaattatgctttttatattatgttggaacactgtagtatggcacatccttaattgcaacagcaaataggagaagcaatattgattaaagaaatgaatattgaactagaagttgctttttcttaacctgcctcacaatgctgagtgacctcattttagtcacatgacttctctgtttcccaggcatacttttgtcactcagcaataatagagttattgcaaggctcaaatgtgacagtttatgtgaaagcacatgggaaaatatgagaagcattccaatggaaaggttttattgcacataaggccaagagcagtatggtattatgaaaagctcatggttgtggacgtgaagacctagatttcaactctagttctattagtcaccagagtgggcttatttaagtcaagcacctcactaagcctcagctcttcatcaatatctactggttcatttccatccctcctcacagagttgcggtgaaattaaatacaaatctaaaagtccttcagaaacaacaaaaactaaaagtacactgtattatttgcactagcacagccattaatattgttaccatgattctcatggttacagctactctgataagaacttataatattacttatttattagaatatagactgactaaaataagcgtctttatcactatttcagcttcaaatataattggtacaggttaaggccctgtttaaacaaaaaactgtgttcgcacaatttgactttagtttatcctttagttaaaaaaaattctcatttagttcataaactacctaattcagatttggacaataaatagtctaagtttataaaaagtaaacaaatcatcgctatagtttgaaaaaaataaaccttttaaaaacattataaccaatattaaccactaaaatgccagcgataagtgtgctaagcacatcaaactattcattaaaaaaggtccaatgtttgcctagttatgcgttctagacatgtttcaaattatacaaattgctttttttgaggaagggttttgctctattgcccaggctggagttcagtggcacaaacgtggcttactgcagcctcgatgtcctaagctgaagcaatcctctcacctcagcctcctatgtagctgggaacagaggtgcatgctaccatccccagctaatttttaaattttttgtagagacagattctcacctcttgtccaggttcaaactgcattatttttaagtgctattctcctagatgcgaatgtcaaggctcctaagttatacaaagcagtaagttatatttttatttcccaagtgctgatatgccagatattacacccataaatttcttttctttcattattttcttcttctgagctggggtaagaaaatagacggtagtcagatgagtgagggcgtgggactggaagcagagtcacaggtacgtatttatggactatggcattcacttcacttggacattggacacataaagaacttgtccaaaaagaggtgcagccattgcccttggtttctggaaggtaatttgtgttttcctgagagccttcggctaaatagagaataacactatgatttagggtaggggctttgggtcacacaatatctgtggagtcagaggctgggatcaagcacatgcgcaatgaatgaatcctgcctacgtaacagacgccaatgacatctcttgacatagaggctcaggtgagcttcctgcttggcgacacttcatgtgtattatcacatgttggtacctgaagagtaacatgtcctgactcaacaggaagacgacaatagaagctcagtatttggtacttctactgaatcctgctttaggtatttcttcccatggcagattttaatctgtccctctctcaaagataaactgtaaccgtgagtataaccatggttttcagtgaggtctgtgagtccttctggaaagttatcaatctaaagatgattctgtgaggccataaacttgcagttggtgccagaagtgagggtggtcttgaggactatgccctctaacttagtagttggcctaaactccttatgacagctaactaattatgattataagagcaaactataacaagataagaattgtatctatttcattcatctttatatgctcagtatgcagtctggtgcctgagatgtggtagactttcaatcagtatgtattgaacaaattttaggtttactgagattgctttgaggacaaaccagcatttgtgcagtggtttgtaagactaccaattaaactttgatcaatgtaatcatagttaattgtgcaacaattgtatgaaatttgttccgtctatacttgaaataggcaattcttcaaaattcaacaagtctttactgagaatcttcctttaccagggaatgtgtttaatgctgtggttgggccaaatatgtggcccagatggcccagatagcaaagatgaatacgatgtaattcctgcccaccagcaaaataaaagtcaagtgctcagatattacagcagaagtagcatctaattctcatagaggatggacaatggagacaggtgacatatcaggtaagatttgagctgagctttaaggaaaattatgaattacataggtacagaagagaaaaaggcaaatataacagtatcagtgatagcactttagtaagtcttatttttactctttacatattttatcacatgtatcattctatcaagttacctaaaatattatatcactagtgttctaaccacaatttgaaaatctagctttataatatcataccaaatgatgtttatctacatttgctttatttatacaaggttcagttcaaacaactcaaatataaaaagatgtgagtcaatttacagaggatggtcgagggcttacttgggttttgtctttcctgtataaaatgaaaatatacctctccttcaccactcccaaccgaaatgcctttaagcactgtgatcatttgagaaaatttaggtggtcttacaagttttgtcaaaaacttttaaaactcaaaaagaataaaacattaaaggatattacattttaaatcaaaactggttaaacagcaaaatttttaaaaggcactgtctatgtataaggtaaaatttgtagaaaaatctgtttcaacagattgtaacacagaatggtatttcctgaactatcgaaaaaggtgtttcagaaacataagtttccaacatgcttaaccttcttttgtttgagaaagagatgcattaagaactttttatttactctattttttaaatgttatttaataccattaaaattattttggtcttcctttctaaaaggcactgtgagattaaatttaatcaaggagttgaaaaacttgtatactgaaaactactaaacattgtcaaaagaaatcccatgtttatgaatcagaaaacctaatattcttcaaatgtccatactaccggagacaatctacatattcaatacaattcctatcaaaatctcaatgtcgttttttgcactaatagaaaactccattccaaaatttatataaaatctcaaggaacctcaaatagccaaaaccatcttaagaaaaaataaataaataaagctgtaggtcgcacaccttctgacttcaaaatgtagtggaaaactatggtaatcgaacagtatggtactggcacaaagagacacaaacaccaatggaacacaatagagaggcccagaaataaaccctttaatatgtggtcaaatcatcttcaacaagattacacaatggagaaaggttagcctctcaacaagtggtgttggaaaaactgtatatccacatgcaaaagaatgaaactggacccttaccttacaccacatgtaacattaattcaaaatggattacaaatctctgcataagaggaggctgaggcaggagaatcgcttgaacccaggaggtggagattgcagtgagctgagatcacaccactgcactccagcctggcaacaaagcaagactccatctcaagaaacaaaaaacaaaacaacaacaaacaaacaaacaaacaaaaaacctcctagaataaacataggaaaaaaccttcatgacactggatttggcaactatatcttggatatgacaccaaaacaataagcagcaaaagcaaaaatagacaaataggactacatgcaactttaaaaattctatgtatcaacagaaacaactaacagagtgagaaggtagcctacagaatgggagaaaatatttgcaaatcatatatctgataagggctttaatagccagaatctataaagaactcctacaactcagtaacaacaacaacacaaaacaactcaattaaaaagtaggcaaaggaattgaatagacatgtcaccaaagaagatttacaaatgactagcaggtatgttaaaagatgcccattactactagttattagagaaatgcaaatcaaaacaaaatgggttatcatctcacacctgttaggatggccactatcaaaagaaacaaaaagtatcaagtgttagcaaggatgtgaagaaattggaactttcgtgcactgttggtgggaaggtaaaatgatgctgctgatagggaaaacagtatggagttttctcaaaaaaaaaaaaaaaaaaaaacaaaaacaaaaacagaattaccatataatccaacaagatcttgacatttgtacgctcatgttcattgcagcagtaatctcatatccaagaggccaaagtaacctaaatgtccatcagtagatgaatagataaacagaatgcagaatgcgtataacatacaatggaatatttttaaacattaaaaagaaggaaatcctgtcatattctacaacacagatgaatgttgagaacattacgctaagtgaaataagccagttacaaaatgcacaaatactgcattttcccgcctatatgagatatctaaagtagtcaacctctttgtaactataagtaaaaaatagtggttgctaggggctgggggaggagaggaaagagagctattgttcaatgggtatacagaattttagttttccaggatggaataaagggtctgtagagattacctacaagggaaagaatattaaactgatgagaaacttctcataattaacaacagataccagaaaccaatgtaatattattttccaaatgctgagaaaaatattggtctactcagaattgtataactaccttaactgcaattcaagaatgaaagtgaaaggaagacattttcatggaaaccaaaagcaagttcaccatccgcacaccttcacacacaaaacaattaaaggtttagtttagaagaaaagtgaaatcagagaccaaatttgatatacacacacaaacaaaagttctatgcataaaattattcaaaacattcattaatttaacgattagctataacataactaattgtgcatatgattttattttaaagtgcaactaatcaaactggcagcaagaaaggttgtgatatttactagcaagaaaacactgtaacctccataagctgttggaaaggaagacagaaacactaaaaaatatttagcaaagtatgtcgtgatttatgtatgattaaaaaaaataagactaaccactacaggaataaaaatacagcctgaggttacaaacttgcagaagaatttaataaaataaaaaaatgtgaataaagcaacagaattttttaaaaaagaaaagagaaacaaaaggaaatttaaaaaaatacaaactattatggtaaaaacatatccagatacatcaataatctcatcaaatatatatatggattaaactcatctattaaaacacaaaatttcagaacaactcttaaaactatagctctgtgctacctaacactcactccgtctttgacactctctcctcctgcttcctggtgaagaaatagaaatcaaaagtaacaagggaattacttcctattaattcctagcttaaaaataaatagaagccaggtaaatgacactagataaatgatactgcttgtgaatcttttgggttctaaattagcttatgtaggtcctcttagtttgcttcagcactctcctctctctccataaactgcagttatgacccttattggttgcccaactacagtgttgcctacgacatagaaaattgcttttcaaagaaattctagccttaatgcataccagaaacacctcaggaaagtcaaagttaacagatgacttttaactcacgaggcgaaagcattgtgattctagatgtgaggcaagtttgacttaagtcgagagaagaactgaaaatacagataccccaataggtttacaaaggtaaactccattacaaaagaaactccctcttttggctcaagattcccaccccctcgtaacctcagaactaagcaagaaggacagaaggaatgcatctctgaaaagcttcagaggatgaaaccacaacccagcaatccctccaaactccctccttcccttatacaattgtctcctgcttacaatactgttgtcaaactttctgtgtttttcttcttcatggacctttggggatcaattctagtctaataaactgaactctatagcttctgtggaattataacctgaattatgactttttaaatatacataatatagtctacatttagctgcttatttaatgactgattaaatctttaaagtaagactaactagaaatattcaaaataacatcctcttgccttttttaattttaattcttacatttaaaatagactcacaataactggacattaagaattgttagagctgtgacacactaagagagcccattattttgactgaaaatgtatttaattgttattttaagcagaaactttgaaaaaaggtatatgtacacatatagcatatttatagtgtaaatacaaaatatagtgtatattttgatctgaatattttcaggagtaaaaaaaataattgtaatacaaatgacagatgtattactaataagcaagtatgatgtacctgttggagctaaaggaaaattttcccttcactctctgtagcttaagtgaaaatcgatggacaaaaggctgattaagaggagaaaagaaatacaaatttattaatgtgcactggggagaattacagggtgattaccccaccatgcgaaatgtggtacacatggttatatacccttctttttagaggaaagggagatggggatgtgtggatgattttacagcgacagcaaatgattttgggggggagttcaatgaacttaaagaacatacaatgagctgggacaaagtcttttgggtctgcagagtaaaccatggtttgtgacaaaatgctgtctaggtgtattgatggacttctgtctttcttcctgtgatacgagttcagttaatgaaaactcagggaagagaccaaaggtaattgttttcttctttggcaggtccgagcttaggcagataagggaactccagagaacaacttcatcctgtgctttgggagagacaggattaagacacaggaggcagacggagttcagaggagacttgaggctgcttcttctgtgcagcatgtaaaaacaccatatttgagagtatcaatttctgagctccaaggtaccagagttttgtttaattgaacattggaagagcctaatgaaaattagtcaataactaatttagaatccagcagacatatggaaacttccaaaataaccttgtgctatttactgagatcataaaaagtaagggtggaaatctgtaatcatgattttcaaggaatttttttcatgaactacaaatagccaactctcttacaagaaagcggaaatacacacatatacacacacaccccattcagtgcagccacattctctcaacgcataaattattatcctgagagtgagacaagcatcataattgtgtttgctactttaaaatatgtcagtgctgataatgtagccactgatggctacctaattttgccagtttgggatttgaaagacatgatacaacattgtgtccaacatgctcatttgaaaagtccaaaattaagccaatgaaggtagataatttgcccaaagggatatcaagatagtaaatgaaatgcaaataaaactcaaatatccttgctcgtaatccagagctcattccataaattcatattgcctttaaattaaagttattctgagaatctgacatattagataaaacatagacctactaaatacaaacaaagccacaatctttcacaaattatgaacgtttttttctccatggtaggacagagactatttccagacaaattgaagaattttcctccctgagccatcctccatgcttaaaggagagataacaagagaaaagaaaaatgtcttgctctttgaattaaacagaaaggtaaaattccaaaaggagagtatcctgcagaaatggaagctagacacaaagaatttatatcgcatggagagtaactgcaatatactcattcaacaagacatggtccttaacactctaaattacaaaacctcaaaataatcccgaaaaacaggatcacaaaatataaaatgacttcaacttccaattttcttgcctaacatgatggttactccattacctctcagtggtagttcacacacatacacacaaatacacactacaatgtacttactgaactgtagagatagccttcaccattcatggccacatagaggctagccttcactccttggatggccactacacgcaggcccacgggaattagattgaagagagctggggggagaaaaagaagggcggaaaggatcagtgaccttttgaataaataatccttcttataatcattcttttgagaattaaaacctattaattgaacttggtagaaaaatggagagagaaataaagagaggtctaaaaacgagagaaattgacttcttgaccctgcaccagcattaattacctatgtaacttcaggtaaattacataaactctgtactaaaggggttggattagaaggtctctaaaggcccagctggatctgagatttcaggatccctgatccttaaaatgatcctcaaacagtgtaatataagataattttttctaacaaacaaataatatggaccgaaaaattctcaacaggagaaaacctatctgtagtcacaagaaataacaaaatactatctttaaaacaggccaaagcttcttgtttttagtattttccttgttgttccaaacattatattgaacacagaagaagaatgcaaaaattactgacttattggtgataacattcagacaaaacttttttcttgatatctcaattttttacatgtaaataaacagagataaacagatggacagatgattgatagatagcttaagctgtaatggatatattttatatccaggtgggaaatacacacacacacacacacacacacacacatatacacacatatatacatactatatatatacaaatatatatacacatatatatatgcacacacacacacatatactcaaaaccattaagaattaatttgacaaaagtaattcaacatcctaagatgaaatggaaacatgcttgcagtctttacatattcgagttgctcatcactcaaaatactcaatagtctatatgtccacttagagaaggaattcgtagatcagaaaaaaagatacctaagagaaccttctatttttcttccaacaatatttttctgtccttgggattatttcagttacttttgagatcacgaaatgagcataaacagaaaacactgcccccaccctgaaacaattcacattgcatatggaagaaaagcaatcatatagttaggctctatagatggcaacatggagatgaattaagtatctcacggctgtatgcataagagaatatctctgcagttcatttcagtatcctggcttaattagaagttcttatccactttttctgttgataaaattcctatcagttctcgtcttcttagtttttaatacaagatacacataaattaacccaagggctaccattatttagggatgcctctatttttctcggcttctctcaacctacaatagtaagctaaacacacacacatgcagacacacacactcacagtatttggctttcagtcaaatgttcaattgacagttgtagaggatcaagtcttagaccacaagtttagtagaacaggattccattcttagctgtcgacatcggatcagtccttttgcctctttgaatccatttccacattttttacgaaaactgagactagataagaaactgtaagtagtttcttatagattaattgttggctcaatttagatttgaactggttttatttcttgctatattcttaccagtgtccttgtgttactgaaacaacttaagaaatacaagaactagacaaagtctagttggggagaaaaagctaagacatatggaataatatgatacagtgtataatttacttctataattaaatgtaatatatgcattctatatatatattccctatgttacagaagttcaggaaaatggaagctctgtgtggcctgaagtattcatggaatgccttacacagaaaatggaacctgagttgacacctaaagaagcggaagttgagaaagccaagaacagaaaacattttagtgaggtggaagttaggtggttttgcagagtaatgtgtgtatgcagaaagggactggcagattggtggatttgatttatattggggggaaatgagaaagaacagcatgtaaataaaataaggataaataaccgagtctgtcactctaatcttagatatctggactttaccaaataggcaacaagacgtgtgacatatgaaaactagagcaacaacacagattatgagatttgcagacacatagtttctaaaccctccactcagtcacttggctttgagctattcatttaacttctctgccttagttttcctatctgtaaaatggacatgataatgcttattgcacagagttgatagaaccaaatgcattgtcatgtttctgaaagtgattcacagagatgtatcctctctaagagctatttgtcatgaatacctaattcttctgtttgtcagataaagttaccataagactattgtaaaaactgacatattacctcagtaatattttttagtttatattcagcagattgctttaaagctttaaaatctaataccttatatttgtgcaagattaattttcaaagtgctgatacattcattaattgtatttgatcctcaaccataaatgctatgaagaatttaggacagaatgattaccttaatttatagaagtacaaaaagatttagagttaacccaggggaaaatgcatctaaacaaaggctttcaggctccctaatgtggttacctgttcaaaacatcatatttcatctttttgttctttatttttcttttttgacagagtctagctctgtcatccagctggagtgcaagcaattctcctgcctcagcctccagagtagctgctattataggcgcctgccaccacaacccagctaatttttgtatttttagtagagacggggtttcactgtgttggccaggctggtctcgaactcctgaccttgtgatccacctgtctcggcctcccctttttgttcttttaatttcctctaatatccatttttgccttcttgcaaataaatagattattcagctacaccttctaacatatcctgcaaccagatgtaggtcctatggacccactactggccaatgagatgtaagtcatcacatcattataagcttgaggaatccttccttaaagacagcataaaggtgtcctttgtgccccttctcaacctttgcctattgctgtttgaatggggatatggtagctggatcatctcaaaccaaaaaaacaaggactactccccagcgggtgttggcaggtgagctggaaggagctgggtccctgagagctttgtggagcagtggcacaagtccaacattcaattacccaggtctggcttttacgtgagaaaataagtccttgttctcttagtctgtgcgatgcagagccaactctaatcctaactgatagagatgctaatgaaagcagaattaatatgcaagatatgaactagatgcaaggtacttcattttaaataaaagcagatactggaaaacgattaagttcactgataattactgtgagaaggagaaaagacttcccaggataaatgctaagaacactggtttatgtagctgaccatagaaggaaaagcaactataaagtttttcctacatggaatgagagaaaactgataatgctaggcagggacaaaaacaagaaacctgtttgaaagttttatatgaaccacaacatgataatggcctttagctggtttgctttgtgagacttactaagcccatttttaaaaatcagtaaacgatttgaaacgagactttattggtaaaagctaaacatagtttctctggaaaggtcctcatctgcctcctaaaagtcccaaaaggtggcaaatgacttactgttatctattaattatcttcagagtagcatactgtggctccagctcacaggagccctttgctactcctttcactactcctcaaagccactgtcctaactcatagtaactgggctgcttgactccacccactctttaagtcccttgcatcctcttaagccattttcctgcttacaacctgcagtgattcctccctgtctccaatgtcctttacaacctggctccaacccacatttccagcttatcacctgtcaccctttccatctgctgtaaccggcttcacagagctttttgccatttcctaagttccccctcgatctttaactaggctggagtttgtcctcttttgtcctctatctctttttggaaagcttatcttcccacttctaaatttggccaactcttttcatcatttaaggcctaccttgttgaactcccccatgaatcttgcccaaaacccttcagaaataatacttcccttttccagatggcttatttcttgtgtatatttcggtaatgatatttagaacatggttttagagttctttgtttatatctctgtctccatccctacaatgcaagactcttgagggtagttgctgtaatgtctagcccaggtacatgtacacagctttattaaataaatgttattatatgggttatgacaaaaacacgttatttccaggaatgtaggttttcttgttagaatgaaagttctttttaagataaaaatgaaattagaaacttaaagcatctcagcctgatactcaaagttaatctacaacatacatttgtgctacatggcactttcactccaatactgagtgcttctagtaatttgatcttcctcctcctaccttctaaactccatctttttgctaacttagctccctctgcttggaatgtcactctccctacatcttcacactgaaatccctgacatgcgtgaaatgacacaccaaatgccaagtgctttctttcacttcttagctgccctattcctggatccagactatatttatcacaatttatagttttattcttctaaaaaatctgtttcctctgccaaccacaaccagattgtaagctctccaaaacaaaactcacatcaaaactacacttgtataatacaaggaagggaggagacagatagagacagagaaaacaagagggagaatatgcagggtagtatatattctgtgtatattagcaatcccagtaaacatttgcagactaaataatactacaattatatgccaaatagagtccaagtatttaatctgacattcaaagatcttcttaaacttgtcctttccaaaaggagtatcttgttctacatctttttgtaaagttgactcttgtattttgaaaaatgaaataatggagctggtactcttggcttccataaaccaagctcattcataaaacttcacagaaaaaaggtaatggaaaaggtaatgaagagaaagtatagtctcttcaacaaatgatgctgaaaaaactgggtattcacacatgaaagaatgaaattgggcccttatgttataccatacataaaattcattcaaaatggattaaataattaaatgtgagacctaaaactgtaaaacccataggaaaaaaacataggggaaaaagtcaacattggccttagcaatgatttatttcttggataacgaaaagcacaggcaaatgaaagcaaaaactagacaagtgggattacattaaactaaaaagcttctgcagagcaaaggaaacaatcaacagaatgaaaaggcaacttatggaatgggagaaaatatttgcaaattgtatatctggtgggggttcaatatccagaatacataagaaactcctatgactcaaaaggaaaaacaaaacaaataagccaattaaaaaatggacacagggcttgaacagacatttctcaagaacaacaaacaaatggccaacaggtatatgaaaatatactcaacatcactaatcatcagataattatgagctgttaacctaaaataaacacttccaagttataaaatattaaaggatcactttgattaatcatgctacaggaaagactgaattatatttctctctacaagaaatgtataataaaattgttgtcatatggaaagacattcaaaaattatatatccataataatgggaaggaaatttatagacttgctgctatcaggcaattaattaaaatgttgtattattttcctgagttgtatcatctttgatagttctcagcttttcaaaatttaaactgttgtggtatattttctcagtctaaatactcaattttgcatctaattttcatttcattatatttattttttcgagggagaaccccacataagataagctttaggacctacaaaacctaaatcattctcatattgaaatttaagtggaaggagaagatgagagaaagtaacaaatgagaaaagaaaaactaaatagataatattcattgactgtctattttttcaggcatcctgctaggtaggcattttgatatgcgaaatgtcattttattataaactcagtatttgactacttaaaatagcttcattgaacagtatataaaagtcctaacttctttgaggggtacaaagtgaaaaaaattgagaaaatgtaaagcaccatcctaacatttggagttaacatacagcacttgtaaaaacctgacttagaagtcatttattcttaccataaatatttgttaggacttactgtatgccaaataccatgcctaggctaaaaaaagagtgacgaacataacagttgtggtctctagtgaaaagacttttatctgtgaatctttccgaggtttccactactttaagggcaagttgaaggtaccagaaacttttattatgatccccaatgcctagcatgatatcttggttttagaagctgttattcaatatctgctgaataaataaatgaattaggagtagtttctccttacacatgtttattcataacttttctcagtcatatttttataattaagcatgtaagaaaaaaatggaagataatatgtattacacatagactaaaggaaagccaaaaaacctacatggtacaaagtctgaaatggcagaatcatgggatgcataggcctggtaagggtaggagtatgtgtgtgtgtagagtgatgcaaggttggagggaattaagaggaaggaaagagtttggggaatctgttacaattgagatattaaacatcttgtcagcaaggcgtggtggctcatgcctgtaatctcagcactttgggaggctaaggcaggagaatcacttgagcccaggagtttgcgactagcctgggaaacacagggagactccatctctgtaaaaataaaaacaaaaataatttagtcaggtatgtgtgtgtgcctgtggtcccagctacttgggaggctgaggtcggaggatagcctgcacccaggaattcaaggctgcagttaagccatgattgcaccactccactcctgcctgggtaacggggcagggcatgcctctgtctcaacaaaataaaataaaaaataaacatcctgtccaatgatactgcaccaaaaaatgtactttctaaaagtgctatgttttactcagcttaatttctacctgtacacaccatattattccagtaagaaaaaggtaacagtcaatccaaaacacataggaaaacaatgtgacaaccaagaaagtttcaaagaaagagaagaagaggaagagagggagagagggagagagggaggaagaagggagggaaggaaggagaaaaaaaagctcattacaaattgtctttggaacatgtaaatccagtatctttccaagtaacttctaaggacagactcattgcttgtaacgaagaaaggtataaaagagtacagttgtatttagaaattctagatctattttgtcaaatggccaataaaaaagattcatcctgtgacccattaaaaacccatgtggaacatactgagagagaatggagatatttgggtttataatctgtgcattttcaatgttagatttccttgaaaattcaatatcatttcccacatctcaaaatgttctcaatcaagatattttattagagtgtgaataagatcatatcctacaaaatcttaaataaaaagttaagttagtaccaggttattttctcctacaataaatcctatagtctctcacaataatatctataattataatattcataatatttgcaggccactcaattggtttttcctcagttatgaaattaatatttacttctgttatttataatttacttaagtcaattattcaccctccccattctcaacaggaaaatgctattattgaatatacagcaaaggagtgagctcttaaatcttccaatacaaaagtggttatataaattatggtacaatggaatgttcacccaggcaaattaattattcattcccttaccctaattccacagcattccatacatagcacttatcacagtgcttattaatatttatatgtttgtctgagtttccctgaaaactagggattcatagaatataacatgtttttgttgttgttttgcatccagattgcatttcaaaataaagcctaaacaattgttgttactgaatttaaccctctaaaacagcatttcttacagacattaaaggaaagatgtaacttgccgtattcttttagcttttaagtcaaggaaataagtggtcttggtgactccaagtaatttaatgaggttgcaattttttgaatttctgcaatcagaccttggcgatgactttgagcagtaggatataaataactcccacatgcgtagtgttccaataatggaacactaggcataaatgagttaaccactttgagtatttcttggctctgaatgcttcactggattgttatgaagatcaatgagataataaaaacaagccactttttaaaccataaaggatacaaagcatcactatcagtgttgtcagtgtttttgttctcattgttgttttcatatctccacatctggagttttcatagtaggaggaacatggctgggtggtcattattccatagttcaacttaaattttttaaaatgttatgggagaaaaaaaaaagcatgtattccatcttctattattgaagttcccataagcaaaacaactatgtggttaaaataaaacactgttaagaatgtaaacatcaacatactttaagttatattggttcactgctttaagtatgatgtcctattttataagcaattggccaaatagtccaactgactgatttattttctcactgaatttatcgacttacagagctgactagtggtttgggacttcagagactaaaatttttcttctaagcattggctgacagcatacactgtgggttttcagcataacaaaaatgagcagcattgtgatctctttatttgataaggtagtagaaatatttgccttagctctggtaaaagtcctgtcattgacttttaatcctgataatatcatataacctttcctatgatagttcaaaaatgttcaaaaatttgcataattaacaagtcaattaaacgtgattattttttcattaagatgaaaaatgaggcatatcactattgataatgaaagcaaatgcctgtcattactcattctctggagccatttgtcttacacagacttgtcttggagcccgtctggtctgaagaattcagtgaacagcacaggtgacggtccataagatcaatgggcagaaacatcttccaagaaatctttgcatgttttgaagcttttagatttgcatcctctataaacctttcatcaaaaactatgttgccaaaatcaatactatggcctactaggtttattcattaattcatcacatatattccagacattgtgccaggcacttgcaatacagtggtagaaaggacagagatggtacctgccatcatagtagttaaagtctaaaatagataaaagtaaccacatgtgtaatatgtatccatctttacagaccaggaaactgatactcaaagatactgttttcccaaggttataaagtcagctagtgaaaaagctaagctgtgaacctagattctggtggctacaaagctgtaaaatattgttgctcttaagatataacataggccgggcgcggtggctcacgcctgtaatcccagcactttgggaggccgaggcgggcggatcacgaggtcaggagatcgagaccatcctggctaacacggtgaaaccccgtctctactaaaaatacaaaaaattagccgggcgtggtagcgggcgcctgtagtcccagctactcgggaggctgaggcaggggaatggcgtgaacccgggaggcggagcttgcagtgagccgagatcgcgccactgcactccagcctgggcgacagagcgagactccgtctcaaaaaaaaaaaaaaaaaagatataacataaaattctaatgataacaattcaagtagttgtgaagaaagtaggaaaaacagactataataagaaaatgtgaaaaccttacaaggaatgttttagccaagtagaaccatcctgctcaaaaggtaaaaaatctttagtttttcttagataaaattacacacaggcaacacaagcacacttatttgagttgatttagatatgctcaaagctttgcacgttgttatcattaatacctaaataagaaaatatgactgcctaattccaaaaatattaagtggatctatagaaataaacataatgtggaaagattttttttttttagaaattagggataaaaaaggacttgaaaaataaaatgattattttgtccttactattctctacttcaaaatctctcattcaatccatgtctactataaactccagttagaaaatttttctaaagtattgcattttactcattgctcaataactttcattggttccccatttcctacaacataaagcttacactcccttaagtgtcagttaagacactctaaaatatggccccatgatacttccaaataatctctttgcttcatgcaagctagtgggttaatttttcccttacatggtgggagctttctccacttcctgattttgtgcctccttacctgaaatacaactgtcctaatcttaatttatttattttgttcccattcttcaagaattgggttaaaaccaaacttgttgatcactatggcttttgaggatctgttagatctctgaaatctggtgattcttctaatcacttggtagtaccagtgacaccttttgttttacattaaaatgtaaaaccttttatgctctgggaaaagctagaaggcaggaattgtatcagattcatttttgtaatccagtaactagaacgcagttggccttcaatatgttggtattaatgaaaataaagcatgcatatggcaggcatatgtgaaaactcaatcattttgtggtagctgcctgaaacaatgtcttaaggagacatttgaagccaggcaacaatgaatgttgtgagaatttagtgatgtctgcagtgaacacaggaaggggtacttcagccattgatttgtcatttcccacttgagggcctccttttataataaaatagcatgaaacattccataaaaacagcgatgatttgcaccgtactttaaaatcaatatcttattgtataactttgactcaaagttataataatacaaatttggaatgcaaactttaaaaattgaagaaaaaaaccaactctccagaggtaatttagcttaatggttcacagactttgctgcatattaaaaccttctgaaaagtttgaaaattctgatgtccagactacactcataataattaaataaaattgcctggaattgaagacaagtactttttaactccccagattattccagtatgcttcattgttgaaaacaatttaatattcaatagtctgggatagttctagcaagctcacatgcgatactgattcttcccaaatcttaccagtcaatgaaccaaaccttgctgctcaaagtgtgaacagcatcaccatcatctggagcttgttggaaaggcagaatctcaggctgtatccaagaattattgaatcaaaatttgcattttaacacaattacaatgcagttaaagttttgagaagtgctgtgtgcttggttctcaaagtgtggtcctcctgcagacttcctgattcaaaaacaaagattttggagccattgttgagaacctggatctatgaggagcggctgctgtcttcctttacgtctcagtagggcttttctgcccagatcatcagtgtcaaagactgggaagagaccatatgtaactgtatattccaaccccttcagagggaaactccaagtgcactagatgttaatcttatctaaattagacttcgatcaattcttccaaagaaaagaaggttggtctaaggcctaaaagagtgctgaaactacagatgtggttcaaaaatggcttcttacccaatttgtcaaagctctgctcaagtccttcattttttctgaaatggctcttgatcactcttcagtcagcattgatttcccctgttgagactttccaaggcacttccttccataagagtacattttgatattattaacttaaatctcctacatattattcccattttgcggatgaggaactctggtttcaaagtgttaaactaattgcccaagtttatccagctggcaagtggagatactcatattaatatccatgattgtctgtccctaaaatcaaatggactatttataacactatcctgcttcctcaagtatgggaaatgatccctggtatatactatagaaacaataaaagtgatgttttctgctcgtacctaagtaggaaggagcaaggagttctctttaggatatttgtaaaaattcaactgtaatactgtggagtgggcttaataatgctgtgcatacatagtctcacataggtatgtgttccagattcggtctcaatgtcaagggaagcagatgtactaagtgcaacctcgctagatcttggctggatgcctgttcagtaccactctatctaggctgctgaataatacatgaaaatatatatccacataaagacacacacatcctacacacctcaaacttctcaaatcagatatatgaaataggcaaccaggttatttaaaatctttaaaattattgtataatggtttattatctctaaaaaatgttttaatatatattttaaatacgtcaaacacattgaagaaaaatccttgcaagttcactgtttagcctgtctaaagtaaacctccataatattttagaactaaaccacgttgccttcttaatgccttttgaaagtgttgtcagaagaatgcagaggtatgatttaagagattgtttattatacactgggaaatattaaccaggaaagataaattcgagatacagtgtaaactgggtgaaggtattaacattggaactaaacttgctgaattcaaatcctgggtctattatttaatatctttaaggccatggactaattatttaaccttcctgtgcctcaatttactcatcttcaaaatagaaatgattacagtaccttttatagggttatcacaagacttaactgagtacaattttgaaaattttcatagctgtactgaacatttagaaggtgttcagtaaacagttactattatctgatatgtccccaagtcatagattaagaaataatgcttgacacgtaggtgaccattttattttccaaatccttcattccaaatatgtagttcttctttatgcttcatggtagtatgccctagaaaatgctaatccatatgagtatacatttataatttataccttatttagctggtggctaaaaacagtgcttaatcaaaccagagacatataagaaactacactgcaattcattaagaatatggacaaatctatacaaccttgcaatcagtaacttatgttgaagacggagcacaggatatggatatagtagaaatgaattctacttactgtacttagagcaaatcaactctcacttcagagcctcaaagtaaggtaatgaatttcaggaattttaaagtgatctctaattctcactcatcaaaattttaatacccttttccactacttcaagaaaccctctctttttagtttcttattcttaaaacacctgagtgtgtattttctttttcctgcaacatatgtttaaatttatactgctgcccttagatgaataataaaagcaatgactctctctcttatgggcaaatataccatttgcttattttaagaaaatgatgtctctataattgtcaacatgaatatatatattcatgtaacactttgagaatatatgtaacactgcgaaagtgtcttcttttactattattgctatagaattcacttttccagactaagcatactcaattttcttcctattttcaaaatggaaataatttccttactcatcccttgaattctcttaaatcatctgtcattctcaagacaaaatgcaagcatggtcccattagcattaatttttcaagctgggcattgtcacgcaaagtcatattcatttttgatggggttgttctgtgaattcactttcattcatttattcaacaaatactgaatacctaatatgtgccaggtattcttttaggtgctggagacatagcagtacaaaatgcagataaagctcattgcccccatgaagcttatattctaattaaatcttttggtttcaatggtataatgattatactattgctactatcaatgaacttatccatatccattatcaaggcgttactcattattaagaatttattacaggccaacacagagataaagcaggtattgtcaatgcccttaagtagttcataaccaaaaagaagtcagccagtcatatacacaataaatacatacagatgaaacagcataaaatcataagagatgtacagtttgttcagagaaaaagtagaatgtacagttaaatcagaaacaggcttcaaagacaaaaggcttttagaggatggcataattagtgaaagaaataacataagcaagtataggatagaataaaaaaagtatggtatatataagtaatattttagtagtaagaagacataataaaacaagtaggtatattagatagtggtaagggttctaaagatgaaaacaaaattcaagtaggcaaaggagactgaaatattgaggatagggactgagatgtatatagattaactagaaaagatctttttgagaaaaggcttcccttttgagtggagtatgaagattatgagggattgagctatttagatatttggaaggacattccagaaagagggggatagctggtcccaatgccttcaggcaagaacatggttggtgtgtttgaggaacagcaagatggccagtggaaagaaagaggagagataatatgtgaggagggatgaaggagacaacgggtgagattatataaaacgttattggtcataggaaaaaggtcattggcttttaccccgaatgatatgtgatgaaagggattgagcaaagaagtgagtttatttcgttttatcttttaactgggtcactctggctgctgtgtggaaaataggctgatgcggggaagctttaagtaaagagaccagttagagagttattgcaagagtccatacaaagaggatagtagcttggactagggagtggcaataggggtattgagaattgctggaaatctgtatatgtatacactgaaagtagcagtgaattcactactgtgttccaattcaatgcaaaagctattgtactatttgctcttacaattttgccttcttttgtaatgtgtttaaaataaaaagtttcccatttttcaaaggtgaaaacaaaaatcattgtcatcttgtaggcttgcaaaatttcagatctatcagagatactggatattatcttttctaaacgcttcattttacagagtagaaaacaaaggattcattcctcagaggagaaatgaggggtgggggaagtaaaccaaggaacagaaagtttgtgggacttaaataagttcactcagctatttagagaaagaacctggactggaaaccaggctgtctgactcacagcccaagctactttgtcttacaatcggtgatatttaaggggtttgtactgttcgtttaaagttctgttctgttattttgatttaacaaacattgagtgaaagccacaggtatctcaaactgaaaagtcttcaggccctaggcaggtaggaagaaaatgtggggaaaaaagtagatgcatctgttgcttacatacaatcattcccccttcccaagcatgccagctaaatgaaacacatttgtagctctttggattttggaaaatctccattgcttggctaagcagaagggcaaataaggaagtcatactctaatagggaaaacacaaaagcagataaggaattgcagtatataatgtgacttgcgcagctgtaaacaaatgcataaccctcaaatacagcagagtgaagtgagtgagcgtggggttctgtatgggggtgacagttgagacaagatggctaaagaagacctcacatggacaaaagaaacaagagttgaggagggttttgaagggtgagagtggcttgcctcctggataagattggcaaagacatcgcaagcaaaataaatttgcatatgtaaaagctccaagacatacaaatctgtgatacaggcttacctatatcactacatatttttcatatttttttcttttttttttgtaatcctccaaacttatatttgatcatatatctgtccagaattgagccttgactctcttcaagtaattaatcaaaatgtaacagatttcacacattgtttaagatgatagaaagtttgaatttcagtgtctacagacctctgctttccctattatattaggagtcagatccccatagaaataggcttcacagtcccagaacagagattgctttcattagcaaatgtgagcacttcaaatcctgggggcagaggaaagatgccagttgtacttgctgcagtgcatcagaataatctggatggcttgtcaaaacacagattgctgggccccagcctcacagtctctgattcagcatgtctgaagtgatgctggaaaatgtgtatttctaacaagttctcagatacatagatgctgctggtctagggactagacattttatgaatcactgacttattcttcaatacccaccagtgtaaacaccttcaaattcttccatataataatagctgccactgctaagaattctatttctgttaaaatggtcactgtgtatgagctccttgaaaacaaggggtctctcatccctgttgatgaaaataatgacagcagatgacatttattaagaattactgtgttctaggtacttttaaggaatcaaaccatttaaactacacaacagccctatgatctaaatattattattattgtcatttaacaaatgaggaaatttaacagagaggggttaaataactaattcaagggcaaagaatctcaagtcagattacttggacccaaattctggttttagcatttatgtatttaactctctagatctttaaacacactttgagactatcacacagggatttgcaaactgatgatttcctgcctgctggtaacatatctttcagaacaaagggtatttagggaaatggaggctgtcaatcagtttttctgagcatacctttacttctatatcagaagtaaataaaagactatcaaaatcttagtgattcttggctcctctaatgttgtactatctgaatttgtataaatcagagaatgtttatgtgacttgcccacggccaaagcactagtcatcacacagagccaaaaacagatcaaagacaacctcagtcctcagctctttctaggaatacacttggttaaggagctccaataagatttttaaatactatgtattctgcctagaaatatgcccataaaaagtcacagagtaaataagaaagaatatcatttcaaatgactcgttttgctttactgaccagaaagatacatgggagcagaagtctttttttttttttttttttttgagatggagtctcgctctgtcacccaggctggagtgcagtggcacgatcccagctcactgcaacctctgcctcctggattcaagccattctcctgcctcagcctcccgagtagccaggactacaggcgcccgccaccacacccgcctaattttttatatttttagtagagacggggtttcactgtgttagccaggatggtctcgatcacctgaccttgtgatccgccagcctcggcctcccagagtgctgggattacaggcatgagccactgtgcccggctgggagcagaagtcttatgatcaaaaatatatataagatcaagaagaaagtgaggagccaaggctgaagaatctggaggagttatccccttatgattttatgtaagggggtaagccattcaagaaaataactagtgtttgctaaaattttccacaaatattatttggaggcactatctttaaaattaaaacacagtcaatgaaaacaaatttctaacaaatttagaacatctgtttaattttttgtagtacctgcatgcccttgtgataagaaatagatttccttcataattttcctcagctaaccatttggatcatacttctgttcatagtttagcaataaaagcttctgctgactttggctgtgtctatatacttgtgactggtggtatcaaaacatcatatgtttggtattgtatagaaaacataacgagtgactaaacttttacatttccaattggttttctgaaaatcagacacagaacattttgaaatgtttgttgttgctaaactcacagtgaatttagtacgttcataaaatctaatgaaagtgtatttgtattcataactgataagaacataaagtattagaagtctagactgagagaatcttaagaaataaattccagattaactaaatatcaaatataagaaaagaaagaatacgttacaaaaaacaaaacataggagactttttaaataattttggataaataaaggctttttaaattggaaagaaaagctgacggcagaaaagcacatttaaaataaacaaaaaagaataaagcatggcaaaaaaaaatatcggaggcaacagaattagaaaaaaaaggtaaatcacaacaaagaactgattttttaaatacagatttcctaaaaataagaaaagacatttcatagaatcagatatagacagacagttcatagaaaaggaagtaaagatcacccttaaacaagtgttcaacctaactcataatttaaaaaaaattaaaatttacattttaaggtaacaaagaaccaagttttttgtttgcttgtttgtttgtttttagttttcgagacagagtctcgctgtgtcacccaggctggaatacagtggcacaatctctgctcactgcaacctccacctccctggttcaagcaattcacgtgcctcaggcttccgagtagctggaattacaggcatgcaccaccgtgcctggctaatttttcttgtatttttagtagagacgggttttcaccatgctggccatagctggtctagagctcccagtgtcaggtgatccacccacctctgcctcccaaagtgctgggattacaggcgtcagccactgcaaccaactaaaaccaaaagtttgataacacattttgttgactagatgataaggaaacacaattttagagtaaatttgcataatggagagcaattaggtgacatctttcagaatgaagaaagcacatacccttgacccagcaattctacttctaggtaactatcctataaatacatttgcatatatgaaaaatgacttatataggaggatattctttataggattgtttgtattagcaaaatacctaataggaaattaagtatttaaattatccatttaaatatgtattatatgaaaaaatcttgcagatatacattttaagttaaaagaaggtgctgatagatcaatatagtagatagataaagacagatggatggatggatagatattgtacatgttgataagtgcatagactatatcaggaaaatatcaagaatgtgcccaggtggcaatggagggtgtgaatgaaaattgcttttgactgtgtcaatgacttccaatgaatatcataaacacacccaaggttgaacaaagtttgttttaataacactcggcaaggaggaaaaatacacaccagagcagaactggggtttcttggtaagaggatgtaagaaaagatttacaggatttgggtgtgtgtcaagtggttttaaggagggctcaaagatatgtgaatctgccccagattggatgctctaaggatgtgggtgtaattctatggctactatcttagtaattcttttctagaaggcaagaagaacagagcaaggttaaagctgtgtttggtaaagaagcagcagccacccacataatctaggacagagacatatttgttcattttgtaatttaggaaacatttttgttttcgtcgtgttcagacatgattacagggtcttgcttttatcttgacccatcatgtctcagtggctttgtctaattgcaaatgtgaaattgtctatattcaacagaaggagaccaagtcttcttgggagtgtcaagccacctgctggctgtcagggactgttttgctatttctcaactatacgcccttttgtgcctttataatttggtgccacatacttatcttacctattcaaaataatttttaaaagaatatcaggactaaatgagaccttaaaagtcactgagttctgaaaccatgcccctcccaccaccactctgcttcctcctcccacaccaagggggttttcttgtaaacctctccctttgcctcaagtgccaggacagcatctgcttcagtatctccagtctttccaccgtactaacttgtcaggcagcccattccatatcaaatgctcttaatattttattgttcagaggtaaagagaacaatacctttggttataatatctttgttgttttctccctagcgtttttgacctcttcaaatgtatcttgtcctatggtaactcaggaaacaaaataattagctttttaattttatgtaaaatattcctattaataccctccaaactgccattgtcttttttgttccagtgttccaacacagttttgtgctttttatcattacatttgcagagattcttatctgttcctgccgacaaatccatttgtgttttgtactcaattacatataattagtcttttcttcatgaacaaaagaacaggtgtctttatcaattctgtgaaatataccatggtaaggttggttagacctaatgatgtctagtgaaccaaacaacacatttctgacagatgctcatagtaacaagattcttttttcaaacaatcaactgcttctactcctacacacacaaagtagagaaagaaaagacattttaacaacttagaggtttataatttttctatgaaacaaatgagtagaatttaaatccttcttcgatattttgacttctaatccccactctgacaaagtatatgtaaaattatttgtttttatttgatattcttcattaaaatatgtggggaaagtgtcagaagaaagcacattagttgaaaaactggtaacattttaataaaagctatagcactctgtaaataatattcactagtgtcaattttctgatgttgatcagtatgttgttacgtaacatggtaccattagtagaagctgggtaaaaagtataaaggaattcacttttattactttgtaatttttctgaagtcttaaatgattttttaagttaaaaaatatgtggggccaggcacggtgactcacgcctgtaatcccagcactttgggaggccgaggcgggtggatcaccaggtcaggagatcgagaccatcctggccaacatggtgaaaccccatctctactaaaaatacaaaaattagctgggtgtggtggcatgtgcctgtaaccccagcaacttgggaggctgaggcaggagaatcacttgaaccagggagtcagagtttgtactgagccgagatcacaccactatactccagcctagtgacagagtgagactccatctcaaaaagaaaaaaaaaaatgtgggtaacagtattttagccaatgacctacagccactgaactccagcctgggcaacagagcgagattccgtctcaaaaaaaaaaacaaacaacttttctacatattgacggagacgttcatgcacctagtcattcatcattcactttgtattgagtgcttactatgtattacagaccattcattctaggttctaatgatgcatgaggcatcaatcaaaatcttttcactcatggaacatacattcttctgggaaagaagatcaaaaataaataaacagcaacaatacatatttcagaaagtgggatatgaaaatagagttccaaggtgagaagtgtaatttttaaaggactgttaaggaaggcatcttcaacacctataagacagatcttagcagcactatttgtaatggccttaacatagaaacaatgattatacacaaaaaggaaaatgaataaatatgtttgtatacattcatacagtgggatattttacaaaaatgaaagaaataaagcaaataaatatattaccatatacaaacctcacaaccataatattggggattaaagtacataaaatatatttatgataatgttctaacttataaaatattttaaaatatgcaaaacaatattatgaattaaaattttttcttaaattagatatatatgagacatacaaaattccagggagttattatatctggtaatgatgaaaagtaagattccatgagggaaaacacaacaagaaggttaaactatattgatatttttaattaattttaaagctagtggtaggtatccagataaacttgtattaatctatatattttgtacacctaaatgattttaaacacaatttattaaatttatcttaataaaatattaagatagtttatcttaataaaatattagtttaaatttgggagttcagagaatttttaaaagtacttatttgacacaatgtgtgccctatggtgtgtgtgtgtgtgtatgtgggtttgtgtgtggtatgcagaatgacattatgctaagatatatatatgcatggaggaaggtacaaatgtacacgtgggtgtagatttacactagcagttcacccagcgtcagcagagcaagcgttgtcaattattttcctagaaagagtgaaggaaggatttgtcctagcttgaccccacacttgcacttctacccttctgtctctgccccatgataaatgtcatgcatttgcaagatagttggctgggtaaaggtagcattttgtagattgaatatggctaatcgtcttacttggggattgattctatcttcatcaatttataatttttcaattttttttaaagttagatggacgatgctgacagggatgttgatatatcatcaccatctccagccattagattttatagaaattaaacctgagaactagtaatatcttggagttagtgcagataagtgacacaaataagtggttccctggttcttgcatctatatttgtagcctcactaaatcgacattcagttacagacgcaataaatgaaagtacatggagagaaaagtatcctgattcttctacactgagttgaaagctttaatcatttaaagaatgctttcacaaaaacacaagccaacaatgcaaaccaaaatcagccaatcaacaacttagcaaaaaatctgagagcaagaaaactgaaatgaaattctttataataagatcttttatttattgtaaattatattttaaatgtgtaatattaactgaacaaagaataacttagaaagggtggacaagggcattttcattcattagggattttaaatttttcctcaaatagttcttaataatttaaaagacgtttcactacaaaatatctagcttcctaaattactttatgcagtttggtagattatcagcctgatcacaaaattacatccatcagaatcacaacttgttgggacagatatcagtgagcatttattgtgtgctcaacactaaagatctagcagtgaagacagacaaacattaggaaacaatatggcaccatacataattttagaatgacatgaatttgccctcaggtatctgtatatgattatgcagaatttgaaagatatgacagctatcaatcttgcctctggagcttgtatttgacatttttctagactgcaaattcattttgtcataccgtgatgattgcatttaattttttaacttgtcaactctaaagttagagcacttaaaaactatatccagagaaattattattaatctttgaatgcccagcatttttatttccccccccaaaatttttaaattccatttcaggtctatcagtcttcattatcttcttactattatatatatttattatatgtaccatatgtaattataatatttaaatatattttccttttaaaatcagcaattttgcctttaacataaaataacatatatatatatatacatacacatatatgcatgtactcagtgtttaccttaagaggtaatttttgtctgtcagaaattgtgttctaagaaatatagaacttgttcattattgaactataacttgttcatcacttggttccgggatttaaataccatcttgtgttggaagatgtgcttgtattgttcctaggagtgtgtatcatcatgctgcctaaaaacactgtgatgggagtatattcttgcccattgaccaaatggacaagcctcttaccttctcttaagtgcataacctctctcctatactgtctttgctgtaggaaatcatagcaagaaggataaaggaaaagacactagcttactaatagttaaatagtttgaaaggcatagtttggtaaggcagcttagcaatgctttaagtataagatacactgggccctacatttgatttgtaatcagattgtaagaagctaatgtttcttactgtagtcgctgttttcgtccttggtcccatcaatggtaccatctgggtgcatctgcaggaagtatccctgctggctgaataaccttgtcacaatccctttgagctggggttctgcaaaacaaaataattattcaaatttttatttggcttacacaaatgcacacttacagattgttaaaaacatcctgtaagtaaatacgtaaatgccaatagcttaaatattgaattatgtatttgggagttgggtgtttcagtaacatatctatgcttttttttttccatttagaggtagagctttaacacttttagcagtaaactaaatgcaaataaataaaagctaattatgattgggaaaatacagagacatgctaaaaagtgagttattttcctcctttgtgcatctggtgtctgactgcaagatttcaccaactttatagtcccattccagaattattgtttaggccaaaatgcctctgtaatttctaagtttctagtagccataaccaggtccataagacttctatctctgcaggatgtcagctctccatcagaagttcctgggttttgaatttgtgatcaagttcagccagaaagaatagtttggagaagaaccacaggcaacagcaaaaacttccacggccatgagatgtcactggcaaatatgtggaaacgcaaatttcaccttcactaaatacttcatcagagaggagcctcagtgttccaaagttcatttctccagtacaaaaaaaaaaaaaaaaaaaaaaatcaagtcatacatatttatctaagtatttcaaaccagaattgctcaacttttaaaaaccctctaaacacaaatactttcaaactaacctttgtataacacatttgaatttttgtgcatcagctaatataaatatttaaagctttctcatcgcagtgctggctgccagcaacaatctagtttccaccgcatcaccatttttgtctctattgttgagcaaaaatgaagtattctagtgcccttatagctctaattatttcattaaaatgaggagaaaaagaaaaatgctgcttctggtgataaaaatggaggcaaagatggaaatcatatgattgctgaagtaacaacatggtatcctcagaaggacaatcgctgaatttaagctagtcaacttcatccttcatccatttattcaactaatgtttaccaagaatgtcttttttctgccaagcaatatggcaggcactgtgtgttacactgaatgcattattgatatttaggtctaaaagaattctagttaagcatttaatgtgattaattctttgagaattggcctacaccctataacaagtgtctgcagttgggacttttgcacatgtgacttgatcacattcacattatttgggaatatggggcaatgcctctatcaacacatctttttcaaagcagtcctacaaagcaaaagagatgtcaagaaaattgggaatgaggaagcagactaatgagcaaagaactgaactggaaattaggtattctaattaatagatatgtattatctttatgagttaaataaattccgttttttaaatttgtgaacctcaatgtcctcatcaataaaaatctggaagttaagctgaatggttgtttgttccttcatatgagtctctattcactttgagcacattagaatcctctgccttgaatggtgtcagaaatagaagaatggatttgtcttcaatgcatttcctccataggctcatctaatcccacaactatggacaagtcagggacacacttggctagctaacgtcactgcaaacaactctctcttttttttaaaattatacttttagttctagggtacatgagcacaacgtgcaagtttgttacatatgtatacatgtgccatgctggttggctgcacccattaactcgtcatttacattaggtatttctcctaatgctatccctcccccacccctccaccccacgacagtcccaggtgtgtgatgttctccgccctgtgtccaaatgttctcattgttcaattcccacctatgagtgagaacacgcagtgtttggttttctgtccttgctgtaaacaactctctgtgtgcctctgcctttggctacctggctgacaggcagcttctgatgtggtagactcacctatagatttgaacctcaaatgctgtgtggccccgatcaactcatctaacatctgagtttcaagtttttgtatctatatagtaagatttttaaaaagtcctactctataatccttgcaaatttcaaatgaatagtgacagagtacaaactagaaaacccataaaatatacatcctaattaaagtctaatgtttcaactatgaaaatcaaggacacggtataagggaggtaaaagaagcattctgagaaaagagtatgtctccagcttctgctttagtaaatattaactgagcttgtaaagccactaaagtaaacagtgggctaaaagtacaggatataaaacaatagaggggaggaagagggcaactgtcttacaattcacactgtatttctaataagcttgataaagtcactttaagaagtcaccacatgttctcactcataagtgggaattgaacaatgagaacacttggacacaggaaggcgaacatcacacaccggggcctgttgtggggtagggggaggggggagggatagcattaggagatatatctaatgtaaatgacgagttaatgggtgcagcacaccaacatggcacatgtatacatatgtaacaaacctgcaagttgtgcacatgtaccctaaaacttaaagtataattaaaaaaaaaaaaagaagtcatgtttttattggtaatgagatgcatgccagtttagtcgttaaagcctgtgaatgattgtttgttttctttgtgctcctctttctgtacctgtaattaaacacttcttttgccctggtggagccatcccctgttggagccctgggaattcgggttggtaactcctgctcaggataatgagcatcagactctgagcacccatctctgagagcagtgccagaacaggcccagagtctgcgttttaatcatgttgtgatatgtgaaaatgaacatcctgcattacagaagtttcaaaggagacttgatcatctattgaaaaaaataccctgaacatatataatatagatggggcacagaaagctgtgtagcctgagtggcatcttgtatgtctattaccatcgatcaagtcctaccaacctttccaggttcagctcaacatcaccttctccatgaagactcagctatcgtaagtgagaatctcctttacgatgaggaaaaccagaacatgttttgctctattttaaagaaaggaggtataaaatgagaccacttttcagcatatccagcatcctgggtacattcaactaacacacgtttatttatcagactatgcttggggacccaagatatgaagaaaacgaaaacctttgctgtcctcagggagcacccagtctaatgcatgaaacatatttgtgtataataccagtgtgggagagctgataaataaggaagtgaatcacagtgatgtgatgtcaccaaggagcaagggaccagttctgcctgaaggttgggataaggcacttcatctgtcacttaaagaatgagtaggattgccataggcaaggaaaccagagaaagggcattccacacaaaacatcacaactctgggaatgatgcagcctggtatagacagaatagagaaaagggttctcaaatgcagacatacaagtaagtacctgttctcaacaaatgttctagcacaacagtgacactaagacaaatagggtcaatggaataggttttctatgaagctaatattttccagtttatatgactccttgattttaaaattatgctcttccattactgtttttctttttcttaatgaaatgatgactatattattagatggtaggggaggaagggttggtttgctcccttttgtgctctaaagtggtgtggcaaatactgcaagcatttcactgaaatccatttcctcttttttctgggcacccagctagaccatatgtcctagcctcccttgcagttaggtttggcagatgaatgagtgtcatatggaatgtaagtggaagtgatgtgtgccattttcaggccaaggtttttaaaagcaaacattctcctccacactctcttttccttaacaccggccagattaagataacatagccctaggggctatagaaacaacagaatggaagaatgttgggtccctgaataacaggtaaaggaaagatgactgccattgaaatacctaccttggaccgtgaactgaataagaaataaacttccattggctgtgcataatgggctttggacttccttccaaaacatacagtatgcaaagggaaggagagagtaatattatggtggagaaacctaacaaacaaagcactacctcagtcaggcaatcaaggctaatatcatcaattataaaacatgctgatagtatgttctcttgagattatgtgatgagaatagcactttacctctgtgatcttcctccaaaaaacccacaaccccagtctattcatgagaaaaaaaaattagacaaatgcccgttaaataatgttctacaaaatacttgaccagtactcctcaaaatggattgttcatcacacaaagaagggataaatgcttgaggtgagagataacctatttgccttgatgtgattactatgcatcataggcccgtttcgaaatatcacttgtaccctacaaatatatacacccaccatgtacccatacaagttaaaagtaaaaaattaaaaaaaaaaaaaactatcaatgtcattgaagaaaacgaatgtctaggaaaaagtcatagataaaaggagtctaaaaagacataacaactaaatgtaatggggtattctgaatgagatcctagagctgaaaaagaacattatgtaaaaatgaaggaaatctgaataaagtatggattttagttaaacatactgtaatgatatagattcttcattgtgacaaatattgtacattaatgtaagctgttactatgggaaattggatatagggtatatgagaactctgtactatcttcacatctctataaattaaaaaaaattctaagataataattatattaaaaatactaagtacagctaaaaaagcaagtaataaatgttttcctcaaagaggctgagtgacaaggaaggtaaaggatgggacctcgggttcaatactgcttcccatcaggatgacatggcaatttcagcagaacgtttgaattcagagccactcagaaaagctgacacatgctggagctatctagacgttcctgccggcttgacagtccatctagtgctatgaagtatttcctaggtacacgatggaaacccagaacagagacagagccaaggggtcctggtcagaaatctcaggatgaatattcaattacaggaaataggatgaattttagacgtggaaaggatcgacactttacttcattagcttcaaaggtaaaaaaaaaaaaaaaaaaacaacaacaaaaaacaaaactctggctcggagagacagtgtcttatccaaggtcacacagctaacacactgatgagttcagacaagaactcagctcctatatactgaatggacatcatcctttcctttccaaagagcaaaatccttaccttaccaaaactgagggttggggagcaagaagggagaagagaggagagaataaggaggggagagtatctagctgtgaatcagttattaaagtacgtgttgatagaaaagcagttacagaaaattgtgcaagaaatatgtatctatataacctttgatactaaaatcttctagggccagcgtattcacatatacccaaactttagagaaaggttctgcatataaactccaatctaaaatgaaaactattataacaataatgaaaattatgtaatgggggccatatctagagaattaatagtacttttgataacaatggctgtatattgaacccatctccttcgtggcaggcacacttctgatacttttactgttgttttatttattatgcataacaactaactgtatgaggtactcttttctcatttttcattttttgttgagattcaaggaagctgcaccactttgacccaaagtcacagccactccctagtactgttcagtcactttaaaagagtactggcaaaacaggaacctgtccagaggaaaggagccaaataaagagggtataaatgactgtcatatgaagaatggctgaattaacagtggccgtgcagcctagaaaaggaagcatttggagggatgtgagagcctagaagagggaggatttggagagctgtctccacgttcttgaaaatccaaagaaataagaagcagccaatttgttctgagtggctccacagagatagacctagggccaatgggtgaaagttacaggaatatgcagattaaaaagaactttctgtttattgtattcaaagacagaacaggtcgcctaaggaaagagtgagttttctatcactggacataaccagaaagaagcagaaaaactacaggtcagagcagctgtgaaggacgtggacgtctccaaaggcggagacactctgagtgagaatgaaaggtcttttctaaccctgatgtcctggaaagctttgagataagccagatggtccactaaatacaatttcacttttctgtttccttagtcggtgcttaagacagggaattaaaaagactgtttaccaggcatccagaaaatgcaaccttctttataaatgttaaacatagattgtggagtagtttgacgggttcttttaatcagcctctttgggtttacaaatgtgccttctgtattaacatttaatgttgtccacttaagggaaatgagattgaagaagctgttaaatgtgattcttgtcaagggcttcgggggcattacattgatgcagacttcaaaattagactattagggttagaaaatgttcataagcaaatacatttctgaccaatcataactaaagggtatagactagggcatatttacataccataaaccaaagtcccaggcaaatcagaaatgagctacagtaagcatttgaaaagggacagaacttacctggacttttgaacacactgaaaaattgcaactctactgatctatggggattcagtaaaaatatatgctatttagtaaaggagaagcaggcctgaggcccctcattcactcaacagactgcagtgaacagacctggaggaacaccttccagaactgaaaggataaggctgaagacgtgtcactctagcctggcagaatctgctctgtggagtaaagtgagtcatgtcctgtccctcatcttcgatctccccattggtcaaatgaagacgagagacaccatcagcagctaccttgctgagggccgtgaatcaaccccaaaagtgctgatattccaagaggattctgtaactaagtgcattctatttcagttatcaatagatactaatggcacgttttattttttaaaaatgaatatttattgagcaacagcctttgtgacagttattcttctgggcaaaagggataatcggtgcatgctagtaaatcaactctcccccacctccctccccttccaaaaaaaaacagagcagaaaagaaaatccaaaaccagactttcatgggatgatttccacagtgcaactacttcaactatgactgctttaaaactactacttgacatcactgaacatagatgtgaagctggaaagaggtgagcaccatcagctccagctcaccaatgaatataactgaggataaaacataaagcgtgcattctagtaggaagatggaaaataaacatgtaaacaataaagtatataataaaatgttagtataagtgctatgataaaaattaaagcaatataaaaggatagagcatgcaagggatggatgtgctattgtggacagaacgaatagaagataacatcacagaagcctaaagaaagagaggaaggaaaccattaaggatatctaacagaaatacattccaggagcagggagcagcaagtataaagcaatcctaataatggtaaagattaataaccaacagattagaggctctctgaagatccttcctctatgccaagagtccacaaactatagccctgtggctgccaattttgttaataaagttttttttttcattttcttgctcatttaatctgaacagtattagagcatgaccatgcccattcactcatgcattgcctctgctttcatgctacaacaacaaaggtaagtagttgcaacagataccctatatcctgcaaagactgaaatctttactaacagaccctttaatgagaaagtctgccagccctttctctacttgctttctcttgcttctgtagacacctctgcctgaaaagcacaacccctgccttcctcctctgcccaggggtcctccagagccttctaagcacagctttcttccacagggtcttccctgacaccctgaggcaaaattaatcacttcctcttcaaagctccattgtgcataggttaggagagctgtgcactattttagaggtgcttgtttacacccctgtctctgctgctgaactatgaacctctcagggcagagaccttattcatcaactctatcccagcacctaacacagtgccaggcacaaggtagatgaggagtgtttgtatgctgaaggaatgaaagtaataagatatacctggcattttcctttgtcacctgtgactttcaaaggagcttctcatttgtacaaagagctgcttatagcctttgaatataatgcctctggcctctaatgcgtttcttccaattttgtcctgcacactgaacacagtctgacaagcacagcagcctcctccataaactgcacagtctccaaagccctgagttgcctcacatttcaacaggaatcgaatgaccttgagacaggcaatcctcaatcttcatattgtctcaaagctacatggaaagaaaataaccttcatttttggagtttcctcttcaccaaagcagtctgagctgtagaagacatgagacggagggcaggaaaactgagctaagatgtgaaatgccaatagggacaaggtttttgtactgagccagttttattcctcatagcattagcccccttcctcctagattcttctttgtaatatgctcatgaaaatttaaaatagttccagcaccatttattgacttccaacatgcactaggtgctgggtacaaagatgagtaagatgcaattcctgccttgaaggcacccacggcctgatcaaggagacacatacacaactaatcattatttccgtgaacatttaaagtgctgtcataaatgaacaaataaaatgccacggaatcacagaatggggatgctaattttacctgggatggcaggttctgggacaagaaacagttgaaaaaagctttaaagatgaagtaccactttatagttagcctagaataggcaggaggattttgctttgagcagcaccagcaggagcaagggcacagacagatgcatgtgcttagcatgtgcagggaccaggtatgtagctgggtgtggtcagggtgaaggaaatatgggggtgcatgcaggggctggaggcgacagcagaaaagaagcagggtccaggacacttgaggatctttaagcaaagctaataacaagttttactttattctttaagtcaatgatgtccaaacttttctaattatacatctctatcagtaaaatattttaaatctacagccttcatatatgtacatgtataatttatgccacgtgtatgtgccactctgtaaattttgtgtataatataacacaaaataggaattttaaaatgagatcaatgaaaaacacaaacaaaagttgtaattgccaggcatggtggtgcacacccgcagtcctagctgctggggaggctgaggtgggaggattgcttgatcccagaagttcaaggctgcagtgagctatgattgcatcactatactccagcctgggagacagagtgagaacctgtatctaaaaaaaagttgtaatagttttttttcatagccaatggctgtcatgccccacatgcttcagaggccaatgcattaagcaatgggaaaatttggaaggattttaagtctggggctaaaattatgagggtagtattttacaaagtcaaaggatactgtggttatgggagccagttagggagctattccatataagaaggaccttagataggcagtggcaatggggatggaaaaagctgtcagccagaggactgactgtgcttggtgtgctaacgtttcagccaccttaagaatgaaagtctcatttcagttgtaaatccaaatcccaaatccgaatccgaatcaatcgtcatcttcctaagggagcactatttaaatgtagaatattaatgaaagtgtgggtgaagaaagcttaacgcaggcattcccatgaagccaaataccttcttgccttttaagaatctctgttcatggaggggagtttgacactggtcaacctcactgggttacaactccctggtctttctcaaatgatcacccagagaagtagacctggaatgaacatggctttccaggcagctcaaaaatgattgctggagaatgccgaccacaagacacttcaaacatgaagataatcctaaaatcttaagatttcagagccagacaagccattcaggataatctaattcaaagctcatgttacatatgaagaaacaaaacaccagggagaggggaaagtcgcgtggcagcacatcttccaatccctggagtcagagctctttaatataccaggatcttccagttctgtgcctcccagaggtttcctgatcttatcccaaacgagctgcatggtatccagaaagccatttcatttcttcatgcatagccatactttgcttcttgtgaaattgtttagataactaagacccactgaactaaagcttgttctaagaaattaggaagacacattatagtgtgctctatgactaggaagccacgcttatatggtagatttaactttcagacagaattaatgtagataggaaaatccacggttagttaaacagtagcaatgggcaaattctcctgaggttcattcacagaaaggaaatgccaagcagttaacaaatgccaggcactttatgtggattatctctgaattttcactgaaataatttaaggcaggtactatcattgggcttttttttttacatctatattagggaactgaggcttacagaggtgaaatcactagtgctaaattacagagttaatccatgccagagccagggtggaaggtttttgctttacacctcattgttaatcatcagttgtcttttgaagaactctaacatgctaatacatctctctacttctttaactgtgatcagcccacaaaccctgtggaaatctataaagccaggggccaggaataaaaagcaaacactaaactggagttgcagacatagcttttggcctcctgtcacaaaaaaaagtggcggggctgtagacacttctatgcacacagaaagtgttctgtaataaaagcatcctcatttggcatagaaaaatcttctcagtgagtctcttttctcacagacacatcttttggcaccagaaataaatgaacaggacacattatttgggcgagcacaggcatgacagttccctgacatcaggggagctgcacaaatgttggacttgtcctgaaactgccttggatatcagagatctgtttatccaggttggcaagcctgaggaattccctcatgcagcccaaatgtaaattaccttcaggtatattattatggttgttaaatgtgacttttgtctatcatcttttcataccatcacacacacacacacacacacacacacacaatgctttgcctttgcagagtcaaccagagtgagttctagtggtgtaataatactttcggcaaaagagcagttgagagctccaagaacacatccatcagccttgatcctggtaaattcaggcaccgtggtgcaggggcatatgcagggcagtgggatccggacatttggggtctaattccaattgtttgcttctctccatccgcactgcctccacctttgttcaggccatcgagtgctctgggctagattccactaacagcctcctcactaacactctttctcttccaaaccacactacagtcaaggtaatattttacaatataaattggatcatgtcactcttctgcttaaactctttaacagcttcccatttcatttacaagaaaacgtcagacccttagcatggccgggagagctttgcaccatctggctcctgcccacagtttcatcatcatcttaattgactctctccctggctcactaagctctaggcacatgtgccctctttctattcagacctagggatttttgtacctgcatttccctctgcctggattgattttcttcctgaaataaattcaagtcactgcataaatacaatttcatagaggtcttgtctaggcctccaacctaaatctgccgccacgtttgtacagatattatctggcagcacactgttttttttttcacctcccttcattgcacgtagtcgaatttgtaactagatagctatttctctttgttgtttattatctatttcccactctagactgtagcatccctgagggtgaggccatgtaacttttatttattacagaatatctagttcttagcatagtgcccattaacatacaggaagcaaacattttttttttttttcagtgacctagtttcttctctctgggcttcaggtttcatctataaaacgactgtattggaagagttccgtggctccaagtctaggtcccagaaacctgagggactctcaggtcaagatagatacttacaagctatttttaataagttagaattaaaaatggagaaaacatttttaatagatatatcttttaccactgtaaatcaatgaagattattaaaatttcagttaaattataatctagacaaactatattaatacaattaatttattacttgatattacatcacacaaaagagcactgaaaatatttatcaaatgtggataacacatacactgtaaatatgtaaacatgggttgggtgctataacttagattcattttgggaggctcttagggacaagtgaaacacagatacagggaactgccactgtgactgataatgatggactgtgacatagaggctaagatctcatgaataaagaaatgaaccagtgttttcagacaaagtgccaggacaatactttcaagggtggctgatctgactgtagacatgatcaaaagcctacttctctcatggccgactccaagaagcatatttcaggattcaatacagcaaggattgatctacccctagctaaggaatctctcaaacttatggagacggtcagcttgactttaacacctataacctattttaaaaattgaaaacagtttcccatttacatgtgacacattgtattaagaaaaggcatgatttgtcaacaaataatttttaaagggcacacgtttgggagaacaattaacattaaaatgtatgttgcattttgtttaggtgttacagaatcaaaaatacaaaaacattgggttttttatctgatgcttcaaaatcttgcactttgttttataaaaactggtttaattttagaatctctgtgttttctttctagtgaccacataagatgaaaaaattgaaactcttcccaagtatgtatccacacataatccattctttccatggatcacctgtgtagtcataaatgggaaaacaaattagatacaatggtcataagattttcttctttaactctgatattgaggctctgaaaacatctatatgtaccacgtaggaatttttattcgtaattttaatttgctttgatgaagattatcttgattatgatttgaagatttattatagttttacctatccattaacagttttattaatttgaattatctttttagcatgaaatatttcaaacatgcagaaaacagaaaactaataataacctttttaacagtgcttaccatgagccagggactcaaatgatttctatgtctagtacttactcattccatctttgcattagctctatgaagttagtattttttttctcattttatagatgttaatactaaggtgcaagtgaagtgactgcccaatggctcacccaaatttcataagcagaagggctgtaaagatttgagcgcaggcagcctggctccagaacccatagaacagattatcattctcactgcctctcaaccaggtactcatcacccatatttaacaaatactagcattttccataattgcttcaaatcgttttatagaatcaaaccattacagtcatctctttaattccattccattactttgctaacgagatgcagacatatttctgaatttgggaggtagccttcctattcatatttttgtgcctgtactccctctgtaaatatccacaaaaagtacctactgccctttgtgtgttgtgcattttaacataaaaatatgccatgtatattatcaagcaatttgattatctcattcaacattgtattaacaccaaatatttggattttgaatcttcatctgatttgaaattcccataatagatggctataatcattttgctttaactttaattttctgatttagctgtttttatttctatcatcttcgtttgtggtttttatttattatgcatttctttgcttcattattttatccttatgttccttcaattagattgatttagtctcccttatactctctccaatttttccctttatcttgaattggaaattacagttctgtctctattattttagtagtaatccttacatatctaacataaaggtgtagtttaacaaaatccaagtctaactgttaattactaagcttttatcaaataatgcaaacggctaaaaactcaaatccacatattcctattactggctagtattttagttctggtttctttttaaacccaagaaatgctcgtcataagatttttttcgtttattatgatagatttacaaacatgtttaccatcttttttgctcatcattataacccctctttccccccagactcaaccccctctttgtgaaccaataaggaaccaatctattaaagtgtaaaaatgtctcagtgtttggcattacatttgtttatttatttctctctctttcttattgtaattaactggacacataacatcaaaaagatgcttactttccctcagcattctggaaaaaaatttcatcatcttctagcaactattattgctgacaggtctgcaatctatctttcatttgtagttaatctgtcttttctctctgacttcttttaaaatattgtatcttcatcataatgtgattttataacattactataatattcccaggtgtggattgttttaagaatccacatgatgggaaaagcccatatgaattttggggttctgcaaattctctatcttaatctctttgattatagatgatctgacattgtatcttttcttctttcccaggactccattgaaatgcatgttggagcttctttatatatatttcctatctcttaaaatctcactcaatgttttccatctattaatctctcagaagaattgatttgtctgctttcatctccaatttaatcattttctcttctattatttagagcttatttttgaacacacacataaactttctttcttactattgtcattgctatataattattaatttaattttatttatttatttatttatttttatttttatttttttgagactgagtttcactcttgttgcccaggctagagtgcaatggcgtgatcttggctgaccgcaacctctgcctcccaggttcaaacaattctcctgcctcagcctcccgagtagctgggattacaggcatgtgtcaccacgcccggctaattttgtatttttagtagagacggggttgctccatgttggtcaggctggtctcaaactcccggcctcaggtgatctgcctgccttggcctcccaaagtgctgggattacaggcgtgagccaccgcgcctgaccgctatataatcattttcttcaaaattcaccttttttcctatactgcccttttcctgtcttgtgatttctgcttcatttaattaataaacttttaaaacattatttttaaaatttattttagattcatcttaatatctacaacttgggggtatgaattattcaacttgttgagctttactcttctttttgatggtttatatccttgtatggtttcaattatcagactgagattttcctcagagaaagttgttttgtgtttccctggactgtgaaacacatggaaagcttttgtattggcctcttgtagtatttcacggatttccccagctagagagaagttcttacgttaacttctcagactggaattccaacttaacaaggagagtttgatattgaacctcacccaggaagtggtccccgtttgggtttctaattcctcatagacaacactttccacccattgccctaggtggacacatcaagttccttttagttttccttggcagatagaaaatttttctagatcaccatctctcagaaggagcactgtctctgtacaggcccctgcctgcctcacacgggtctgacacccagtctcctgtgcccacataaaggttaagcctgatgctcacctgttgatgcctatgccattctagtaatcgccacctgaagtacagaaactcagttcctgctcatctcgataaatataaattccctcttcttttctggcacatagagatttcccctttttggttttgagcgcaactatgcattttaatttttgttgttatattttctccagcagattcacctattttaagtgggaggcagagtcatttcgtaacagctcagattacaatagtcaaagtcttattttagcgtcaatgtttattatgcctctaacaagtagaacattatgggggtaacattaaaactataatattcaaaattatcattgtggttagaactgtgcaattaggacataaaaacactctgaatgactgagtcacgaacacatctgcctgatcccttccaagtgtcaggtatttagtaggtgagagtctcccagggccagacactatgcaaggagcttgggatacaataggcagcttattagtttatgttcccaaattttaaatcttaaaggaaaaataatttttaaatagttcattctattgctttaaggagaataatatatctgaacagatgttttccctagagaattgaaaaccaccagtgaggaaagctgttcttattaccactccttacaagagaaaaatagaaccctagtgcaggaaaaaatgtcttttctggtattacgcattgatcaaaattagacgagatccctttcttctgactctttcttttctttctttctttctttctttctttctttctttctttctttctttctttctttctttctttctttcttctttctttccttctttctctctttgtttttttttctcagtgtctcactctgtcggccaggctggagtgtagtggtgagatcacagctcactgcagcttcgaactcctgagctcaggagattctcccgccttagcctcctgagtagctgggactacaggcgtgtgctatcatgcctagctaatttttgtatttttgtagagacagggtttttgccatgttgcccaggctggtcttgaactcctgggctcatgccatccacccacctcagcctcccaaagtgctgggattacaggtgtgagccactgtgcctggtctcctctaactattaaaatagctttcccaaaaatgcaaagatatagacacaactacttttgtaactggaaatttaaataggtaaaccttagattattcataaacataattttagtaaacttaaatttaagatttccaaaagtaacggaacagggattcattttcgtcattttagcaaacagctcttcaagaatattctttggtataagtttacattctgatttaagaaaatcacatttatttgttgtttcttgttccattttaatcctttttctccaaactccaagaatcaaaagcacttttttttagggtccgggggtgcaggtgtggggttgtgggctatatctatattttaacttttattttaggttcagggatacatatgcaggttttttatacaggtaaactcatggattggggggctgttgtacagattatttcgtcacccaggtactaagcctagtacccaatagttattttttctgctcctctccctcctccgaacctccaccctcaagaaggccctagcatctgttgttcctttctttgtgtccatgatttctcatcatttagctctcacttataagtgagaacatgtggtatttggttttctgttcctgcattagtctaaggataatggcttccagctctatcaatgttcctgctaaagacacgatttaaattttttctggctgcatagtattccatggtgtatatgtaccacattttctttatccaatccaccatcgatgggtatttaggtcgattgtatgactttgctattgtgaattgcaaaagcagttattcagcttccataattcatacctacatttcccaaatgactgtgtgataaatacatgtgtatatgactatttaataaaaacattaataaatacaaataaaatcatgtattctggagataacctaacaaattgtcactgtgtatagggcaagggatacataagaaatccctacaccttccactcaattttgcgtgaacctgaaactgctctaaaaaaaaaaaaaaaaaaaagcctatcttttttaaatgtccttttgtactctgttatcttcaacaataaaaggaaaaaaatatataaagacatgagggacactaaaagagctctcaatcctttggggaatctttaacaaagcaataatatttacaaagtggctatttcccagaatgacatcgaaatttcacatatacgcgtgcacacacgcaatgcattcgcacacaaatagataattgtggatttttattaagtttaacatacctaaagatgctgccttatttactcaatttaacaataataagtcaccacactttggaagcaatatactctcaggagaagtccacagaaagaacactgctccaggattcaggagacttaagtcccagtcccagctttgccattcactccattactcagctttctaaaggagttggatcatcaagatcttttttacctcttttgttctatggctttaaaacaataatggtggtagtgataagacattgacttacgattttattatgttttagttattggataccataaagtacccagatttgaacacattcaaacaccacagcgttacataacacactttttatagctcactgcttggggaaataaataacaggaaattaataacaatatttaaattaaaggctatgccagaaatctctaagaacactaaatcagatccaactttaggcagtaataattaatatccactaataattaaatagatgatgtctagtttcagttccaggtgtccaagtttcccttccttgtctcattaagaattacaatttactgcactgcagataaacctttaggcaaagcatatttcatctgtttgcttaatggactggtgtcttcttaaaattcagagttctagacttaatattggttgtgagataatttatggttgatttcaacattttctatctcattggaaaaatttccaggcttatttcaaagcttgaaaccttaccaactttcatttgcctgaatgaaaacataacaaaccacattctagaatctagcaaagaaagtatagatggtggctaatagagtataagttcatgagagagaaaaaataatctaactataaataaatgctctacaccataaaacactatcaaatggtaacaattatgttatttcagaaatagtgtttatgtacagaaattctaatttctgatagcaagatagtaaggcaaaatcagaaaaacctgcccctgattgtccaataaaaagtagagtacaacttgttagatttcatagcacattgttgacaatagtcacctcatttcaccagaatggctttctctcccttggatctaatagcaagggaaagaatgctgagtttcatgcctaggccagtactatccaacagtaatataatgcaaaccccacgtaagtattttaaaacatttctagtactcatttttaaacaagcacaatatacaggtgaaagtgtatattctatttatatagagtatatatttatatacagtattctatttatatatagtatatatttaatgacttgttctatttaacataatgtatcccaaattagtagtgaatatagaaattattgcaatatcatacattcattttcttcatgctaagtcttcaaaacacactgtgtattttgcaatcacagtatatctcagttcaactagccactttcaagtgctcaaaagccacatgttgctagtggctaccatattatacagcacagacctaggtggttggacatcttgacagacacatttctccaaacagcacccgaccatctattatacaaagcaacaatgatcttgaagactttgttaatactgataacaacaaggtacaggtaatcaaagaccacgtacattctgaaaaatacgcaccaaataaggtgcaagcaaaaattatatcctaaacctactgcctgcctgccttcattccttccatcctaaccttgatctttccttccaccaataccctggtcttgataccacgccaaggaacacaactatgaacaaggcggtatggctagtgtcctcgtgaaattgaccctcttgtcagaaagaaactaaataaataatgccacaatcagttattataattacaaatatgagaagtgttctgaaggagtcctggctgctatggaggataaacctcaccaaaccctagggcgtcaaaaatggctccctcaggatagaacattgaagatgagtgtaaagaaaaagaaggaattagctagaggaagtgagtacgtgtcagaaaaaatgaggagtaaaaaataataacactccacacaaggacagaagtaaaagaaaaggttcaaagtcagaaacgactttttggtgaatttttttggtgaatttaaacaactgaaagtgtggagttcagagaccaagagtctggacagtggcccaaagaggagttcagatcattcagaatgttacagagcaaggcggaagaagcagtgtgaaagcaagggtcatttgggaaattctgaatggaaaaagtcagacacataggacatatagggagtgttatgtagactagcataacactttttttttttttcttttttgagatggagtctcgctctgtcacccaagctggagtgcagtgctgcgatctcagcccactgcaacctccaccttccgggttcaagccattctcctgcctcagcctcctgagtagctgggactacaggcatgtgccaacacgcccagctaattttttgtatttttcgtagagaagtggtttccccgtgttagccaggatggtctcgatctcgaccacgtgatccactcacctcagactctcaaagtactgggattacaggtgtgagccaccgcgcccggcctagcataacactttttattgagcttgtacatcaatcaaatgctatgctatagtccatctacactcaggctgatcaccctgtacccattttgccaatggtgtagaacttcaaatatatagccataaaacctaaacaccattgcacaaatgtagcctttgattttatctacctttgtcctagaataatggcctttcttcgcttaccaattcttagtgtggtcttctctattacctatagcaataaaaaaaaaatacgttggtataaaaaacaaagtcagtcacacaaaacagctggtttacccaagcaataacatgttttttccttcctttgctataatatagagcaagtaatcaaacaaaagagattggttctaaataaattaaaattgtgtgacagtcataattcataattatataaggtatattcatcatttccctttaataagttgtattaccccaaaatatataattattaaatttgaatgtaaattaccctgtaaaatgaatgcctatatttaaaacttttcacttttatgaggagtaatggcaagtcattgaaaagttttaagcataagaatgatatctaatctgtattttaaaagctcagtagagactgataacgagagaacagataggaggatgagcagggagacaagtgagaaagtaacaacacggccagtcaagagatgccagtgactagtttgtgaagatgtaaaattgtcttgacttagttattaattgcatgtgggcagaaagggaaatgtgtgggagcacagtaaaaatagaaagtggaagtatgtaatcatggcacagacagaatttccttagaagacagcaaagtagatccttcactgatctatttcccccaaactaacatatacaccccagcatggcatggaagacaaaacccagagtttatacttttctgagctaatgaacatacttctctccttgtgagctttattgactactgagctcagcatgcctctgtgagatattatggagccaatggggaggctgcacatgctataataaagtccattgtatccttgctgttgtgtgtaccctttataatattcatgtgctggtgtgacagtaaatcagagggggaaaaggcagtcaaggtggtcttaaataaaacaagttattctcataagtctttgaacccagataaacctttgaggtcagaactcccttaaaatgacatggttccaaggattctgatttaaaaaaaaaaaaatctgattaaaaaaaaaaaacctattgctataagtaatagagaagaccacactaataattggaaaagaaagaaaggacattattcttggacaaaggtagatgaaatcaaaggctaaatttgtgcaaaggtgtttaggttttatggctatatatttgaggttctacaccattggcaaagtgggtacatgcttgtttaaacatgataaccacattatttgaggagggaaatattagaagaggaacagatttagaaagaaacctacaaattaggtttaggatattttcagttggaggcaccaagtggaagtcggatttacaggtttagaactcaggagagaggtcttgcctgaagatataaatgtggcagtgttgatgttttgataaataaagccatgaaagtacaatgtgagtgtttaagatccaggactcagccttggatctctaaagatggaacagaagagtataaactgcttaaagagactaaggagaaaccagaaaaatgggagtaaagactgtttcaaaaacaggaattaaccagcaatgttgagtgctatcaagaagtcacataaatgagggctgaaaagtatccattagatttggtaaattagacatcattagtaatggtggcaagaacaggattgttagtgttagtgttgagtgtaaatgccagattagaaaaagatgaggtagaagtgagaggtaaagaaaagccaacagtgaatatacagaatttgttaaaaggttaaaaatcaaaaagaagaaatgtaggcactctttcagtcctgaaaaaggattggggactattgatattttataaagacttaagcatattaaattgaaaacagcaagaagctagagaagaggggatgaaaggtgatgtatcttccctacgaaggtgagagaggatgagatttagaacacaggagattggtcttagctggaagaaataacatcttcattctaacagaaggaaagaaggatagaacagatgttaatttgcttattcagatgcaaaagtgttgaggagctcccaaatgtgatgacttctctttataacaggtaattctcactcaagatttttaatacatatatgaaaattcttaaagagaaaaaaatacttatacacatacacacgcacatatacaatctctctaagactacactgaatatctgctgaggatgacttttttcctgagccaccacaggtttcccactttcaggctccgggggtgacattcactgatgtttgcatgagtgacacatcccaagaattgtacaggcaccatctgcacagatacactggatggtcagttacctctgtattccttaggtagagagagggtgaaaagtgactgttatgagggtcaggagaacttgcctcaattcttaactctgtcactctcatttgggtgacatctgtttctacaaagtcctcatgtatatacagtagcaacagataggtaaataagtagatatacagatatatagatagatttgagggaaaagggagatgacctggcttttcaggaagcaggtacatagactcggttatgaaattgcttgtcatatttgaatgaatttcagtgtgtctgtggcagtgcctaccatgtcctgagcactttgtgctgaggctctacgtgaagtaccaagtatctcttaatgtggagttctgttagtatttatttatatataaaaataataatatgttacaacatatcctaaatttatgtagattttttctaatttaaatgaaattttaacatatatatgttgtttgttccacagcacacacttttaaggtaggtagtattcaaactcagccctaatatttgtagggcttaaagcaagagaacaaatggagactcccatatcatatgtttaatatttaaatttataaatcaaggtaactgtcaaatattggatatttagttctgctacttgaaaattatgttttcctaattcaaacagatctcctgggctcctcagatctgatctttcacaaaacaaagcaggactgagagaattcaccccccccagctcatagttcagacctcttctcttcccactctgggctccagccaactgacactgccagggacccatagggattcacatataaaccatagtttatatgtccaagcaacatccacctccgtctaacagccttggtgaaccttcaggccaggggcgaatactctctgccatgcaatttgcccttggaagtacagccaaggaagacgagcacacagctcctggaagcaacctcagtaatgtctgggtaggaacttctgggatgccagagtgtggtacagaatagggaagcccaggctccaggtaaacatgcccccttattcccgtggactccttgccaccacagacgtggacatgcctggaggaaggcctgagtagagtccaggacaaaggcccctacctaagaattaaagcaatcattagtattctcattaaactattttaacatgaaggtaactggggctcagaaaggttaagcaactgttacttagcccaattgctagaatatggtaagttttcaatatggggtgaataaacgaggaataaatgacacacatctaattagtgacattgtctccaacatgaacacagtcttctctttctctctccagagctaattccacagttccacgctgacttcaatacatactgctatgctagtttttcatggtcttgaactctcttcttgatagctcattcactcatacatttatatctatgttggtgtgtaattatacatgtgtatgcacacatacacacactgtatgctagctgcagcttatcttgggaacaaatcttaaatatggcttgcagaaattattaagtctcatttcattatttgatttcccctacacaaatttcatctgtcataagttctggctgatttatgactcaggaatgcaatacttataaacctcaccatccaaaacagcattcaaattccatcaaaaattacttttctcactttaaaaaaaagtattataatttaaagttctgtctcccagctggaatccagaagaataaatatgagtatgaaagttaaaggaaggctctgataaaataattagagtaatttatataatatttatttttctatttttccttctacatacaaggcaatgcatgaatagaaacagagacgtgtctgaagaacacaaattgaaaatgatgaattgagtaggtgaagaaatcaaactatttctgacctacctaataaaaaggcaattgggagaggtaacctctggtaatataaagaacactggaattagagtcaaaagctggggaggcaaaaaagaaactaaaattcattgaacacttacaatgtttcaggtacagggctagtgcctttatatactttattgttaaaagtgtcaaaccttcgataaggttgacattcacctgtctgttgcttccttacctagaatatgaatatctctatacattgtacaatataaataacagtaatatgaacaaaaaaaggggcaattgctagcatggctgtgcactgtatttgagaaagaatatagagaaataaccatggtattcctgtctcactgcactgcaaatcctgggatcgtaatcagatcccgttactatcagtgaatcacaatgttccctggcatgcctgcatctgggaacaccctactgaggagctggttaatattctattatatctcacaggaagaattcaaatgacacctccttgttggcccttttatgatttcacagaatagatgtgacaaggggctattcggaagctcaaaattttaaggtttagataaaccaaaagtatatctagccatctagttatagaatagacatccaaacctgtcttctattttttaagttgggagaaagaaaatagcgtattaataaaataactcaaaaagccaggtatgcttcaataatttttagtaaatgtctaaaaatgatttctttttattactaatttcattctttcaataaagtagtatagttattttcagtaaaacaataacaaaacagtttggatgcggtggctaaggcctgtaatcccagcactttaggaggctgaggccagaagatgcttgagcccaggagttgaagatcagcctgggcaatatggcaaaaccccatctctacaaaaaaaatacaaaaaaaaaatacacacacacacaatatatatatatatataaattatctggttgtggtggtgtgtgcctgtggtcccagctactcagaagactgatgtgggagcatcacctgagccaaggaggttgacgctgcggtgaggtgtgatcatgccactgcactccagcctgggtgacacagtgagacactgtctccaaaaaataaaaagtaacaagatagaaatgtcatgactttgaagtttgattatagccactcttagttattttatataattgaacatacataaggccggaggggtgtctcacacctgaatcccaacactctgggaggtcaaggtaggaggattgctagagaccaagagttcaagaccagtataggcaacataaagacacccccatctgtacagaaaattaaaccaaatagccaggcatggtggcatgtgcctgtagtcccagatacttgggaggttgaggcaggaggatcacttgagccctggaggtcaaggctgaagtgagctgcgatcggactgttgttgcacaccagcctgggcaacaaagcaagaccctatctaaaaaaataacaataatacataaaacataagtgtctataaaaataagcaaagacaaagacaatccaaatcgttataatacaatgtaatatcagctacagtaaatgagtcattatattgaaggtatcataatttatattgcattttatttaaaatttctgaagttatagaggttgacatatgttaggtgctttttatttattttttgtctacagaaatataattatttgctagatattttctcagatgttgtagagatcacaattagaaatcatatatgtatcatgccctaaaagaattcagactattaagaaagatatataacttataatcacataaattcaatacagtaatacatggaataaaagttgaagatagaatatagaaggtaaaattaaaatttaaaaattaatgtcattttcttaaaattaaagtcatcataaattatattttaaaaacatttcacatttttgaaagcaacttgctatatgatgccagactgtggaattctataaataagtattcaagtttgaaaaatatattttaaaacatattcaattttaaaaaaaaatgaaacatatggaaaagaagaataacaaaataagcaaaaactttcactatgtcttatgaaatataaagtggtgccaaaattttgtcacttatttcctgatactgatgcctgtgataccaaattactgaaaaaaagaagccaaaaaataaaaaggaaactaaggtaaccaagaaaaaataaaaggatactcttacaacgaaacataattaatggctaaccaatgtgaaaagacttaaattaatacatggccgggcgcggtggctcacgcctgtaatcccagcactttgggaggccgaggcaggcggatcaccagatgtcaggagttccagaccagcctgggcaacatggcgaaaccccatctctactaaaaatacaaaaattagccaggcatggtggcacatgcctatagtcccagctactcaggagtctgaggcaggagaatcacacgaacctaggagttggaggttgcagtgagcagagaagatggcaccaccacactccagcctggctacagagtgagactccatctcaaacaacgacaatacatattccgcaatcttcccctgaggtctgggacaatctagatcaaacacttcctcaaggggaaagttgggaacagcatacgtgcattttaacgctatcctttcagcatgagcatttccatttgtctattccagattttaaaacagaaactaaacattcctaatctttaatgtttgatctagcaaaataaaaagaagcaaaaagcaaacaaaaatttagatcaactcaactttattttgattctacttaaaattattttaaaatctttatttgatacaaaacgctaataaaaaggcattctcttatgagttattaagtattagacccacttttcaaaatgtataatttctacaagagttgattaatcagaagtgtccaatataaactacagttagactagatgatggcacaaaaagtcaattcgaggaacaaatggtgaaataaatattatatgtctgactaagaccatcatccataatatctggacaacaaaaagaacttcctttacttaactatcatgctctaagtttctcttttcaattttaaaatgtttaatctaaaccaagaatggcactatggtaacccaggtatataaagaaaaagctgtcctgtaggctgactcatagtcgctgacttagttcacttagtttatgaaaaacattcaaatgtccatgggttttccttccttagaacatacaaaatggctgcttagattctagcacactatgtgaaaaatatcaaaatggagggatgtgggaaagcccttttgtgtcatatatttctgagtttcagtaactgctgagacatgcagccatacagtttcccatctctattcatttatttgttgatgtgtttaccgcctacacttactgcctattgaaattcttctcatcttctccggcctggctcaaatgccatactcagagtgtgggggctgtggatacagctaagagagaggatggagagattgaaagagataagatctcaccaaagtacagtcattttaaagccatttaaaggtgctcttgtaaggaactgggaacctttgcaaaggtttctataggaaagtaatgtgacattaaatatgttttgaaaaattatgtgtgaagaataatcagggattcaagaaaagggaggttgaaacaccaggtaggagattctacaacatttcaggttggaacaacaagccccttaattatggcagaagggatgaagaaaaggttatatgaaacagaagctgatagctatgtgatgaccatgaccatgctaattcatcttactgtcccttatagttcccagaaagtcctcagttagtacctgatgaataaacaatagagtaaaacgttacagagatacagtcaacgaggcgtgtgactgatatgaagagatgagtcaaagataagtggggtccccaacgtggcaaacaagatggtcagtatcagaaaactaccaatatttgctaagtgtctactaggtatcattagtagtgctgttgactaaaggggaaactcaagacacaaagcagattgggttctggaggaagataatacattcaaattaaggcaaattgcatttgcgttcccagtggaacaactaccaggaggtatctagcacgtagttgaaaatttggatgaggagctcagatgttaatctgtggctcaaaaatatagaggagacaagtgaagtcaataaaaatgagtttatccaaggagaaaccatagccgagcaaagagaaaagcatgagccgaaggaggacaaaaagatgcaccgcttggggattagcaaaatgtatatctcttcattatgatagttttcagactgtaacagtgaaattgtggacaacaatatgctcagaactcttaaaattaaacacaggaatgcctttgagcatatagtttacatgctgtgaaatctacctgcaaaagtgcctgaatcagttcagatgacgtctagaccaactggtgatttaatttagaatgcaagcaaaaatctcttatgaaaatcctaagagtttggttaacgttaaaaaataataaaatccctactgtgaaattatgaagttcttttctcaaagcacattataaacagcagttgcaaggattattaaccaaatattactgtgcagagggataaagtgatctcgtaaaggcctcacagaaattctaatctggactgaaggtattttactctgggtttatcagaccaaatctggattattatatttgattccaagcaacaccctctacaatgatattgataaactggaggtgaacaaatctcctatatgaaatacagtttcataataggtgctgtaaatccttcatctcaaataaattctttccatatttaggataggtaagtttggtgtcctgattttcagataagaaaagtgaggattagaaaaattcaatacctgaccatgtttctctgacatgtcagtttttcaatattacttctatagatgagcttaaagccaccttgtatcaggaagaactaagaaactaagtgagacttagattggagacggtaagacacagattgaggagtgggagagaggctgtattgcataagcaaagatttatgtttactaaagccttgctactcaatgtgtggtcaccaggccagcagcaatggtatcacctgggagagaattccaaagccactcccgacttgctgaatcagaatctgcatttcacaagtttgagaagtgctgatctgaggaactattatagagagaagggattacagattttttcctatgtttctatttttgtttctcagaagacttgaattaagaagcttccaaaagacagactttgaattaatattggggaaacatcattttataatcagagttgacaacatatgtcatccactgaagatcataagattcaagtagaaagctgaactaaggctgtgagcagtggctcacgcctgtaatcccagcactttgggaggccaaggtgggctgatccctgaggtcgggagttcgagaccagcctgaccaacatggagaaaccccgtctctactaaaaataaaaaataaataaataaataaataaataaataaataaagctgggcatggtggcgcatgcctgtaatcccagctactggggaggctgaggcaggagaatcgtttgaactcaggaggtggaggttgcagtgaaccaagattgcgccattgcactccagcctgggcaacaaaagtgaaactccgagagagagagagagagagagagagagagagagagagagagaggaagggagggagggagggagggaagaaaggaagaaaggaagatgaactacacatgtaatttttggtgttctgtatctcctctaacccacgacctttttaagataaaggcctttgtttttttctctattgacccatacttcagttctagacagattataagtagacaatggatgtctgtcaaataattgaagatgtaaatgaatgtacagtggtgttggagtcagtgggttcaaatatgaaggtaaatgacctttaaagttttctacaatatgaagactctgtgattacaatgttaatggggtataggtttgctttttaattctacctatatgcaggatagagcagaatcaaaaactttcacccaacaaactcaaatttcccgaaggttcatagtgtatgtgaagatggctctatttatgagtattcatagaacattgctgaggtctttcactctccctctccaccaggagtaataatttgcattcaccttgttttgttaggcctatgtcattggtaaggtgactcatccaacaaatatattttatgtgacatctacgtgtcaagcaatatgctaggctttgttctttaccgtgttctacgtaagggactaacctcaagaaatgactttattagcaccctgttctaatcaaacagtaaactagccagtgattcagtagaatcctacattgactctcaactcacttgtaaatagggagaaataatcctataggagccctccaaattgtttttgtaaaagtttcctcatgtttgacacacaccatgaggtggcctctaactgactgttatgacattttcctcaaaaagaaaaagcccttctcatggttaaaactgattttgtattatacttcaaattcagggagtaggccaagcttatttttggtgaagtaacatgaccaatggcacaaaagataaaactgaattttcctgtgtatactgtaatcatactgcacagataaagaaaatgggaaaaaaaagaaaaaggtcaaataccaatcacacctatggaaatagataatgtggataatatacatgaataaaattcacagaaactcttaagatatcattttaggatatattttaatcatatccttccttaccaagtcttctactattatcactaatgagcataaattaatttcacaaactgtccataatattaaacgtgatgattctaagagaatgtcaaggctgatatttagtaaacattgttttaaaaaaaaatttcataattgatgaagtcctggtggaaaacatatctaaaaggtatatcccaagtctgggaaatctaaaaacttgataattaaggcatgacttgcctctccacatccattccaatcagttcctatggcatcctatactttactacatttctattgcttaaaactgtcctgcagtatgacattacacattaacctacccagaaataagtctccagctttcactcaaaatcatgtggttcctttcctgtctgttttttaaaaattgttttattatcttcgagactacactagtaaataaacgtattttctattaaaacaaatactagttccactatattattaagttcttccggggctgaggtccaaacttatgtaatggtctaccttgaaggcctgtcaaaatgctagaaacaaggaaaatttagaaatacagtcaatttgtgtccagttgaatgaatctaagaacaaataaagaatatacaacagagaagctaataaaaatatatttgttaaatttgtgatattccatttaatatacatgtcaaaccttctagaacttcatatcaaacatatcattaagccattttcttatatctgacatacagatatcttggaatacatacacctgtcctccatgagtattagcaccataaatatacatcaagaataataaagctgaaaggaatttcggaaatcattgatagtaaccctttcatgctgaaaataaggaaactaagctgaagagaagaaaaatgacttccccaaggtcaccaggactctgactcctagtccagtattttttctatcacatcattttaccttagactgaatcaaaaacctcttttatttatatcttccttttaaaaaggttgggtttcaaaccaagcaaaagaataaatacagagaactgtagcatacacagaagacttatttaatgctgctatcaataactttaaaagtaagagaaaagaagaaaaacaaatgaggtaatcaagagttgacagaaagaaccttttccattaaacccaatcgatactgtatttccccatcacttagcgcttcaccagagaaagtgaacccagagtgaatatgttccctcaagggtatttaacactaagatgacttgttggtctcagctgtaaatataaggaccagacatgactaaatctgaaatcaatggcaaaggttattcctcattaacctaacgttaagaaacctaaaccagtcaaaatagaaatgggcccttttccatattggctgcaccacccactccctctaggtttctggggcaaagacataaatgaatataaagatgctccttctttcagcattcccatagaaactgccccctgcatcagtgggtgctctgataagaaagaggtaaagtttgaaggtgttaggcaaagtaaatactaagtataagaagggatggccattaggagttgggttggggaataagtaaagacatgaagttctaagtatttatcaaacaactacatatcaaattaaactggagtaacaatatttttggaatttaatatcaaatgaagagatatttgtattagccaaaaatactgatttattttctttcccaacattttcatatatatgcagaaattccctcagagcctgactatactgatgccataagcacattagtcaccaatggaattaatttcgttttgatgaattatttctgatcacctagtatgtagaaagcattgaaatgacagggcgcttgccctccaggaactcactctccagcggcagagacaaacaggtacttatagagtaattataagacaagacagactaaccgcagacaacagtgcagggtataaagcctggggcaggcagtgattcattctacctggaaggatctgagaagatctggcagaagagatgggagttgagctgggctttgaataatgggcaggactgcagcagagtggataaatgaagggttgtctctgggtaagtgaaggataggtgtggaggttaatggcatccctcgtggagaaataaaaacatctataaactaaaagaactgaaatggatagatgcagtaaatgttctatgaatgtcaagaaggtttgggtcggctagagtagtatgtggggaagggtggagaaagaaccttgattgtggagcctattcatattgatgatacaataataaactgtctgctcttaaccacgtattgagcccacacgtgtatttttaaaagacagattgtggctaagttttttaaattaagaaattactgtttttcttgaaatatagacattaaaggagaaacagtccaaaataatacagcaaaactataacttggaacacagtaacacaaatccagcaagagttaataaatcttaattatatactgccttacacaaaagaaggcaaggattttctcagtatttctatattccattcccaagcacatgatatacaaatactcaatgggtgtctagcaatataacttgactgtagatatttaaacgcatctacccaacatttatattgctccagacacagaacaggcagatagctcttgctaccagcattgggcaatgggccctaaaaggaggcagctgtggtgtagcagtaaggcataggcttatcgcaaatttcagtccttgctctgcctttcatagttgtatgacctaacacccactatgagtcttatttctttcttccatgaggtgggcaggtgtattgtaatgagctctgttttccaattcaaacccaccaacacttttcatatataccttaccaggtggacatctcaaggctaatgtcacagttagtcaaccccaagtgcaagatatataatggcctgggacgaaagtcttaatcaaggtgccagttcaaccagactttgaattcaaataatgaacccagctgcataaagcttgctgctcttcagccctaacaggtgtctgcataatcacaaagaaaaccagcttcagactgaatgtaattgctgagcatgaaaaagacaacaggcaggccagcagtttcagtgaaaataacaagagtcaggaccaaggaacctccatcttcaccagatcaaaacttaccctgaaggggcaggctcccaaccaagatggtagttccattagcaaaattataatgaatggaactctaaatcataaagccatgtggtaacccagaaaatgcactcgggaacatttcaaagaagggagttttgtggcaataccaggaaaagcataatttcaaagcaagtttccttcttggtcctgcttttctcatgacctgtaggtggagagggaggagtagatagaatgcctgggaaaccagagctgcagaatgtggaggcggcctggccacaatgctgccaactcctttcctgagcaaagctgcagaggataatggcccagggattgtcagggaaagacaggtgaggcaaggaggcaatgaggaatcctctctactttcccgaaaagaaaatagatctccagtttctcagagaaatatcctataagaagactacagaggatgtctgggtttctatcattgtgacttcctttcctagaattctgagcttctgaactatcacctcatatgccatctcttcttctcctagctagagtcgagttgcaaaaacccactgcaatatcctttgaagcaacaaagcatgacagcaacacatacatgactcgctcctcagtgagaaacttgggtttccatagaatttgagatcctctatatgttccatcattttctattaattactcagatatgaatgaaccttttctgttgcggcctctgtgggtgactctgggtgactttcctttctcaaatgtaatattgtatgtagaaggtatattgtgtagacagctagagctatttggctgaaaacagaacctgacacctattctaaccagaaaatttgaatatagatccctactttgggcacttatttaaattctgcccctgtttcttaatgatttttaatgcattatctgattctaggacactgtgaaggtgatctgggtcatcttttgagttcccaaattaatatacaacatttaaatcaccagtgcaatttaaaaaaaaactctttatgaactttttagtctattttatctttataataacttatacaacttatccgggtttatagttcttctttcatgaatttcactcttcccttcaaaccccctttaaaaaaaaatctaaaacactgcacacagcacactgatttaatttctaatccttgaagagacaaaataagcctaaattggtgtcaagagaaagactgacattttagacagatttctttattagtgccttgcaagtaattaaaccatgggatgcagttaggaacatccaaaacagcacactaagaaaatagttttgtccttcaagtaagaagcagggaaaagatctgtgtttcatgttcccagtcacaaatgtttttcctggggtgaggggagctacagttaatagcttttcaggctaaagaggcccttatattttcttttttctttttttttttttttctgagacagagtcttgctttgtcacccagactggagtgcagtggtgtgatcttggcacactgcaacctacacctcccaggtaggtgattttcctgccccagcctcccaagtagctgggattacaggcatgcaccaccacgcccgactaattttgtattttagtaaagacagggtttcaccatgttgaccagactggtctcgaactcctaacctcaagtgatctgcccgcctcagcttcccaaagtgctggaattacaggtgtgagccagctcttatatattcttatatatagctcccttgtttttcaaagacagaaactgaggtccatttccaggactggcagagtagaaagaaaagtagattaggaaaaacaaacctgagtctaaatccagaatctaaccagtcctgtgaaactgagaagccccaggctttgcaggacctcagcatccttaggtgggaaggagagatgctaccttcagaatccttcttcctctgaggcttgctcagtgagtcaggatgtcatttcctcattgatttaacagcaactgaagaactgcagtgacacaggcagtatactaagttctgagaaatctagtgctgaccaggtcctgtgcttaggaactgaagttttcatcaagaagacgaggcatgcaagcattccatatgatgatgcagctcagttttgggatatcattaaacacaggaaagattcaaatataagcaaaaaaaaaaaaagtggtgccttggacagaacgtttatgtgtccctccccctgcccaatgttgaaatcctaacctccaagatgatgttaggaagtggaagactttgagaagtgattaggtcatgaagcctctctcctcatgaatgggattagtggtcttacaaaagagaccccagggagctcccttgccccttctgccatttgaaaaagcagcaaagactgccatctatgacttaggaagcaggccctcacagacaccgaatcttccggcaccttgatcttgggaatgccagcctctcgaactgtgaaaaatacatttctgttgtttaagccacctgtgcatggtattttatcataacaaccagaatgggctgagacagaagagatcatcattataaattatattagtgtataaaatttctaggcataatggatgtgttcctaaagacattaacaaaatcattaattttgtttaagggccacaatttatgaaataaaggaattggaacaggttggggactctcaatatatgatgcatattagcatagactttctaggtgtttggcattagtacgtttaaaaactctcaggtgatttcattttgcagctagggctgagaaccagtggcttatataagctctaagtgctaacattttgtgattcagcatacagatcctatttgacccatgtcattctttacttctagggaaccaagtttggtcttaggccttagggccctctctactgactcctgaaaagtaacgaagaaaagactctatagagtacagtcatccctccctatgttcagggtgaggagtggtggttacaagaccgccaccctcaggatacccaaccggaggatcctcaagtcctttacataaaatggcatagtatttgcatagcatggttgtactatggttttcttcttgaatatttccatccatggttggtgaatcttcaaatgcaaaaccatcagtccaagtttcaattatgaggcattaacataagtgtggttacaagcatggagtctgggaggcctataaatactacaaacgaatcaaataactaacaataggcagaaaaatagaactttataaaatttgtgtttgtaaaatcacttgacgattcgaaggccaatgagtgtttcttgagagttcaagaataaagtaaacagccttatatatatgggtattgtaaaaccattaaacaataaataaaacccaatcttccaccttcacattcttttctttttttttttttttttgagactgagtctcgccatgtggcccgggctggagtgcaatgacacgaccttggctcattgcaacttccgcctcccgggttcaaatgattctcctgcctcagcctcctaagtagctgggattacaggcacccaccaccacactgagctaatttttgtatttttaatagagatggggtttcaccatgttggccaggctggtctcgaactcctgacgttgtgatccacctgcctcagccttccaaaatgctgggattatgggtgtgaaccaccgcaccccgtccccaccttcacattctatagtgttttgtagttgggtaattacattatttgacctctatcaaccctgctccttcaccagcattcctccatctccacaaacatgcaattcactatggaatagttcagccagggattatccaggcaccttcgactctccactcatagtctacctcttatgaagttctgctcattctacctttacccactctttttatatccatggccatcaacttcatttcaacatcatctatagcctagaccagtggttctcaaactttttgttttcaggatcctttacactcctagaaagtattgagtaccccgaagagctttgtgcttatgtagtttatatctctcaatatttactgtatttagaagttacaatgaaatttttcaaataattatttgtttattaaaacaataataagccccactgtgttaacataaatagcatgatttaataaaacttatctttattttccaaaacaaacaaaaaggaattaatgaaaagactggtttgtaaatctttttaatgtctagcttaatagaagtcagcttgttctcaagtctgcttctgcattcaatctcttttgatatcttattgtggatgaagtacatgaggataacctggcctcacaaagaaacgtggttgaaaagggaggaaatttttagtaccttttacagatgattgtggatatatcacacagtctctggaaaattccactggacacttgtgacagaatgagtgaaaatggcaaataactagtggtattaggaaatattttttatgaaaatcgttttgaccttctggatccactaaaagattttcaggaagcttctagggcctctgtactgtatggtactttgagaactgctggtccagactgatgccctagcctccttactgttcccttgcttctactctgcttccattgctatccattctcttctccaaaggcaaagtgcccaattaaaaatacaagtcgcatgatatcaccccatactgctgatctttctttggaccctagattaaaatacaaaattcatcttaggcttctcaaggccctgcggttcttgccaaactttccaacatcatctgtacccctctccccttgttcttattgcttcagctatacttcaatttcttcagaagcaccgagctccctctcacatcaatcttcatgcaagttgttctcttctgccttgaaggttcttccattcctgtctgcctgtttcatcttttggagctcagcttaaatgatttttcctcaaagaagcatttcttgaccaaaagctagaggtaatatcttcattttacaaatcagcaaactgaggtgcaaagatattaagaaacttgcctaatgttcttacaaataataagaccataatttgaattcacatcccactccgaagtccaggtacttaatcattctgctatgctatcacttaagttaaacaaacaaacaaaaagattaaatcttacagagctctctttaacttggtgttaacctctttactatccaaaacatctgaagcaatcatttatgtttatggttaagagagtctggccctctgggcccaagtctcccagtgggtccttaggtatcccatgtggcaccccttcatatcatcaaggctcccggcattcaggcaggaacatccgagccaggagcctaagcccagcacataacaacatagccatgggactgcttcttcagtcctgccctgaagatctccatcagctttccacttctctcctccactctggggactctagaccacacacacagcaaaacaaaccatgtaatcacgttccacatttcttgaacttttcatcagattccctccaacaatagtttcccagcttcctaaccctcagtgtggtgggagataaaagcagattatctgcagtgtggaactgggagccatgtgacacttactcatcttctgattccatgaatctgaacaagtctcattgccacttgaggcttagttttcttttttctaagatggggctatctcagcagactgctataaaaagtaaaagaagcaaaaattataaagaaattctataaatcctgaagtcaagttattattattaaaatttattattatagatgattaatttataggcattttgcatctaagccttctcccactcacagatgcttaggaggtagtcttggaatcacagccctttagatgtggtgcacctttctttagaaaataggaaaagttctgtaattccatgagtaagccagaagataaaattgaaaatatagcatatcaagcgtgtcctctatgtctaacaaggctgttttgtggaatcatcatacaatctataataattctatacatcaaaagcaaatatacatgatgatcatgcattcaaagaagagacaagaaaaaattgatcactattaacatatttccaaagcaaatctacaaaatttccagagcaaatttattctctcaccaagaataaaagcaatgagtttccatatgagtaagcccaggactttttaaaatacaattttatgagacaaagcttacatttctaaagatcttccaaaatattcctattgcttcctcaaatgcagagactgcctcacttcctataaattgtttttctacttctgttcaagaaaaacaaattcattaaaactttaaagacttaatctcgagttacgtcttgatgagatctctgtgggatgaaagaaatcaagagatcacaataactgctattttaaaatgttcctacaatggaaacataatttgttgttgagaatgcactgctgtagagagaaccgaattttaaaaacatgttcaaaatatcagtttaaaccctaaggtgggtttctgaaaagttaggggtcttactgtttttttttttttaacaaaaatcaagccaaatatcatttaattaggctgactttgtagttcagatatgagtcatactttcaaaagagaaaatgtaatcaaagtacttcctataaatgtaaaatatcacctgtcatataaatctattcttgacccatatattggccaaaactatttcaatttataaaaatctaactcatattccataaatcacatgattaaacattatttcacctttactgtcaactttcttcttgaagtttctatttcctacgatattttcttcctctatgcaaaaggatacgttttataataaaaatgttgaatgagtatactgttaaacactgtgcatctaccgaaacaatgtaaaagaatactgaaatattttgaataaccataatttttataacagcagaaacagggactcagaaagataaggtaaatgaaaatcaacaaaatcgggtaaattacaattactactttgatttattttaccatgtagtgtaattctactccattactttttaaagggatcggcgtatgaaatcaaatctttaaattgtaaaaaaattctgaagatctttaggttttaagatagatttttcctgattgattattcttttcatgttctggtttgaggtaagaaactaagttatatagaaatataataaaaacacccacatcacttaaaatacctagatttaggcttaatcaattgctttgctctttccagagagggtctcatttgaaaaatgaaagagtaatattgatgacctccaaggttcgtggccactcagacattcagagattctacaaacacctttccctccttgattatgagtgttaccctttgtctgtaataacttccgagtcaaaacatacatcattttgtagtcaatcatttgtactattgtttctactcaaaataaagctaaaggttggacatgaataagcgtgtaattcatacggatgtactaatagtctagatacaacaaattaagtggcatcaacatttaggcaaatattctagtgtgcctgactaatacagccttttcacacataaataatgactcaaataatgactataagtacactcttttctcattagaaagtgcacaaacagaaatgttctaaaggctttttcatggttcaatgacctcatccaactttccagttcagggtctccaatatttcattttcaaagatctacagtccacacagtgtctaaggggcccattaaccctagctgcctataggtcttcaataatgctatacggtggtcattgctgaagtccaatggcctccttagcctatgccttcttctacaagttacctcttctactctaccctatctctgttctaattataaaataacgatcacaatgataataataataccaatggttaaaactttgacagaagacatccagttatttacactagttgatgttactttctgctgtgttgcaaggaaggtaggaaaaaaagtcaactgaatctagttctagtctcaattttgacaaaacctagttgtgtaaccttagataaattacaaacttgcaatggctccaggatttctcatctacaaagacagagattttgctgcacaaaaaggatccaatgtgcaccctggccctgaaactgtgtgatgtgaggccatacctagtcatttcccatgttttcattctgtgttactgtcattttaaatctgagccctttgccatgataatttcaggatccccactgtatttatacagcttcaatactacacatatcagaacttggttagctaagaaaaaagagaaggagagatactcaatgtgtcagccctgaaatcagaaatacaaccgtggcctttcccatcaaacacttgccttagattcacttcctaagcctcactcccctagaaagtctggtcaatggaacatgtgtctcagtgacagaaattcagagtggaaattctttatcaggacaaattattccacttcaccactttaccatttgtgagttactttgttagttcacaatgatatggcttaggaaggctagtggtttcaagaatcagtcaaatattaagtgaatacaacatcaaagtgattataaaacagattcgaatagtttttctttttggtgtttagcaacttcctcccaatccaactaaagattcttctctggaactgatatgtggaaggtgctatctctctataaatagacttattccatgctatgtgaatcatggctgctgacagcaaatcaacagattaattatttggctttgttagtgaagataatagcacactatcatcttcccaaaatgtttttacacacaccacatgcccattcttctaagctaagcttcagaacaaactgaaatggtatacaaatacacgcaggttgcccttgcactgggaatgtcttaataggtcctgccatctctctgccagattgttattttgacactttagctaaaggaagtcaccagtcaggatcctctctgataagatgaacactgtgtagaacaaaaagggaggcaaattaaacgaacactgaagaaaacaataaactcagaaactgcctcaaatctctgttttctaatgagatgctaaggaagagcccacaggaagcagcaaatacagtccttccttcccatgcaaaatgaagccatgcaaaagtaacccattgatcatctccaagtcaactccagagatcaggatcagtttatgttacccgttcacatatatccacctatcattcttattatcttgttttttagaagaggctgactaggatcaactcaaaaacgtcatataattttcccaactagagtgcaagcacgtacttcagagattgagatataaaagtcacattgagttcagaaccttgaagtcctctgtagaccacataagccctaagaaaagaaggcctccaaattatccctccacaacagaacaggttattttattttccactaggtgagttactttgtagaggtaattcaaactattgcataaatcttcactttataaaatgaacatgctatactaattggacataaaataatagagactaatagctcctgtcttgggatcataattatttttgtatactcctgaaatttaccactttatcatcatcacaaaataagaaaatgagcctagtatggagtggacaatgtcatgaaaacccaacggaaaatgaaacagggtcgcttcttcacaaggcttaaccccaaatttctgagctaattctgagcccgacttgtccagacttcccaagtgtcgcccttcatccaatggacccaaccatgtacttcattgctggaaaccaacagcacgccacagtcagagttgcaaagagacaaactagccaacagattacagggcaggctccctttccagacagtatttccttccagttgtccacaataggggtagagtatctgcagaatgcaaatggctctgcagccacaacccagaaaaccaacagtctgatggaagcacagatctctccgcaattctgcttccattctctcaagctgggtacactggcctggcttgacctggaaatcatcatgtcaaaactttgggtatccaatttccctttgcaagtagagacacatccaaaagcaatcatctgcggtcggggctgcagaagagaattagcttcagaaagcccacgccatgaaaatctctgatcaagctgaagttttctttacactccttgaggccaaactgtgtatactgtcttgttccctcaatgtctcaaaagtgtgagtgtgctaagtatggtaataggacagaaacgttaatgagcagagtccttggaaacaatgagaggggttggaagaaaataataggaaaatgaagactgtgtaaaggaagtgaaagagcatgagggaaaaatgaagaggtgagaaattgacaagggcgtctgaaagatgcaatgccaagtgttgctggaggaagagttggaaaaataataaatttaagttcatctggtgtctactaggtgtctatcatggattatgagggataagggaagggctgtattaatctttaggtcctcagtgggcagcgtaagtactgtactctacagacggatggatgcatggacggatagatgcatggatggatggatgggagagcgggagagagagagaagagatgaatgaatgaattaatgaatgaagtggtcactcccctcaaggactctacaggctcttttggaataagtgcatctatacatgtaattcttctcctggtcaaaccccggactgatcaaagtagagtgtttttgctgaatatggggcaagaagctattaactgacagagtggttgaaagaagtctggaaatgagagaagaggggtcagaatgtaaaagaggaatcctggttcccttccacgggggtcccgaggtgctttgaggagggagaaagagggcgtcccctctggggagcccactctccgggcttctactgacctggtctccgcctcaccggcctcttgcggccgctgcagaagcgcactttgctgaacaccccgaggacgtgcctctcgcacagggagcgcccgtctttgctggggctggagcggcgcttggaggccgacactcggtcgctgttggactccctcgcctgccgcttctgccggatcaaggagctggctatcgccgcagccatagctgctcagcgagggcctcaggccccagcctctactgcgccctccggcttgcgctccgccggggcgagggcaggacctgggcggccagggaaagggcagtcgcggggaggcagtgctaaaatttgaggaggctgcagtatcgaaaacccggcgctcacaaggttagtcaaagtctgggcagtggcgacaaaatgtgtgaaaatccagatgtaaacttccccaacctctggcggccggggggcggggcggggcggtcccaggccctcttgcgaagtagacgtttgcaccccaaacttgcaccccaaggcgatcggcgtccaaggggcagtggggagtttagtcacactgcgttcggggtaccaagtggaaggggaagaacgatgcccaaaataacaagacgtgcctctgttggagaggcgcaagcgttgtaaggtgtccaaagtatacctacacatacatacatagaaaacccgtttacaaagcagagtctggacccaggcgggtagcgcgcccccggtagaaaatactaaaaagtgaataaaacgttcctttagaaaacaagccaccaaccgcacgagagaaggagaggaaggcagcaatttaactccctgcggcccgcggttctgaagattaggaggtccgtcccagcagggtgaggtctacagaatgcatcgcgccggctgcggctttccaggggccggccacccgagttctggaattccgagaggcgcgaagtgggagcggttacccggagtctgggtaggggcgcggggcgggggcagctgtttccagctgcggtgagagcaactcccggccagcagcactgcaaagagagcgggaggcgagggaggggggagggcgcgagggagggagggagatcctcgagggccaagcacccctcggggagaaaccagcgagaggcgatctgcggggtcccaagagtgggcgctctttctctttccgcttgctttccggcacgagacgggcacagttggtgattatttagggaatcctaaatctggaatgactcagtagtttaaataagccccctcaaaaggcagcgatgccgaaggtgtcctctccagctcggcgcccacacgcctttaactggagctccccgccatggtccacccggggccgccgcaccgagctggtctccgcacaggctcagagggagcgagggaagggagggaaggaaggggcgccctggcgggctcgggatcaggtcatcgccgcgctgctgcccgtgccccctaggctcgcgcgccccggcagtcagcagctcacaggcagcagatcagatggggattacccgccggacgcaaggccgatcactcagtcccgcgccgcccatcccggccgaggaaggaagtgacccgcgcgctgcgaatacccgcgcgtccgctcgggtggggcgggggctggctgcaggcgatgttggctcgcggcggctgaggctcctggccggagctgcccaccatggtctggcgccaggggcgcaggcggggcccctaggcctcctggggctacctcgcgaggcagccgagggcgcaacccgggcgcttggggccggaggcggaatcaggggccggggccaggaggcaggtgcaggcggctgccaactcgcccaacttgctgcgcgggtggccgctcagagccgcgggcttgcggggcgccccccgccgccgcgccgccgcctccccaggcccgggagggggcgctcagggtggagtcccattcatgggctgaggctctgggcgcgcggagccgccgccgcccctccggctggctcagctggagtgctagctccgcaggaaactcggggcccgggcgagagccaccgagatggcaggtgggacgcagagcccgcggcagccagagttcctcccgcacggcccgccgacccacggaagagcgaaagagcgcccaggtggggccgagctgggggccgggcccctggagcgctgggaagcacagcgcgctctagtcaggttccctttcctggagccctccgcttccagactcccttctttcctccctccctcccgccacccctctccctcctctctgtgtcttctgtctctccccttttctcctctctacgcaatcctacgtgattgaggtttggatgagaaattctcagaggcagagcgagggaactgcagcttgggtctgctccgtccggtccctcccacaagagaaacacaaccacagtgggagttaaaggaccctaggtgcgcaaagaagaggtgggatgggggagctgagaaaatgcagtccacactctctccaataagcttgagcacgtagaattctctgtttagttaggaagaaagtgaacactggagaaagtaaaaatgacctcttggaccttatcgtgggccccacctatggctcattttggaacaggaaaaagtgtttcccttcttcttggaacccagatttcttggttctgtctggaaagctgcaaagcaggctcagtccctaaaaagagagcccaaataagcagcctgcacagaggatgactccaggtgcggcgagggagtgatgtggacaaggacagtcaacaacaagctgtggaatgcaatcaggtctccagacgtgaatgtgacgacatctgatgttggagacactgggcagaggagttctccaagttaaaatgcagcatgaagcattaatcaccctccatttatgctaaagtctgggagcggctattggtttctacttacaatttctcttcatatatccctaatctctctccttcagacacttcacgaagcatctaggatagtgcgaaaggattaaatgtatgatttccaagcacagacaggtgtatgttggcaacatcctaatagaaggcaaggaaaatgcaggccctgaagctactgaaaatggatgtgggacccagagggaacccaggagctttctagatatgagcacaaacctatgggcctagccaagattcacttgggcaataagaaggattgagatctgtgacgttgttcagatcaagcaggagtctaacaccctaccatgcccgggggcctggaccttccaggctgccagctgggcaaagcagaggctggcagatagaggctcatgggacaaacagctgggaggaggattaaataggcaagacatcctgaggaaagggagaatcccagctgtcatttgggaagcacacatcccctgcagcagttcaatgtggctgaatgaagacagtggatatatccttggaattctagcaatacagaacaagacacgtgaaaaagacacacgcacacacacacctcaggtccaaaagcaaggctgaatgcatttccatatgtgcatctggatggggtgaggggcattacttaacatcaactggtaattctatcaattaggaaaatattcacattccacagataaaattattttccttccttggctactagaagacttgtctcattcttgagcaaggcagacacagatagtacagtgggctttgggggctccctgtccttgctattaaacacccacacagacaaaggtcagctaaggggagtagccagagaaataggcaagagggggtgtataatgaggacttgaggaaattattgctaaatttggagtctcttttatattctcaaaatggggataatcattctcatctacctcgcagaagtgaatatgcatgtgtaagcattctgaaaactggaaaatgccaaatgaatgaataaaatatggccggttttttttttccaaagaaaatgcatgagattcacctgaaatgcttgttaacatgctgattcctgatggtctctcaaaacacgaagtggaagtctgtatgggtagagcctgggaatctgaattcttcacaatttctccaggtgtcaaagtgtcagagtttaatgtatgtttgcaacataaataatactagaagacaaaagtaaaatatagtacatttctccagaactgcagtcctgtgcaccgccaccctgcgccccctataaaaggcctggaaagaggatgtgtattctttagtctttgtgttgctgatttttttctgtaggtttatgagatatgagggtgtgctggtgcagaaggtaacgaatacagaggcacaggagagaaggaagttatgaggaaagatgaaaaggcaggtagctgttgctgtttgaagttctcctctctgtcttaacctgacaacatcaagttaggcatttaaagaacagaacaaaaacaatgtcagctttctgggagcaacattctttctgtgtttagatctctattaaaagaatgtagtgttttggattcaatcggacaacaaagactactttttccctcgcactcctgcagctattgtcagagagctttttggctttttaagtcatcatcagcataatttactccatttccccagtgagaagaggtgagtataaagaaatttaagaagttagctaagacctaaatatatggatattgagctcagaagcaatgcttaaatcaatttattttatatatagaaattcgtaggtttcctacctgggccactaaatctcataagtctttctccacagttactcgtacatttccaatatctttgcattttgggatcaggaatgaaattaagccaacctactgatgatttaggttaaactaacaaccaggtatttaaagggttatgtcccagggataccaatactttgatttttatgctttctttgaacaacttaagaatttcttattcctattctgaagacattatgagtggaagaagttttaattactttgaagaaaattgtcaaatgcacatcaaaatgataattatgtagttatatttagttatatatatatagtctatgtttttgggctctagtcaaacaaataaaaacatgggcagtcttaattatctccacattttaaaaggaaaaacagaggctttttggtcttttgcttattcataggccaagtctttcaacttccaaatctactattagggctagtttacacattcattttaaacattgcattgtccacagattacatccagggctctgtcagttaccgtgaaattccagacacttccacattctctctgccctcaacaagcttccagttcatgacattatgaactttcttggctcttgttttaatcgcccactagctgtatgctgttggacacgttattcaacctctctaaactacatctgcaaaatagatacataataatactagcagtacctaactaggctcttgaaagactcaaagaagatgtgataataacgtaaagtatgagaatgaccatgctgttattaaaatctccatttaaattaagtccctgccataaaatacagatttcctaaaacaggaaaacacaccttatgattcatacacatcatcattcactcttggaatgtatttaacaaaggctgaaaatttacttgaaatgaatgattaaccttgacattgtcatggcaaacagaatttcattagtggaatattgtcagtgtccttgtcttgagaacacaaagaagtctagctctgctcatacatcatcttgctctgagatcaggcccctgactcaaagtcgggtgaatatgagctcactgggctctgccacagcaaatggaagaagaccttttctccatgaattttattatataaagtagctgtatttccacttgcttttttctgacatattgtcagttacagtaggctgacaaaagcaatataaagaactactttctaataatttgtaaattcctttatatagcaaatttattcatggtgctttattcaacaattcgacaactgaattactacatgttatatgtccatctggttttgatcatcttccaaaacagaaaagagaacagatttaattcctctttatgacatagatgaagggtggtatcattgcccaaaaagggaaattttcaatgttctggagaataggtattttgataagaaacatagatgtaattaatgtgagccaatgagaagtgccctacacacttataagtgcattacaattattgacacattgaatccttacaacaactctatgaggtaagttctgtcatatcgccattttataaatgaagaaaccaggacagagaggttaagttgtttaaccaaggtcacccagctaagaattgccagagttcagattcacacccatataatttatttccagagtttcccttttacctctgtgctatacgcatgtcaacaaaaacaaaacaccatgaataattacaatcatgtaataaagtcaataaaataagaatgtgcagatcacatacatttatgtaactctttactaattacaaatcatcttctcatgtattatctcactgagactcttcaacaatcttatgatggaagctaaagggaaaataataattcagtttcacaagctgagactccaataagtaatgtgatcgcccaaggtcatacaatcaatgagtgaagatctatgagtttaatccaggccttttaacctcaatgtgactactgccctaactaaagtaacctggaggggaaaaatgagaatgccaaatgtacttccattcactagcttctaacatggtttcacatcttgtgaatgaccttgaagagatcattttgtgttggaagggagaggaaacaagtatccccaattctctccccgtgaagctctttcctttttctagatgaggaagctactcctggttttactattgttggccaagatagggtactatgttttctttggttctaggagggtggtcttgaaacactctccttcttagtttagtaattcaagtcgagctcaataagaaaatcaaagggaaactaagttaaaacagaaagtaaagaagcttataaggggaaaaatataaatttcctccattttcattccttaaaaatgtacattggtttggcttataccacctaggagatggttgatacttggttattttccttcatagctgggttaaggatgctgaaagacctgtcacaacagaccgcccatcattttagccctactctaagtcccactgtcactaacccagtggcaccttttccttttcaaagagaaactcggctagaagatccctatttgaatgtaatacccataaggacagggccattgtctattttgtttactttcttatctctagtgcttaaaataatctttgcacatagccagatactcaaaaaatactcaaataaatgaattaattcatcaatccatccacccagatttttgagccaaatagatgcatgggtcatcccaaagtgaagaatggggtatcaactctttgtatcaggaaataagctcaggtaactcaagggtagcctccacatttccaaagttgattgttttgttttatcaacactccctaaaattctctgcctaaatattaaatctgatatcctcagagggtacatggtacctaggtttctgctctgatcacccccatccccatatctaggcctatattttcagttctgatacttctcttctctctctctctcacacacacacacacacacacacacacacacacacacacacacactcatgttcacagaagaaaaggaatataataaggcaaacagagagccacagacatcaggtaaaatgagtaggcaactttaaaatctcagaatatgactaaaatgaccttaaaatggtttaataatcttcacattcatactgtcacccatgttcactgagattctttctccatgggccattcctagttgctctcatttctaaatttagattccaaattttcagggaatggatcttgttgaaatagcagtctcttacagcacccagcacatgactgacactcaaaatatactattaaaaccacaataaattcatatttttgtcctctgcatgcacacagcaccagacactgtgaaagtaagagacaattaatgagagatctcactgatcctgcattcacaggtatctgatgttgagtaagattttactggagataactgaaatatactaactgattagaaaaaatctgtcagaggatcaaatggaagtttggacaaggtgaccaataggacatttcttgtcctaattttgtagaattctctaagagtaaaatgttaagtacaaagagtatgcaatttagagtagataagttgtccttacataaagctacttcgtctgcctgagttgaagtttatttgcctgtgaaacaactacattataggacctaaattggtgaaaataataggttgaaattatggcactgatttgtgaaatgagaaaaagtgtgaatgaataaatgaatgaacagatcagcagatgagtggacagatgtttgtatggaggaaatacagcatatttcatttaaatatccctaaattagcattgttaggctaagcgaaattgctcccaataaaaatttaacaagatgtggagagcttgttagcagattaaaaacattgaagaattctaggatagtacatgaaagcatgtaataaaaatccgtcactcacttaaaagtaatttttacataaaacaatattcccctgtgcctagtattagccactaatccaacctgcaacatgacatcaaggaggcattgatgtagatgtctgtgtgtctgcgaagtctacagccaaaacagacagacagatagatatagataggtatgcattttggtgctcagctatccagaaaagcaggtataagataatgtataagaatatttctttaaacagtatttgcagcaggaagaaacaatatttttccaatgttttggacaggataatcatatttaaacttgcagtgttaactgcaagggatctcatgaggtcatcagcctactctaggtaatgtatacacattgtagtaagctagcaacagtttaagagaggagatttatttaaaagtaggctggaaattgtctcctggttggttgagtatgctaatggcatggcaatggaaaaacagcatgatcctcattgcattttgacagttctttctctcatttctttaaaaggccatgaccaggaaatagccgtaactggcctttaaaagataagtaaccaaaagcgtttattattttgtaaggacaaaaggcagggaaagaatgttgacttcatgccaagagaagtagaattcattaccaaaaaaaaaaaaaaatgctaaaaatgatctgtgtataagagtagacacagaatttaagggtaagaatctgacttagaatttttgttcctcctgtaagaacgtagtatagtgtttggaatataagatagacactgtaagcatgtgttgatttttaactttgacttaaaaataataaatgttcaggatgaataagaataatctcaatgtcaccttaagcaaaaccctaggcatgcttttattaatagtggaatcacctttgatctctgatagcatcagttaagtagtggctattaaaacaagaaataaatgtttgataaatatggtaaaaaacaaatggttttaatctaggagagtttcccttatctcctttgtacatctagcagatactgaacccttgataaaaccctgctgcaaccctgataaaaccctaaggtaaacccacaccactctagggaagggaaaggttatgccctaagtgagggaaacatcatagtttcaggcaacagctaagagatctgagccttggaaggtgcatttaaactcaaaaaagaggatgtgccttgttcttttgtgcctggattttgaataatttgcccatgtttatggttgtgctgacagacaaaggaagaaatcctctaccaagcagaattaagccaggaactgcacaggaaaacaatctcatagggattattttaagatattagtctggagttgtggactccaaagagtgaactatatcaagttatgtagatgttagatgcaaattactctccacattgtaattttctttgttacacactggctttcaataaagtcttatgttaatgttcctattcagtctctcttttgctgccggtaattaataaaaaagttaatatgtcaatgcttaggccaggagctacatactacgcagcaccatagaaataacaaacataattaattagagtctccaagctgtatctctggggtgagttagtcctcactacaagacactcgttcaacacagactatggagaattaacagtatgatgtcagtcaagaagttgttgggttttccttaccaagtccttatataatttcaggcaaatcctttgaaccacagaaaaatatcaaaaaactctgcgttccaattataggttaaaagtgtttgagggacacgaaggatagggtagggaatagaagggacattgatctggtttgaatctgtgtccgtgcccaaatctcatgttgaattgtaatcccagtgtttgaggaggcgccaggttggaggtgattggatcatgggggcagacttccctcttgctgttcttgtgacagtgagttctcatgagatctgactgtttaaaagtatatggcacatcccccctcactctcttgctcttgctccagccatgtaagatgtgactccttcctctttgccttacaccatgatcttaagtttccagaggtctcccaagctacgcttcctgtacagtctgcagaaccgtgagccaattaaacctcttttctctacaaattatccagtctcaggcagttctttatagcaaggcaagaacagactaatatggacattaagatttattagacaccttctacataccatgcacagtcctgggccctacacaggttattttacctaatcctcacaataaccctggcaaggccaacactgttattcacatgttacagtgggaaagctaaaagtcatagaaagttgattaattgtctgaaatatggggtcaggtccagaattcaaatctagtttagctcactccaaatccaaagctctcttcatgactttttttaggatgatgaatccacaaaatgaacttatgaggacaattcatattcttgaagtgttaaaaacaggtaagataacatcatttagggccacccacagtctaagtcaggggcatccctgctgtttgttccttgttgatcatgaccccatttgaaatactagttaacaaatagagctggggaaagagaaactgaggaaagtgaggcctatgttcaagtgtttgaagaacttgagtattgtgtgtgtgcaagagattcacactaagaacaagatatcctgtgtgtgtagaggcaaacttggatgcctctcttccacccatggaatagattacatcgcaaaatgaggaagtggttttcccaccatcagagactttccactcaagatcaggagcaataccatgggaagtgggtttcaagaaatcagacaggtattctataaaatgattaaggtcagcattgctgggggtggagagtgaatcaaaatcattataggctgcatccaaggcaatacttgggaaaacttttgttcattttaaaggacataaaaaagggaaaataaggaatcatgaatcaacaatgaaactgattgctggggatgtgggagaaatgacagaaggatggaagattcaaggagatagtcacggaaagcacatctttactaacccggaaagaaagcacagagctaaacacttctatatggcatcaaatgtgtattgtaaaggctggcataattgattaaataagtagatttttaacacatggttgaaaacctaaatgataatgttcctctgagttgtggtatttgagaataagaaaaagaaaacatattaacctattaagttgtatgtgaggaaagctcccctggaaaggccagggtaaaaagctactaggttgttcgtcaaaactacagtggattctatggaagatggtcattgactcttttggattcttgtgtaggaaagatcccagtttggggtaaggcacctcaaaataaccaaaagccgatgagcttaaaggtgagcacagaaccaaaggaaaatggtcgggggtggaaatcgtgctattaggagctctgctatggttccctcacatcaggccttctgcaggttaagtgttaggctcatattagagagtgtgaaaaggaaatacttactttaagttgcagtcatggttatttcccacgagatctaccaattccactaaaagtaatcacagagaaatctggagactcaatgatgtagttcagatgttaatcccctccaactcttatgttgaaatatgatcaccaatgttggaggtgggacctggtgggaggtgtttgggtcatgggagcagattcctcataaatggcttggtgccctctccacggtaatgagtgagttctcactctgttagttcatgtgagagttaattgttaaaaacagtctggggtgtaccccctctctctcttgctccctctctagccatgtggcactagctgttcccccttcgccttctgctgtgagtgaaagcttcttgaagctctcaccagagacagatgctggtgccatgcttcttatacaatctacagaatcacaagccaaataaacctcttttctttataaatgcccaacctcaggtatttgtttttagcaacatcaaatgggctgctacacttaattattggcaaaaagaaagaaatacgtaaatctcagtacacactcacagctcatcatatagtatctttgatttcatttgtcaggaagaaaaacaagaatcacaatttggaaaaactcaaaaccaattggagaaaactgactacaaattggaaaaaaaaagtcttacaaaatgttttatcaataaaatgctacaaaacacaatgaagggggtggagagatattcgacgagaatcgacagtggccactacatgcatgaagttaggagctttaaaaggcaaccatcccatttcctgcttgacaatgtttaactgactccatgcacagtattatctttaaaattagaaagtaagcatgtgttccaccagtaggtgagaaagttgtgtgaccatagaaaggtcacttaacctctgtacatcaatttactcatccataaaatgagaaattgttaaaagaataactgatgatctttatgatttaagtcctttaatgaagattacttttggaagggttctggaaccatgtgtgacactcagttttagagagtctaaacaataagaaaaaaaagtatatagtctagagtacccaaatattttcaatgtgactgcttacttgaaaaaaaaaaaatggctttagtagctgtagcaaagattgtcagcatggaacactatgcagccataaaaaaggatgagttcatgtcctttggagggacatggatgaagctggaaagcatcattctcagcaaactatcacaagaacagaaaaccaaacaccacatgttctcacttatgagtgggagttgaacaataagaaaacatggacatagagaggggaacatcacacatcaggacctgtcaggggatggagggccaggggaaggatagcatcaggagaaatacctaatgtaggtgacgggttgatgggtgcagcaaaccaccatggcatgtgtatacctatgtaacaaacctgcacattctgcacatgtaccccagaacttaaagtataataaaaaaaaaaagagtaaatgactcatctcaacgaaactctcttgaagctgctaagttctcccaattttagttcaaactgaattcctctatctctgaataagtggtggtggtggtgaaggaaagaaatatgaagatgtctattaactggggagatggcccaaaacaacataaagctgtccctgtcatagttggacttcaaaggtttttgctttagtttatttttttttggcttttggtatttttttttcctgtgtacaatttctatatagataagaaatcttagataactgttggtgaacagttttgtaataatttggataaaagacagagataattctatagtgaggagagtcaacagaggaaatacattctaatggatttgtttctagcctgagctgaatttttattctgatgttacttactcagtacggaactttgaacaaattattcctcttttttggtctctatttccttattcttaaaatgagattaaccagatgattgctaaggtctctttctactctaaaattctatgactctaaatatagtgctcaccgacatcatattacttaaacaaaacaaagtaggaagcattttctgtcatcttccaaagtaacttcagagtagttaactaaagtgaaaagagcattggttatccttctttccccaggccattggctagattccctcagtccccagaagaactaaacctgactcattaatcttgtgccacaaagcccttctctataactctggataaaggcaatattatttaaagctaacatttttcaagtgcttatcatttaccaggaactggtctaagcactttatatgtatcaacttattatcacaaccaccctattaaatgggtattattgtcaacacgtaaacagaggaacaaaaaaaagtaacttggctaaggttatacagctgtcaaagggaatgaccatgatttgaactcagcaagtttgggttcagcctcttagtaattgatgaatcacatttcagttatgtggtcccagtgtagtaggagaggaagggtgctagttctggtgctagtgatggctatgatagctcttcttttttgttctatatgcaaagaaaacatgtggctgggcagggtgggaaaacctgatgtgaagaatgctctcagctataagagttgggagcaagcccatgctttccccttccaaataccggaaaatcttctaagtaagccttgatatgacagctccgtgagtttataatcctaactgagccctgtaatagcatagcatctcacttctacttccttgaaaattgtgggtaagacttaatcctgcttctgaagcagaatcaggcctaaatgtgtggctcactaattttcttttttgttagagagccccctgttgcataatttgtgtaattaaagtatgtatagctttgctaagcaattctcctagagccactaaaatgtgtgagtgttttagaaattatattggcataaaataccaacctctgattttctttttggagtgttccatcttagggagccattttataagtatgtatctagaagagcgacttaacacagcattaagtcgctaaattctcgggtttttcattctaatgtataactgctgttagcttattgagagagcctgggcaaacagcttaaactttttgtttcttaagatcatttccaaaatgaatacaacagactctcatgacaaagatttacgtgcaaagatttagatatggaatcaccacatacaatacttggaatggaaagaactttaagaattattcaggcttatgccctcattttaaagattatgaaattgaagaccaagaaaggtgcaacatgctttaggtcacacagttcttggtagcttaagcagaaacacagcctaggcctcctgattctacgatcagtggtttctctggtataaggtttaatttttctattaaagactatattttaggctttttaaaaaagttctaacaaaagctagtaggtacaaaatgacacagtttatagaagcttcccattcaagcctcacaaccactcagtaagacagttactagttattatcaacactcactatatgcctaatttatagatgcataaagagaagctcaggctgctgaggaagtggtccaaggtcacactagcattctagctctgatctccgaaatttgaaatttattttcttcttcggaccttttcttcaccccgccctctttaaatttgtttcacgtcagatcaaatgaattataaagtcttcaaaaaaaaaaagactattaatgctttccccaaaacgtccccagttagcatataagctaagcatttcttcactggccacttccccagatcctgttcatctgacatctattttcaaataaaacaggattccttagaacagtaggaatttctcacactggtttattgcataggaaaagagagtcataattctttttgtaaccatagaagtatcatcaaaatacagaattatttgtaatgctaatgagaattttcttcaccaggtagtgctgtttgcaaaacatctggtgcaccatgccaaaaatacataggagctgaaaggcaggatgcaaactttgcctcaggatcttctccaccaggtaatttcaagacaggcattgcctttaatatatgtgttagatgttgcagcatctgatagtcacataactaatttctttaattagttcaccccttgtgcatcttggcttcaaggattcaattaaacacaaaacttgcaactcagtgctagagtattcattaacctgcaagttatcttttaaaacaactatagtctagggaaaatttcatgaagatatgaatttgcccttgtcctgaatatatataatttgaatcacatgccacaggaggagagtctataaacaacgtttattcttagcaatgattcaccgtacacacagagagacacacacacaaacacacacacgtatctttacatcttaccaatttctttgtttacctataataaaactttgcaataggccatgttttttatcccttcaccagtcttcttgcctcagcattttataattttatgcatatacaatatacatatgtttataaaatatgatacatcctacatacaagatgcatacaaggtgagttgtcatgcatacacatatttgttgttttatatgtatactgcatatatgtgtgtataaaattttaaaatgctaaggtaagaactggtgaaggagaggaagaaaagcggtctcctgccaactttttctaccaaagcatttatgtgcttttccttttacatccatccctcagtcattgggcacttaccacatgccaaactgcttatcacatgggagacataaagaaataaaacataatttctctccttagaacgtactgtctagtggatggacctgatattttatgtaatagcagaatgaagcaaacacaaatgaaaggtgggctctgtgctgggatgttcaggagagaaggacactcttctcaattacaagggtccttacaaggtttcaccatggagtgacatgagaactgcccacttaaggaaaagtgggatgcagtctcccaggaataagtctgagaaaggccttctaaacagacaggaaaggaaaagcacaaaggtgtcaaacatcaaggttatgtcaggctgtggaagtcctccagggcagcgatcctatgtgtctactatcatttctcatatgtcaaactcatgattaataaaattaaatcaatcaaacaaaacaataaatgaatgaacagtgtttggagagtgttaccagcttattgggtcaagaaaataagatatatggagatatatgatagaaatcataataaatcactagcgaatagaatgcattgctgtggaatttgtgcctcatcctaaaggcaacagagagctattgaaagttttttaagagaactgtgatagaatttaatctataaagtcatgtactattgtagcttttaatgaaaataattggtttaaatgtggtacaacagagtagtaatcagattcattcattacattaaaattaaatagtattaaactaaatttcaatacattaaaattacatggggatggaactgtcttactacaactttcttaaatggatataaatagcacttgagacaaagctccaagagatcaagttcataggtgttacacttactctcaccaagtttatagctctttacaaatgttattgaaaagttatctgttttcataagtagaaaaacacatataaatatccacaaactctcccacggctatacataacacacagcatggactagtagtgtaagacctggatttggtgttgttattaccattaacttggtctaagatcctgggcttttcctccccttgctaggctccagttccctaatctataaaaggaggggggaaatggtgccctccatggtctgctttagctctgatagtctgtgattccaatgtggtctctggaatggcctctgttagtttccacacttagcacagcagagggctagggagtgatgagcctcatagtattgtcagagggaaaaatatcacatccttttctttactcacctaaaattgaacaaatacaggtataaagtgaaaaatgaggcaggaagctacaagggaacattgcattatgtttaatgctacttttgaaaatatattaggcttcaaatttggaaatctgtgtagctcttcaaacagatgttatattttaccccagagatgaccccattttagatgatggcaatccagtatgtataataatattcttcatcaacttcctaaattacttgagagttgtaggagataaaaagtgtaatacaaaagaaagatggtgacatcccagtaactatattaagagctagagagactgtgagcacatttacttttatccttagctatgtttgaaagagagacacttacataagtagtatcaggatttaaaagaaccaaatgtctcaagagtagaagagtatttgacttgtaaccaaaatcttgattttaaattttaattatttaagtaaataacggtagaaacgtaggttaattactaatttactgtctcttagtttggtagtcatctttgaaacggaaataaaaatacttactgatacgattattttgaggtatacaaaaatacattatagtaattacttggcatggtttatggcacgcagtatgtgctgaataaatgctagctttttttcctgggacttttcaataacgtttgtagagcactataagagtagaagagtgtaggctgggcatggtggctcacacctgtaatcccagcactttgggaggcagaggcgggtagatcacgaggtcaggagttcgagaccagcctgaccaacatggtgaaaccccgtctctactaaaaatacaaaaattagccggatgtggtggcaagcgcccataatcccagctactcaggaggctgaggcaagagaatcgcttgaacccaggaggcagaggttgcagtgagctgagactgccattgcacttcagcctgggcgacagagcaggactccgtctctgaaaaaaaaaaaaaaagagtagaagtagaagagtgtaagttgtttaacactttctcatgatgtacgtagtagtgccaaacatactctaggttctcaatgaacataaaacacagatgaatttttaaattagcatgaacactttgacatgtgatttgcattatctggataggacaatctgacgttaattctaatcaatatggtaggcatttatttcatttagtaaataaatacaaatagcagtagagtggttctcacatcatttcatttagtgcccagtagtatgtgtttctggaaagatgtgtaaagagacaattttttcaagagcagatactgagaggctcttgaagtgcattccctggtaccattctgagagagcatcaatgtcactaagacttggcagcagggagcagcactcatctgtgtgacttccaagaaacacagagacagccacttactgcagccaccagcagagaagtaggtatgggggacacagcctcttctcatgcctgctggcatctgaaacaatatccctcttgattttgtgtttgcttagatcagagtgcagactcaaggcactcacataacctgccactgagaatgtcttagaacttcaactgtgctttgccaaccaaagccaaaggatgttaatattgtgtagcaagttgggtcaggtagaaaatgcttttcttattcaagcccttcaagatctttctcaattgcaactttcttgtggtctcctaacaggatccccctccgccacccaagtctgaatgtcaaaagcactttctggttttgccaaaggaaaggcagcttcctaccttgcattacattgatttgtgtctcaattgtgtctatctcctctactcgaccatgatttcctagaaggcagggagtctaaattcctccttttagaaacagtcagtttaattaaaggtgtgttagagggaagaatcaggagaggaagaagggaagggggaaacagttcacatgtatgaaaataagggaaataaattactatgtctgaaagcagccactctaataatgatgttgatttttatactcctgacttgtcaaacagataattatgagaaggttccatctgaaaaataaattagagtatctgggtcttaaaaaagaaaaaagaaaaaacactgcttggaatgttattaatatataaatgatctaaaacttgacagtgactcttctcttgggttctcataattgggcaatgcttcggaagatggtagaaggaagtccaaatctgggcataatcccgtacttccccagactggggacaatgtcagactttgaaacagtaaaatatgagagaaaaaaaacctgtatattttacaaactaacagaaagaaggagggattttatgaatcaattattccagcaccttagctttagatgaaggatatgaggttgttcctttaagtatttcataggctttgaaagctctgtgagtctgcatatggcaatccttctgtctggaattacttctgctgtgtttgacccacctccattgccgtcttttccttgaaaccttctctcattcctccagtcagtttattcatccttcttaaagacccatggatcacttttaaatacttttatttatacactgatatatgttggctttctcaattagatcatgaatttattttgggcaaaaactatgtttaccctactcaccccaaacacctagcacaatgcctgaaaaaaagagtacttcacaaattaatattgagttgaaatatttaagttcactggaagagatgagggaagaggacagcatcaacttacctcttcacgaagcttaagacatctgactcttgtttataacagccctcgcagattaataattttaaactgtaaagcacactggcaccacttaaagactggcttgtgaaggatcactcaaagaacaggccatattttgatggaatggaaggaggagcttgtcctctatactgcagtattttggaaaaagaagtggactgagaaaaatgcagtcctttctttcttttcctaacttccccctccaacatttttctcttatttctccttgtcttcctttatgtgctcctcctctttctcctttgcataaagtattgatagtcatatccttaaaatactacaaaatctctctgctttctacatgcattactccttctctagaactatgtgcctacactttacccaaaaggccaagtgtacttcgtgatggctgccatgaaaaataagaaaaaagaaagctggttagatattaatgcacttgtgtttaaaccacaatgtatgttactttttgtgggggttgtactatacattggtgcttgtttatcttggcaaatgaggtaaggtaggtaacaatatttatagatttgagaagatatctcttaacgccattctggaaaaaaaatgcagctggtgtattttgctagaaaatactctcaaggaaaaacaataaggtaaaaggcccttaagatatttttttgcaacaaacaaatacacttctgtatagatataccagatgctttcttcaaagccacacagagtagattttcaatggtaataaaatgcttgtctctgttgccactattctattttagttaaatagcattagcaattttaagataatctcattttggaagtattataattaccttaagaatttggccttctctttgcttgcatatgttcatagcagcatattcacaatagctaaaaagtggaagcaactcaatgtccattgatggaaaaatcaataaaccaaatgtggtatgtaccaacaatggaatattattcagccttaaaaaaaaaagggaattctgtcactatggatgaacttgagggcattatgccacatgaaatcaaccagccacaaaaaggcaaacactgtattattcttcttgtatgaggtatttaaagtatcatatccacagaagaataaagtagggtggtggtttccaggagctggataaggggaaaatggggaatagctgttcggtgggtatagtttcggttctgcaagatgaaaaagttttggagatccattgcacagcggtgtacttaatattactaaactgtacacttaaaaatagtaaagatggtaaagtttatctgttttatctcaatgaaaaataaagaactggatcttctttgaaacaaaatgcctgcaattatttcaacctcacccctgccatttaggttttgattaccactctctaaatagttaccacacaatgtacaaatatttctcaaagtaataatcaagttggctagaagacattcaattcatttattggggtcctattatgcctgaagtaatgagtttggccctagggtgaaagggggaatgagggaaggcatttcgccaccatgaagagggtagtcttgggtgggtcttagtgaccacaggtaaggaaagacatgactcctgttgatacggaatacaacaacctgcttctgtactataaccagtgtattgggagcataattgttattggaatttctcaacctttgagtttttcaaacaattgggtctatgctcaatatcaacagtttttaaattccactgaacacttctctatttcaagagatacctgaggttttcatgttaacctcaagtcacaatggagtccacccactttctccaagcaccagatattattttgaagatatcctgtaagccaaaggaatgaaggaacagatgatatgagttatcttgagaactccaacataaatgagatctgaatggagaaattacttggatcactctaacaaaggcaaaaacggcctttaccacccacaatgaatcccagagataagctcgccctacttacacaggagctgggttctgaaaagagaaacttcagcggtacctgtaagcagttgtaggtgaaacctttccatttaaagtttgtatcaggttgattttcttggaaatcaaaatagaaaggagctgattagatcttagctaaaggggagaaacaaaatagctggagtccctgatggtaaagctgtattaaaaagaaaacgtgtgaaggagaatttaaaaagcatatagcactttattcttgtatttctattgccaatgtgactagaaaactaaagaaaaccaagagactctttttatactgttattctacttcctgtaatgaaaaatgacagggagaagtggaaaatcagttcaaaatacaaaacctgctcaacagaaaacaattctgatagaatcacagaatcctagggttggaaggtcaagttgcccaactcaagtaccaagcgtttctccaatgatgacttgtattatcataaagtgtataatagacttgtatctagacttagacttatgtaagctttctattatctagaaatgttgttgaaatactaaactcaacatgtcaaatcagcctaacttgtcccattgcttatcagataacagctgggataacagcattaaccttcaccaggtcatttaataggaagcacagggcatcctctctgactacagcctctccttcatgtaccccaagcacagcacacacatatcaatacacatgtacactatgctgtttccacaatgtctctttgttgtcttttttctgttcccactggcagccctttatccaggcattccatcaccgttcacctcggcagcaccacatagatcaggtctgcttacctgtggcatctccctcttaattcccattcttcaagggacttatttcaaccaccatctttcaatgtttactgacaccagttatgtcccaggagctgtcctaagtactaacaaagatgcaaaaatgaatgatgacttttgcctttaagtagctgagagtctaatggaggtaacacaacctaataaataagtgtactacaggtcagaataaaccaaatacaatcttgttcaaagtgttgtgggagtattgattcatatgatggaaggaatgacggtaaggccagaccttaaagaataagagacattccaaaaacacaacaagattctcgtcccctaaaatgcataccctatataatccactccccttcgacataagtaggagaccatgaatatgatgagatatcactctctggattgtgttgtgtaagacccctccttagcagatcagagagagagtcctaatggccttaaaggagaaattgtcatgttgtgaaccgcctgtgggaagggccatggggcaaggtcctgtaggaactgagagagcattgctgacatctggcaaaaaaaaaaaaaaaaaaaaaagaaagaaagaaagaaagaaaagaaaagaaaggatgtcagtcttgcaaacacaaggaattgaattctgccagcagcccgaaagaacttgcaagaggatctgagctccatgtgagaaccaacagcacggcaaacacttggcagttttgtgagaacctgagtagaggacccagtgaagctgtgtccggtttactgacccaccgaaactgagatatgagcatgtgttgttttgagtaataatttgttatgcagcatgagagaactattacaccttccctaaatgaagtgagtcggggtggtctgtagcattggtgaactccctgagggtaccatatcatctgatttcccacacaatttctagggaatggtacccttcagatcgtcaaacgtgagaatccagctgtcatcaatctcctcccaccccctcgctccaacgcacacatatgttctatccagggaattcctagaaagggcattgattcatcatttttagattcattgtctttgagggcacccccagggaccctggcaccccagtcattgtgctgagaaaacagaatcacagtactttagatatagaatgatccttaaagatatttgggagtaatcttctcctgatcctcattttagatgaaaacaggcccaaagtgtcttctttcacctcctacaaatagtcaactgcagaaggacaaacaagttttgtgtggcctgaagcttatataacttgggaaactctccttaaagaaaataatacaaatttacaaatatcaaattacttaccaagcaaatatttactaaatataagaaaaagaatttagaccaaattgcgcatttgaaaaattaacatcacaaaattcagacacagctttaataccttttctttataatttttgtctgtaaatgttttcatcctgtaacataaatgttaacaatattttctgtaaaacagatgatcagtctcacctccaatgtgactaacttatttttaattgtgaaagttaagaattgttaaattcagctttaccactcattattgctaacgtcatgtaaatatttagactagtatcaaatttgattttaaaacaaactcagtttccttgatttctcaaatatttcacatatgagctaagaaacgtgggagaatttcccacgattaattcctgtacacttcacctccccatggggtatgttcacaacacaattcaatctcttgccatgcacttttgtgccatgccccacactgagtcagcacagtgggcagtttcagtatttctggccatttcgacatcaggagggctggcaatgatttactagtaagtgactgtaaacataaatgataatcctaccaaaaccaagctaaatgtatccccagttcaacttctccttagccagagccaaaactggcaatgacgaatccaccacccttaaacagagaaaaactgataaagcaaatggccgagtggaaaaagatagcaaccttaaccaattgtggaaaaaaaattctcacttttgcaaataaaaaaacccagaaaacaaaacacatgtgaacaccctccgggagcccctcccagaacttggaaggggctgtgcaagtgaggaaagtgaggaactgatgaagctgtggtttgattagcctctgttcagcggaagtgaaggacatcagcttttccttgaaaaactgagacagatcaagctctttgtggaataagaaaaacaaggcatggaaaggttacataacttcccagtctcatagccagtaaagtgtacaggtaaagttgaactcaggaagcctgaatgctgccttcacactttttaccagtgtgctacacagactgccataggagtaagcttgagattgtgcatgtgtgtgtgcaggcatatgtgtacatgtgcaggtatacatgtatgtgtgtgtgtgcatgtgtatgtacctggcagagaggaaaggaaagaagtgttctgtgatcaatcttcatatggagttgacttttttgagttcttgtttgttctccttgattacagttagagtctttaggaataaaattgggtcatagagttgattttaaagtaccataaggagcagttgtgctactcgaaatacagtttgactctgtcgtggttgcaaagccaatctcaaagcatttcccccagaatgctgtttattagtttaaaacccctatgatcaggatattaaaaaaaaaacaagaaagataatctaactcatgatggcttctctatccatttaattgcggttagcagtacatttatccaaccgcttttcaggtctatgcgcatgtttctcagtggtgctgtcttagccattgaagggtttaaagagcactgaagaaaaagtcaggagaactggccttaggtcccattttcacaattattccatctttgacactttggacaactccagctcctatccccgtcttggtctcattttcctcaacagggtaagtgattttacagctgttccaatgttctatgatctataaagcataaagtctctattttctactttaaaccacaaatcagaaagctttagaagaacattccaggctgtgaagttgggggaatattctgggtttatctcagatctttttcatttagtgcaacactagttttttttaaaaaaacttcatttctttgactgctaaatgaagaatgaatttgtaattactgctaaaggaaatacagtgaaaattttaattctgaaattgaaaactacttaaaagagacaggagagcttagcaaaagcctctaaaagagcctggccatctggcttcttactcccaggactgctcactgtgataatccccaggcttggtgatgtcctgaacttgcaagtttcgggaagttggcgatccattttgaccatgtggtatcacagataatgtactggaaacccaatttctggtcccagaacagcattgttcggccagcaggctatacatgagcctcctgggccttacttttctcctctgtacctagtaacttccttaggtctttctctctcagaaattctgttttctaaaaggcaagttactctgaaggatgaaacagctttgcttttctgataaagtatatcaagcctaaatcaaaataagcatttcttctcctgttcttctgtttgggctctgaggatacaatctgcttctgtcgttttcccagtgcagagtaattttcaatgtgttaccatgctaagccttgttatcacattttcagaagcataaatgataaataacatttgcttaaccagcttttacaattccctggcatttttaaaaagaatatttattttgaagaatattttttgaaacaacacaatttgaggaaaccaacacaccacagcgaatacgtctacttctctcagttagcccaagcaattctcaaagttttctcctcgtctttattgaacactcacttcacgccaggcctcgtgctaggggttggagctctgaaggaaacagaagaacgtgacctcaggacaatactgtcatagtccatgtctacaagaagctcactcccattgtagatggtgatcccacttaaattaataaagatgagaagcctcctgggccaaaaattagatactttgttgtagagcagtaccataccagagaggaacattcaccttcctttgcgcctagctttgcctctgggatacagtggtactgagaatcagagcttactgctgtaaattaggggttctcaaatagtcatacacagcagaatcaagtggagggcttagtaaaacacggatcgctgggccttacttccagatttccaattcaaaaggagtcaagagattttagtactagtgagctcctgggtgctgccgatgctgctgatgtggggcccacaattggaaaacctccgttgtaaacgagcaatcatgaataagctaatttgtctggagcaaggctttgacttcggtagttttacaaagctctccaggtgtttctaaggtgtatccaggctggacagccactgggttagattgcacaatgtcagtttcccaaaataactgcatgttcaagatacttttaagattatacatgtttctgagtagcctgtctgatcaacaatttcttgccctgtagattgaaattctaggtgaagttatgcttaaggtggcattcccagaaaaaactagaacgcatcccccttttttgggtagctgactatacgcaaactgctgtctcccaacacagactgtgttccagtgctggagaacacaaaggtgggaagatatgaaaggacacaaagattaatgtatgaaattatctacgtaaaaaatttcttgagtgctcactctatgctgtgccaagaaactcaggcttttctttctaaaaattagaggctatggaggtgtttaaggacgagagtgatatagtctgaattgcatcttatgaatgaatagtgtataattccttaaaaggtcttgcagcaagagaagccgggtagaaggggcatagttaagtaagcacaggggagcagggagaactctgggaaaatggaggaaataaaaggctagcgactagaggaagtgcctgtgataggattgcagactacaaaaaaatactaacaataccactctcaaaatcattaggaaaatagaaatactatcatctttgttaaagaagttcatcaaatacaaggagctaacaaaaaatgctatttgtgtagagaactagttgagaggtagcatcgccttttagccagaaggtttaaggaagtcagtggaatgtgtaagagtgagcaaactggccaggcgccgtggctcacgcctgtaatcccagcactttgggaggtcaaggtgggtggatcacaaggtcaggagttcaaaaccagcctgaccaagatggtgaaaccccatctctactaaaaatacaaaccattagccgggtgtggtggtgggtgcctgtaatcccacctactcaggaagctgaggcagagaactgcttgaacccaggaggcggaggttgcagtgagccaagatcacaccactgcactccagcctgggcgacaaagcaagactccatctcaaaaaacaacaacaacaaaacaaacaaacaaaaaaaaaaacagtgagcaaattacttgctagtaacccccagttccaaatctattccttcagtctctttgtaatctggaagctttattggagaatccctctcacttaaagtctccagcttccttgggcatcagggcctgcctcctactctttgcccactcccttgtatagcttcatttcctgcctctccttccttcttttgtccctgaataaacgtgttctctgaattctgttcttctttggcagtcatatcccctcaactgactaaaaaagtcctttctatagtgatgaatccaacttttttcctcgaacatctgcaaatatactgagcttgagtctctcattttcaattgccttttgtacatattttacaagttaccaaccacatagacacctgaaactgaaggatatgattttactcattttcacccgttgatgagatcctattgtcctttaaaaaatctcacatgtgctataaaagcatctctgattctaactgagtattattcccacctttggttcttcttccttcctctaactttacaacgatagctcatgaccctctactcttacctctcatccagatgttaaaatcattaagaacaaagagtatgcagtgtttgcatgtgtgagacttaaggcttgcacttatcatcttttaaattaattggagaaggtataaatggatacaaaagtctgatgttaagccttctggaaacttatagccaatctagaagaagccatcttcagggatgcaggaaaatagatttggctcctcttatccagtccagaggcagaactaaggattcctgctcttcgtatttcctggtgccagtgcagtgaaatcactaattaataagcctctttctgcttcagcctctgaagggtaaaagccagggaagggtacccagacaggagaccaggtttgctgctgtaatcaggcagactccactaaggaaggaaacattcatgtcaaagattgatgatttgtgagtattccaataacaacgtttgtgcttgaccagtaggagtggagtcttttggtgtgaccaagaaagtcagtttgcatgcgcttcaacatgtcaaagcctcttagtctctcaggctctctggctttacaaagccccccggtttcaaaagaactgaaacagaacaggttggcttgagagaagcacctctacagggctgaatgtaaaacaagagtttctatgtgggagtcatgaagtgtgggtaagcccccaccttgtcctgaactgcaacgctaactctatggacctagttgcatatactggtttgcagtttgcagcgggtctctgaaaattacccaagacattgtatcaccaacatgagatcgactgcctttttcacattcttatggaatattacaaaaggcaatcagattcagatttaagtcaaagactcaagcaggaatttaaaattgcctaaagcttttattaaaatagtaactttgtttactacaatggccccttcagaaattcactgacctagcctttattctctcctgtcaacctacattctgacactatcagtattctttatatagattttagagcatctactggtaattcatcccaatatttctttatgtccaacacaatgcagagctcttttacccatcctcaggggagctgaaaagaacatcaaacttttctccatgtaatgcaactcctataaaggtccttttaaagccacaccttaatcttcccttcctagaatcagaatcgtcccatttttcttggatcaatcattcaacaaatacttagcagtttccttctatgtgctgagcatttcactggcttggggatacaatggtgagcaaaagcagacctggttcttgcctcaactgagcttacaatctagtggtgggagagacaggtgggaataaatcatgtaagttaaatgggaaattgcatctgtgagccagagaggtacatgttgtataaaagcataacatggccaggcgtggtggctcacgcctgtaatcccagcactttgggaggccaaggtgggtgaatcacaaggtcaggagttcaagaccagcctggcaaagatggtgaaaccccgtctctactaaaaatacaaaaaatttagccgggtgtggtggtgggcgcctgtaatcccagctacttgggaggctgaggcagagaactgcttgaacccgggaggcagaggctgcagtgagctgagatcgcgccactgcattccagcctaggtgacagagcaagactccatatggaaaaaaaaaaaaaaaagcataatataaggagaggaaagtcaggggagctttatggaagaagtaaatgttgaattgaggtccaggggctgagtggaggtacccaggtgaatactttttcaggtattgggaacagcatgtaggaagactgccatgtgaaagagtgtaaaggataagaggaagttatttttcaaagactggaaaaaaatggtctttgtagaccattaaaaacaatttttatttgttataagagcaacaggaaatctattgaatggttttgcagaattagtgagataaatgaaaaacactgcattttgaaaacgtcactctgactgtggtctgggaaattttcaagcaaagggagcatttagcacagaagggtggacgggagtattttccagcagctcaggtgaaagacacaagacaacagcggtggcagtggggcaatcagtgattagtcagatgggatttgggggagagcaacaatgtgtcaacgtttctggaataaatgtatagtgtgataccatccacggaatgtagcgatactgccaacagacacactgtgagcaataaaatcatacatttgaattttgatgtgttgagcttcacgattttccttcactaaccctccgctttttcctagctacaaggatatcaggcgacatctcttaaaatcttgttttgcagatggtaagaggttttcacacatctgccacatttgaaaacctaactctctttactcttctaagacatattaatcactcaacaaattgaaagtaaaacaattgatgccctatgtgtcagccacacaatctaactcttcagtccctgtaagcatcccatgaggctggtaacttttctctgtcccatcatatataccaatctggtgatgacacttaacttgcagttttacttacattttaaaggatatagaatttctctccaagttgagtgcaagctcaatgacagcaggaaccccatcttacattgtagaaaatgctctaggataaaggacttcaatctgataaattaaatactgttcatttcccaatccctaacactgttttgggcaccggcaatggtttatggcataataaaaagagacttattttgtggagttgagtcctaatgccagtattgccacttaactagctacgtaaaactgggcaaattatttcactttcttgggcttcaactgcctccattataaatattgaagattcagtgaaatgagatagtatactttaaagcaacagcattcatcacagaaattaggacagctttccttatctttttctgagtaaatgttggataaataaaggcatgagcaaatgaatctttgactgggggaatctgagggaggatttagccagtagaaaaagtattagttaggtagtcatgaaaccagggttctagccccagttcagccactgactctctgatctggggtcagcctcttctccttctgtgcctcagtttccttccctgtaacgcctctcccagtgatgttgcacgtttttttctgacatcctattgtcacagcctagacccagggagccacagaaagaacctctttactcaattatttgaggatgaagaaagaagcaataaactgaaagcactgttcatttccagtatgaaaagactccttcaaatgagaaacgtcagcacttagtttcacccctaagattgtctggattattttcttcttgtccaagagatagcaagagaaattccactttaggaaacacaattgtttaacaagtgagtccttagcaattctaaggccagaatcttgtgagcagatacggaaaggtaccaattacctctcaaagactggcctggtttcccagtgaacaatttcatccattacagaattttcctgtttgtaatcccaaggtccatacttgtaccagaattttactctctaggttagatgaactcattatagcttaagtttcccttagaacgacaataataaaactgctattgctgctgactcactttaatgccaacaattgtacatacattttagaagcctaattttgatttacagtaactatatagatcaaaattagagcattgttgagtgagactttcttttgcccacaggacgaccaactagagacagaggacagaggacctgtagtgcaaaataaactgccagaggtgaatgattcaaagaagtctgtgacatgacccttgtattcaagctcagtgggcagggaacacatgtctcttgttcacctctgtatgtctgtgcattcattgggctgatatatatccagtgtttactacactgcattgcgcactgactatatagtgaaaaacaatggtttgtggatgaaagctgcttccagtatagcactgggcttggcacagtatggacatctactgattattaattgaataaatgcatgagacaattaagtgaaatcagcaatattataaaagaaaagataatagactcaagacagactaagatgttggtgagtctagttggattctataagttttaggtgccagagggaaaagaatctgaagatgcccaaacaagttacagatgtactgtctatctgggacagagaaaagaagtcaagattacacacatgtttttctttggagagaagatgataaagaaatgtgaatatcatcacactggtgtatgtaatcaattctgaattaaccttcagtaaacccaaaatctcagtatttacatgaattcttttattcagatggtaccaaaataatgctgcctggtaactgagatgagccctagctaaagaacctgttattgttttcagatagagaaatgggagccacatgtattctatctttttttttttttttttgagacagagtctcattctgtcacccaggatggagtgcagtggcgcagtctcggctcactgcaacctccgccctccgagttcaagcgattctcctgcctcagcctccctagtagctgggattacaggtgcctgccaccatgcccggctaattttttgtatttttagtagagacggggtttcaccatcttggccaggctggtcttgaactcctgacctcatgatccactttgcctcaacctcctaaagtgctgagattacaggcgtgagtcaccgtgcccggccgtgtcttccatctttattaacaagatctttgattaagctgaaagaaggagttttatttgggaagactggatttcagttgatacaacacagagaaattcagacattttcaagcatatccatcctctttggaaaatacgtaaacatcatagtattcagagataaccttaagtgaggttttcactgctttgtacaattgtgtcactgtagctcctatatccacaactgagttgtgatagaatggaatattcttttctgctcttacatacagattttaaatgtggataataatatagaagatagatattttataaaaatataaataacttaagtattgcaggacagtagtaataagtagggctggaaaggttgttggagagctttgaatacctaggttagtatttaactgtatctttcaggccattgaagattttgaaaagcagttgcaacataatcagcattctgcttcaaaacttacagctaataattttgttttggctcaatatttaaaataacatttcggttaagacctgagttcaaaatgtctctcaatataccttataagttatgaaaacaagcaaaaaaatttaaagatgatttccagctcagcaaaatctgcattttcatttggactttgctttacccttttcacaattatttatttgcttcacacaaaataagccaggatggaaattccccatcatggtcaagttctgctccatgatgcacacacaaggttctgtagcttatgggaaccaggagaatagcaggtggggcaggtagcaacaagagagctcaaacagagtggctgagaagcactggcgctgcaaggtgcaatgctggcccaatgtcaggcactgggcttatccaggacttacagacctcctctcaactcaggaccatggattctcagagttccggaagtccctatagtgccataataaagtaataattcttcaccaaaccacagacatttgcatggactttaacgagttgattgtgaggaagaaataggaaaatgaccatcagtctggccgccttgagttccgtagccaagccctaaaaccaacgcccagcctgccacagtgtgtgacatcacccatatcccctccagttctctccggtctgaccttgacagctgaccttgaaaaaaggagaagaaagatttgagctcactttttttcaaacctgaattcatcatccgccacaatttccttctctcttcacaccttccaacatttcccattcagtaggtttattagaaggattccatgcttttgactcagccctctttgtttgttccttttgtctttttttttatcttgcctttctgtgaaactgtctttgtttcttctagttagccaattgatcctaacattgcttctggaacaagataatgtgaccttcagcattagacaagactggaaccagtggggaaaaaagcagagtatattgtcattctatgttctaagaataattcaaacaagcctatgccataatgctgacaggatctccccagattctctcagcttctagacaccatcacagccctgcttgctacgcacaggaggccaggagtggtgggcgagcgccacctcgtggacatgagggaaattgcttccctctgcgaattagactgtgtttcggcttagctctcaaaacacgtttaagagaattgtatttttaaatggcttgaacaccttccagtcagtgaagcgaagcctgaattcatgaattctctatcttagggattctctgagtagcaggagaaatatctgtacggtgaatccgtcctcaggtaaaatttaaggtgaaggacaacagtagcttcgcttctttaaataaaagatttgtaacagaaatttaaagaaagaaaaaagagcactaattatgcagattgcattcaagttaaaatttacatagtatctgggcagtaaattccaccatgctttaaagcagagcactaattactactcttccattaaatctttcctgaagaatctcttctatctttgaaactaccatccattttgcaaaaacaagttaccttttcatatttaacaccagcaattcacagaggagtgtgatttatagacatttgcattgaaataacctatacttttttgttgtaagtgcagcttcttaggccctacccaacatcaactgaattagaatttctggggctgaatcccaggaaggggcatttgaggttagcatctagttgattctcttgcacactgtgcgctccagttagagaccccactgctttcttcattgaatccaggaattaagcaatttaggaatagaattgccattgttcttgcaaattacactattactagttttttatagcccagcttcctagagcatctcatctagaaagctttcccaatttattctagaaaattcaaacagatgccttttcctgagtccttcaccccaagaacatccttatccaggggtcgttttactccaccttcctattttagctcatcagagatccatatcttcacctagaaattctgaaaggtgggggtctctcacgcttctctttccatgggctttcagaatacatgcagcagcgttttgcacgtggcaaggtttaaagagttcatcccaaactcttatgagtttgctcttggaatcctatggattcaaataattagccaagcaaaaagattggcagcacggccaccagaaaacaaacctcccaccttccctaaagtggcagaacagctgccaccagtagaacagagttgttcctctcctctgccactcaggcaccgtgactgcagagttatccagacacaccaatcattttgcaactgcttggctctctgcagtgccccaggaattctaagcaacaaaggagacagtcatctgttccacagcctagcaattgtgtcattaaacaaattgctccataacgtcaaaagaggcattctttgtgacagccaagtgatataatttgtcttgattccagacatgggagacatctgtctcgaattcatgcctgtcatttgaagttgcaagtttatctacagaaaagtgagactatacccagacactgaacagaaatataaacattaagtgactacttaaaaagctatagttttacccttttagcacaaatacagggaaattctttctaaactatatggctgtataccaagtgaaaaacatagattggtattctctcaacaaaactgctttcagaatcggcaattcagtttgcctgaactgttggaacataacaatagatgcaggttaaacacacagttcatttagctcaacacatccgtttctaacagtgatgtatcacggaagcattaaattaagcaaatgctcgttgagcaccaagttatgcaatgaaccattagatgctatggaattaaaagaatgacaacatgtatcaaattgggcaattcacagatggcctcgtagaagttctgcttcccgtgggtctttaaagatgcatagtctgacagtagtcagcaaacagagatggtctttcctttctactcctctccattgtctttccagtgaggtcagcatctacatgtgtaacgcatccagcaccagccgtcagaccaccggcatcctcaccttgaataatattttcctccatcctgcctcacaactcgcatccaaggcaaacatggacatacaccacctctgaaatcttcatctgaaacatccaactctgactcacctccctcctgtcctacagtattttcttccaccacttcccaacaattcctcagtcttcctgagatccctaatccttcgttctcactcccgtccaccatcacgtgtcctgtccttttacatttggcagatttctattcatctttttagtctttgcttaaacaaaactttagcagcaataatactgcacctttagattggatgtgatctcccttgtagataaactttcctaatactcttaattttttcccatcttcaacctaatcagtctttaagacaatcgcttatttattgtcttccccagtagaggaaatagtaatcaagggaaaggaaatcacagccactcatttgttgctgtgttcctagagtgcttggctgataaccgatgcttgaaaactgtttaatgaattaacaacaacaaaagagaaaacccaatttgctcaaggcacagggaatatttgtagaaggagggagaatccaggatacagactcagattggtgccattttctagagtacttgagcattaggtaatgggaaacattggggtctttaaagatgaagacgctctccaaatactcattttttttcaataattagtacagctgattattaaaagtgtttatacgtttattgcaggaaatctgaaaaaacttagtgaagtaaaaagaaaaatcacccatttctgtagtactgctaacatttgatgcatttttttctacaaattttctagacatttggtttacatagtggcaataatacagtgcattcagacttggactctaatctgtttcctctcaacgctgtaacctaagcactcttttctcatcacgtaaaattttttagtaaacttacgtaatgactacttaacattaaatcattttaccattacacagtatacttatcattttcccatttttaaaaacttaagttttacccataaatgttttattgaaaatattacatagatcaagcacacaaatcttttctctatgaaactgacaaatgtctactcttacatagctaccacgcagatcaagtatttgacacagcagcatcccaaagtctcctatatgtcccttctcaggcaatacccccaaaggtaattatcattctgacttttagcaccataaattcgtttcgccagtttctgaacttcacagccctttttgcctgacttctttcgcccaatgttatgtctttgaaattcatccaagcttttgtataagtagtttattcattttcatttcttcaaagtattttcatatatatatgtgtgtatacacatacacatataagcacacatttatatgtactacactccatccaagccacggaaggacacttgggttatttctaccttgcagctattaaattcagttcctgttattagccatgcttcagtctagtcatactgttagcataaaacacctcttaatgaaatgagctgcagaaatctaccaaggatgtggaaaactgttttcttttgaacatgccttagttgttctgcactctgcaaaaaattcattttctgatgttagagctagacaaccaactctaaatcaatttctgcttatctattatttactcctagtgtcaaatgtgtgagttattgaaaagcaactaaatataaaagaaaaacatccccctgaaaattgggagggaggggtaacaatataccagaactgtaagcaggacagagacatgaaaggtccaaagcaaatatgcattttgcccaagtgacggcactttgacagtatactaggcttgagtgatactatgcttcaattctaagttagaggcacaggttgtagaatctgaaaaacctggaactgattcctggattatttccttctgtatggtcttagaaaactactttacctcagctcctcattttaaaaacagggccagtaatataaatatcagcatgagtaaatgtattctggcatatcattagatttcaataaatattattttttatactgatgaatggccaccaatatgccatacagtttagcttagaagacccaaataagtttaaattcaggtgcaatatttcccaaatataatcttaaaataaattccctaaaaacaagaacagcagacttgctgcagcagaatcagtctgatccaactctggcactgtacatttatgtcagtatcatgtttaattacagtgaatcataactatagcaacagtatatttttgtattctgttttagtgtacacaaaggcttttaaaatcaaatctcattcagtccttccgatacctgcggggatctgtcccttcctctatgcaagttatcaatttattgtgtctcagttcaaatccatccttcattacctacttggcaacaatggccttgaaccctttaagtctctgttctttgcagcaaacacaatattaagctttgtcactagagggtgctggaggaagtggtttctctccctgcttccagtttacttctatattgattttcttgttatttgttttggatggccgtcagcagctaatttgtgaggggaatactcacaaattgtggtgctcacagacccagaatgtgaagccccttggtaagcttgcgtccccagtttcagctcagtgatcatcttgccatggatctcccaatgtggacaccatgcatcccaggttccacagcaccctgctgtcgggtaagctcctgtgcacctgccagggctcacttcctgcagggcttatgcattcttaagcattggacccctctagaatgcagtttctccaacgccccattcctacagacgaaggcttctctatcccttggttcttgtagcatctggtgaccaacagtgcccagcagaaaacggttgcacccagcactgactctggcaactctgcagcaaggcttgagggcaacacctccctatggattgcttttctgtaccccagaaggcaggtttccagcaagtctcagaagtgaggcactttgatgacttttcaataattcataatcagccatgggcatgccctctccaagggagtctggatctcagcctgaggtggggttagagggctcctccttgacactgtatctcagccttatgacagcagctgatatttatatatactattgctgcatcctatagaattctttgtacttcttactagccaattttctgttacttcaatccacattacaatgaataattcttatattaaactctcacttttcaaattactgtgaggtttctgtctcctgagttgaccacaattgatacaccatctttcaagatgatgaaatccaagagtagcagagacaaagccaagaccaaaaccaagaccttctaaatctaaaaatcccatttttcccactgcaccaagataccctttccaggaataaaaactactggagaagaagggaagaaacacctaatataataaaataacctcagtgtcattttatagcaatctccttccaactcattttcttagagactcaaagacaaaagcatcatatcatactatgtaccaaaccaggactacccattacacagaaataggtctgcagatccttttaaggagcaaaaagtggagactgacaatatatccaattttaatcatgtagcaaatttgggaagccaccagtaatactaaacatagatagaaccgaacataggataccaaataaaactcaacacaggatactgagtagattaacatcctaacttttgatgaaataaactatacaattacaatgaccacagtgttatcaggcattcatgttatgattcatccaaataaacaaaactgaacaaaaagatgctttactctttataatcatcaagagtcattcacttagtatagaaagagaagttggcacctaatattagaatctgaataaaaatgtaacagtttcatggattaagaatccacagtaccaatctggccaccatctttgatcaatttctgatagtgaagagatcatttagcctccgtatctaattgtcaaatttaaaatagagtggaaaataccaaactatgtgtcaatcctatacttatttcagttgccagaacccttttccaaagcatttccattggttacagcttcctgtatatgttcaacacacctcagcacctttgtgtgacactcatttccaatatcacctcagtcatgaagctttggctagtctccactaacaaaatgaaaagtgatttctccaacactggaagcctcatagaatgatctgtgcttctcttatcatgatctgtgctctactttgtatggtgactacatatgtatcttccttggtctcttggagctgtaagttactctgggacaagaattactttattgatatgatttttacccaaagtgtaaacacaatggtttctgcattgacagtgcccaatgatagatatttatcacttcataacaatttctcaggttaactcagtaggtataaagaatgatcaggagtagaatccaagtctcctgactttccaacactctctttgttctatgccattgtaagtatcaagagacaagatttaaagacagctgaaagaatgggagaactgtgagaattaccagtctgacagcataaaatacattgttcttgacaacaggaaaattgtaaaaggcttgctatggccaaaccatgagaactgaaaccagcctactgtaccaggaacttatttgatgtcattatgactattgagcaggaggttgccatattaaaagataagtttgtgatgattagtagacccttaggtatttaatggactaaagataagtcatgttgagggtttaggagatcactaaagttaaaaaactactaaaagtcccagacacaatgaatatgtcaagacctggtaaatatcacatatatttaggattttgcacttaacagttttcttcttaacaatttgtttctaagattcacctatgtagtaatgcatagctgtagttaatttatttcatggctgtataatagcccattgtgtgaatttgctaaaatttatttatgcattccgctactgacggaacctgggtaaagactggtgctaggctaaacattgctgctataaacattcttacatgtgtctcctggtgatgcgtaaagagttttagctagaatgtttgccttaaagtagaatagataattatggagtattcacattttcagcattaatagatttttttttcttttccttgcctgtttgctttggtaaggatcgccagtgcaatattgaatagaagtaatgaaaatggatatctttgccgtattcccaattatagcagaaaagcatcgatatttaaccattcactttgaggtaagctataggtttttttggtacatattttctatcaaattgagaaagatccttatatttctcagttgctaggagatttttttgtgaatgggtgtttaattttgttaaatgtttttattctgtatttgttgagttgaccatgtgaattttaacctttattctgttaatatgctgaattgcatagattggtgagtttttaatgataaaccaaacttcttttctaaggacaaactccacttagccataatttattctccttttgatacattaatggatttgatttgtcagtgttttattatggattttttgtggctctgtgttacgtgctatagtctctactaattttcttaagtatttttgtcaagttttagtaacagggttctattggtctcatgatatgaggctgaaattgcttcctcttctacttcctgaaaaattacaggtcatatttgaaagataattttgttgagttcaaaattctattttatgctgcattggccaactccagggaacactacacaaactaaatcctatgtgaatcacacccctctggagttgttcagtgcacagcctatgtggctccactcagcatccttgtccgtgattgtgtcaaaatgtggacagtattgctccggtctttcagcttccattttttagaagtcttctctttacctaattattgttcccttgcagatgatcagtcttttctctctagctgctcctaagatctctttttctttggtgttctaaaacttcactatactttctttgacattcaaatattttattgtatatacatgcatattttttattaacctacctaatgtgcctgtttctttgtgtatctatgatgcgtatctttccataattccagacaattttcagttacttgttttctcaactgcctttgtcctttcgttctgggactccagttggatctagcttagatatttattgtgtcctccatatcagttaacttttctttcatattttctaccttccttctctgcattattatgacctgggtaatcacttcatatatgtctcccttttcatttattctttcttttagctgtgtctgatatacttccaaaccatctattgggtttttaatttcaattatatctttcacttttaaaagttgtatttgattcttttgggaaactaatttgatcacatttgaaaatcttttgttccttctatatctaaacttataaattttacttttaaaatattttatacatagctctgtattattctgaaactgaccattctaatatatgaagttcttggttcttgaagggtcattaagaatgcccccccctttttaaaaaaaaaatttggagagtttggtcacatttaacttcaaggtcatatctgattctatctaatatctttacattctgaggatctatttgtctcctagggaactgaattccaaaatggaagtaaaaacactttaattctttaaggtattattagaaaatgattaactatgtttgctttccttcagagaatatttgcattttttttgtcaggatttagtactgatctgtgatcacttttgcttgttttattgggggatgaggggatgtctcttgcttggcttgggctcagctctcctagcatgaagacccatgggattagtctcccaatttcacgctcatattgatctttgccttgatcagttagttagcaaaatccatttgtttaaatcaaatttaactaatctgggtttaaactttatttctctataaacttgaagtatttttaataagtataatatctatgtaaataatacatatttaggaccaaagatatttctttctctccatgcaatacttttggtctattatttcctttctaatcaaaatttggcaaaaagttaaagatgtatatctacatttctctccttttttttttgttttgttttttgagatggagtctagctctgtcgcccaggctgcagtgcagtgacgcaatcttggctcactgcagcctccacctcccaggttcaagcgattctcctgcctcagcctcctgagtagctgggactataggtgcgtgccaccatgcctggttaatttttttgtattttagtagagatggggtctcaccgtgttagccagaatggtctcaatctcctgacctcgtgatccacccacctcggcctcccaaagtgctgggatttcaggcatgagccactgcgccagcctacatctctcttaacaagaaaggcctgcatgttctatttccacagtccttatcaaaaacacaaagattttcctgtttcgtcagcagaataaaatgaacatggggagtgtctggtacaaatacagtctagaaatgttatgcactcaaaaagagagatacttctaaaataaggaaaaataattgaaaagtacaaggagaaaaaaaaattcaggaataaaaggcttacttcataaacctaaaaagggcttaaaccttgtagtctgataaacatggtgcaaggagagaaacacagcaaggtgtcaaaggcatacttctcagactacatagttccagcccttttcacacggcaaagaaagttttagaaaatgacaaaggacacaaaaccattagcgataatttcaccaaaaatttaaaatgatactgattgttaattactacagatctgaggagaaaaaggtgtcacactagagaacaggccaggtgacacattcagaagatgtctggtacataaccagacaatcaattgtgagctcaacaataagacggacattacaaggctcaacatctattctggatgtctgtgggcttggacatctcagtttttacaatatttccactttctctaataattattttaattattaatttcaaatggggagaatacttttttaaaaaactcccccaattctcaatgtattttctcttactggtgagaaatttacttttactgaacttctaacatcaaagctaagccataagacttattgcttggaaaagagtgggcaattacttcctaaaattaaaagcctatagagttggaaagaagaataatatgatgtacagaaagtttccaccacataaaatgcagacatagaaactctttggaggagaaatactgtttcggagaggggacaagaagaggatcaaaagctctctgagcctcttaggtttctgatgactctgtcactctagttctcaactcagatggggtgatgacaagaagattgaaactcttgatcaggaagaaactgagagtacagaagcctttggacccaaatcttatgtggaattctgggaagagaaatagttgcaaggaaactctgcatcaacatggtgtacctacagcagaatagaaatgataacatcatatatttagacagagagatggtcagggctggccccttctgcacacaggatctctttaatctctacacagtttattgtgtttatgggattagatgcaatgataacattttataacttttttatttaacattatatgctaaatataaacatacgtgttgttataaactttttataacattatcaataactgaataatattccaatgatttgctctaatgcacttagtctttaccatgcttctgcatatttagatggctttaagtttctatcataaataattctaagattttctgcagaatattagtagatgtaactgagaatatgttcagaataaccacacgcctccatgataccaaatgtcaacagttccattggtccctcaaacacaattccacatacatgcattaaaaatcataaagatgaaaacatacttcacacagttcatgggatgctcaagacagaagcaaagtggttaataagtggggccttgcagaggtggtcccctaaagccagtaactggtcttttgggtccataatatgttatcaactcaacctgactcacattacctaaactctgaaaagatgattgatacattaggtatcactattctgggtatatgacaaaatatgagagatgataaaaacatggtaatgtctattacattttcacaatttatgaagaatacaagagaaaatatttgaaatgtaattatgctctaaaattcgaaatgtattgttatgttttagacctacacagttatcaaaaatttctttctactttcaggattatgtataaaagaaactggaaaaccaaatttgttatgccactgaccaaacttggaattaagaggcagaggtcatctgagacttagagatatcttagcccaaagcctgctgtcaagcaggctagagaatggagtttcattgcaattagatagttttgaatacctcattaaaaatactttccaaagattaatcttttttattataaatgtgatacaggcttattgtagaaaaaaattgatgaatacatttttaaaataagtgaaatgatctaatttgattctttaagttattttaaaatctcatttaccccataaatgtatactcctaatacgtatccacaaaaatttttaaaaataatttaaaagttaaaaaaatgaaatgacttaaataccaccacctagaacattttatgtatgaactctttgcagataaggactgcaaggtaagaattacaccctgcagggtttagctatatagatgtttagtaaatatcttggagactcagttcaaccatactgcagtgaatagaggtagtactatgagaatgtatgattcctatacactcaaaagctaggcactctcttctagattataacataaatccacacatgcagtgatatggtttggctgtgtccctacccaaatctcatcttgaattatactcccataattcccatgtgttgtgggagggacccagtgggaaataatttgaatcatgggggcagtttcccccatactgttcccgtggtagggaataagtctcatgagatctgttggttttatcaggggtttccgcttttgcatcttccccattttctcttgccactggcatgtaagaagtacctttcacctcccaccatgattctgaggcctccccagccatgtagaactgtaagtccaactaaacctcttttacttcccagtctcagctatgtctttatcagcagtgtgaaaatgtgctaatacagtaaattggtaccagtagagtggggtgttgctgaaaagatacccaaaatgtggaagtgactttggaactgggtaacaggcagaggctggaacactttgtagggttcagaagaagacaggaaaatgtggaaaagtttggaacctcctagagacttgttgaatggttttgactacaatgctgatagtgatatgaacaataaggtccaggctgagatggtctcagatggagatgaggaacttgttgggaactggaacaaaggtgactcttgctacattttagcaaagagactggtggcattttgcccccatcctagaaatttgtggaactttgaacttgagagagatgatttaggtatctggcggaagaaatttttaaacagcaaaagcgttcaaaaggtgacttgggcactgttaaaagcatttcgttttaaaagggaaacagcataaaagtcagaaaatttgcagctgacgatgcaatagaaaataaatacccatttttgaggagaaattcaagctggctgcagaaatttgaataagtagcaaggagcctaatgttaatccccaagaccatggggaaaatgtctccaggccacgtcacagatcttcactgcagcccctctcatcacaggcctggaggccaaggagaaaaaagtggttttgtgggctgggcccagggtccctgtgctgtgtgcagctagagacttggtgccctctgtcgcagccactccaactgtggctaaaagtggccaacataaagcttgggctgtggcttcagagggtggaatccccaagccttggcagcttccatgtggtgttgagcctgcaggtgcacagaagtcaagaactgaggtttgggaatctctgtctagatttcagaagatgtatggaaacgcctggatgcccaggcgaaagtttgctgcagaggtggggccctcatgaagaacctctgcttgggaagtgcagaagggaaatgtggggtcggagtccccacacagagtccctactggggcactgcctagtagagctgtgagaagagggccaccctactccagaccccagaatggcagatctaccgacagcttgcactgtgtgcctggaaaagctgcagacactcaatgccagcccatgaaagcagccaggaaggggactgtaccctgcaaagtcacaggggcagagctgcccaagaccatggaaacccacctcttgcatcagtgtgacctggatgtgagacctggagtcaaaggaaatcaatttggaactttaaaatttgcctgcctcacaggtttttggacttgaatggagcctgtaacccctttgttttagccaatttttcccatttggaatggctgtatttacccaataactgtacccccactgtatctaggaaggaactagcttgcttttgattttacaggctcataggcagaagggatttgccttgtctcagataagactttggactgtggacttttgggttaatgctgaaatgagttaagactttgagggactgttgggaaggcacaattggttttaaaatttgaggacatgagatttggaggggccaggggtggaatgatatggtttcgctgtgtccccacccaaatctcatcttgaattgtatccccacaattcccacgtgttgtgggagggatccagtgggagataatttgaatcatggggcagtttctcctatgctgttcttgcagtagtgaataagtctaacgagatctaatgggtttatcaggggtttctgcttttgcctcttcctcattttctcttgccaccaccatgtaagaagtgcctttcacctcccaccatgattctgaggcctccccagctatgtgtaactgtgagtccaattaaacctctttttcttcccagtctagagtatgtctttatcagcaatgtgaaaacaggctaatacatgcagagacttcatcttgtctatttttgtaacataattcctagaattccatagcaattcagaattaaattatcaaatactggagttgctcgatttcaccaacttagttaagttagcaaacttctcatcagatctaaaaattgagcttcaattcttgttgtgaatgctaaataaaacggcaacaaaatttggcatttcctacatctgattctctttcatttcaaaagaattgcctggtatttaggagacataagttggtcaacttaaattgtttaactcgcatttgttatgatgctacattcaaaatgaaaggatttggaaaatgctgtgcagtaacaacattacaaaactgtgaatcttatttgattgcttccatgtctatggctacattcccatgggaaccagacattttaatcttttttgtcttcaaaaacaaggcatcattctgcatgagccttgtctttgggcacattgcatacattgattcaaatattaaagtggattaataatagaatcaaatttagaatggttgcatggtttccagaaggaaaaataaaatagttttgaagatgtatgtgctttaatctgactggttaaaatatggcattgcttatacttgtacaaccttttaagaaaaattcttaataatctgaaaagaaatctttcctgcatgtatgtttagtgtgtgtgtgtgtgtgtgtttgtgtgtgtgcgtgtgtgtgtgagagggagagaaggagacagaaggtgattcaacatccttcaaaaaaccctcattgagtacctttcatgtactgagagacatgttagacttttaagctacaaagatgatctagatcaatctagtcttcgagtcatgcaggatgaacagacataagtacatttacgatatggggataatgcaaatacttacaaagaagagttggtgggtgagaagaaaggtaaccaactctaccttgtgggaggggggagttagggaacactctgttgactgttagggacctaatgagaaagacaagcacaagatctcagtcataataggcaaagaaaatgtaaagcatgctccaaccttttcttccttgcctgaacttcttccttttccaaaagactcagctgaactaaccacttggatcacacaaattttattcctactcatgcttaagttcgggtaggaagagggagttttttctaaattcagaaacctgcctgagttctctgtctgagctttgcccacagcctcagagcggagctagaggaatggcagcgaagttcaggatgtccactgaaaaacagtggaatataaggctcatgtatcaggtctctgagaatcaactctgaaacaaatgtcacataagtgcctttaaacccgcaagcagagtacacgtgctctgcaaccagcaagcacaggctacagacgctttccgaatctcccctctgtagctccacactcacccctttacaaaacaaaaacaaacaacaacagcaacaacaaatatatacatatacacacacacacacatatatttatatatatatatatatatatatccactttgcatttacttgcatttagatagtgccttacagttggaaacttttttcttatatattatttaatttgctactttcaagagcactctaagctggttagggcaagaatcatggggcttagagagttaaaatgaatttctcacaatcactttaactgaactggagcaaaaagttaagcatttttaattcctatgtatttcctgccatacggtactgctaagtgtttgcacctttcttttttatccagagtacatatattcattaagcatgtggtatggctcacagtttgtgctaagtgatatgggggccagttttaaaatctataatccatgatctgtttcaagtaatgtttactcaatgtgataacctatataacatacaggacacattttttcacaggctgaagcttattcagaaaatgcaatcatttaacaatgggatttttgtaaatgaacattgtaaaacatttatttttgaataacaaatataccttgaattacactgggaggaacatgcttaaagacatgccaaaaaaatgatccacatgcacacctccagctcaaaacattcaggcttgagatcatcaaaaagaaagttaaacagaatcttcatggaacacatttgcctaatttataatgacaattgaaaatattggcactgtgatatcaaaaatggtgagcactatagaacatacccaaattaggttaaataccctaaagtaagagaagagtacaaaattcctgtgaaggattaatagtgactggaattccatcatatttataaggtaaattataaactagtatctatcaaatcctaatcagtatttttatctgatgtggtttttatttcttaatttaaagaaattttatgttctcattcctacaagctatataactgagattataactgaattcacttttcagttatctgaccctaaacagaagtatgtgtgtaagcagaagtgtggggaagatgttttttaaaaatcattattacttggccaggcacggtggctcatacctgtaatcccagcactttgtgaggccaaggcagggggatcatctgaggtcaggagtttgagaccagtctggccaacatgttgaaaccccgtctctactaaaaatacaaaaaattagccaggcatggtggtgcgtgcctgtaattccagctactcgggaggctgaggcaggagaatcgcttgaacccgggaggtggaggttgcagtgagctgagatcgcaccacggcactccagcctgggcaacaagagcgaaactctgtcacaagaaaaaaaaaaacacacattattacttaatgattattggatgataagaaaatgaatcaaataaaatatatggcttgtttcattttgaaatttaaaacatgtttttaaaactcactagtaataaagaaatgtatattaaaataataaaattaacaaacactgaaactattaagaatttctaatgtcaataaaacagtgggagtataaattcttctggacggagattattatggtttgagtataccctccaaaactcatgttgaaacttaatcttcaatgtggcagtattgagaggtgaggtctttaaatggtgagtgggtcttgagggctctgactcatgaatggattaatccattcatgcatttaatgggttatcatgggaaggaactggtggctctacatgaagaggaagagagatctgagttagtatggcaggatgctcagccccctggccatgtgataccctttgccacctcaagactctgtagagagtccctaccagcaagaaggtcctcagcaaatatgccccctcaattttggacttctcaatctccataagtgtaagaaataaatttattttctttataaattacctggttttaggtattctgttataaacaacagaaaatagactgacacagagttattggcaagttaagaactctcagatagttaagaaggcattaccaaggttctttaatatgacagttcactgagaggacattaggtacaaatgcccctaacttttgatttaaaagcctacagtagacttaatacattttaaaaaggactttatgtataaagtttcatatgataatgatatatattaattatacaaataactgatttataatgtaagaaatttaaatatgcagccatataagagaagcactctgtagaagctacacaactgtaatggcttacgaaaagctttcagggatattaaaaatatgatgtacgaagagtttgtggggatatgaaaccatgctcatgctattgtgtcaagtgaaaagagcaagctggaaaactgtagttataataaatccccaggtatagaggagggaaaataatatcaaaggcattagaaaggaacagaccaagctgttcaaagttgttactttagggtgatagaagattttgttgttggcagggtgcggtggctcatgcctataatcccagcactttgtggggctgaggcaggtggatcacttgaggccagaagttcgagaccagcctggacaacgtggcaaaaccccatttctactaaaaatacaaaaaattagccaggtgtggtggcacatacctgtagtcccagctgcttgggaggctgaggcaggagaatctcttgaacctgggaggcagaggttgcagtgagctgaggttgcaccaatgcactccagcctgggtgacagagtgagactctgtctcaaaaaaaaagttgttgttgtcgttgttcaaaggaattatcaaaatattatataataaaagacataccttgtttccatcaactggttatggttttatcttttggggatgaactcttcaagcttacctggccattcccaaaagttaacatcacatatcctatgagctgccagttgcacttaacagtcgtgcgttttgattcccaaaaaccacccgacaccttcccagcccagcacagtggctggcacctagatgggtgctttcggaactctgcttccagaagctctaggcatgacagggaatcatgtgaaaggatgatggaagagtaagagcttgtgggtaggatttagtcccttaactcacttaaatcagagtagctggtattcatctgttttgttctttttttaggttagtttctgtttttgtttttttaaattaagaacaaagctacctgcaaaacaacatgctttattatcgtccatactatgactcctgccagtgttcccaacccaaacccggctcactggtgaagctctccaaccttgccatactaccctcttttttctactcctactcttagatcagtggttctactcttgactacaaattagaggcacgtgagaagtttttaaaacacacaatgcctgggtccacccttagagattccaattacactgctcagggtggggcccagggatgagttttgttgttgctgctgttgctgtttttagtttcagtaggtctggggggaacatgtggtgtttggttacatggataagttctttagtggtgattttgtgagaatttggtgcacccatcacccaagcggtgtatactgtacccagtgggtagtcttgtatccctcacccccctcccacccttccccttgagcctccaaagtccgctgtctcattcttatgcctttacatccgcatagcttagttcccacttctaagtgagaacataggatgtttggttttctattccggagttacctcacttagaatagcggtctccatctccatccaagttgctgtgaatgccattatttcattcctttttagggctgagtagtattccatggtgtgtgtgtgtgtgtgtgtgtgtgtgtgtgtgtgtgtgtgtgtgtatgacattttctttatgcactcattgattgatgggcatttgggctggttccatatttttgcaattgctaattgtaatgacatgcatgtgcaagtctctttttcacataatgacttcttttcctctgagtagatacctagtagcaggattgctggaccgaatggcagaagtttcctttgggagaaggggctctgctttacacaactggattacagctttttcctgtggactggggaagggtagtgcaagcctgcctgaatgtgttaaaaacaggtgtggcaatagagacagtaggtgcagacacacctctgagaggtctggctgttaagaagaaaaatgccctagagctgaatgagcaaagctaaagcatcaagtggaggagaagttcctatctcattgtgatctgattttaatgagaaaaggcccccaaatatcccgtgctttcttattacagatcatgtatgttttaattaatataacacagtacaacttcaatttaacattatataatgatatttctgtgggtgtataataatgtaaattcctcactggcatctaaattggggcagattaaatcccaattatttgttaaaaacttatagaagaatttttaccttgcagaactttttcttaagttaaatgcaaattagctggttaataaggcaatataaaacttctctatgtttgagtccactgaagacttaacttttcaaagaaatagcctggcaacagtgaaatatttaaatttcttccaaaaatcccaaattccgaaacaccgtctaaaaatatacaatcaggtaaaagttgagaattaacatatggatataaggtgaatacatgaatttttaaaaccatattgataaaaataaacccaagacttgccctacactcagaatctgtagaaattatcttgactgtgcagaaaaaagttaagaaagtggaactgaggctgctgtctctagagtgtctgtcttgaaaggttggccctgggctggcgtctggaaacttggtcgatggagagttccctccattctctctctgataaagatggtttgctgtgcacagactgtctatacaaacaatgcgatttatgctgaatagctacttttcttaaattttgatagctgctaggcagagggtgcctacgtgactgtcgccctccccgacccccactcccaagtcaggtaatttccttgcatgctctgtctctaatgagcttcctgggaagaaacattgtatacatgttactgcgtttttttgctgctgaagaaaagagcaccctcagtgctccctcagaggagacagaaaacatcagaagcctccgcatgaatctctacagtctctgagtatcttttcccctattgatcctgttatatttcctttccctgcaataaacttcagtggatagtgcaactatgcttatgcattgcttaatgactggaagatgcatcatcaggcgatcgctactgtgagcattgtgcgatcaccacggagcatacgtacacaaacctagatggtgcagcctcctacatacctaggctatgtggcatagcctactgcttctaggctaccaacctgtacggcatgctactgcacttaacaccacagctgattgtaacagcagtaagtattagtgtatctaaacatatctaaacacagaaaacatacggtaaaaataaggtattataacattataggattaccatcatacaggcaagtctcttgttgactgtaatgctgttatgtcattcacatgacgatatctactaaatcctgtgagtatttccagcaaatcacagaatgtatgcgtggtcttcgagatcctcaggaaagcacttaaacacacacacacgcactcagagacaaaattaaacatgtaataaattcacacatatgcagtggctggcaccgagcacaacaggtatatacctctcaaatgtatttgctgtttgcatttaccaaagggtccctcctcagcagaagacgaaaggggttcctgagagctctccatatcattaacaaatttctttgtctcatctcaatttactccataattataaaaaagtaataagcatacttattgtgcttgcaggttaccaccaattttaccttaattttcttagttaatgttggcaaatttcctgtgaggaagctattcactagcatagatgaggaaatgggggacaagagaaagaaggtcaggggtctgatcaaggttaaattacttcacactcacagggtatggaagagttgaaatcagacccagttattaaaatccagagcccctggcttctcctcattataactagttccctcaaatgtggtttgtagacagacatttataccagcaaagaagttgcattagccctcagcgaaatgagaaaaaaaagtaatataatatcgccacatatttttagctatgttctgcctttttttagggttaaaatatccattttgttggaagatgatacaaacaatagataatggctcttcttatttataatttttaggttttttcttaattgtttgtaacatctgcatagagtaaatttaaaagaagacgaatctagagaggccctgtgcaaaaggttttagaattttttcagttattcaaattttgtagtattcgaatctttttcctatcatcatatatgtcggaaaattaatttcaactgcatgggcctgggttctgctcctaattctcccactgatcagtaagtagcacaaggcagttcactctccctctatgggcatcagtttccttattaacaaagggatcggcttaggtgaattctgagggatctcccacctccttagaggtctatgattctgtaaattcctgaatctgtttactcttttgttagtttcccagccttacagtacctagaattggccagatgatggcagcagagttctactttagccagactgtgcgccgaacaggtgagcgggacgcctagagcactgtgctgaagaggaaaacgtggaaggttatatggaattaccataattaagaaagaaatattcacaggttggctgcctctgacatgctatgtcaagaaacacagctacacttacagagaggaaggtctctgtttgtcttttaaaagaggactacatgattgtgaattcctagcaatagaagattcaggcccgttttaaagataaaaatactaggcacatgaagaaccactgaatgcccaatgcctccctgctaggaaatggcagagctcaaacttaaagacaggtcttctgactcccaggtcaatgtcctacacttaacatgtagcaaagctgtctcagagaacacatttgctttgacatctagaagaggctctaaaagaagtcttcagcggcaggcaccgagcacaacaggccatatacatctcaaatgtctttgctatttgcatttactaaagttcccctcctcggcagaggatgaaagggcgtggaccttggaccagggttcaccaaggacaccaatttccatggtacactcccgacagtggggaagtcctgacacggaaattcaaacagcccccttttgcatgaatacataagagacatggagttctatgactaaagagtgggtttcctgtctgatggtttcaatgacaatctttttggaaaaattgaaagatgagtagcattcctgtatatccttaatctagctccccttaatgttaacagttcacacaatcacagtacaattatccaaaccagcaaattaacactggtaccatagtaactaaactataggccttattcatagtttaccagatttcccactgatgtccatttgttatttcagaatcctatccaggatccaaattgcatttgttgtcatttctccttcatctcttccagtgtatcacatacaacactttctcaatcttgtctttcataatcttgacacttctgcagtatactgatgggttattttgtagactgtctcacaatttagggttgtctgctgttttcacatgattagatggaggctacgcatttttttgaaaggatgccacaaaaatcatgctgtgtccttcttagacatcatatcaaggagctgatgttaatatgtctactactagtgatgattaactttgatcacttggttaaggtgacatcttccaggtttcttctccagaaagttactgtcttttcacttgtagttaatatatatcttgaggaggagactccgagcctctacaaatatctgttcttctcaaaaacttccccctgattttagcctccatcaggcacattatctgcattcattattaacgtggggtttgcggaacagtgatttttctatttccctttttccttctacatttattaatagaaattcttctgaaaagaagactgatcccttctcccccattcattcatttatttgattatttatttataccagtatagattcacggctatttcttttatcccgtggattaaaatctaatactaccattatgttcatgctcaaattgttccagatttggatatcgagagcctttaggtaggctcctgtgttcttttgacaagtcctcatacctgtttaagcacgtcctcattttttagtatcacaagatgctccaggctcatctgacattttcccttccccagcgctgcaatctagcacttctctaaggtgtcctggctctttttatgaaagaatgcaatttagaaatgaaacttagatctggttgctaagtgtgttcattataaacagagtgcctctgtttctacaccctctcagccaatagatctaggaaataaatgtacatttgctaacacctgcatgtacacacctgtatttctctctgtatgtctatctattaaatactatgaattcctactaatacctgtaaatccaatcaaataccagagggctcatgatagccttccttctttacctgtaactttttctcaaaagatgagaaacctggctcccagaggacaatcaatagcagagcttgtcctccacaataacctactcagccaacacaaaagtgtgtatgtttaccaaactaagtagaattgtgtaagatctaaattaggctaagtgaaattaagtagctctatgttttatgacccagagaatctgttctgtgctatttacccaaggtctataaaggaatgtgtgtaataaccgtccccacaatgtttgtagttgtggaaactgaaggcaacctaggtgtccatcactgggggatggaaacataaaaggtaatggatataaaaagtgggcactgtgcaataaactgaacctggatagacttcaaaaacagtgttgaatgaagagtcaggagatcaataataataccacttatgtaaatttaaaacacacgcctacataaaaattatctgttttacaaagctatgtgtgtatatttggcacatatcagattctgcatatcatgatgggaaggggaatggaactggatataaagggaaagagtatgacaaaataagagaaatgcattttcactgaaccaagataatgatgtgtgatgcgctggagagtgtaactaattccaatgtcctctctggaggtaaaaatcaaagtaggcaatgtgtaagaagtcaatgaaatcatcaaaggccaataataagatcagtctttaacttaaaaacaatttttttactcatattaaatttattgtcattcaaggcctccagaagctaaagggtaagaggtttttttaaaaaattcagcactgaagatattttaattcaaaacgacatgcgagaacaatctaaatgcattacaatgctttgaaaatccaacattggctctattaaatatcttgttttagtaatggaactttgttgttgttgttgttgttgttgtagttgttgagacaggttctcactctgtctgcctaggctgtagtgcaatggcacaatcttggctcaccgcaacctctgcctcccaggttcaagtgattctcctgcctcggccccccgaatatctgggattaaagttgaccgccaccacacctagctaatttttgtatttttagtagagatggggtttcatcacgttggccaggctggtctcgaactcctgacctcaagtgatcctcctgcctcggcctcctgaagtgctggtatcacaggcatgagcccccacacccggcctagtaacggagtttgataactgtcgtgaacattcatcattatcagggtacgtcagttattccttgggctttttctcccacaagggaaaactaatctcttcattctccatgttcattttacgccagtcactgtagccctttctccatcttctggacaaatgaagcatgacctccttgggcttgtgctgcggctgacccttctgtcttcactcttcctcctccacagtttcacacctccggcttctcatcaaatggcacttccccagacatcttgcctgaccacctattgaaattacctctcctccaccctttattatccccagtgcagttttatttcattggttgtttcatttaaagtattttactttacatgatgactttcactctctccccactagaatgtatggctcttcaaggcctgttcattgtgatgttaccagtactaggaacggtgcctggcaaggattagatgctccataaacatcatactcgctcaggttgcagacatgtacttcttgggaatgttttattcagatgcagttttcagcccgggaacagagctttctctgagtccctatttctattcttagctttaggagccaagcagtggtataattactacatatgacaccagaaaaaaattactttttaacatttctctcctatatgcaacaaaattatttgtaatcataatactaatagagaaatttgcaaacagtgaaaaagtgtttattcaattctatatataatgaaaccagcagtaaaataaaaataatgtaatgagaagaaataaaacaattacattcatatactttttagaaaagggaaaaattgtataccatggttcatattttatttcactgatttaaatgctaggcacaaaagctcttcaagtggtcacagaattgaagtaactcaaattacttcttcatcttcacaaactgtgttattattgttgatttcaaatctactatttaaatccaggaattgatagatataagctgctctcaaagtgagctgggatattctgagccatggctaatttatgctcaaaatgaacatgtgtagctgagtttgcatgtattgaggaccgactgtggaactgggaagtctctaaattagctttcatatagatagaatacagtgtgttcaaggatacatgattttaaaatgtgagaatttcaagcttacatatttattctaaaaactcaactgtaagcaactgcaacagaagatttttaaggggaagagtatgttatcaagtacctgcacatgctgattaaaacaaaaaaagcctatagattgtatttcactttattaattttgtttttgttgttgtttgtgttttgagatggagtctcgctctgtcaccagactggagtgcagcggtgtgatctcggctcactgcaacctctgcctctcgggttcaagcaattctcctgcctcagcctcctgagtagctgggactacaggcgcctgccaccacgcccggctaattttatgcatttttagtagagacggggtttcaccatgttggccaggatggtcttgatctcctgacctcgggatctgcccgccgcggcctcccaaagtactgggattacaggcataagccaccgcacccagcctaatatttttaaatctgtagacaccacactcccttattgtccgtattgggtcaggcctctccggtcatccagtccagctacaccagtgtaggttcagatacttggaatgaaacttaacatttcctttcctaacactgtcacttccacatggtacctggatgacactccatactgtcacctggctttttctccctctgatttctgtcttctgctagagtccaaaggttcccccaaagcccacattccagggcctccaaagactcacaacaccctggaaattcccaaaaggctaataagctaaaactcatgaacagcatccagctattccacagaggaatgaagagtaggaagggagagagtcattcacactctgctccaggaagagggatgtctcattttctctaattctcttgctctccctgctgggctcctcagccctgtctcctcacctcctcccactacttgcccttcgttcctaccaggggtgttaaagacaaaaacacaaagcctgtgtctccatgatttcgagtttgtacttgctattctctttacttggtattgagaagtacaaatgtaatttctacctaaataattcctatcccattattcaaaattctgttcaagtatcacctgttctgagaagtctctccctatgtctctctccttcatggcaggctccagaaagatttagccattttctctttaatgccgtttctgtacttgaaaaaacttctacaattgacatgtttttactcactgtgatttctttcagttcagagcctatgagtttactcatctttgtaattctaactcttaggttgtgttcaatttatggaaaaatgtttgattgaaacaggaaatacaagatacaaggtatgttttggagccaattgtaacttaaaattatcaaccacacctcacccctcaagctgcagaagtttgacctaaccttcagaatggctgacacactgatttccttgtgctttcactaatttattcccatgcctacttccaacaagttttctagaccagatgacattacttgccatcccttatcatgagttgatggttattatggggtaactaaaggcatagtggtcattaaaggctgtatacatggctggtgaatccaggaaatgaaatacagaaatattatttagctggttacactctatctaatttctatctacgtgaaagaaaactcatggtaattattacttatataccaatatgtcatttctgaaacacttaagaaatgaattagtgaaaattcaatattactttgtaagtgtagtattttgggttactgtcctgaatcatgtttcctctctaaaacaggattatacatctctatttattgtcaaatgacttgtcatacattctctgggaaagaaccacattcccacctcattgattctgcgcttggccaccatgtgatatgcactggccgtgtgaccaaaagaacggtgagcagacatttgccatgattaaacagaagcctttagtgtaactgtgtggatggctgaagcttttctgttcttgccctccaccatgagaatatcatgtctccagacaggggttgttgctctttcagtaaaggttccacaatgcaaagaaacatagagcagaactacactcacctagactcatgccctgaagcgctcatggtgtgtgagcatgaattaaatatttattgtaagccactcagctttatagttggtcttcacacagaacacagaagaaaaccttatgcatagggcaaattattgaagactgattttattttaatttaaggataagaatgatatcatattgcctttttatagtttggcacattaaaaggttctaaataaatattttgaattaatataattgcaataaagtaaaacaggttgtgtttaacgatgtagaaattaaaactttaaaaattagttctcctttgtgtattggacatctgttgtttttgtcagttcagaatttcttcctctacttccaggaacaacactcatctcattttaggggcaagtaattcttctaaggcttttaatcataggacactggcttcccagaccacaagtttaagcacataacccagatttggccaattatagcacctcattttctctgtcacagtgattggtgcttggataggaacataatctaggatgatagagtccttccttgaatttccatatactgaagtggttggagaaaactgctaccttttttgttgggttcacagatgtagtaaactgcagccatgcccaaaaggtataaagaaaaaggaaggccaggtacggtggctcaggcctgtaatctcaacactttgggaggccaaggtgggtggatcacctgaggtcaggagttcgagaccagcctggccaacatggtgaaaccctgtctctactaaaaacacaaaattagccaggtgtggtgatgtgtccctgtagtcccaggtatttgggaggctgaagcaggagaattgcttgaacccgggaggtagaggttgcagtaagctgagatcgtgccattgtactctagactgggaaacaagagtgaaacttcatctcaaaaaaaaaaaaaaagaaagaaaggaaaaagaaaaacaaaacaaagcccacaaagagagtaggagaattaacagaatgttctgtgggctcttgagtcttttgcctagttcttgaaatcccatatctacctcattaatgtagctcttctttctgtgagcaatcctggtatccttctaacaattccttctttgcttaagtaaattaaaattgagtttctgtatctcaagtactattgaatataatttgaattaaagtagctttcaaccattagtttataaatcaaaacagaacaaatattacattgatccaattcagcaagttgggttgtaaagaatgatgatgctcttgaaagcacgccaggtaaccctaatcagtggtccattctagctctaaattagtaaggattaaggataggttgttcctgagcctttccagagcttccgcccatatccaaggaagacctttcccccttaatctataaacggaatgactgggacacagaaaagtgacatgcacacaaaacatacaactaatgtaggtgccagtgaagggcatgagagagcatgatgcacaaggttgcaagccttagatgactggaaataccagcttggtccaagaattatttttccagaaatactgaaataaatacagaaaatacaaggaaagcacaaattcaaagatgtttctacccactgatgggaaagttgtaaagctaagccaaacagaaaaagccagagtgctttaagtgattatggattccagtatttcaggagaggcccatgttttctagaccaaatcttctcatatcataatttttaaatgacaaagaaatgaaaggattacacgtcagtgcaaaagctgttctcgtgatagggaaattcacagggaccgaacacaacttctatgtgtctgaaatacgattccgacctaatagtcagaaaatttccttccagaagtccaccacttgaagcctaaaatcattatagatcagatagatgatagatagataatagatagatggtagatatagatgatagatgatatagatagatgatagatagatagatagataatgataggcagatatataaaatatttctgaaaaatagcctagcccactcagcaaagaatgtaacaatctatgaacttcccaaaccatcatcaaacagcataaaatagaataacgtgatccccaagagatcacctgcagctccaggtgagatgacacccgaaagactttccatacatggcctaaacattggcttcagagatcacatgtgagctctatattttaaagggcaggacaacataaaaataatcatagctacaatcttgaaacttttttctgcatccatttacctaaatgattctgcccagtgactaccatttagttcttacctatgaggaaaatattgttatttttgtttacagatgaaaaaaaaatgaagcccagaggtctctaacaaaaaagtggcagaatctaaatgtgaatcccaattgtttgagtctaaagcctgactcccaccaccactctacattaaccctgatgaattactcatcattttaccacaacatatgggaagtacttgataaataattaatgaatgaattgatcaatggcattaagtccaacagcctcacagccatctgtaatatgccccctgtttattttgttggtattaatccccactgtgacttttcatggaattacctccacaaatacaacataatgcaaaattgcaggaaagaagctcaaactttgggatctgagaacaaagaagcaaaatggcttccctgaagtcagacactgaggatcagagaagtacctagcagtctagttttgctagaagaaaggttgtctggaggacactagtgggagtaaagaaagactgattatagccaaattgtaaatgagtttggatgatctttactctgaaggcaatagagagccattgaatggctcctaagaggaggagtaacaagattggagccatatacaagcaagtatctgataaatgctttcggatgattaagttgatatcagactagatcccaaaaggatatggcattcttaagtttggataatttgaggaatatttacttacaaaagaagtgattacagaaggaagaatgaggtgtagagaaactacagggagcaggtaggaacccagggctagtagcagcagagctgtactagcttaacggaaaaagaagagagaggggctacccaaatccaggggagaaagctgtacagtgtaaactacccagaaggcagcggtgacattctgccatggccagccagaggtcacttcacagggaagaaactagaggaataaagactgactttgctttctctcttcactctatctcctgccagcgcttcccactggacaaacccaacaagcagcagagtacactcatgcccctcaaagagttcacataggggagacccccaggaagaaagcagaggtgggagagtggaggggatctggaggcccaaaccaacgatatctggctcaaagtcttcccaataacaagaaaaattctattgcagtatagtttatagacaatttttagttacctgtattaagataaatgaagaataagtagaaacaatggtacgatattattaccagtataaagatactttattcccaatgattgtataactatatttatttttaaacactagactcatttatattgtagttccagtttctgtaagtatagcagctattgaaatggagaatgggagtggagagaggggaagagtcaagtctggccccaaaatacacacttttgattggtaatttgatctggcatgaaaaattagctataaattattagtagcagaaaattgcatatggttgatttaaaaatgacttcactcgaaaccacatatttataatgatagtttaatatgctgtttgatcaattattctttcaggttcatgacacaatagaaaactgtcatcaacaagaacgttggtgtttcctaatcaggagctaagtggttgtactttacatcacttaaaaatacaacttgtttcaattctggagataattgctttcccacatgggcatccataggttacctctttgtgtgactgataagcacactggcttatgaaaaatgtaagccagaatttcactttgctaagaatcgttaaattcaaaatatccttggtaggcattaggcctaaaatctcattgcattttagctctgtaaccctgggcaagtcttttgacctttttaagcaaatatcttgccctacctaacctctcatagaacatatatactgagcaattaccgttttccaaccaccaggttggtacttatcaccacaacccaagaagcaggtacaacagttatctccattttactgataagaaaagtgagtcttattaatgtgggttaagtaatttacttatagtcttacagctaataaatgataaagtaggattagaatccagcccctggcccaactccaaactatatactatatatcctcctactccataattagtagatagtatatactgtactatcttcctaccccataatagtcatttagggtttgaatgaaataacatgttaaaatattatgtaaaggtaaagaattatacaaatgtataatttttgttttataatatctaagattcttgatcattccctaagtataacttttcaaagagtctactgtattcattcttcatgtaaatattttgatcatctattaatcattttcagttttcttgtgactaagataaaattttcaaatactagactgtggaaaagcatacttgaagtagttaaaggtgaacaccggctgaaagaaaaatgaagtttagaaaattcttttaaaaactatcatagtatttaattggtcttcagaattggattactgtttcagtgtaactgttgacttgcataaactcaaaagaaacagtttctcatattccagtaagcatgaaacatactgttggtgttgtcctgatgttatgttatatattttaattcttactaaaagttttctctggttagaacctgctcagtccacttttctgcagaacagacatcactaaggcaaaataaatctccggttgtacatattgatcaaaatatggaagcctaaaagaggcatgctgtttgaaaaacactgtgaaacatcatgcagatgagtgttcttatccaaagccaaattcttcccttcttttagttcttctttttctggatacaggaaatatattcccttttgaagaggcaatatgcctgggcctccctccttctcctcaccagtgtctaaaaggaattattccacttccaaggccacaggagactatatcagtgccatctatgtttagagtctaacaccatcatcctttcagaaggcagcagtagcagctatctcaaaagacagagcagtaggatgggtccctgagcagatgcccacctgtccaaagtcccaggctccatctgagtcaggtgtcattgaaacatatcacccagtgaaagtcacatggagtcttaataatgcagatttagtcaacttctttatttcagatgtccaactaaaaacacctgggagaccttaagcattatctattttctctttcaccaaacaaaatgataaatggaaaaaaaaagtctgcagactctcctatcttccttagcaaaccaaaataaagagagattccttactcttgaatggtaggtgtgagtaaggtgggggagaaaaatagcagcatgagtctactaacctagtctggttaaacaaaatcctgttttacactctcatgacaatgctacccagttcatttggtccattttaactgaatgcctccactgtgcccagtttctggagtttgcacaatttaagttgcatttcccatcccctagaatattaagaagtaagaatattttaaaaattattacggtaacatgagttaggctaaagaataagattacaggtaatgaagaccctataaacactatagagcatatacaatcaggaatttttacagactcgagaactggggaagggtttgtggcacagatatgggccagcctgggtttgaaagacaaaattgggattgagaaagagaagaaagaaggatttgggggctggaggaggggggaaatgccatgcagatgatgaaaagataatagcaaagaggacatcagtgctctgggaatatttggctggcaccaacaagtagaattattttctgtggggatggagacaaagaaagggaattacagaatctaacgacaactgaaacaatttcagtgctaagcattgattattatagagacagaataaagaggaaaaaacttaatcgtaagacttcgcaaaggaaccttaccattcttctcacccttgccaacaaaacctatttttctcccacaaaacctggactatgagattctagcatttcacttggcacaatcacctttaagtatcaacattaacttccttcacttctcctctaaatacaagattttgaatatcagtacgagagcccatggctaattctaggaagtcactcattgtagaaatggcatataattgctgtgctggccagtgcaaagaggatatgcttattactagagaagatagtcctctttccaagaggaatctgagacaaatgatgcttccatgtatagaaacaataaaagagcgaaggtattttgcaaataaagttgtccattgagtagactcattgctaaatgcagaaagcatgtatctcactatggggaaacactgagacctctttcaactctccctacactgaagcaacataaaaagtttctgtccaaagtcccaatcaccagcaatatggaacacagcaaaagtcatttacagtcttattccatacatgatatattctacattaagaataaaataactcattacattgtgaaacctagaatggaatccaaaccagcttaactgcattatcttgtgacattcacccattactattgattgatcaaagtgttttctttgtctgcatgctgagctaacacagattaattactccatgatccgtttaaaattaaatcaaagaaggctccattataattggtcagacataacatgaaggcagggaaaggagtagcagtggttaatgccctgtatgcttaatttatttttctaaaaaaacatgctgaatttaacctcccctcaaaatcaagtaactataatgctgaaagatgacatttttttatttgctgtatgtcttgttcagaatactgcatataagagaaatttcatttctaagatctctagggcttgctgaggaatgacttttatcagcattcttcaaaatacatttcatgtaagggtacgttgatataaaatttttaaagaaaactctttgaaaatgaaaaagagcataaatagcttggatggtttaaaaaaatgcacttatcctctctgaggaaaaaaaaaatcatttgtcctgatgtatactggaccctagtctttcttttcagattccattgggtagcagtcatttcttttgataggatttaccagtatctccaactaggggaaggtcctaattaatccacatctataaaggtaatcctatgcatcttgtttgtttaagataaactaggtctataccaatcaattaataataattctctggccacagagatttcatgaatgttgttcagtggcatccacactatcctgctgagtagtgtaagtttgcttcaggcagcctcctatccatggccacaagagaaaccaatctaagaatgaagccagtaacactgtaaatggcagagcgaaaagtgaagaaaaatctagttcttgatgaaagagttgtaccactcgaccagcccaccctgaagttcggtctacgtctggattttccaataaaatgaatcacgttatcccctggtgtttaagccaggctgagtcatattttctgaaattctgcccaaaagtatcctaaccactatgcaacatgtattgctcaattgttcacagagcctatagtcagagaataataaactgaaccttaaagactgctgggtattcaagcatatttttatttgtctaaatatgaagaagtaaagaagagtcacatgaagaagataagatgatttttaggaatagtaactaatggggactcctgggcccaatgtttgctactatgtcattatcacaagccaaccttatcactgctgagaatggtaagaacattgcacctcattattgggatcactatgagtttccaagtttgagttttgaacctcaatcatagaagagattgcaaccttagtgttttagaatttgaaaagaactaagcaaaatgtgtatgagaaaaaatataaacatattcatatattatttaagattattttattaaatgataacctaagcttttactggaaaactaaaaagtcaacagagaagagaacaggtaccgtggtaaagaaaaacagtatgagccggacgtggtggctcatgcctgtaatcctagcactttgggaggccaaggcaggaagatcgcttgaggtcaggggttcgagaccagcctgaccaacatggagacaacctgtctgtaatataaatacaaaaattagctggacgtggtggtacatgcctgtaatcccagctactcaggaggctgaggcatgagaatgacttgaaactgggaggtggatgttgcaatgagccaagatcgcatcagtgcacgccagcctgggcaacaaaacgggattccgtctcaaaaaacaaaaaacaaaaaaagaacagcatggagtatgaatcttgagacatggttaaattcctctctgccttttagctgtgtgatcttgtgctgtttacttaaactttctgaggcactcccttcagcagtaaaacaaaataataataaaattttcaaaagctattaaaaggatgatattagataatataaaaaagcttaataaaatatttattattcacatatgatttccacaaaatgaatagtatttaacctagttggaaagataaaatgtgcatggtaaaacactgattcatttccttgttcgaggctgccaactttccattgtctgaagaataaagtccaaatattttagaatagaatttatagtcttctacaacttacaacctggcttcaatatatgtttccagcttcacctcctactactcatctttacaagttctgcatgccagtaaccctgccgtccagcattcctagacacctcattctcagcaccccttatgttagccacttacatatcttggctcttgttattcctccttgaagaatactccttctctgcctacctaacatctacctatgtcttttaatacattattactatttacaatttttttaatggactactatacctaaagcccagttcaaatgccccctctttcctggggattcatataccaccactagctgtcatccttcattctctaaacttccacagcccttgatttgtaacttgcttgctcttaaaagcgaaaccaaacaaaatgaaaacgtattatacaacagccacacgtaaaaaaaatgtctaatgtctcttactgaagtgtaaaggctttatgaacagaattatgcctgatacggttttatttcctcaagatgctaaaatgagataattcacaaatattatagtaaatatcagttcaataaataaacgaaaataatagaaggagaaaatatggtataggggaattcgtgttacaagctatttgtgtaaatgagagaagaattcaaagcagagaatgatcattccagcatgaattgccaagtagaagtgtagctgaggtggagtttgaaggaaggttactatttggatgcattaaaaggaagtggaaaggcgttccagctagaaaaaatatataagcagtaccctagaagaaaaaaaatgtattttatttgtggtaaaggtagagaagtaacccatctaacaatcacatgggctgtgccacacatcaatagaaaataaaaattgctgtaaggtttaacaggcgtattgctgtacatatgaaggagacattatgctcttgagaagtcacttgtggcataatatacattataaagaacaaatgttaattatatgtgactgatcaatataaaaaaaattgtaggatattaaaggtaaatccaagaatttgagcctgaaagattggggaactgattttatccctgatagcaatgaagactagccacagaggcccagttaagtagatgaaatagcaaactctattttggtcttgaatcaaagagaagggcactttggggacaggtgatactgttaaagccagtgtttttctgagagagtactctctattatcaccacttaggtgcaaagattctgatctctatgcaaaagaacactcaacaactggatgctcttttaatccaatagagatccttccattttcctaaaaaaaaaaaaaaaaaaaaaaagaacatcaatttgtattaatctagagcttgctctagaacctgatataaacatagactctgaaattccacacagacccttcagtcagtgcatgataaaatatgctgattacagctcgcatatccccacaaaaagcaaaatacagcctgttgttctaccttattattctattattgacatattcataatatacagcagttaacttttaggatgtgaatatttctgtaagagggaattatcatttaaactgttgccaaagtgaatgatcggctgtgagaggtagtataggagaagagcaggtttctctgggtgaaaagagaggacagttgccataaaggtgggcggaccttatgcactctcccaggctgaatcgacaggcccacattgcacaggcccaaagggcactatttccattgtatttatatgaaatgtaatttcttgaaacacaattccagaaagccatgtgaatggtgctcccggaactgtgcaacttgttggctattttctagaccagagctcagttcaaagacaacaatgcattttctaggagtttcatctctttatttgtatttttaatttaagtctacatgtttcaagattggtctacagccccaccctccataatcaatgcctggattttaaattttatatgtgtacacataaattttaaaattttaaattttatatgtgtacacataaattttaaaattttaaattttatatgtgtacacataaattttaaaattttaaattttatatgtatacacataaacatccatctatctgtatgtattatatctataaacaggtgtgcatgtgtgcataagtatgtttatctattatttagaagtagacatattctaaggcatctgagcaatgactttattgactttatggagactaattattgccacaaaattttgaaacgaatgtttctggtttgtattatatgtttcactccaataaagttaagattaaatcactgtgaattgaagaaataattgtttgaggtagttcaaattgagaaaatggagtaatcaccagacttttgaaaagttaaatattaatgcttcgacagtaagaagacattttacttagcaggcatacgtctttcagaaatcccagctctaggaataccattgttagaataattcattcatagtaagactaaatagcaaatattcaacaagaaatttatctgttcccaattccagcaattagttgataaaacattttaatgtagttttcagtaatgctgtcttattaactgtcttccaaaattttttttagtgatatcattacatttagcattttaggatttctagcaggcaaacatttagttaagtatgaagtctaattacccttaagtaaaaaaaccaagaaattagtaatataattttattcaacatacttatgtgaacagattctctgtataagtattattgaaataaaagcatagaaacattaaatatataactgcatctgaactgagataattttatgtcattaaacattaaattaatattgctaatttagattgaattgtctctgtatagacttgtttataatttaatttgtaaattatctagtttcatcattttgtacgcactataaacaagagaattttatgccatatacgtgcatatataatacgtagtaaaaataacctaagttgacagtggatggccattaatacggtttttcattataaaaagtgagtcctttacctaagttcgaggaacactgctccagaagatctaggtccaaagaatacagcaccaaaccaacacatccaggacataagcctttcaagtccttttatgcagtgatccatccattcatatttattgaatgcctcctgtgtgttagacactggagttatatatcaatgagcaagacagacgtttcttatcctcaagtagtttacactcaaatgagtgagacagataattaacatgaaagcaaatagttttttttttaattcaaattgcattcagtgtatgaatggtcctgtggcaaacagagtaactgggaggaccagttggtattaaataatcatccgtgggagcctcttggagagcatattgcttcagatgaggccttgatgaaagaatgagccatgtaaaaacaaagagtgaacacggatggcaaggggaaatgttgcagaagagggaacaaaaaattaaaagcctctagtgtcggaaaagtttggcatagcctaggaagtaaaagaagaatactgtggctcgaaaattgtgagcaggaggaagaagagcatgagacaaggtcacagaggtaagcaagacaccctgttcagggccttgaaggccatgttaaagtgttcttctttcattctgagtggaatgggaagacattgaggagtacaagcagtagacaaacatgatataatttatattttgagaacatcaggctacagtgggtaagatggctagatgtgtcatgaataaacactgaacactcatagatggacaaggatacgacctcttttattcagagccaaaactgtcttaaaaggaactagagccaagactgtgtttacaagtgtgttttatatgttttaatttgagttgccaaaattattaaaatcatgagatttcacttaaaatatctggatttcctcctgcatctttggatttgttttactattattattattattattttctggaagatccagtaacattgagcctgcagtcctgcctagaaccaactggctggagctgagtagtagctggttaatttccccatttggaaagtgctgtgatttcatatttgtcacatttcttccaaatcccctactgcctaagaactagcctacctcattcacttttcttacttgttggctacagctagatgcatttattattttctacttcctcatagcaaccatagtaactaataacaatcacagcccttgggagctgttcctagtgccgcttcgaaaccttggtaaagactatgccaacttgatcttttttttctaaacctgatcttaattcacttattagtcccagatgactttgtccgttgtttctccaagaccacacctaggcatgaaacatcaacttgtcctatctcattgctcatccaagcctagtgcttagcttcagttctgtgagccattatcccaggtctcaagctcgcctgttcgatcatgcttgtttctgaagacattcacacagggcctctgcactatttacatctactgttcatgtcattgctggaccctttgaggggcagggtattgtatacaaaattaagtgttttagttggcaaaatcgatgctgcctaacgtgctttgtttataatatgtttataatgtaaacgtaaagaatgtacaatcctaattgtattttatgtgtaacctcttgggttgagattaactgaagcctgtttctagttttatccctttactctcatctgcctggaaagtatgcaatttagtcaaatcatgaaaactaaatgtttctaaaagaatgtaagggtattaggtcgggaattttaacttgttcattactgtaactccagtacctagagtagtgggacctgggaagcttctcagtacatattttgttgagtaggaatgaatgccaggctatgagacatgcagcacaatattgtgctctggacatatgagatggctaaatggaaaaccatgctcatgcttgctgacaagatctctaaaataacagaagcatcgtctatatcactttcttctccaaacaacaccagttacttaactataagctatggcttctggctcatatgctgttttcctaagctatttatattatgaatctataatatccctcagaataataaaattcttcattaattacctcttgataaaagtaactattggttcaatacataatcttgaaacataccaatagatacaataattatgaaattatgaaatatctggggaatatttcctaatatggaaatataacgttcatcactaataaccacatacgaaaatagagttacctaaatattgcttaacccaggtctaaattgtatcttccaatcacagtcacatttctttcctcttcttcctcttcctgagcaaaacttcttggacggaaaagacattcatcagactcagcataaaatgaaaatctctcagtccattagctccacctttatcaataccacattggaaatgacatagttgtgattcttttctttctctttccttccattcaatacagaaaatgtcaactcttgccaaattaattctaccaccttatcaccaaactaaatattaacaaacgaccatcaaagacaaaagttatgttgtgtgagccttaattggatgagaacctcgtcttgctgcttgcagggagtcaactgtcaggaaacggaatttatagactaacctgattcctaagacttgtttaaaacaaaaagaacctcaagaacttcatatgaccatctttctctctgtagggcaatacatacttcggctttgaaacaacatctgaatcaatgtgctatctttctgtgcactaactcaactgatttcatgacaaattaatttgtcagaaatcaacaactgcaggttagagatagaaataaagtcacatgaaagaccaaattggggctattttggatctgttagccttatgataggatgctttaatttatgcatcatagaaatctctttacaccactgcctgtaattgcagcatctcacaatgcttgcctgcgctctggtttcactttattctggaaaagctggtaaaaagtcactttatgtaactgatgacttgctgggccaaagtaacttttagacatattatctaatcattttttaatctcgtgatatcattattatcacaataataaaaataacaataaaaagagcaaaaatactacacataaaaagacttagtgagtttcccatcatcaaatggaatacttaattttccctatacaaatttccattttttttaattctctatgtgaatataaaattgcacattacaaaaaacccatgcccctaattcattcttcactccaatgccgtcattgctatagaagacccatttaatggcctatctaaatccatttctttttcttctttgccaagagagtctcagttttcttcagaacaacaatgtgcttagtcccaggtaactaatcataatcaacgcaagccaaacttaataatactatgcctcacttctagccagaagtcacctactttcggtaattagacttgggaagaagcctttgcagggatgtttgggaaacttttactcccctgaggagaaagagagactagggtggcaggcatcactctgccacccttttgctgctttgaatttaggcttcatatctggaactgcaacaactatcttgagactaaaaaagcaagtcagagtataaatggcaacacactaaagataccacagaaagagctcctagacacagagacgggaatgacacacactgggacctatcagagggtggaggctgggaagagggagaggatcaggaaaaataactaatgggtaacaggcttaatacctgggcgatgaaataatctgtacaacaaacccccatgacacatgtttatctatttaacaaacctacacatgtacccctgaatttaaaataaaagttaaaaaaatactaagttctttgtgaaatccagcaaaatgcctactttcagacttagtatttgagaaaaatccatcctcatttgatgaagacactgaagtctgtaacttacagtggaatacttttctaagtgatacagtggtttttttagtagctcaggacttctaaagaaaagtctcaccttgtttcttgtgtttctctttaaatctgctttccactttagctctcaaatagccactcaaattgctcacgattctctgaattctctctgtggttcgctgcaggattttgtaaatggttctacctccatcactgaagtattttgccatctttatttttcttcatcaaaagttatgttagtacaggtgtatttcatgactcagtaagtctacccctagtaatgtttcaataagaaatgcatatatatgtttatattacacatatgtgtgtatggatattgtatacaaacatatataaacatataagtgtgtatgtatacatgtgtatgtatgtgtatacacacatatgtatacattcacaaatatacacatttatatacatatatacacatacgtacacatatacatatatatatatttaccaaaaagacagagattgatcatagaaaacactattcataaaaaccccaaactgaaaacaactcaaatggacatgagtggtaaaaaggataatgtgtggtatgtttatagcactgaaaatgaacaaattgcaactatagccacatgcaacaataaggatagatctcacaaacataacacaaagcaaagcacctaggattaaaagaagatgtactgtattatttcattgattcaagttttcaaacaggcacctaatcgatggtgtcatcgcaagataattgctgcccttggggagggcagtgactggaagaaggaacaagtagagctaccaggatgctgggaatgttctgttttctaatctacgtcatagtcacatggttgtgttcactctgtgaaattacaccacactgtatatctatgattcgtgcattcctctgtatgtgatatttaaagaaattgttttccaaagcaaaaaagtttactcaggccaaagaattatcattaacataaacacatttcttctacaacccttcctttggttccttcttcacttctatttaacctttttctctcttattcctccatagaattttgtctacacttaccatgtaacagatatcccaagatgctttgtattacaatgtttgtatatgtaaacacctcttctccccataagaccatgacctctctgatggcaaggatctcatctgtgctatgtcatactgcaatgcaccagatagatcagtaatcatctttgaagggagttttacttcaaaatagctttctataaaacataggtaccaaaaatcagctgttttgtgtgcttttgcatttttgagttttcataacctaatatcatgaagttttgcaattcttaaggcagctgtagtgtagaagactcattggatgaaaaatgtgatgaacttatttacaagccttcacttgacaccacctttagctgtggaaactaatacaggcaactttacctcttagatctgcaatatcttcatctaaattatggagataatcatgtctgcctcacaaaattgctatgtatctcaagagacttaatgtatatgatgttacataaactctgaaactgtatataaactacaagcattgttctccatcgtcttccagtagtatttcctagcctttttcatgtcatgtcacacctagaaaattataattattgtacaatacactagagtaaaataacaaggcttcttagagctggaggacaggtaattatgcacactggctagaaagcactagaaaaccatgaatttactaaaatgaaaaattctcgctcagataggatcaaggtattgtgtctctcaagcaacatgcattaagttgagctcaaacacaatggtaggtgtacaagacagattgctcccatcaccattgggatcaaaacaggagtgtcattcatcatgtaagagtattcatactacagacttaaatctcctaaactgaatttggaatgtttatctaggtttgtatggactttttggtggcatcgcaggaagaaaaactttataaaggacactttgtttgtatcttacatatctaatgagaataaatttgtaaacacctgatcaatacttaagaaggaatgaaataattattttgcacattttcttaatcactttttctagccaaaagattcatatcattagttaatatataattgtaacctgattcattcatgtttctaacaaattagtttccagttctttcctatttcctccacccttatggagaaagaaaaaaatatataaaaatgacatacacacacacacgcaaaggtagggattgatgtttttttctcttaaattactgagatattagtagtcagatggggagggtggagaagaagaaattattattacacattgcagagttttttgaaacagtctcatttcctcagcaattcccaaagcacggtatacaaaattatcttagttgacacacagatgaaactgttaaaaaaaagtatggttatattaaagtaattatttttatagtagaaaaaacagcatgctaaacttgtgattttacagacaccattactaggacaaagcttaattaatttttagatacgttgattaaaagagaaaggatcacaccgatataacacaattcttcaagaggtgcaagaatttctagttttgggctactgtgttagttgatatttgctcctcacatgtcactaggtgtgagaaaagcctccttaatggtgctttcctctgggtcagttccaaaatttttccaatttatacacaggatggtagagataagaagtgatgatgcctcccaagtagctgggaccacaggcatgtgctatcatgcctggttaatttttgtaatttttttttttttttttttttttagagacagggtttcaccatgttggccaggctcatcttgaactcctgggctcaagtaatccacccttatttttaggaaaacttagaaatagtcatctcaatgtgtaatcatgggaattacaaatttaggagacaaatggaaatataaagagtcagagtatgccttggccaatgacagcaggagtccagggtctcagtctaggtgctgagactgtgtgcctttagcagatttcttccttgaacctcagcttgctcatctgtgaaaggactaaattatctctaaagattctctctgcaacatcaatctgtgagtctacatataaaacattaactctgcattaggagcacagttagctgttaagtatgtcaaatggacttcttcttaactaagtggcccataaattaaattcttgcttcttccacccaatttatgcacttatccaagtctatgtgctaagggttttattattttatagcaaattttaccactcaaaggaagacataagaaggcctcaaagaatgtattcgtcaggacttgcacttctataaagaaatacctgagcctgggtaatttataaagaaaagtggtttaattggctcacagttctacagactgtacaggaagcacgatgctggcatttgctcggtttctggggaggcctcaggaaacttacaatcacggcagaaggtaaagggggagcaagtaattcacacggccagaccaggaggaagagagagaaaagggggaggtgccacacacttttaaataaccagatctcaggagaagtcactgttgcaagaacagcaccaagggggatggtgttcaatcaggaaaaaccacccccgtgatccaatcacctcccaccaggccccacctccagcactgggaattacattttaacctgagatttggatggggacacagatccaaaccctatcacaggatgatttttttctgttatttagaagagaactagctatataccaaggacacagttctgactccttggatcagaagagaatgacagaacagcacgtacctagagatttatctaaacacttcagaaatcaaatggcaagtttcatgtttctagatactttctgaaatactttctactatttagcataaccaagtatgtcttgcatctctgtcttcctctgtagcttcccctccagtctccattagagctcagaaaattcactagctcttcctctcgtaacatcttagatttgacacagaatatgggagctagaagacacttcataggtcatttatttctgcttcatatcagatgtttaactccctctgcaatatccctacagtcatctagcatctgtttgtacaataacagtcactgcaaagttgataagcagccaaaacatccattgtgttctctacaatagtacttcctgttggcacagagctgcttttcaaactaaatctgtcaaacctacttctacttcctcaaaatcatcagaccatcatatcctacttcaatctctcttctttaggttaaatatttttagtctttacctgttccttctgagtcatgattccaaatcctactaatatcctggtcattatcccctagatgcattctagtgtgataatattccttgaaaatcatgattcccaagaccagatataatctcctccttcccacctgcaaatgctttgtgatctgcatggaatacaatggtacaacctactgtatcatgcattctattccttctctcatttgtgatttatttaatatgtgggacacagattgaaacacagttgtagtacagagaaacactagtaaaactcaagggcttatctacatacttgaaagtgctgtgggaagaattggagggcctatgcatatatatatatatatataaaatacatttttctttttgagatggagtcttcctctgtcacccaggctagagtgcagtggcacgatctcagctcactgcaaactctgcctcccaagttcaagcaattctcctgcctcggcctcctgagtaactgagattacaggtgcccgccacctcgcccggccaatttttgtatttttagtagagacaagatttccccatcttggccaggctggtcttgaactcctgacctcgtgatccacccacctcagcctcccaaagtgctgggattacaggcgtgagccactgcacctggccactaacacattttctacagtctcattagccataatccagaaatcatcctaatctctgaagaaacctaataacaaagctatactgaacaaagctatacaacaacatacacatttatatctatgtatgcttatatatatgtatgtgaatatataaagtgtccgtacataaacattttaatcagtcttactttgcatcacaagtagtagaatatgaatgttttttcccaagatacttacatcatgcagtatataattgtttttatgaaagctgttttccacaattcacaacaatgatatatataaacctatattatatatgtgtgtgtaagtctttatcaatcataaagtgttttagacctacttgatctttacagaactccaggatgctgtaaactcaaggaaagaattagcacactcattttcaaataacacacaaagcttgtcaaaattcacatagtttttaaattacagagacaaaattgtaacctaggcctttgtattccaaatccaatagccctcacctttttgaaacagggtcttgctctgttgcccaggcttaagtgcagtggcgtaattatggctcactgaagccttgacctctcaagctcaagtgatcctctcaactcagcctcgagtagttgggaccataagcatgtgccaccacccccaactaatttatatatatatttatatacagggtttcccatgttggccaggctcatctcgaactcctgggctccagcaatccacccatcccggcctcccaaattgctgggattacaggcatgagatactgtgcccagcctaatcttcacttttaaaaacaggaaaccatttgttaaaatccatgattaaagtttttctaatcataaatagagctagactcttatgtaaatactccccaaagaaaccacatggactccaaaaaccattagcagcctctagtcacaaatgctatgatcattcttaataggagaaattcaaaaccaagaaaagccgaagcaagatgaaacatttataaaacgtctaactttccaccccaagctaatggattcttgccaccactgcaatatcttacattgcttaaaacaaatgttcccagatctaattgtacaatataatctcggggggagcttttctaaaatataaatacagaacctttctgatagaggaggtctggtgcaggacaaggcaatctgtttgacaagagtctgatgtgactctgatatactggtccaagcctgacatttgccagccataggaagacgcttttacacttgcaatatccgccgtctttttcctgcaacatcagctttccttcttctagtcaatctatctcatcagcatataaatatgctaataatatttttcataaaaacaatgttctcatcatctcacattcccttacttctccacacaacttcactgcaaaactcttagagaaagatttttccatactcactgtccccactacctcactttctagtttcctgagccctttcaaatcagactttgtcacccacttctccgtcgaaactgctcaccagggttaccaatgacctccacatttcccagtcaaaagatccattcccagtctgcgtattgtggataactctcatcaagctggtcattcctttctgccactttgttcacttaattcctgtgttatcacactctcctgaatttcctctacttctcaagctactccttctgggtttttggtaggatttagctcctgatggctaaatatagaacattgcaggcttagtccttatatctcttttcttccatattgacactaactccttacatgactaaatacagttctgtggtcctaaataccatcatctatatgctgatgaatcacacactcatgtctcagcccgagtctctcctaaattccagaattttatctttctattcaatgtctcttctctactccatgtgaaatttaacacattcaaacagaacactttattcctccgccctctgccgcctccaccccacaacacagatttactctatttcccaaatcagtaaaaggtgtcactcttcacctcgttgctcaggactgattacttgagtcctttttgaggactctctttctctcaaatcccgctgtcaatcaatagcaaatcttgacagttctaccttcaaaatatattccaagtcagactatgtgtcactactcaacacattatcaccctattccaaacctcccaccagaaatgctgaatagcctactaaatggtctccctgttagagtctgttttcatagtgcagacagagggatccgtttataaatgtaaatggctcatgccaccgttgtccaaaatccttccatgacttcccataatcctcattcccaaatatatgtcacagtgtaagacaccaaataatctcctttcttacaattcttcttccctttgctcttgccgcactgctcttcttgcccctctttaaatatgccaagttttttcctgcttcaggacttttccacctgctgttccttccagctgggatacaccttccccaggtatttgcaggcttgcttcctcacttccttggtctttactaaaaagcaattccctaggagaaaactgctctatccaaagagttcttcctttcactctctatcccctcaatgggtttattctctttatagcacctatcaccacctgacattctattatacacatgcaagttgtttatttattgttttacttctgcactagaaaataagctttcaaaatcaacattatttggctcaccactgaatctctagtaattaaaatagcacctggcaaacagtaggccatcaataaatgaatgaaggaataaatgaaagagcaaattcatcagcctgaagcacatgttctttcttggccccatgactcggtgcacattttcccttttacttaaagtgttctttctcatcaccttctatgccaagtgtatgcctatttatttttaaaactgcaacttgaatgataacttgctttcatctctgtttgctcctgtggataattattcttatctttagcacctatttttgaagatgtacttttgattatatatttgctccctggctacactatgaactccttggggcaggcgttgacttatctttgtatgcccaaagtccggcacctactagaaacaaaattatgtctaaatgtgtctaatcactagtgcttaagtgagcttttactatttccttctgcctgtgctgttatttttactaacagctgatgttcattaatgtggttgccacacctaaaagtagttcaactgttctctctgaattacagataaaaatgcatgtaggtcctaggaattaaaccctgattgggtatatatttgctcaccattgactggcctttaataatagaagtcagtctggatattggagtccattaccacacactttgtaagagtctagttactagttactctttgattacagataaaaatgcatgtaggtcctaggaattaaaccctgattgagtatatatttgctcaccattgactgagaactagagtgacacaagcctttaataatagaagtcagtctggatgttggagtccattaccacacactttgtaagagtctagttactggtaactggtgaaacccttaaaacaagtttaaatcaataaaatgcattaatctctatcatgttatcccagtccacaacacagactgaaaagtttctatttaactgataaggatagcatcttctgtaaacagcatcataacagaataggtcagaaaaatttgtgtgcaacaaaatagctattggaagatatacctcttacgccaaagaagctgtaagattcatgttggtataatttgcttctgcctttaaatctctctccaaggtgatataaaatgaagctttatttttatccctgatatagtctttgtgttatgaatgcatcaaatataacaacagtgatactaaataagttatatctgtgtcatgctttttatattttacgctttggacgtacactatttcatttaaacttcacaatgctttgatggaagcaaggatgatcataatcactttacagatgagaattttgagagtcaaagaggttaagaaacttgccgaaggtcatgcattgagtgaccaaaataactagatttcaacccaggtcacaagtctacaaatcccaagtgtactaagaggtaaaagttctggattcaaagatccagccactttatacagacttggggctttgaaaaaacatctcaagcttactggccctcaatttattaatctgccaactaaaagggtgcattcaatgcctccaattgttgctagcatccatatatatatatatatatatatatttttttttttttttttttttttttttttttttgagacagagtcttgctcggtcgcccaggctggagtgcagtggcgcaatcttggctcactgcaagctccacctttcaggttcatgccattctcctgcctcagcctcccaagtagctgggactacaggcacccaccacctcacacggctaattgtttgtatttttagtagagatggagtttctactaaaaatgttagttaaagtgttagccaggatggtctcaatctcctgaccttgtgatccgcccgcctcagcctcccaaagtgctgggattacaggtgtgagccaccgtgcccggcctgctaggatccaaatattaagattctgcatttaaagtcacttacgctctctgcacttaagctctgtaaccttcattagaaagttacaacccaggtattattttattcttcctaaaatctttgttgcaataataacagcaaggtgcattagaattagtgaaacttggtcatgcctaaaggattcatgaggtgagaagatcaatcaaaacaaagtcctgcctctgtcaatgtctgccttagaaatgcacttacacctttctgagacagctggctatttttggacataagaaacctgctaaggatgcccaggtggcttggaaagtagagctgacacagatctgaagtcactggacaatcccagctccacatactgtctttcagttatttttcctcttacacacctggaaggatttacttgagtctcaagtgctcactctagttccagctcaaccaagaaccatgccctttccatttaaaaggtgagatgacaagagtgcacctatttacaattgaaggtctagaaaatagaataggatttcagaccattctcagtttgtccctgtggtattgctgatataataaatccaacatccccccacccgccacacacacacagaatagtcaggcaatttctcagcagatgctacaaatttcgctctatgccagtccgctgtgcaacagcctaatctatcctgttcaggttactactctttctgcttcatttactgcccaattgcttctgagactaatccaactctgaacacagaatgtttttttctagttaacatgaatgtaagaaatcagagaatattagccaagcaagactgctcctcctactatgactgaatatgcattcccaagtgaaatacagataataaataactacattgtgcttaataagtgccaggcactatcctaagagctttgcatatattaactcattttactcctcactataatccccataaagtaggtgctattgttattgccattttatgaatggagaaattgaggcactgaggggttaaagaacaactctgaaggttgttcaagatcgcataagtggtacctctcagagccacgtaaaacccaggcaacgtggctccatagtccatactctcagccgctgtagtagactatttcacatcaggctacctctttctaaatttgataaatttcttttaacaggcatacatttcaaaaacacaaatttgagtgaaaaataagatgcagagagataagtaaagttagatataatttatataaatgtttaaaacactcaaaaccattacatatatgttaagaatgtaaacacatggactggagggacacacaccaaaatcattatagttgttacacctgagaaaaaaagaattggagaatagagctgggaagggttctaataattttaattgtatcactaatatttaacttcttcatttaaaaaaacttgaaataaatatgacataaagtcagcaaatttgttcattctaagttttaggtgtattggtgtttgttaccatattctctgcacatttctgtttcttaaccttaaaaacaaactacatatattttttcttctattccttcctgtgccttcccaattccaatgccatgaactctacttccagttgaagtcatggaatccataagtattgcattttggaaaacaaaatcatcatgatgactcatctagggctagttagcgtaatagtaactacaaatagaatatttccagctgagagtggtgaaaacaacacaacaaccataccactcaactagaataggaactgagcacacgcacacaatgacagcagccaaccgtaattgccagagaagataacctacaaacaaaaatatttgggagaatttatttctactctaaacatagcagtctctgctagaacaatgacaatgctgattaagaatggcacactttagacatcattaatatcttaattaggatcagttttgctcacatgttatctcccttatcaaactgtgagttcttttaaaatagggttcatgcaggctcattgcttggcacatgacatgggtcttagtaatgctagttgaagaaaacatataaatgaagcaatatttcataatgtcattctttcccaaacctaaaacattcaactcttcaagcagtagggtgaccaatgaggctggcctttaaaattcctatagctagatagataccagtctgggaagtgtttgtaattgttgctccctagggtagagatgagaattttcccttgtcctagaaattactttgttttgagagggactgccttgtgagtctttctaatcatacaaatctaagtccatttcccattctttgttcttggaaatacccctcccaccaccaccattgtaacagatgcttccaacgaggtgttaagtattttgtttagtaatttacattgggtatattttaagcagaaccaagtttaagcagacttaaaaatttttcctctgcatttggctgccctgtttgaaaatccttgtttatcattcttagaagaacgtcttatttttcctaaaagtctgtgagaacagatcatcccaagaagagcatgtcagactaatctctttgcaatctacgttgtataacagataatggaaaggtgtaatgctacttgggccagactcttagtgtttctcatccagtgtttaaaatgaaataacccaaacacatagaaatgtacagataactactgtgattactttttctggaccaggagtggccagactgtgtagataactactgtgattacttttctgtaccaggagtggccagaccatgccctgtggtacaagcgtttctcctaaaagacagagatgctctaccttcagtcatgtggcagtaagaaaagcaactaacgttggaatgggagcaggaattttctctatggaattgggagtagcgcctaattgctagaggaaacaaagaatatccattatgcatatctaggctagaagttaaagagagaagacgaagaggctcttctagggaagcacatggcctaagggctgtagaagcagtgatagctaatatctagcttaacatttccattttctgcactgtaatacacttttgttttctgtaggaattcagcaaattattccaaagacccacagtctgttttttcttaagactgaaagaggagagtggcaaagttcttgcgcctcagcggttctgagttttcgaggaaagttggtggatatgtcaaataaacaccaggataaatttgtggaatgtataaatacttacagtgtttcttagaaattacttggtgacagaaaaacagcaagaaaatgaaaaatcggcagtctactcaatgagcccagctgtcaggacttgagaaataaaagtgaatttactttttagtcacaggttaatgaggtcaaaaatttttgttatataatttataatgttaaattttaatatgactttggcttgcctcctgtcctgatcctctgaataatctaccaacataagagagggttgaaaatggatcaccatagactattcagtagtagtgttactatgccgaattccaaaaaatcagtgatccaaaatcacttaaaagactatcacccaagttatatgttacagccaaattactgcccaataccattttacattttttatccgtgaaaaaccaaattgaatttttttctgaattctatggatattatggtgattgttagtttttgttttggttttttttttttggtgtgtgtgtgtgtgttttttttttttttttttgagatggagtctctcactctgtcacccaggctggagtgcaatggcgcaatctcggctcactgcaagctctgcctcccaggttcatgccattctcctgcctcagcctccggagtagctgggactacaggcgcccgccaccacgcccggctaaattttttgtatttttagtagagacggggtttcactgtgttagccaggatggtcttgatctcctgacctcatgatacccaaaggaatataaatcattctaccataaagacatatgcatgtatatgttcattgcagcaccgttcactttgcaaagacatggaatcaacctaaatgtccatcagtggtagactggataaagaaaatgtggtacattcaccatggaatactatgcagtcataaaaaagaatgagattacgttctttgcagcaacatggatagatctagaggccgttatcctaagcgaactaacacaggaacagaaaaccagatactgcatgttctcacttataagtgggagacaaagaaagaggacatataaacactaagagaggaaccacggacgccagggcctacttgagagtggagggtgtggggagggtgaagaccagaaaactttctattgggtactatgcttagtacctgcgtgatgaaataacctgtaccccaaatccctacaacacacaatttacctgtgtaacaaacctgtacatgtacccctgaacctaaaagaaaagtgaaaataataaataaaagaatatctatgcctttgaaagttacacactgtaagagttaacatttgctctctcactttccacagttacttcctggcccacaaaagaggcacttctgcctttcccagagtattggaaataagagtctttacccttccatccattcttctcactcttttccagggaagagaaaacttttgtgtgtttggtgagatcggggggaaattgaacacgtgaagtgtagcctgttgtttctttctctgtggatcaggctggccacaggctggacacatcctgagctgctgagtaggcactaatgggtcaggacctcgacctgcctctacaggtagatgtggaacccaaatctctctcacactactattggggttcaacaaagatgaggcggggattctcagcagatgagtcctctctgtagacccagaccttccctctggtgagttcgacgtgtcaagatttagttttgggagaaaggtgctaagttccattttgatcttctccaatctagtattccagcaatcaactaagaaggtggatagccatctgtttgacaagtttctgtattttctcagttgtctggaactcagaatgaaggagggagttcaaaggaagaaaatgaaagaaaagttattactgatgtcctcccccaagcccacagcacacacaaaaatctaaatatcaaatggcattgagtagactggtacgtatggtacagacctgtaatgtcattccataacgtaatttaaaatcatgtttgggagaatcttttgtaaaatggcatatccattagtatttttaaatacagacaagcttaaaaaaaaagaaacaaaaatgattcactattctccacctagctacacccttacttatatttaaataaagtcaatatgtacacatcattagaaacagcacagaaatgcacaaagctaaaacgggaaagcctcattcccgctgcttcagaagtttctctcttcaagtaatcattactaatagctgcttgtaaatccttttggaaaaaatatatgttccaaatatttcaatatatgtacctctttccatatttagaataattgtttagtcccatagaaaggaaacaaaacatattaatgtttgtgtgataacttttgtttaaaaaattcacacgcatagaatagaagagattatattggggttatagatttataagagattttcttactctacagagattttacattttcaaagtcttgtgctatcatcagaaaactgcataatctgaatatatatataatcactagtttttaattataaaagaaacacatttttaataaaaatttaaataatataaacacatgtaaagtaaaaagctagtcttccttttcagctgtcaaattccctaaaggtaactgcggttaattgaaaaatcacagaattataaatctgggaaggagattttatttcttatcgagggtaacagcctgctaagtggccattcccacaggctgggaagtgtagctctggcgaagaccagacacacgaacttcgaaggaggagggttggggtgggagctttatgctaaacagggtggctaatataggaggagttacgaatattcatgaaagtagttctgatgcatgcatactgaacaaatatgcatgtaacatatgacctatgttcactttggggtggaggcttaatattaagtgtattacagttgggcccagtgggtcaaaaggtgaagcagggataggaaggcactcaagtgcatagcttctgtaagccagccagagccagtgcatggtcaatggtctcttatcaggagaaagttactgatatcaatctcttgtccaatcaaagctacagttatcacttgtggaagagaagttgggggtcagttagcatttggtggagctgtaattgtttcaacattgcttatctcaaagccagtgcctgtttagctgctacagaaaaacaaatatcctgtggcagttagaacatagtttattctttttttgttttttgttttgttcgttttgtttttttgttttgagacgaagtctccctttgcagcccaggctggagtgcagtggcatgatctcggctcaccgcaaccttcgcctcccaggttcaagcgattctcctgcctcagcctccagagtagctgggattatagctgcgcaacactgcaaccagctaattttttgtatttttagtagagatggggtttcaccacgttggccaggctggtcctgaactctcagcctcaagtaacctgcccacctcagtctcccaaagtccttggattacaggcgtgagccaccgagcccggctaacatagtttattctttaagtgtaggggtgcataacttaacccttgcctgggatggctttagattctatttataatttgctaatttttggccacaaagagtctgttctaacagccgtatgatctccattttaacaatgctggtcagttgtgtctaaactgcaaaacagagaggatataacggcgaatctgacctcccatctagtcatggccattaactcagtttttttttttttttttgagatggagtcttgcattgtcacccaggctggagtgtagtggtgtgatctcggctcactgaaagctccgcctcctgggttcacgccattctcctgcctcagcctcccaagtagctgggactacaggcgcctgccaccacgcccggctaatttttttgtatttttagtagagacggggtttcaccgtgttagccagcatggtcttgatctcctgacctcgtgatctgcccgcctcggcctcccagagtgctgggattacaggcgtgagccactgtgcccggccatgaactcagtttttacagcttttaaggctcttctggggtgagcctcttggttgagaggggggtccagtcagtcaattaaggggcttagcatttagttgtagtttatactgccattagcaatttttaatgcatttgaccaaatacacacacacacacacacacacacacacacacacacacacacacacatacaagcacacagacattttaaatagatataaatatatttaaaatttataaattttttcaggataaaataatgtacatagacctaaatcttcacctggggaagtctcggtttcctaatttgtcttctataactgtaaggaggaatgctatcttactttatctcacgataagatttgcaagcccaaaggtcaaaggtaatgattgatgttctccatattccgtaccatggcagttttagacaatgcaacaccaacttttcactctccttttcaccacttttaggtaatccccaggctgcttgtgaacagaagactgtcaccaggctgaaagggctattactgcccagaattcctgatctcaattaatcttctggcctcagccttttaggaactggaactacaggcacatctactatctctagtcaaagacttatttgcataatggtggaattagttggggtaaaaggatcatcatcatcatcattttgagaatggcttcataatgactgtaactctgctatccacccacaagttccttagagccaaggtcagatgctgaaccaacatggcgattcactggttctcaagttcctccaagttaagcaaataattagtgccttagaaaaatgatccagctagcaacaacccctctcccctcaaaaaaagagattcatcttgtgtcactaagttttatttaaagaccatgcaatcgcatcccagctggcttcattgaagtaacaacgtgggcaatcagtgacaccaactgcaatgctatcgtttctataaacagtaatgagtggagggggtaggtcggtactagaagcttatgtataaacaagaaagatcatttcagaaagagagattgtctcaaaaaaagtcacagtatctttctgattgtcaccctatgaaatgcaaatgccccacatttaatggcatcagaagaaatattcaaacatgacattcataatattgtccagtgaaaattacatggcataaggataacaattgcatacactaaattagacaaagaacaataattccattgttttaagatactccatagaaactgagataacagatctataagtactcgctggatgtctctttataactctggtaccacagaatagaacttgcacctttctaagaagctgatttctaatatatctggctgtaaataaatggatttatgttgaagcaagagcagagaaaaggtatcacatagataactttgcaggatatctgaatatgggcaaagctaagtagacttgaactgagttgtagagtaattgccttttgttaaaaattgcttctttttatatctttatcttagttgtattcaaacacatttttttccagtaaaatatacagagatactactcatttccattaaagctctcatctgtcataccccagcacttccttgtgaactcctaaatgcttttcaagctcagagagattatcatgaatcttagattgaattaattattccttccttgaggtgacttctaccattaaacattaaatcaagtaagggttgttgaactgaaacaaactgagactcctaattacttcattttggcactttggccttgtatgacaccttttgcttataggtatagagttccctgctgagtctctattgcctgaaacagaacctagatacaatcaatcctgaagggtttttttttttgctaaattggaaaatggcaatctctgaagcaagagacatatttctctaactttctaatctcagatggagagggaaagaaagaagggaggggtggcaatttggaaggttaattggcatggtgcaagtatcctaggcttcagaaaaagtctgggttcccttctctcttctgctgtgcttaacacagagtcgggcaaatggattgctggcccatgagccagatgggagcattgagcctatcctttcaccataaactacttccctgatattcttcccaatgcacacaactctttgtttataagttgagagaagaaaaggagcatttatttgcagtttccattgcctggcaaaactgcagcagtgatgaaagctaccacattgtcagtgctttccaggcaatggagataactcttcctctcctagatgtgatcgggagcctcaaaaggtaatttccacattttagagtaagtagaaaggaatgactgagtttttcagagtcttgcaattaaattacaactttgaaagaataatctcaaagttcttggaaaacatcagtggggattaattacatctttggaaaagagatcgatatcatttaaggaataatgcaccaactagcctcaggacacacactaactagaatggtaataacaaaacctcataatttggtatgctaagctaattatcaaaagactacaaacagaaatcaatacatctatttattatatactacacatgatatcacagagaaattagagcattttaactgaaaacaggcttcaacatagctcagtaactttccattaaatcttattatttaagctgcaccgccttattatatcaacaaaggcaagttagataatacactaacttaaaaattgaagttactcacaaaaagaagttttaactttttatttgcattaaatgtctatcataggtcatacggcggggctcttcatcacagatactcaggtacacaggctaagggagtaaccactgccttgaatgtcagctgcagcaaagaacctgaggtgagttgtgctcaggctatgaaagcttccagtgtgtcacttctgctcacatttcatttgtctgagcaagtcatacggccacacctaacttccagtgaatgggataatgccatccaacaatatgcccagcagaaggacccaaaatattgggtgaaaagtgctaatgacaactcaacaatgagaaatgaacaacctgatttaaaactggtcaaaagacattaagagacacctcaacaaagaaaatacacaggtggcaagcaaggatatgaaaagatattcaatatcatatgtcatcagggaattgtaaattgcatcaataatgagaaattactccacacctattagaatgcccaaaatccaaaacattgacaacactgacaaaaatgtggagcaccaggaacctgcattcattgctggtgggacagccatatgctacagcaactttgaaagacagtttgacactgtcttaccaaactaaacactgttgctatacaatccaatagctgtgctccttgatatttacccaaacaggctgaaaacttatgttcacagaaaaacatgcacaaggatgtttatagcaacattattcttcataatttccaagtctcgaagcagccaagatgttctttagtgggtgaatggataaataaattgtggtacatccacgcaatggaatattatgcagtgctaaaaagaaatgagctattacaccatgaaaagacctggaggaaacttaaattcatattactaagtgaaagaagtcaatataaaaaggctacacactatattattccaaccatatggcattctagaaaatgctaaactatagagatagtaaaaaggccataggttttcagggattaggaaagatggagtttgaggtatgtgttttttataggatcgttgaggttttttttgcctacagtgtttcaattccacatcaaggccacttgatgtgattgtttagctcagtctctaggcatctgataatccttcaggctaccagcctgagaagcccctgagtaaataacgcagaagagtcataactatacacagaaggaggttgattttctggggcagcccaagtgataacacaggcaagcaaggaagcaattgtgtgtacacacacacacacacacacacacacacacacctgctactattactactactgtagggacctactgccaaaaatgctgcccttctgtttcagattgagacttaacccagctttctcaggagcctgatcattaggacaggaattcctcttctacaacattttaatggtctttcctgctgaagtgatgaggaacctgcaattttaacaccactctgatggattgcttccacatttcccctgactacattttgagaggaatgggaataggcattagctattgttttaatcactactcttctgtgagtctttttctttgtaaagtttctatctctagagaaaaatgaacttgctttacttcccctttaaactaaaaacttaatatattatcagattaatacaagtgccatttaaccttagcaatattgtttagcatcttaaacttgaaatctttcatttaatggatgggttttacatgcttaaaaaaattcattttgagaaatggaaaaaaaagaatcataagagacccagaatttagccttaaacaatccactcaaccttgtctgagattgtcctccatttgatagcttatacccatcctactgcagtacaaaggactcagaaactaatatgatggataaactagacaagacattcatatctgataatgtagaggaaagaccggagcaataatatattttaatgatactaaaaagctcaaaataaatgattagtttatattttcttagtactattcatttaataaaacttaaataaaatatcaaaatgcttataattccaactattcagcaatctgttaggagaatctcttaacctactgtaacaaattatgttatttcctttctgtggacctcacctccctcaactgtaaaataatggagaagaagcagctggcataaaactttgttatacatgcttacattgtttaaaatattacttaatttctccttaagttagttttaaaaattagagtggttcatctgagctgtttttatacatttgctctgtgaaaaaaaatgtttgatatcattacctcaatttgcatatgcacactgggcatggcaatattacatgaaaaattgctgtgaggtcatactaatggcacagaccacatgaaaaaaatatcgctttaaaatagaacacaatgataaaaggacctaaaatatactaagcacatggtgtatagtaggcttaaagttcttataacagtgcctggcatactatgagagctcaactaaatctttagctgctattaatccatttaatgcttacaacaatctattaggtaggtaccattattatagtaatttacatttatgcactaattaggaaacagcaaggccatgttagttacactagatcataagtttaaaagagtcacaattttcgtaaaggtagtttagttcccagaaacagtcttctgatacaaaaccgtatattacctctgtctgtggaaagggtgggaaggaaacttcactacttggaactaaataccattttacaagaattcctctaccccactaagtaaaaatgcatatataaataaaacacaagttttcacagactcactgttaaacctagagtatactcaaataaatatatatatatatatatatatataacaggctatgtctatcatttccactgttgtcagataaaaataatgagtttcaaagatgggtagtgacttattgagaatgtgttacaactaaatcagtcccatacttgcaacaaactatgctgtccaatcacataagttaacccttctatttggatctatcgctatttaggaaactgactctgcaggtaaactgaatatctttcctaatttgacatgagagactgccctgtcttcattacataccctacacagttttaaaattttcacctctaagagacatatacccaagttatgatctattcacattatatttactgtggaccaggaaaaaatgaaataataacacatatctctactggcttcttgaaatatgtatatcaaaacacgaaactttaacataaagccacttcgtttagaatatagtggtatgatgcgttttagtacttacaaatataatggcaaaaaataatgtacaaataatcttccgaactgcatggaagtaaaaatgagatctcgttgctgattccattttgaaagtgtgttctgcaatttcataaatcagttctttttagtagttttctatttaattctaattaggtctttttaagtagttttatatttcatttagactgatgagtaaccacaaagtcaaagatctataagaatgaatgaaacctacatatattataatctttccaaatataattttcatagctcaagaacagagtgaaaataggtgccataaccaaatgaatcagactctccaaaataacatatggagttttaaacacgaaatcttgtataatgttgttaaatttttgaaaagtaaaattatttggaattcatggaccaaaaacgtatatttcttggcaaaaagacacttgtctagatgtattagggtgtcattgttctcttcccacaccccactcccagtttgtaaaaggaaaatcaagacacagaaactgaattagcccttgcaagattaatagacacaccactttaaagataacttatacaaaccttttaaagaactttataaacaattagagatagacaatggaggaaacgtggtgaaacagcacaccattttgcaagacttcagcataaaagaatcacacttatttgatattagtttggtggggtttttttcattcaatttttaatggcctttctcaatatctcagttcattcaaaggttctgattttctttcttttcctccgtgtagtctttcccagggcacccggttgaagcccaaggctaactgggaccctcctacttcagcaccaaggacagaaatcgctaaatctccaggggaaacgtacccctaaccaccgccagatgtctacttttcagacaaagcaagaaaaagaaaatatacctgccttgccagccatctgtttaaaagtcccctctcctgtggaacgcacgagcaacttttcggagacactgaacaactccaagtcgcgcgccgccctcgcaaatcgcagagagggccgcgagaaggtgcgaacgcaggtcacggccagcgccgcttggagagagacccgcaggtttcagcccaggcgcgcccggcgaaagccaacgcgctctccctacaaagcgtcgatgacttcagggatttaaaagaaaaaatacccacagacagaaccagcggaggggccctgacctcgccccagtcgggaaacgccttccctccgccacaggcagcgctgaatgaagcagaggagggcggcggagagggccccggaagaagggaagggggcattctgcagtgtttgggggctggggaaagaacattttctcaccacttgggctgtcgctggacctcaggctccttccacagagacactgcagcatatgcactcctttcttcagagaaagctcaagaatcttcatggagaagcgcgtgtgtggggttggtcaactccccgcccacctgcgctagtagtccaaccaacaggcggcctgtcttcggaagccgggtcccgagtccatcgcgcgcgcccaggtggaggggagtttgcacatggagccggagggagcccgggcgccggcagggggcgggccgggacgcggaagtgccggtccgccgggggcagccctccgagagcccgaggcgctgccacccctcggtgggctcgagcacggccccttgagaccttccggaggcggtggctggtctgaggacgacgcggaggacgtcactgcgggtcggtgcttccttacaggtgccttctggaccggggtccttggcacctcccctgctcctgccctcggtgccggaccctgtgccctgggagcccgactacctcggtgtcccagccgtcccgggcttgaggcgctgagagggctgcgcggcttccagcccggaaggcagcggtcccgcgggctgcgcgcggccaagggcgactccggtgtgggaatccggcggaagggaagcacccgcagggagggctggaccccggaggctgcagagcgtcagaagcgactctagggaactagggggtggggtagggaggcggggacgtggaataaagaaagctcctgggtgccggctatgagaagtcaggtgtgcgtaggcgtggacagagtgccgatgtgggagtctggacacctggattttctggtcggggctctgtgtccttgggtaagtcacttaccaccctgggcgtctccccgtcaatctgggtggggaagagggtgtgagatagaggattggcagcggcgtgcttgtttgtccccgtgcctttcaggctcctagaaaagcttagcataggtgcagtgggaagtggagctagaagggacagagggagaggaggcaggtgaggcgagaaatctgaagacaaaagagcgcttcgctttggcgccagtattctggcaggctttgcctctgccagcccgccccgatgaccaaacagcttctccatgagtttaaagatctcgatttttttttcccagcagcccccttgactctttttttttttcttttcctgatgccaacaatgcccttttggaagtgcaatgagtaagcatgggaagaatgctgtcgaagtgacaggacgtaaccctatgtggaatctcagggcaagaggggactttaggggacacttagcaatacaagtgattaagagcacagacactagagacaagcagcgttaagttcaaattcctactaggtgtgtgaccttgaacaaattacttaaccgctctgtccctcaattttctcatctttaaaagaaagttaaagatagcatctgtctcacacaccccctgagagttaagaaaacacttgttttaaagtaagtgctaaaatagtgtttgcaattattattatttagaccccacctgtagggttgtgaatcattttcactttccgatgaatgccagtgttcataccagtgaatttctgcttgaataatccaggtgacagtgaactcagcagctccctaggtaattcattgcacgaaaactgttaggttttccctgaggttgagccaacaactgacctcacctttgttccatccattgtctcaaggctgcctagcactaactggttagctcttccctgcaagggagtaaaaatggtttgcatcacacctgttctctttctcttatataggctaaacattcgcggttccactggctccctaacacttgaaatgatgtttgaagttgcctggaagaagtctcttccttttttctctcagaggtgatggaagaaaaaccagaacatctggagggccgcttgagtttacagccaccacctgggttcacaccctcttagctcctttcaaagctgaagctccaggaaaggtcatttggggtgattccaagattcaagaagatatgcccaggcctttctttctagtcgcctcttagtcctgttgttcagtggtatcacaagctctttaagctccaaggtccttgaagatcttcctaaaaccactgcagtgacatcaccgaagaagttatgcagccccagggcaacctgagccatggtcttcatctttcctgtctctttgagaattagtgagaaaattggctcatctgggattctacccatagaaattccccacagagggagagacaattagcaaaaggaaaacatctaaaaatagtcctttgtgctgcagcggaacacggttttccggtagggctctcctattctggaacccaatacctagagctatttccttactttgagggaagtgctactcctggaaaaatagcaaatgaacaggacaatgctgtggttccctcgacggcacttgagcagagtgaacaggtccgtgtgtgattttaaaacacatatgacctcctgagcatcagtttttatatttatcacaaccctctctgcctcctggcaaggttgtggcaagagttcaattaggtaaaacatgtgaaagtgctttgaagattttaattatctttgcaacataaggtgttattaccaacttccctgggttctgggtgttagactattgacgtctaatacagtggctctgttatttgattataggaagcatttatgtgtgagtcttcttactccacaacaggattgtaaacttttaggatgcaaagcaggaaagacaactcagtacaattaatattcaaatagtgtactgtattgtttaaatggctatcacagtgattcttatgaccagagaggaaatggatcatcacagtacttataaaaacaaactgaagtattacatttatagattgttttgttggtattgagctttcaggtgagttcagagggcacgtaacattttaatgcaaaatattttcttactgtatagtatggacatttgataatagtaagctcgtactttgtaagtatatatcaacataagtttctactttgtaagtaagtatgaaagggacttgatcagtagaattgtattacttagacagttttttattttttaaaaaaggctcttacacttatcaggatttcaatgttcatgctttttaaagcaactcctcatgtgattgtcacccacttccacaattaggcacacagagtacagtctttctgaagtatcttgagcaatatatcagaattcatttttacatgtatcataacatcccaaaaaagacaaaacaaaacaaaaaaaatagccaggagcacatgaagggtaagaaagtgatgtattttagtttgaacaagaacattcatcttttctcctttctgtgtattatcccataagccaaactcaaaattttactggcaataatatttttaattttatattcagatatattattgttttaatacccaaattttaaattatgttatctgtctgtagttgggattttttaaagttagccattctttctgttttctaattgacttagacatcttggacaaattatagcaagtgactcaccagtgtggcttcaaaataaaataagttagcactttttgagaaggattaggaattctggtatataatgatggatgaatgtgtttgaattcctagtacctaaattttttctttttaaaaataattactaagagtttgtagaaattaataattgtgtaagggagttttgagatatttaaattgtgacttatctaagatatttttctattaagactaaacataggcatctgttcactcttggcatcagctgtgcaattaatcagtatatttatctgtttggaagagaatgttgaattggtaataacatataaagaatcatgccaggttgcaaaacttttattgaatatatcaatggcaaaatgtctgttgaattgatattaaatttattttcacaaagaaaccaacatataaactaaaagatgaaaatcagtacgatatctaacatggcatttttgttccatgttatgcatatagcccattgactctgaaagggcacaaaaccatgcctgtagctctcatcttagcaataccttcaaatacaatcttgatactgtttttaaaaaagcaaacatgttattttaaaatttctcttcttccttttgttcttttttatttctttttccttcccctccctgactcctgttcctcttcttcctccttctccttctcttcatcttcttcatcttcgttatctccttctattattttccaaacttttttatcataagtttccacttatgcaaatgttataaaataagactgagagttcatacataccatttacccaatttccctaatgttaatgactttcatgaccagtgtacaaatatcaaacccagagcatttacactagtaccttgtgattaactaaactacaaactttattcagctctcaccagctatgcagctctcaccagctcttccccaccctcatgtcctttttctgtaccagatccaactacgacccatattgcatttgattgtcatgtcacttgaatctccttcaatctgtgatggtccctcagtctccctgtctttcagtaccttggcatttctaataggtattggtcaaatattttgcggaatgtctttcaatttggatttgtccaatgtcttctaatgattagtctaaggttattcatttggcaagaatgccatagaagtgatgttgtatccttcttagtatatcattatggcaggggggagggtacatgatgtcagttagtggtattaaccttgattgcctggttaaagttatgtctactagatttccatattgtaaagttacatttttttcatttataattgataaatatattgaggaaaaaactttgatgctgtgctaatgtcctatttttcctcaaacttttatccactgattttagcatccattgacagatcttgcttgcaacaattattaatgtgcagtttgcccggcagtgacttttgtatttcctttattctgtctaaagtaataggaattctgtaagagctgttccttctcctacatttatttatgtattcagttatttatttatatcagtatggcctcaaggatatttattctaaggattataatccaatactatcattatttattttgtggctaaaattgttctggctttagccattgggagatccttctgatttgctattgtgtccttttgacataccccaattgttttttagcagttccttaattgtttggcatcacataatgttccaagtttattttgtcccctctaccctagccctggattcaaatgattgccaaatgagtctgggttctttctttggagaacaatagcaaccaacatctgagcgctaagtgtcctcattcttactggggtgttattgctctcaggtcctctcagcagagagagctaggaaatctatatacacatacacgtacatcatatttatttctacatttctatcggtatatctttttagatagattctgatatatcatgtagagctagagatagagatagatatcgttaatacttcaatcctaagtcaataccaccaggttcattttattttttgccttttccttatttgtaacttctttctgacagtgaaaggcctgacttccgttatttataatatattcacttatttattaaatcctactatacacttaaggtagttagagaattgctaactgatactcctgtgagaaacacttattacaagagtacagtatttatgtacacttatttttgtcttgaactttacagtatccaatcaaaatactattttcttttgaaagtgacttaggttgcttctttacttgcccatcctcttcagtgtggtttggttattcatttgtaaacttatattccatacacattgattttaattatttaactagatttagtttacttaaattattttttttatttgggtgcgtgaaacgttactatggtacttagagtcaaagctttaccaaaaagtatagcttgataatcgttattccctcattatccctcctggccagttcctgttccctctttttttccacttatttcccatgcactgcctataggtaactggtttctttagtttatcttgcctgtgtttcttttgtacaaatgcacacacactcttctatgtagtggtcttttgattgtttccagtattgtactattataaacaatgctgcaataagtaaccttgtgtgtagcattttcatattgtagaaaacactgctaaccaatactcctgtgagaaatacactctgtgtgcctccagggtagcctcctagaaaaagaaatgctgggtcgaaaagtatgtgtatagatatttatgctaagtattgctgaattttactccagaaggcttgtatgaatttagattcctgccagcaatatatgattgcctatttgcccacagccttaccaacataatgtattgtcctactttttcatttatgtcagtgtgattgtaatgttttaatttgcatatctctaattatgattgagtttgaacattttgtcatttgtttgagaacttttttcttatcttcaaatagatacctccaggatttggggctgcagttggacgttttccatctcttctaatagcactgtaacaagttgtcttgaataaacacgagctcgttagccataagaaaactttaaagatgagttatctaattcaaatggaaggaaaatgtttttaaatcatcatagtaaaatatgagctgtttattttgcaaaatatgaggtcaatcagttcaggataataaatacttatgaatgtcaaggaaaaaaagcaattgctcattagtcaaaactcattaccaaaggaggggcacaatacaaaatgggtgtttccacccttttctcctatcacctgaacacgtctctgaccctataaattatacacatttcttgagacctaccatagaagccacagcgatctctctggtaaactttccctcctatctccccgcctcccccaaagcagtcacagcttcctcgtagttcccacagcacactgcaattcctctattataggatttattttattcagcttgcacatgtatattttccccccaagagactatgagccttttcgcctccaaattttggtgttcatgttcatatcttttatgtttgtatatcttggtacctagaatatgtaagaaataatttatttaaatattgatgaaatgaaaacaatggggacttttactttgggaggccgaggcgggcggatcacgaggtcaggagattgagaccatcctggctaacacagtgaaaccccatctctactaaaaatagtaaatattagccgagcgcggtggcgggcgcctgtagtcccagctactcgggaggctgaggcaggagaatggcgtgaacccgggaggcggagcttgcaatgagccgagatcgcgccactgcactccagcctgggcgacagagcgagactccgtctcaaaaaaaaaaaaaacaaaaaaaaacgggggggacttttttgtgattttccaattgggaaaaatatttgtaattctgtattacatttaaaaacaatagctcagaaagaatttagagtgaggatatgaattagatagaagatataacttacttttaaacatttgaaaagtcatcagattcacacatgaaataatatatataatccaaaatcaaatattaataccgtataagatttcaaggataaaaatgtttgataacttggtgtactagagagaatataaaggaaatgggaaccctcatacattcttggtaaaagtaagcattaatgcctttatggatagctatttgtctctaaccttcaaactttaaaaagccaattccccctttggcaaattcttatttagttattttagatatagttgcataagcatacaacagtgacaactgcacaaagtagtcggtacaacattgttgataacactatttgatagtagtgatactaatctatcaataaggaactaacttacattttggtatattcccacaaagtaatgtgctacaatttttttaatatgaatagatctgtgaaatttattactgaatttaacaaccatataaaagaataaatatagtttgccacaatttgtgtaatctagaaaataagaatgtgcatacgttcacgtttataaactcatggactctttctgaaaaggtacacaagaaattggcatcagttgtcgtctgagggagaaagattaggtagcagaacacaacagagagggagacctacttttgactgcattccattttatactttaaaaatgtaccatatgcatattcttcaaaataaataacatattacaacaaaaatcagttatataaatttggctttgatttttaaaacatatttattactaagcttaattaaaatacaaaaatccagaatgtgaaggagacacacagggactagaaatgttatttctaagttgcaacaggatatagtcttgatgccttgagaatcagaagacctaagtgaacatcataacttctcagagcctaacagtagaatgttggtaccaaaaggagttcaagtattgatgatcattatcctctaggatgaagggatgcatgaggaaatgataagaaatttccaaagtgccataaatctgaggtgctactcttattttacttttaaactatatattcatttttaaatgggaagtcttacatttaggtgacattgggaaaaatagttacttccatgtgattgttataaaccatgtttgattcccacatgcccttctggaatttcaacaatcttgagtattaaagacaccaaaacagtaataaagagccctacccaagtctgataataaagattcacccaacctcttttagctttcgtattatccaagctctccaaataaaactttcatcaaattttataagatactattaagtccacctgttaaatgaattaaacaatattcatttctattcactgcacatttagcgagtgcatattttgtttaaatataaccctgccctcagtggactcactatctcatagggatggaaataatagatagctatacaaacaatgttgagatggatagagaaatgtgaagcctgtggtaatgatagcacagatgagaagagtgattctgattgccgaggagggatgcaaaccatgtaaaaccacatagcagtatcatgatatttgtaaagaagaggttcttccaaaatgcagatagaaaaaggatatgtatatgtggaatgacttcatttggggttttagggaataaaattttaacataagtcaactcatggtagacatttattttctaactccatcctttaacagaaaaaaaaaatacaaaaaagggacagtgacttctaaagtcacctggcccccagcagcagggctgcaactaagtggctcagaacccctgcccccttcctagtgcaacattctccaaaagacactatgatgctgcccctggttttgatagcatcagaatcaaacttacttgataataggcatagaaattatttcagggcatttttcctttccctggaaattgaattttctctgtaaattgtctgctttttagaagcagaaggcagccattcatttaaagatctgaccaataaaaataagcattgcctttacagtaaactctgagctttctattagtgttaactttcagaaaagggcataggaaagagtctaagcttatgactttggctaactttcctgatggcaagcttttaactgtcctaatacaaatggttgtgggaaaggaggagaaaaagggttaactggagatgttcattaggatccatatcaaaggcttgttggacatgaagtaatttggagaatgaatatttcagcccctttaaggtgattgttatgctcacaaatatattcacaagtgtacgtatgtatatatctttctgcctgtgcagaacacaggttaaggccaaagttgccactctcacataccaggcaaaaggcacatgtggaattttgaaatctcctttgtgcattatttttctatcctctcttttttcccttccacaaacatacaaacatcttaaagaagaggctatatgtactaccttcacttcagcatttcttttctttcttaaacccgagtgctgcctcctgcttgcacaatctcaccaaagttctttttataaaatcaccataatcaaggctattccagataaaatggacacattttgtcctaatgctacaaagatgcagtaattatatgtgttgaaattattgatcactctatttcaagaaactcttcctcatcttcagaaacatcatttttctctcggttttccttctacttctctattaacatcatagttctctttctgccatcctctaagtgttactatttaccaagcttcaatctcttctccatttttactgttactaggcatcttcttacacattaaaattcctacgctattgataactcctggatctgtgtctgctgacaagatacctacatagatttaatcatccatttccaagtttccctggaaacctctgctaaaggatccacaggtatttcaaaaaaataataataataactacaactggacacgtatctttctctgtaaacttcttgagctccatattttaatgagcaactacatctaactatccagtttccaaattcaaagccttgtgagccatcctagactgttcttgctaacttatctccaatcagagagtattacagatactatttgtttaacatctctaacatccatcactttattcttgccttccttcaggccctgatcacatcttgcctaattactacaacatatttacaaaaatattccaactgccttcaatttagcctccatactgccaaaataatcaccccaaaacttaagtccctaaagaatgtggctcttcagaaacttttcattgtattgaagattaagtcgacagtgtaagtttggtacataaaacctacgatgatttgcttgtcttcttttatctccgtacatgaacttaactccatccatgtccttgagtctcaccgtttttttcttttctattttttttgagtcggagtctcactctgtcgccaggctggagtgcagtggcaccgtcttggctcactgcaacctccgccttccaggttcaagtgatgctcctgcctcagcctcctgagtagctgggactacaggtgtgcgccaccacgcccagcgaatttttgcgtttttagtagagatgggtttcaccatgttggccaggatggtcttgatttcctgacttcgtgatatgcctgctttggcctcccaaagtgctgggattacagccatgagccaccgcgcctggcctgagtcacacttccatgttcatgtctacatgtttttgcacatgatagttcacttgcttagactatcctgctttctttcttcttccagtgagttcacaccaacccttcaaaaattggattcattatcacctctgtcaataaaccttccctggctggattaggtgcccttctttggagcttacctgcgcatatttcttagcacagaactttcacacaatagtctctgatttccaaaaagccaaagtacttcttgaaaatttagccaaatagtcatgcaaactaatatattattacaactgtaacggctgcaaaagtggagaagtacatgattttatggtgtctaaagaggtggtagaagtgttgatttagccagaggaatcaggaaatgctgaggcacttatcacatcatagtttgtgtcacaattagttgggcacatgctttatatacagttcctcacctcaagcttataaacacacacacgcatacacacacacacacatgcacacagacacaaacacagtcacttttgttccctttcatggtaagtcttaaaagtcattcatcatgaaatattactatttctgcctttcgcaatatacagatgctactcaaaacataggaaatggtcaataaatatctgctgaattgaattgaaaactttacccgagttgcagaatagttatatgattctgtttctttagagttaaccatatggttcgactgaagataaagccttaatcaaatttattataaccttacatttcagttacaacaaaagcagtatgcgtcatgccttctgtctttcctaaaaatcaatgacacacctaccacatggtttcaagtatgataaaaataaaggaagtcttgaaaaaatccaaaagaaatgcaagccaggagaaaaggagcctttggaacccttaaattgatgctgacttgaatgtgtcctcaaaatttcatgtgttagaaactcaatccccaaacatatattgataaaatttggaggtggggcctttgggaggtaattaggattagataacatcatcagagtggggccctcacaatgggactggtggctttataagaagaggaagagagacctgagctagcacacacttgccttctgctatgatatgacacagcaaaaaggccctcaccagatgctagcagccttccctgcctccaggactgcaaaaattaaatgtatttttctttataaattacagtctgtgatattctgttataacaacagaaaataaactaagatgatgactagtttaggataaagatcctggaagaccaacagacaaagacctgggagaagaggttcatagtattagtctgaaaggttgtatacttccagattttgccattgtttccatttctagttttataggttaattaacaaataatgaaaaatggaaggatcagaaagatctgttttctatggtcttatgcaagtgcacattgtaagcattcaatatgtagatatgaaaatcactgcaataatgcttctaggagccagcactagataaccatcttcagcatcctgggcttatgtaaataatccatttagactgaactgttattttcatttttatttttttatttgtacatatttatgggtgtattagtccattttcatgctgctgataaagatataccagagactgagcaatttaaaaaagaaagaggtttaatgacttatagttccacgtggctggggaggccttacaatcatggtggaaggtgaaaggcatgtctcacatggcggcagacaagagaagacagcttatgcagggaaactcccccttatataatcatcagatctggtgagacttattcactatcaggagaatagcgcaggagaaagacccacccccattattcaactacctcccactgggtccctcccacaacatgtgggaattcaagatgagatttgggtggggacacagccaaaccatatcattccacacctggcccctcccaaatctcatatcctcacatatcaaagccaatcaagccttcccaatagtcctccaaagtcataactcatttcagcattaactcaaaagtccacagtccaaagtctcatctgagacaagtcccttttgcctatgagcctgtaaaataaaaccaagtttgttacttccaagatacaatgagggttcaagcattggaagaaattggccaaaacaaaggggtgcaggccccatgtaagtccgaaatccagtggggtagtcaaatctcaaagctccaaaatgatctcctttgactccatgtctcaggtccaggtcacactgatgcaagaggtgggtccccatgctcttgggcagctcggcaactgtggctttgcagggtagagcctctctctcagttgctttcatgggctggtgttgtgtgtctgcagcttttctaggtacacggtacaacctgtcagtggatctaccattctagggtctggaggatggtggccctctcagctctactagacagtgccccagtagggaccctgtgtgggggctccaaccccacatttcccttccacactgccctagcagaggttctctatgagagccctgcccctgcagcaaaagtctgcctgaacatctaggcgtttccttacatcctctgaaatctaggtggaggttcccaaaccccaaatcttgacttctgtgcactggcaggctgaactccacattggaactaccaaggcttgagtcttgcaccctctgaagtcatggccagagctgtacattggcccctttcagacacagctggagcagctgggacacagggcaccaagttcctaggctgcacatagcatggggaccctgggccccactcacaaaaccacgttttcctcctagtcctctaggcctgagatgggaaggggtgccatgaagacctctgacattccctggagacattttttcattgtcttggggaacagtattcagctactcattacttatgcaaatgtatgcagtcagctggaatttctcctcagaaaatgggattttcttttctatcgcattgtcaggctgcaaattttcccaacttttacgctctctttcacttataaaactgaatgcctttgatggcacccaagtcacatcttgaatgctttgctgcttagaaatttcttctgctagataccctaaatcatctctctaaagttcaaagttccacaaatctctagggcagaggcaaaatgccaccagtctctttgctaacacataacaagagacctttgctccagtttctcacaatttcctcatctccatctgagaccacctcagcctggatttcattgtccatatcattatcagcattttggtcaaagccatttgacaagtctctagggagttccaaactgtcccacattttcctgtcttcttctgagccctccaaactgttccaatctctgcctgttacccagttccaaagttgcttccacattttagggtatcttttcagcagcaccccactctactggtatcaatttactgtattagtccatttttatgctgctgataaagacatactggagactgggcaatttacaaaagaaagaggtttaatggacttatggttccacctggctcggggggcatcacaatcaaggcagaaggtgaaaggcacatctcacatggtggcagacaagggaagagagcttgtgcagggaaactcccccttatatcatcagatcttgtgagatttattcactatctcaagaacagcacaggaaagacccaccctcatgattcaactacttcccatggggtccctcccacaacatatgggaattcaagatgagatttgggtggggtcacagccaaaccatatcagtgaggtgcatgagaaatgttgttacacatatctaatgggtagcaattaagggaaggtatctaaaatgtccatcacctgaggataatacagttttgtcaagcatggtcatcctattctgctaccaaccattacatttattcctcttattggattgtatgtttgtacccttaacccacttctgttcatccttctctctccatcctgtttttttttttaatttgacatctacattctcttttgatccactttctctcacttggtggagcttagtgtttagaggttgagctttgaaatcaaactggacctaggattacctctcaacccttacatttactggatgagacgactgctccttctttcagtggttttcatgtgtacaatagagtgagtattcatacttccttagaattgttgtcagaataaattgagatagaatatcttaatatggtgcctgccagatcgtaggtccttaaaaattgtggtaatgatatggtggagaagcttattgacatttatgacttttgggaaactctaccagtaataatccttttcatcctttcatccttgaagatttattcaacaacagcaatattgctcatttgttatttgagattattttaataatttctcttctgtatctataaaatatttaagaattgtctttgtttgaaggagaaatctaagaaaattggacttttagtagaaagcttttgaaggattttgcttcatcaaaattctataagaagtgaatactaatgggcatggagtttttttctgaggtgatgaaagtgttcaggaattagagtggtgatgggtgcatagacttatacatatactaagaaccactgaactgtacacattaaaagggtaaattttatggtatctgaattgcattttaatttttttttttagatagagtcttgttctgtcacccaggctggcatgcaatggagcaatctcagctcactgcaaccttcacctaccgggtttgagcaattctcctgcctcagcctcccacgtagctgggattacaggcatatgccaccatgcccagctaatttttgtatttttagtagagatagcttttcaccatgttggccaggctggtctcgaactgacctcaggtgatgcacccacctcggcctctcaaagtgctgggattacaggcatgagacaccacacccagccctgcagtttaatgttttaaaactataagaaaaatattggacagcaagatagtttacagctacacacgttattagagtggtgattttttttctttcctgttttcatttcagttgtccactccacattgtagagattatgatcagtttggttgtcaaagtcttagatgacatcacaagaaacacttgagagctacacattgctgagttcaagtcccagctgtgtgttaatggacacatttcttaactttaatttcattttccccatttgcaaaacaaagctaatagtctgccttgaggtttgttgtggcaaaaagaaaaaagaaagaaagaaaaggaaatgcttaacatagagattagcacttagtggactccccatttacagaagatcttcttcaaaaggactagtacattccgaaaaaagaggtttgggtatttttttttctttttctccggtcagaacctattatgaaacacccactggtcgtccctatttttaaaacgtataattattttaaagcaaatgaaaatacttttcttaaaggtgaaatttaaaacttaaagttattaacaacattttgggttgttatattttgaaaggaagttatgtgaagataaaatttgggaaatcaaccccctcctttaattttctaccacacgcttgatgctgtcactgacaccttgagttgaggaatataagtagcttttgcttaggaggtgttaatctgatggcagcttatttggatagtgctttcttgtttgttagttgtttttagtccatggtcttcctagacactcagcattagacctacattctggattagcatatactaaaatccagtttcattcttctacatgtagcttgctagttttcccagcaacatttatttaatagggtgtcctttccccaatttatgtatttgtatgctttgttgaagatcaattagctataagtgtttggctttatttctgggttttctattctgttccattggtctacatgcctattttttatactagtaccatgctgttttggtaactatagtcttgtagtataatttgaagttgggcaaggtgatgcctccagatttgttgtttttgcttagtattgctttggctgtgtgggctcttttttggttccatatgaattttaggatttttttttctagctctgtgaagaatgctgatgacctttcgatggggattgaactgaatctgtagattgctttgagcagtatagtcattttcactatattgattcttcccatttatgagcatgggttgtctttccatttctttgtgtcatctatgatttctttcagcattgttttgtagttctccttgtagagatctttcacctacttaagtatattactaagtattttttttattttttgtagctgttttaaaagcaattgagttcttgatttgattctcaactttgtcgttgttggtgtatagcagtgctactgatttgtgaacattgattttgtaccaaacttttgatgcttgttcttaaaggcagagtttaaagactcactatgagtgacacacatacactgtacacacaacaatgacaataacatttttaatttctcaattttcttaaccaaatcagaaacaaattttctggaatttgccttcaggtatttttagcaagaaacatgaacaaatatgaaataaatcactatttcttatggttttttgcttgtttatttttttcttctatgagacaattcttgtatttttaatgcatagtcatttggggacatcaaactctgaccatatttatgtggcatgacacttagcaagctgcagacatgatctagaattgttttctctaaccttatttctcctacacaccatcacaagaaaacaaatgatggatgtaaatatctattttcaaaaggcatttcatctgacaccatcttactcagagtttttgtaattgcatggagaaaaaatttaaaatagcgtgtgctcagggattcaaccaattttgataaaaactggttgaatacttcacttcttcttcaaaagtgtataatggttccttacaatctatagtcaaattaccaaaatctgtaacttggtatgttcaagaactggcacaatcttcacctagctttctggacatagtttctataatatcacttcccccataattacttcaagtctacaatcctttaccagaaacagctggggccgagtgagttttgtaattcaggtttttggggaacaaggtggtatttttttaaagtaatacagttaatgtataaaatattagcaaaatccatgtatgttggggcctgcacctataatgaaatacattgatatttctgcagtaaaatctataaatattctcataagtaggacaaataaagactataaatagcctcctgtcaattcaggtcagtctgtagcttaaggaaaaacaacaacacacacagtggtcttcagagcttcttgaatttagaaattaaagacagtaaaatgtaagcctgcacttgctttacttggacatagacttttgaacttttgagcctctgttcattttctttccttagccaaaactgtcctctatgtctcttctagtttattaaagtttatcgtgggccagtccaaacatcagaagcgaccccatttttctctgttgtctgcatgcatatctctctccataggctagaaagtccatagggaatagttctgtgtctaatttgcattgcatactgtgattcctggcagtgtatttttcctcaaaagaatataaaaattggatgaagcaagcctgcttgaaaacataaatgtcgacaaaacaaacccaaagcattcagtgtcctatctctattcctctttataaatgtgaatttttataagatgacagggtttttttttttttcatatcagatgggtaatgtgccgatgtcttgacaaggttcaagggtggcacatctcacacatacacgtgaacacccaatcatcatgcttacgaactacaaaaggatcaggtttggttgtttaaaaaaagtaattttactcagaatctattttttatggtcaaatattttctagtgattctaagaaaaaagtataagcagtatagctgctagctttccattacagttcaacacactgagtaaacttcaaagaagctggttttaggttactgtagtgctcaggaaatgtgagtttttaaaaaattaacttatattttaaacttctgattttttctaatcatttaatcatatttctatcacttccagaaacaaaaccagatgtaagctctttatttttatttttattttttagatggagtctcactctgttgcccaggatggagtacagtggtatgatcttgcctcactgcaacctccgcctcctgggttcaagagattctcgtgtctcagcctcccaagtagatgggactataggtgcatgccaccacacctaatttttgtatttttagaaaagatggggttttgtgatgttggccggactggtaccgaactcctgacctcaagagatctccctgccttggcctcccaaagtgctgggattacaggcatgaaccaccatgctctttagtctattaaaaatgtatctgtttatttgatgttctttgcagtgctctttgtagacaattaagagtggctgataattcatatatgactgaataatactaattttgaataaaatcattttaaaattaccgattttagaactatttaataataataagataactatttttctaatattggagatttggagacattcctccaaatagaaataccaccttactattgtaagtttcagtggatactttgattttaagtctaacttttaccttacacaatttatgatcttatattctatttttaagatttagtagactatcatatgaagtggtattcctgactccttttgtaataaaatcattattaggatatgttataaaatgaaacaaataagaaatgaaaaaaattcttcctgaaatagtatataaggtgtgttttggctatggcaggggatttgaagaacaatgctgaataatatctagatcacaaaatcaactataataagctaaaaataggtttttcatatttggtactagcctccatatgaagtagctatcctaatatacagtactgtataacatctttttagccatccatccacctagtctttcatccatatatccatagggaaaaaattctacttaaaattaaaactcccttcttaggaagacagttcaattaagggagaataggtcttctttcttcagcaaagcatcttggtagatcaaaacatgcacagaggagtcagagagaaatttgggagtaagactggaggaaatggaattaatctgcagaacaatgtgagaagaatttggagctcctgtgagccatctggaagggactaaggaaaaccaaaaaccatggtaggaggctgcagtctgaggtatagaaatggccaagagactttttcagagaacaaggatagctgtacaatctctaaaatgaaataatttgacagaagcagaattcagagccagaggagaccttgaaaatataaactcacactgaaaatttgcatacaacttgctggtggttggggtgggcactactgaactctaaaattcatagaatggagctcaaaccaatcttagctaggtcttaattggtacaatgaatttagctgtatctgagatacataaacatacatatgcacgttttcatatgaagcaagtgttctagagctcattcattcaataaccccaaatatctgccacatagatacaaacctgaaagaagatgcaaagaagggacaaaagaaagacatctaaccacccacaaatgctgtcataaaattgtagcactaaattttacatagcttgtagggtaacattatgtcctaatacaatatgtacttacatttttaaaaattctatttacttttttacatattactctacacggctatttcaccacgctcaacggtctagaactacaacccacacaccaaatccagcaaactgcctgtttttgaaaataaagttccattggaacacagccaaagccatttgtttctgtgttgtctatgactgtttcaggctacaacctgagtcgagtgattgtgacaaaggctatatggtccataaagcctaaaatatttactatctggctcttagcagaaaaggactgctaacctcttatcaagaagcaaaagttgaaatagacagattttaaaacatatggtgagaaataactattttatagcaaaaaagtaagcaaacaacaaaccaacaaatatcatgccctccaaagtcacaatacatggtgccatcatgtgtgaagacaaataacaccagaaagcctatcaagttgtcaacaagtctccgaaagtgtattttacagggcaatacaactattaaaattaataataatgatcctgagacattaacaaaaattgtaaaatatgttgagaattttctaagacatttaaaaatatatatataaaataagatttttgcttttgatattttgatttttttaacttttagtttttgtgggtacatactgggtgtatttatggggtacataagatattttgatacaggcatataatgcataataatcacatcagggtaaatggggtattcatcacctcaggcatttatcctttctttttgttacaagtaatccaattatagttttagttaattttaaatatatagtaaattattgttaactttagtctccccattctgctatcgaatactagatcttattcattctttccaactacatttttgtactcattaactatcctcattccccgccactacacttcctagcctctggtaaccatcattctactgtctatccccctgagttcaattgttttaatttttagctctcacaaatcagtgagaacatgtgaagtttatctttctgtgcctggcttattttacttaacagaatgacctccagtcctattcatgctgttataaatgacaggatctcattctttttttatgggtgaatagtacaccattgtgtatatgtactacattctcttcatccatttgtctgttggtggacatttcagttgcctcaaaatcttggctattgggaatagtgttactataacatgagggtgtagaaatctctttgatacactgatttcttttcttttgggtatatacctagtaatgggattgtgggatcatatggtagccctatttttagttttttgaagaacctccaaacgattttccatagtggttgtactaatttacattcccaccaagagtgtacaaggattcccttttctccacatgctggccagtgtttgtgatttcctgtcttttggataaaaatcattttaactggggtgaggtgacatattgttagtttttgttagcatttctctgataatcagtgatgctgagcatattgttatataccacttcgcatgtcttcttttgagaaatgtctattcagatattcatgtattttttattcagattaatggattttttccctattgagttgtttgagcttctcatatattctggttattgattccttgtcagatggatagtttgcaaatattttcccccattctgtgggttgtctcttcactttgttgattgtatccttcactttgcagaaggtttttaacttgatgtgatcccatttgtccacttttggtctggttgcctgtgtttgtggggtattactcaagaaatttttgccaagaatagtgttgtggagtgttttcccaaagttttcttttattagtttcatagtgtaaggtcttagatttaagcctttaacctttttttttttttgagatggagtttcactcttgctccccaggctggagtgcaatggtgcgatctcggctcactgcaacctcctactcccaggttcaagtgattctcctgcctcagcctcctgagcacctgagattacagatgtgtgccactgtgcccggctaattttttgtatttttagtaaagatggggtttcaccattttggccagactggtctcaaactcctgacctcaggtgatccgcccgcctcggcctcccaaagcgctgggattacaggcatgagccaccgcaccaggcctttaatccgttttttttcttttgttttgtttttgtttttgtatatggttagctagagatagggggtctagttccattccgctgcgtacagatatccagttttcttagctccacttattgaagatattgtcttttccccaatgtatgtccttggcatctttgtttatgcaataagttaactgtagacatatggatttacttctgagttcttcattctgttccattggtctatttgtctggttttatgccagtaccatgctattttggtactatagctctgtagtacaatttgaagtcaagtaatgagattcctctagttttgttctttttgcacatgatagctttagctggataattctagctttttcctgggtcttttgcagttctatataaattttcaaaattttttttctatttctgtgaagaatagaatgtcattggtattttgaaggacttgcatggagtctgtacattgctttggtcagtatgaatattttaacaatattgattcttccaatccatgaacatggaatatcttttcatttctttgttgtgctctttaatttcttgcatcaatgttttatagttttcattgtagaaatctttcacttattttgttaaattaattcctagatattttattttatttgtagttattgcaaacgggattgctttcttgatttctttttcaggttatttgctgttggcatatagaaatgttactgatttatgtatgttaattttgtatcctgcaactttattgaatttgttgatcaatttgaataattttgggtgcagcctttaggtttttccaaataacaaaaatatcatctgcaaacgaggataatttgacttcatcctttccagcgtggatgctttttatttctttctcttgtctgattgccctagctaggacttccactattatgttgaataacaatggtgaaagtgagcatccatgtcatgttccagattttagaaacaatgctctccatttttccccattcactatgatactagctgtgggtctgtcatatatgggttttattgtgttgatgtatgtttcttctatacccagattttttttagggtttttgtcatgaaatgatgttgaattttatcaaataatttttcagcatcaattgaaatgatcatgtgttttttgtattttgttctgttgatataatgcatcacattgattgatttgtgtatgctgaaccatccttgtatttctggaataaatccaacttggtcatgatgaatgatctttttaatgagttattgaatccaattcagtttgctagtattttgttgatggtttttgcatcaatgttcaacagggatattggcctatagttttcttttctttttgaggtgtctttgtctggttttggtatcagggtaatactggcctcatatgataagtttggaagtattcccttttgccctatttttctgaatagttttagtagggttgatattagttcttctttaaatgtttggtaaaattcaccattgaagccatcaggttccaggcttttcgttgctgggtgacttactactgctttgatctgcttatttgtcatttgtctgttccagttttggattttttttcatgtttcaatcttggtgggttatatgcatctaggaatgtatgcatttcttctagaatttccaatttgttggcatagagttgtttacagtagcctctaatgatcctttggatttctgcagtatcagttgtgaagtcttcattttcacctctgatttttttggggtccttctctcttttctttcttagtctggccaaagttttctcaattttatttatcttttctaaaaaccaatattttctttcactgatttttgtattgtttcttaatttcacattcacttatttctactctaaactttattattttttctctactaatttcgggtttgttttattcttgcttttctatttctttaagaagcataattaggtagtttatttgaagtttctctaatttttgacgtaggtaattatagctataagcttttctcttagtaccgctttagccatatcctattggtttcagtgtgtcgtgtctccattatcatttgtttcaagatttttttcaatttcctttttcatttcttctttggcccattggtcattaaggaacatactgtctaatttcctcatggttgtatagttttcaaagttcctcttgttaatgatttctagttttattccactgtggtcacagaagatacgtgatataacttccaatttttttaatgttttaagacttgttttgtgacctgacataaggtatatccttgagaatgatccatgtactgaggagaatatgtattctgcagttattggataaaatgttctgtaaatatacattaggttcatttggtgtattgtgcagattaagccagatgtttccttgctaattttccgtgaggatgatgtgtcgatgatgaaagtggggtgttgaagtctccacctgtgattatgttggagtctatctttctctttagctctaataatatttcctttatatatctgggtgctccagtattgggtacatatatatttatagttgttacatcattttgctgaattgatttctttatcattatgtaatgaccttctttgattctttgtatagtttttgtcttgaaatctactttgtctgatgtaagtatagctattgctgctctttttggtttctacatgcatgcaatatatttttccatccctttattttcagtttatgtgtgtctttatggaaaagtgcaacttatcattgggtcttgttttttttaaatccatttagctactctatgtgctttgattgaagagtttagtccatttacattcaagttgttattgataagcaaggacttacccctgccattttgttacttgttttctggttgtttgtggtcttctcttccttctttccttttgtctgtcttccttttagcaagggtgattttctctgacgatatgttttaacgtttcaagttcttgatttttattgtgtttgttgtatattttctgattgaagttaccataaaacatgcaaataatatcttataacccattattttaaattaatgacaaattaacacctattgcataaacaaagagaaaactaattaaaagtttatattttaattgtgtcccccactttttaactttttgctatttctatttatatcttattacactatctgtatcttgaaaagttgttgtagtttatttttgattggttcatctttagtctttctacttaagatgtgagtagtttacacatcaaaattatggtgtcaaaatatagtgtgtttttctgtatacttactattaccagtgagttttgcaccttcagatgattttttttgctcacttacaaacttttctttcagactgaagaactcccttacatttcttggaggacatgtctgatgttaataaaaccccttagttttatttgtctgggaaaaatctttatttctccttcatgcttgaaggagaatttcactggatctactattttaggatacaagtttttctccttcagcacgttaaatatgtcatgccactttctcctgatctgttaggtttccactgagaagactgctaccagatatattgaagctccattgtacgttattcatttcttttctcttgccacttttaggatcctttctttatctttgacgttgggggcctcagcctcccaagcagctgggactataggtgcacatcaccatgcctggcattttttttttttttttgtatttttagtggagacggggtttcaccatgttggccaggctggtcttgaactcctgatcttgaatgatccgcctaccttggcctcccaaagtgctgggattacaggtgtgagccaccatgcctggcccattcttttttcttcttctttttttctgtctcccctggctatttccaaatagcctgccttcaagcccactaattatctcttccacctgatttattctgctgataagagactctgatgcattcttcagtatttcaattgcagttttcagctccagaatttctgcataattcttttttaattatttgaattcctttgttaaatttatctgatggcattctgaaatccttctctgtgttatcttgaatttcattgcgagtcctcaaaacagctattttgaattctctgaatgaaagatcacatatctctgtctctctaggattaattgctgctcccttatttagttcatttggtgaggtcatattttcctggataatcttgatgcttgtggatgtttgtcagtgtctgggcattgaagagttgggtatttattgtagtcttcacagtcttttttttttccacctgtccttctttggaaggctttccaagcattcaaaggcacttgggtgttgtgctctaagtttctggtcactgcagccccatctgtattagggagcaccccaagcccagtaacaatatggttcttgcagacttatagagatacttcttggtggtcttggatcagatctggaagaattgtctggattaccaggaaaagactcatgttctctttccttacgttctcccaaacagctcagctctgtgctgagctaactaggctagaagagaggtgacacaaatactcctgttgtcaccactattaggactgtgctgggtcagacctgaaactagtatggtactggggtctcacccaagggctgtggttaccactgcctgactatcacctatgctcacccaaatccctagggctctacaatcatcaggtgacaaagccactctggcttttgtccttccattcagaatggtgagtttcctccagcaccagtcacgtctagcgatgtttttcagaagccagtcccttaagtcagaaaccttaggaatctacctgttgctctattctactgtggctgagctggcacccaagccacaagactaagtccttcacactcttccctcccttttctgtaagcacagagtttctgcctgtggccacccttgccccagacccatggcgagtactgcctggctaccactgatgttcactcaaagcccaagggcacttcagtcagcatgttggtgaatgctgccaagcctgggacactctcttcaggacaatgggatcccctctggttcagggctaggtccagaaatgccattcaagaaccaaggcccaaaatgaggactccaagagtctgcttggtgctctaccccattgtggccgagctggtacctaagctaaggaacgaagctccctttactcttccctccccttttctcaagcagacggagtctctccctatagccatcacagctgggaatgtactgggtctcacctgaagccagcatgtctttgagtctcacccaaggcccacagcgagtactgcccagctaccactgctgaaagttcaaggcccaagggctcttttgtcagcagatgatgaatcctgccaggactgggttctccccttcaaggcagtggattcccttttggcccagggtgtgtctagaaatgtcatcctggaattaaggtctgggatggggccctcaggactctgcctagtgccctgtctttctgtggctaaactggtatccaagtggcaagtaaagtcctctttactcttccctatcctctcctaaggtggagggaagaagtatctcccagagctgcaagctacactgcctggggctggggaacggatagtgcaagcactctctttgctgttcaagctgatgtctcactaggtcacatgccccccaagttcactggttctgagcaattcccctttgctagggctggtctcattgctccctccattagctttggctgagttctgcctggtgttgctgtctgctgtgacaggacagcactgagttccaatgcaaagtcccacaatcactgtgctctccctcttccaagcacacagatttttttttctccacgccacagaactgctgctggggggagggggatgggtactgttggcaattcaaggctctcttttccaccctcttcagtgcctctttaagcaatatgaagttaaaactgggtactgtgattgctcatctgatttttggttcttatgaaggtgcttttttgtgtggatagttgttcaatttgttattcttgctgggaggacaatcagtgaaggcttctatttggccatcttgcgctgccttcctctctgatattttaatttttagaaggagtaagtttcgatatctggacagtgaactcatgtaaattatctcatccttctgagaattttactgtaaatttattttatctcagtattaaagttatccaaaagagctatttaacacataacaaaacatatagatttctctctacaacactttaaattttacaatttttttttatagaagtagggtctggatttcacattcattttattattttaaagtattattagtgaagcactatactgtaggttttaagagagctgattctagagctagactttttagactctcattccaggtctagcccacacaagttgtataagcttgggcacagaatcagggtacagtcgtgagtatagcagacctttgtatttccattcagtctgtaagtcaacaggtctgtctaagagcagacacctatttcagggcaatcgccgcaactactttgtctggactttgacttttcctcttcctggaagaggagatggaggagaagtcaggtgagatagcttaaggagaacttgaataatcagtaagctggtacaaagactcacgcaagatcaactgagccatgtccaagggaagcgagccccacaatgatcagaaacacctatgagaagcagcactctctagcatagcattataggggatttctgtgccaactacaactgcctggggaatcaaatactacaggatattcctttatgtaggtaccaaccgaacacttgcactctggcccccaaaactacttgtgtataagccttaattatcaagacaattgtaccaatttatcattaccaacatattttccctggcactgaattccaggaggcatttaccatgtgcatccacatgataaatgttatcacaaaggacagtgagcatcacaaataacagtcttcagctgtgaatagtcatgtttcaacgacctctgaaaaagctttcctccacaaccactgatctttctctcccacagaaaacccttcacaagtatgtgcatagcttttgtgaaatgtttaccttctagcaaagctgtgaattacgtcccatagctatagcttgtctcagctggcccctatcccgaggcgagtgacacatggtgaagagaatgaaactgtaggtgctagaaaaagtagcttccagaagaaaacaaaattgtccacataatatccagagggttcttttatggataaaatattgtaattcttcagcgtggtagatgctggtactttaaggagacaattctcaactcaatattaaaaaatattctctttctcaaatccatccacagttggaattacctgtctctactcatagtgagcttctttttactttcagaggacatttgagctgtgggcaaaggacgttgaaccacttggctacactctctaagacaaattagatctcagagattttgaaaagaaaagtagtccaatctgactgattaaaggcataaggatctctatgctctgaatggattccacccaaataaactaaggaagaagtcataacttcatttcagaatgaaatgtaattagctagctgtaattattgccttaggaaagacctagtaaatgagggacagagtggtgtggtggaaaagaacataacttttgagtctggacaactttgattcaaatcctggttctgtcatttattagctgtgtcatcttagacaatttacatgacctctctgagtctcagttgtttcctctaaatatagataagaatgcctcattatagagtattgtaagaagtctatgagatattatacatatagtgactaccgcactacagggcttacaataggcactaaacaaattaaacctatcatcactaatactttaggtgcaaaccacagtgatcccagctttttaagatcatctatggaaaaatcaattatatatatataattcataaattaaggagaaatttaaaatgcgcagcaaattttagaatctgtaacatgtttgtcatgagaaattgctacttttcaaaaaaaaaaaaaaaaggatatttcgacagataaagaatacaccaaaaccacaactggagaataagggtttaattgtagttccctggttcaatgcttattccttcctgatagaatgtaagctttatgagggcaggaactttatctgattcaccaatgtatttctagagaccagaactatttctgacacatagtctctactcaatagacttttattgacaaatgagtgaaccctaactcagtaccctaataaccaatgactatttacaaaatagtagggtgggctgggtggggtggcttatgcctataattctccacactttgggaggctgaggtgggcagagcccttgagcccaatagtttgagaccagcctgtgcaacacagcaaaaccccatctctactaaaaaatacaaaaattagcctggcatggtggcacacacctgtagtcctagctacttcggaggctgcagtgggaggatcgcttgagcccaggaggttgaggctgcagtgagctgagattgcaccactgcactccagcctgggcaacagagtgagacccggtctcaaaaaaacaatagtggggcaagacaaaccagattctagctgagcctccacaaatgttccttagacctacccaactctatctgtactaatttcacatatcaaaagaaaccttgtgatgactctttggctttttataagccatgtatggaatcctttatagaaaacagagtggcaatttccattggtagtagagcaggtgacgtctctctcccagtgtaaatgtatccatcagcatctgactcattaattaaatgttttttataagtagtctctatgaattagtctttttcagtttgatcacaatagaataatccacaatcaaactatacatagttctcaactccctcaagttcaccattttctttatagagtctctgcttctgcaataaactcccccaatgtctctctttcatcacctcaatgataccaagttatttcaggaaggttgtctctaataaatgattattataatttataacaggttattatctttacaatggtatattgttgtggacaaatctcaatatgtatacaaattatagcttatgttgcagtaaaattggccacatagaaatgatactggattctaaacagtttgctgaattcacaactgaatccaaaaccaacaggaagcgttctccaacctgttcttaaaaatacctgctctaggtatataatgctagaacttaaccaatgaaactagtattattcctcatcacagcactggccagggttgcctttcagtcactgcgataaaaattatcattttcttctctatagcttctgtcactgttttttctatagcttctgttatcattttcttcaacatgtgctgggagataatactctgttcccttacaaatgcttcccaagtattagctagaaaatttactggaggcctctgtacattcagaatgtagatgactagaaccagaaatgaagtcaaaaaatgaaaccaagatttaaaaaactttccaactactacaggatttgaaaatgcctttcttagcatacttcaaaatgagtaaattgcttctaagtgagtaaatacttctaagtaaatttgaataacatccaaaaatacacatttcctgttttttaagtgtcagggtatgctgagggagagaagaagggtgtttgctgtctagtacatagagagactttagagctgttaccagttgaattggtgacaatagataacattaagcaacttaaagtccttaattcccgaagcattgatacacatgtttaaaaatataaaacacgaatcagaaatatttcttaaatttcaaattcaatattagaattgatataaatttcagacattacacagttcaatgccttcattgtacaaatggaaaaaactgaggcatagggaaatgaatcactcagaaaaactcacaacataattactcaacttggagcagacttcaagccttttcacttctaaatcccttttccagaggattttgctagattgattcttatcaactgtgtggctatcacctgtattttcagtgacactacaatggctcatctaccgtgtctaagatggggttaactaattaatcaaggtatgtattagccagattctgaacattattattaattccagtgatagctattctctaataatgccaccattgtgtttcagagcagatagactcaaagacaatcatgtatttacccagttgtagtgttatatcccttctaacacatttactgatatttttattcatctcaccaataacaacacacagcattaaaaaaaacctggcaatattaacctaaaaaatggaaaggaaagctgattccataactaatctacagttgttcctgtgggaataattcattgcaatataaccctgtctcttataacctgaaaaaatacttcacttgtgtttcttccatcaaaaaaagtctttcatagatctctacatcacttctctattataaaccactgccacatttcttaataggcattaaagtggatgtaatagtttatgcttcctaaaccataccaggcaagctaattacactaactgttgctcaggctaagaaatctggatttttaaaaatgctatcaaagctgttgaaagattttaactcctagtaggctatatatgtgattcaggaggattactctggtactagtatggagacagagaaaaccaatatgacctgacaacaaattgtaaaaccctaaacgatggcaaatgcagtcatgataaaaataaaagaacagattctaataattaatgtaacttagtaattgattgtgtgtggaagtaaagaagaagaagcaataatgtccaagctcctggaattgtgctaagtagaaaaggggctcaaaatgaaaaatagacatttattattcatgacagaataatgattattcatggtaaagtgtataaagtgtcagatataggaacaaatgaaaaggaggataaaatcacatttgaaaatagaaaaaaggaaatttggaatgttaattttatgtgtctacttgagtgagccacagaatgcccagaaatttggccaaacattattctgggtatgactatagggtgtttctagatgagactcacatttgaatcagtagatagagtaaaacagattgcttttcatagtgtgggtgggccttatccatcaattgaagacctgaatagacaaaaaggctgagcaagagggaactccttctgtctaactgctatgagctgggacattggtctttttcagccttcagactcaaactgaaatatcagcgtttcttgggtcttgagcctgccagctttctgactggaacttacaccattagcattcctggtattcaggccttcagacttggacagaagctacacaacagctttcttaggtctctagtttgcagactgcagaccttggaacttatcagcctccaaaaacatgtgagccaatctcttataataaatctcctccctctgtctctctctgtctctctctatatatgtatattatatatacacacatatatctatacactcacacttatatatgtgtatatgtgtgagtgtgtatatatatatgtatatataattacacatatagaaaaaaggaaattgggatggttaattttatgtgtccacttgagtgagccacaggatgtgaggtgtatcagagaccatacacatatgtgtatatgtacagatatatatgtatgtatatatatgtatgtgcatagataatatttgtacacacacgtatatatgtatgtgcaaacatatataatatattcctttccttcctatatatgtgcatacatatataatagattatatgtgtgtatacataatatataatgtaattacatatattacatatataacatattatatattgcatatgttacattatatattacacagatataatattatgatatacaacacctattgaagaaccatgagttccatgaaccatggttctctgaagaaccatgagtaatgcagaaataagtaacaaagaatgtagtatgtcaagtttgctaagccttaaaaaaaggaagagggccgtttcagacaaagagaaaattacataggtagggtatagttttaaaagaacaaatagtataacacaactagagcatcaggtgagataaagtaggaggtaagcagaaaaaggtagattggaggtacacaggggaaaatttctgatacataaccaaagagttcagagctaatttaagaaaaagaatataattcaatgaaggttttgtagaagacttaaaatgaaattttaaaaatactttaaaatactcaaatatttaaagatacgaatacctttttctctctctttacaaaaagcaaaattatccccatttattttagcttcctctccctggaacgcatgtaactgtcaggtttagagagtcacttaggtcaggaaccctaggaatagattgtgtatgcaatattaaataaaaacaacacttctgcttctagccatgacaaagtccaactagtattggacttatccttctgccataaacaattataaaactgggtcaaaaactattaacacattattttcaagcacttgataacaaatggtgcaggactgtcatattttagagaaagggaaaatgtaagttaaccccgtattaactccagctttctacccggggtcactttccaggggcagcatgggagacagaggccaaatagagaatgacaattttactgagaggagaaggcacagatcagagtttcgggctggtaaggtagctagaatttgtgtggccaagtactgaggagagaaagcttcgcagactaggggaagcaagaaatcttcacagaggttgccctcaggcccttggccaaaagatgggctacttttgttcaggagagtattctgtgacactcttaagagaacaactatagcagtgacaaatccttcagtgctcatctgaatggagacattaaacagtgctcatagatgttaaagtcctaacgcagccagagtgagaaagcttcactgagcaacaaaagcattcggtcgagatgctggaatgaccatgcctaggaggaaagaccgtgacctaaaataatggccatgccatagaactaaggataaaattgaaataaagtataaatccattctaacaaaatcaaaacaagccaccagtagttaaccacttgccagaataaaactaaacactcctcaaagaaaaaaaaaatactcaatacataccatcccacaacataccattcataatgtcaagcatacagtcaaatattactagacatgcaaagatgtaggaaaaatgtgacccatagtcaaaagtaaaaagttgatataaacaaatcccaacatgatagagatgttggaataaggagataaagaccttaaaagtggataaatatagatatataggtggatatgttattatttatatagagatatatatgtagagatatagatataaacttaaagaaaaatgtagaaataatatattcacaatgctgagttgggaaatctcaggagagaaaagaaaactataacataggactaatgagaattctataataaaaaatactttccctgaataaattcactagatgggctgaacagcagattagacactacaataaagggtcaatgaatttgaaaacatgtgaatataaattaaccaatctgaagacaatgaaaagaaaatgattgagaagaacaagcagagccctggtacctcagaaaattcaactatttgtgaaaatccagaggaagaagaaaaggagacggaggaggagaaaaagtaggagagaagaaaaggtagggagagaaaaagaagcaaaaaacaaaattcaaaattcaaaatttgttttaaaaattaccctccagattcaagacatttagtaaaccctaaaccatgtaaatagaaaaccttgactgagtatattataatcaaagtgctgaaagataatggtaaaaagaaaatcttaaaatgtatcaaaaaaaaccctcatatgaagggaaaaaagatgaaagatgatggactcttcatcagaaaagtaaatacaggccagccaggcatggtggctcatgcctataatcccagcattttgggaggccgaggctggcaggtcacctgaggctgggggttccagaccagcctggccaacatggtgaaatcccatcgctactaaaaatacaaaaattaagcagatatagtagtgtgcacctgtaacaccagctactccggaggctgaggcatgaaaatcgcttgaacctgggtagcaaaagttgcagtgagccgagatcatgccactgcaccccagcctgggtgacagggtgagactctgtctcaaaaacaaaaacaaaacaaaacataaaccaaaaaaaaagaaaaaaatacatgccagaagatcttgaaacaacagctgtaaagtactgaaagttttttaaagtcaagccagtattccacggtcagtggaaatacttcaaaaatgaggataaaataaacatttttaataaatgcgtactgagaaaatttgtcaccagtaaaaatacgctataataatttgttattaatggttcttcaaactgaagtaggataccagattgaagcacagatatgcaagaaggaaagaagaaaattagaagtgctgaatatatgaatctatataaagaaactattttttcttttacaaatgtcattaaaatgcagcttactagtcaaagtaaaaaaaagaaattatattgtagggtttataacatatgtagaagaaaaatatataacagcaataccacaaagatggaaaagggtataaatataattataatacagttcttacattttatatgaaatactacaatggtaactctaagtaagtaataataaattaagaatacatattttaatccccatacaactgctaaaaataaataaagcagcacagcttaaaaagccaatagaagagcaagatggcaaaataagaagcccagaacctctttcccctcataggacaccatttaacagcaattcagtgacaaatgtcccttgttagaaacccataaaccagttatgaggttcctgaacctcaggcaaatatgaagccaaatgcattgaaaccagtaagaaaattcgtgtcactcatacaccatagtccccccaacccccggctcagagttgtacaatccggagaaaactcccatttcctggcttctctctggggaggaaacgaaaagactaaaacacatccaaaactcagacttttgcggtgctgcccaaggaactggtttatctcctgcctgactctaagcacagaaaaacaaaagggccaggttggggaccactgaaaacaaaagtaatggtttagactaacaaacactcgctcaccaaaattctatacccttcccctctggctcagtgcagaatgagtagggagaaaaagaagcctcaactcctggcttatccctgtggagggaaagagttaaagtgtgtgtccaaaattctgaactttcaagggactgcccgaaggactagattctgtcttgcctgtcttggaggatggatgggagggacctcgaatactctatgtacttgcaaggcacagaggacaaaatagagctgggcagattgctgctgctactgataacatacaacagacagaggcctatgccatttggtggtctctcctttgtggggtcatgccagaagagaagagtagagtatgcctctagtggtctggcttttcagggagctctctggggggaattgtttctgtgtcttcggacttagtgcactgatgtgtcccaacatttactagaagccactgagagcaaaagagagctaggcaccttgtggcagctccaaagaacacaaacagacacattagagggagaaagagatgatgaattcttaaaaaaagaaactggcaaatctctctaatgaatttatatgcacaagtccagagaagaggcatccataggaaaagtttgagaagctctctagaatatctagctgggctgattggtaaagatcttttcctatacaaagccagttcataaaaactgatatatatggctattttttcaaatgaagagatcccaacacaaagttataaggcacataataaacagagaaacatggttcaataaaaggaacaaaataaatctccagaaactgaacccaaagaaacaaaggtatggagattacatgaaatagattttaaattgctactataaagatgctcaatgagctaaggaaaaaaaaaagaattcatgaataaaatgagaatatcaacaaaaataaaatatttttaaacacccagaaagtttggaatgaaagaatacaataactaaattgaaaaatttactagaggggttcaactgcatatttgatctagctgaacaaagaattggtaaactcaaagacaggtcattgaaattatccagtaggagaaaagaataaaagaatgaaaaagagtaaagaaagactaagaaacttatggcacatgatcaaggtgttcattatatgcaatatgagggtctcagaagatgaggagaaagagaaagggaaggaaagattatttgaagaagtaatgggcccaaacttcccaaatctgtggaaagaaatgaatatccatattcaagaataccaaaagacttcaactcgtataaaactagtatataagaaatctataacaagccacattgtaatcaaattgtcaaaagtcagacaatgagagagttttgaaagcagcaaaagagaaagtgactttcacatacaagggaggctcaataagactatcagtttaaagctagatggcaaaggtaaatagaaaatcagagaatagtatggtactataaaagtagtgcataaatcacttttaattctggtgtagaaattgaaagataaaagtacaaaaaatgacaataaaaacatgataatacacaatataaaaagatgtaattgtccaggcacagtggctcacacctgtaaccccaacaatttgggaggctgaggtgggtggatcacctgaggtcaggagttggagaccagcctggccaacatagcgagaccctgtctttactaaaaagtaccaaaaaaaaaaaaaaaaaaaaggccaggtgtagtggcaggtgcctgtaatcccagctaatcgggaggctgaggtgggggaattgcttgaacccgggaggtggagattgcagcgagccgagatcatgccattgcactccagcctggatgacaagaggaaaactccatctcggggaaaaaaaaaaaagatgtaatttgtgacatctatagcatagtgtgtgcacggggagacattacaactgatggcactgataccatggggaggagacgtaaagggcagtttttgtgtacaattgaaattattagctaaaaagagattgttacaactataaaatgtctaatgtaagccctttggtaaacacaataaaaggtatctataaaagatgcaccaaagaaagtgagcaataaatcaaagcatgttgctattaaaaaaaaaatcaacaaaacacaagggaagacaacaagagaagaaaggaggaccaaaaggcaacaggatagacagaaaacaactaataaaatggcaatcataagtccttccctatcagaaattacttcaaatatagatagattaaactcttcaatcaaaagacattgagtggctgaatgtttgtttttgttttaaagatccaactataagatataaacaaatcttgctttagatttaaggacacacacagactgaaagtgaagagatggaaaagattttccatgcaaatgataagcaaagagaatcatggtaaccatatttatttaaggcaaaatagacttcaagtaaaaaactgttataagagacaaagaaggacattatataatgattaaaatgtcaatttaccaggaagagacaacaattataaatatatatgcacccaaaatatgggcaaccaaatataggaagcaaacactgatagaactgaagggagaaatggacagtagtacaatgataataggagatttcaatactccactttcaataatggaccaaacatacagagaagaaaccaataaggaaataggagctgagcaattctatttatcaaatggacctaacagacatgtaagaaacattctacagcagaagataaacattcttctcaagtgcacacaaaacattctccaggatagatcacgtgttgggtcgcaaaaggagttttaacaaatttaaggatattatttcctatagggttgtttgagctcctggaagattaaaattatacgaagtatcttttccaatcacaatggattgaaactagaaattaaaagcagaaagaaaacttaaaaattcacaaatatgtggaaactaaacaacacacccttgaatgataaacaacgaatgagtcaaagaaaaagccaaaagggaaacttaaaaatattgctagacaaataaaaatgaaaacacaacataccaaaatgtatgggatgcatcaaaagcagccgtaagagggagttttatgtcagtaaatgcctgcaataagaaaaaaaacctcaaataaaaaccttaatggtatacctgaaataactagaaaaagaagaacaaattaagcccaaagtcaccaaaagaaaggaaataatcaagattaaagtagaaataaataaaatacaagtagaaaaacaatagaaagaaatcaacaaaattaagaatttttttttgaaaagataatcaacaaacctttagccagagtatgaaaaaaacagataagtctaaaaaaaaagacatgaaagaggtgacattacaactcatgccacagacataaaataataccaattacaggtaaggagattgaatcagcaccaaaaagtcttccaaaaaggatgagcccatgactagatggcttcatttatgaattctatttacaaaacacttaaagaagaattaatatcattttttctcaaactcttgtagaaaattgaagagaggggaacacttcaaaactaattttatgaggacaccattaccttgatagcaaagacaaacaaagacaccaaaagaaagaaaattataggcctatattcccaatgaatacatacgtaaaaattctcaacaaaatgctagcaaaccaaattcaacagcacactgaaagaatcatgtatttattaccaggtggtaacatatattcctgagatgtgatgatagttcaacttacaaaaatcaatcaaggtgatataccataataacaaaatgaagggtaataaccacatcatcaactcaatagatgcagaaaatgtatttgacaaaattcaacactttttcatttaacaaacactcaaaaaactaggaatagaaggaaattacctcaacataatgaagactatatataaaaaaccaacagataacataatattcaatggtaaaaaattgaacatgtttcctctgagatctgtaagaaggcaaaaatgcacagtctcaccacttctatttaactgaaatagtacttgaagtcttagctagagtaattaggtaagaaaaaataaataaaatccaacaaaatcagaaaggatcaagtaaaattatctctgttctcaaataacatgattgcatatagagaaaattctaaagtgcatatcagaataaacaaacagaaaaacagagataataaattcagcaaagctgcaagatacaaaatcaacaaacaaaaataatttgtgtttctatacactaataccaaataatttgaaaaagaaattaagaaaataattccatttacaatagcatcaaaaataataaaatacttaggaataaatttaactgaagaggtaaaaaatttgtacactaaaaactacaaaactttgttgaaagaaattaaagaagacacaaattaatggaaggacatcccatgttcacagattggaaaaattaatattgctaaaatgtcgagaccacccaaagtgaccgaaagatttaatgtaattgctatcaaaatcccactggcattttttgtggaaatggaaaaaaaatcctaaaattcatatgaaaccaaaaaataaacaacaacaacaacaacaaaacactgtatagccaaaatgatttgagagagaagaataaagctggaagcttcatacttcctgacttcaacatattacaaagcaacataatcaatgcaatctggtactgccatcaagacagatatatagatcaatggaatagaataaagagttcagaaacaaacccatatgtatatattggttaaatgatttttgacataagtgccaagactacaaaatggagaaacaatagtctctttaacaaatagtgttgggaaaatggaatatccacatcaaaataatgaaattgaaccattatattacaccataaacaaaaataaactcaaagtcgattaaagacttaaatgcaagatctgaaactatagaactcttataataaatcattagggaacatcttcatatcgcttttcacaaggatttcattaatttgacgctgaaaatacagacaacaaaagcaaaaatagacaaatgggactacatcaaactaaaaagcttctgcccagcaaagaaaacaatctgcaggtaaaagccaacctaaagaatgagaaaaaatattggcaaatcatatatctgaggaagagttaattccaaaatatataaagacccccttcaactcaatagcaaaaccaacagataacccactttttaaaatgttttaagaattggcaaaggacttgagtagacatttctccaaagaagacatataaatggtcaataggtgtatgaaaacatgctcaatgttactatgggaatagtaaaaagatgagtggttatcaagaggtagggatagggaggggtaaacaggtagaacacagaggatttttagggtaatgaaacaattctgtgcgatgctatgatggtgtatatatgttattatacatttttcaaacctcatagaatgtacaacactaagcaagaaccataatgtagaacactgattaataatgatgtgtcatatgtatacatatgtaacaaacctgcacattgtgcacatgtactctaaaacttaaagtataataataataaaactaaaaaaagaagaaaaaaaagatgtgtcaatagattgcaacaaaagtgccactgaggtgggagatgttgatagtaatggaggttgtgtctgtctggggacagggacatatagagacactctctgtactttccactcaattttactgggaacctaaaactcctctaaaaactaaagttcgttaatgaattaaaaaaatcagtaggtaagtagaagatttcagcactatctcaaccattttaacctaattgatatttataggacactactgcaacaattgcagaacacacatccctttcaaatgctaaaaatgttcaagattcattcatgatataccataaaataagtagcaataaatttaaaaatattgaaattttacagtgtatgttctctgaccacaatggcattgaattaaaattcactaagatgaagaaaatcttcaatattttgaaacgaaacagcacatttgtaaatcacccaaggtaaagaagaaacaacaaggcacattagataatttctgaaaatgtatgttcacgaaaacaaatcactctatatttgtatgatccagtttaactaagtcttagaaatatatgagattcaaattcttatatttgaaaaaaattaaaatcaataatctaaggattactttaagaagatagaaaaagtagagaaaattacactcaaataaataaaaaaataataaagagcaaaaatcaaaatataaaacaaacaatattggaaaatttaaaagccaaagtgtttttgtaaaaaaaggtaataagatggttaaaccctaacataggtactgttgatgaaaaaagaaaaaacagtaattaccaatactaggaataaaagatggcatgtcattgtagattctatgggcaaatattatacatgcccttgtgttagtatattcaaattaggtaaaaggattaatttcttgaaaagcgtgaattaaaaattgaaaggaaaaatgaagaaaataaatataattctgcctggtaaataaatttaatttgtaaattaaaaaccttctcacagagaaagctggaggcctggttggtttaactgctgaactatatattaaatattaaagaaagaagaatgctaattttaacaaactctttcctaaattagaggaagaaataaaacctgtcacaaatctaacaaacctattactgaaaaaaaggcaaattaatattctcatacacatagatgtgaaagagtaataaaattctagcaaacaaaacctagcagagtattaaaaagaataaacaaaatatagtacatgcatacaacaaaatatttagccacaaaaaggaataaagtattgactcatgctacatgggcaaaccttgaaaacattatgctaagtgaaagaagactgtcacaagaggtcacatattacatgactccatttatctgatatgcccagaacaggaaaatctataagggaaaggggaagcggggagtaaccaacatatatatatgccatatatacacacacacaaacacacgcacagctatatacacaaacacacattctgcaaatcaataataaaaagacaacacaaattttaaaataagcaaaatatttgaacaggcacgtcagaacagaggacatacaaatgaccaataagtacatgaaaagttatcaacatcattagtcttcagcgaaatgaaaattaaaatgatggtgagaaacttcacttttctttttttttttgagacagagtctcgctctttcacccaggctggagtgcagtggtgcaatctcagcccactgtaacctccacctcctgggttcaagcgattctcctgcctcagccttctgagtagctgggactacaggcacccgccaccacgcccagctaattttttatatttttagtagagatggggtttcaccgtgttagccaggatagtctcgatctcctgaccttgtgatccgcccgcctcggcctcccaaagtgctgggattacaggcgtgagccaccgtgcctggaaaatactatttatttgtgaggatacagaccaactgcaactctcatacattgggagtgtactatgttacaaacgattagaaaataatacttctagaaatgtcacttaaaatagtatcagattgtttgcaaatttgtttcccagttcattataaagttaaacaagagcttacactatgaccccgtacttctgctcctgggtttttacacaagagaagttaaaacatggcaaaataataataataataataaagaaaaaaagaaagaaaaaaaaaagaaaatgacttgtacatgaatatttccagaagctttattcaagttagtaaaaaactgaaaataattcaaatgtctaccaaaataaaaacaaataaatacaccatggaatacttagacaatagaccttatactcagcaattttaaataattaactagtgatacacaacaacatgatggatctcagaaattttgtttaggaagaagtttcaaaatagtatagactgaaaaaattcatttatatgcaattcaagattaggccaaacaagtctatgatgagaaaaattagataattggttgtgggtgggtggggaagagactgactggaagggatgtgaagaaattttcccaagtgaaatgttgtatgtcttgatgaatgtgttggttatacaggttaatttaacaaaactcaataaattacacatttaaactttctgcattttattgcatttaaatttttaattagacaatagaaacacaaagaatgcatgtatttttacttcataaatgcatgaagtaaataataagaaaaacatgaagggatttcttcagtaaagttcaaaatttgattgaaataaaaaacccacaatgaagtagaattgtactagatacagctcttattaataaataaaaaaattatataggccatcttgtcgccatgggacaaataattgctgtgaatttatattatcttcaataaaacatatttgtaatcagtaaataggtatactcttcattatggcaactagtatggaaatttgggtacagaagataaattctgggtgatactaaccctacctctgagactttttttttttttttgagccagagtctcactcttttgcccaggctggagtgcagtggcgcaatgtttcactgtgctatgagagaagctatgtttcatccactaagcttctcttgcaaacaattatctctcttattcacactgtcattgttcatcctgaacgttctctatcaagcattcacacggatttcccatactgaaaccaacactgtttggcttacatactcttagacacattgtttgccacatgagtatgaccagggtaataaggacactcaaagtgctatcacagaaagactccaaggatcttgagaagactcatactggacgtataagtggcttttatatgccatgaaagaagattagacttttttatgtgattttgagagctttagaactgggacctaccgttgaagttaaaagtaaagcaatttcagttcaaaataacaaagttagatctatccaagattaatggaatattattaaaaagttgtataaactgaaaacaggtaaatagacacaaattttaagcatttgatgaatggctagacaatccaatctttaatatctctcatatcccaagatttaatggttctgggtgcagatggttcaccaggctctttatgcccccaagctcacaactcacacattcaccacttgctcaaacaatgaagacttgcacacacaatcccatcctcctcctagtttgttaccagctgctgccaatgatttaatactggagactgaggagagccagagtagtttcaattgtactccctaaagaggaaaaaaatcaagctaaatccaatgaggaaggataatatttgagaatggcattttcattagcagctgacaagtttaaaagtatgaacacaattacatagtgctttgtcagcaaagatgtatcattagtgtcctgaaacaaagagagaaattctacataattaataaaatgatatttaactctgctattatcaatagataaacacaatgataagtagtattccttagtagttaaagcttgaactttggatccagattgcctgatttgaaatcctaacctctctgtcagttctccaatctgagaaaatagagatgacaagaatacctatatcatagacttcttatgaggattaaattcattaattcaaatcaagcctaagaaaagtgtattgcaagacataggtatgtgctattatcaatggatgattaccatttggtatgcctacatttttcagtgttcaacctgtccatatattaggaggcaccaaggcttaaaattagactatgtgtagttttttgtttttttttgtttgttttttgtttttgtttgtttgtttgtttttgagacacagtctccctctgtagcccaggctggagtgcagtggcgcgatctcagctcactgcaatctccgcctcttgggttcaagtgattctcctgcctcagccttctgagtagctgggattacaggcgcccgccaccatgcccggctaatttgtgtatttttagtagagacggggtttctccatgttgagcaggctggtcttgaactcctgacctcgggtgatctgcctgcctcagcttcccaaagtgctgggattacaggagtgagccactgcgccctgccgaccatgtgtagtcttattggaacatctagaagttccagatgctccacttacctcagggattacattttttcatgtccactttatgcttcggggacagtattctcaggaagactttccaacacaagccagcatttaaggcagcaggtgatatgtgatatgtctaatgaattgcttttggaattgaatcattgtctttcctactgtacaagctttaaaatacttggtctttggggtctccacaccatctgcacacttaaagaaatccaagtgcaacagaaaccagtgatcacagttcatgatcacatggagcactgttcccaaaatgggctatagcaagttgatgtagcttcagtgcagcaatgagcttgacattctgcattccactgggtttggaattttttaaatgtttctgtgttttggtattcagaaacagcatctcaggactgaaatgaaagattagaggagaatgtatttatagcacagaattcccttaagaatgtaagctcttgagacaaattgcattggttctaatctactctccatttactggctgtgggactttcccacacctttgtttcctctacataaaataggaatgctgacattactactgatctcaaaactactgtgtgtattaaatgaggttatctacataaaacattttgaacagagctttttcacttggtgaatgctcaataaatattaatcactgtttattaactaaaaatttagcaagtttgaaaattctctgattaatgcatagacaaatcatgagatgactttaagcatattttggtaatataatgagagttccaagaaataaactggcttaaagcttagtgatccttcacctatatgtttaaaaatcttatcaaattactacaacttaaaagtgataggtgaagttgaagatgctaagacaaatcaaattcttgcattcaaaataatttgcattctatcagagtgctaataatagcaaatattagttgaacactaaattataggcactgatgtgaattcgctcattttatctgtgtcagaaataaagttacacatggcgtaacaatgtttcagtcaacaatggactgcataatagtacagtggtcctataagattataataccatatttttactgtatcttttctttgtttacatatgtttagatacacaaatacagttgtctgtagtattcagcccagtaacatgctgtataggtttttgtagcctaggagccataggctataccctacagcttagttgaatagcaggcaacagcatacagcctattgtatagtgggctatacactacagcctagttgtatagtaggctatatgatctaggtttgtgttagtatgccccacaattttcacacaaagacagaactacctaacaatgaatttctcagaacatatccctgtcattaagagacgcatgactgggccgggcatggtggctcacgcctgtaatcccagcactttgggaggctgaggcaggcagatcacctgaggtcaggagttccagaccagcctgatcaacatggagaaacactgtctctactgaaaatacaaaattagccgagcatggtagcacatgcctgtaaacccagctactcgggaggctgaggcaggagaatcacctgaatccgggaagcagaggttgcggtgagccgagattgcgccattgcactccagcctgggcaaaaagaacgaagttccgtctcaaaaaagcaagagagaggcatgactgcatatgaagcaggcattagtagtatcatatttcataggtaaggaaactgaaataaagagcatttaagtaacttgcctccggttaccaaatcgctctactagttagagccaaattgagggatctcagtttcagactcaaggaatctggcctcagactttactctcaatcactgctctgtactctttctatagtgcttcatgaaaatcattctagcagcatgtgcaagataaaagaaaaataagagatcatggagataggaagaccaggtattaaaatgatccagacagaaagaaacaaaggcctcaaatacacaatagccataaggctggagagtatagaataaatgaaagagatattggagaaaagaagctaaaaagacttggagactacctgtggagagcctgggaaaatttgcaggaaatgttagaattcaaataactgtattttatggatgcccctggatagggcacatgcttttgtttctctaaagtctacaacactgtctgttgtctctttggcccatcccagtcttttaatctctagatttgtccgtcataatatttcaaatggtatttccaaaccatctcctagtttccctcaaacaagaacatagacactgaacaatttcacagttgtatgaccagtatttttctaaaataaaaattactttttaccctgaaaatttataattataaaatttatggctaaaactattaaatataagaaccaacaacactaacaactaccagaaaggccacacgatggcagcaaagtatagggtacaagcagcaagagccggcggcctagagggtgctatgcactgaattctcagattccgtctattctctattgagttcatacatattagtcagcagctgtaatgctagtaacattatctccacacagcacctcacactttacaaaactcccacagatactttctctcgtctacttcttaccaccactctgagaagtcaacaggaaaaggatcatgctttgtgtggaggataaagatggaagttttactccaggtactagaagcacctcagaggctcaaaggtgagacaaagatcaaaactttgtcgttgtttcttttaggatatgatctggggaaatataatatgaatgggaatactctaccttcaactttagtggggaaaaaaatctaaggcttttttaatagaactgggaattttttaaggggttggggctgtaagttattcctcaccgaagttggagaaaaaaaaagggaaaagataaggaaagggaaagggctttatttttttaagtaacaaaggctaaaaattttcttagagattattatagaaagcttaactggagagaaatatgcctggggggaaaagcatgtatcctccaaatggtgcttgcattcattttctagggcggctttaaaaacccactacagacttgggggcttaaaacaactcttctggaggtctgaagtccaaaatcaaggtgtccacagggctgtgctccttccaaaagctctaggtgagaatcctctcttgactttttagcttctgttaatgccaggccttccttggcttgtggtgcataactccaatctctgcctccatttttacatggtcttctccatgtgtctctttctttctttctttctttctttctttctttctttctttctttctttctttctttctttctttctctttctttctttctctctctctctctcttttctttctttctttctttttttcagagttttgctcttgtcgtccaggctggagtgcagtggcgcgatcttggctcactacaacttccccctcctaggtgcaagtgattctcctgcctcagcctcccgagtagctgggattacaggcaccagccatcatgcctggctaatttttgtatatttaatagagatggggtttcaccatgttggccaggctggtcttgaactcctgacctcaggtgatctgcctgcctgggcctcccaaagtgctgagattacaggtgtgagcaccatgccccgccctttgcatgtgtttcttataaggacacttgtcattggatttagggtccacctagataatttggattgatttcatctgcagaactacatctgcaaagatcccttttccaaataagatcacatatacagttaccagggtttaagacacggggaaatcttttaaggccaccattcaacccactgtagtgctcttgtgactgtacttcctcctgccagtggggagctcatgcatgtacacattatggactcctacccttccgtgtgtttagttgccatagagcaataatatctgatctctgctccaaaatctgacaccattttgctgtatcctctccttgggttgtctcctcacctgtaaaataagagagttagaccagccaatggtcacagtcaaaagcgttcttggtctaagaggaaatgaacagtaaggcttcagagaaatgaaagcattcatattttctgccaattacttgtcatattatagtggaatcagctatcttatctccctcattagttttgagagtgtttttgttaatttttacgttttattaaatatctgcctattgtggatatttaataaatcctgagactatagagatgggcaagacagagtccttctgccaggaaatccataacccagtaggagagacagatacataacgttatcactgtgaggtagtgttcaagcagtaaggagagatcctttgcatacatgagcatagagcccacgtgaccactctaggctatgggtagactcaggtatgagataacatttattcaaccttcgagaaccaacttaagggtgtccttcataaaagaccaacttatgaagggcacacttacgttggttctccaaagttgaataaatgttattagctgagcaaaacaggagaaaacagtacatgcggaataatcaccatgtctaaagatgctaaaatgtgaaaccaactggttaagtgccttggataaagtacagcgatgaaaggtagaaaaaaaatattgtctgcaaagataatcttatgtgaacacttgctttggggccaagcatcatagcatatgcctttgtatattatataatttctcataacagcctttgtggtagaatgtcagtgtaggttaagctgtgctgaggtaacaaacaaccctcaaatatcagttgcttcatctaatgaatgtttatttctcatccacacatagtctgctgtggatttgagtcattcctcaggacagttgtcttctgtgtgtagcctcagcattctatctccttaatttctaaggaaccctcgtattcctatgttttcacattcagcaaaggaacgtctggagaattcagtaccagtaattaaatatttatacacagaagtgacatatagctattgtgcttacatttcttttgccaagcaagtcatttgtacacacctaacttcaaaggccagggaaagataatgtccaaaattagaggagaagcaggtattggggaactgaagtaagatttatcgcaggtagccaccaaattattctcattttacggaagaggaaattgagatatagagaagttagtcatagtcacacaactggtaagttgcagaatgaggatttgaactcagatctgtctgattccagatcttacactttctttattgagaaacgcatgtgccatacaaataagtttggactttatcctaatgataacagggaattactggaaggttgcaatagggaaaacacgactcatatttatgctttagaaatatgtgtataaaacaatgattggggaagaacaggactaaggatgtgaggatactagcgctgctatgacaatttttggaagagaaaagataaggccctacactgagccagtgccgtaaaagtgccagtgatgactgcaaggaggcagaagttccaaaggcaagtaagaaccagaatctataggttttaataaatgagtgaatagttaggatgaagaaaaaagaaaagaggacagaatatgattagcaaggtccaggcttgagcaaggaggaagacagaggtgccatataccaagacagggatgtaatacaagcatcaggctagctgtgtttgtttgcttttgttttccatgggggggagggccataggtggtttggatttgaacatactgaatttgagttgcctatggaaatccaagtagagagctccagcagacatttaggcatatgtatgttaaacttatcaaaaaaagattttagttacagataaatacttggggaaaaacatgcaaatctggtagtccaaatatgtgattaatgatattgccaaagagaaaaaaagagacaggctggcacaaacactataaaagataaaggtttatgatgtgtctggaggtggggatttcatcatagtcacctttgatctctcagcctaattaaggactgagtctggaagtttccccaaatttggttagctggatttatgaaacagaaaacataccagagtgtacatcatgtggacataagaataacatctgctgtattcatagcaccatattgtctacagcacatctagtagtatgcagatccccaaacttcacaatcctggaaatcaacacacacacacacatccatacattgttttatcttttcataaaatatttttattgattttggcttattaccaaaaaaagttcactgtaacagtaataatatgtataagaaaaaataaaactaaataaaaaataagattataaccttagcacatccctttttaataactattctaagctggaagctcactttctggcatccgtcctagcaaggctaggaaagtaaatgacgtagtaatggaaaagggaggggaaacagacggggagttctattcatttagggttccgtgattccattaaccttctgattcttcagagcttctccacacctttccaattcctctctgctttcatttctacattggtgttggggggaaaaaacaaaccttattagccacacataaacatcttccattaaactgctctaaagcaattactgctgttaacacagttaatggactgtcaatgtcaaatgtgaaaccttttctcctggaaaggcaacaatgacttcgtgaaatcgttttctgtgctgtagcagaaagggaggaattctggaggatcgctctttctgcaaacatcgcggtctgtgaaatctgccccctaaaaaacaaacaaacaaaaaaaccaaaccaaaacaaaaaaaccctgatcatatgcctgttatcctaaaatagcaccttcctccattatgccgaggttcagcgcaaaactgactcatgcagtaccgggatcgctgccagagcgacggagcgcgcgagcagcgcggcatcaacaggcagaaggtgccacggggcggacgggacccactgcccgggtccagactttccatccgagaaagcaaaagctttcagtatccaacttattagaagataacatcttgatagggttctcgggccttcttaaaataaatctgtcagactgtgcttttgaatctgtcctgtgtcaaggttgctcccccagggcagggcagcaatttagcttttgcaagatcctgcacttgctcctcaaacgccaaagcagcaacgcgagcaacttccgagcagctgcttcttccccactcaaagccacatcaccaacttcctcagcagcagccccagcagcaatctgggtgttcaatctatctcgatctcacaatgcccatgcctcctagaggtcttcccagagcttaggagtctttgcccctcctgggaactttctgagggtccatatagtggtccttagcactattgctgttttttttttttttttaattttagttgtaatatacgagtgttagcaatcctcatacatctctgacttatccacagtgcctagtatacaatggacaatttagtgaacaatgaataaatcagaatattgaggcttaggaaactaggacccatcacgaaccttctcatagtaatccagatcctggatggaagcttttaataaacacaacttctgttttccttcctctttgttttttatttcttctcgaaagagacttaattgaagaaaatgagctctttcacttcttccatcctccaggaacataaaactgacagcctcctccaaatgattatttagcatttaatgatttattccttgagcgcccagttgatcttccttgggcccatttgaagaactcttgtagcaaggggaaaattcacatgatcatgcacagcgtcaagctccatttaccttttgtcctttaatgatactgatgagcaggcaggtgatttaaaagagaacaaatggtcattaaaattaatcaaaaggacacaataaggaaaaatgtgctatataagggcaacataagttttgtagtgacacaaacagaacaaaacaaacaaaactcaaaggaatgcaaaggtggcatgtatagtattttagccctttaatttgaacccaaggacttaaatatgcacagttttatgcacagacaaataccactcactggggccaaatacacagtaacaatgctaaaagtttaccccttagactatttttagaaattacatactaaactattttaatcagagctataaagcacacagtgacccattcacaatttacaccaagaattctgtttttatgtacaatttaaaatgcaggggactcactgtcatcacaatggcaatgtatagaacattttaaaagcctacaatgagaaataggagccatttcatggtcatcctcatagtttttccaaccgttagaattactttatataaaataaatatttagtaaatgttagaaaaagggagagagaaaatgagggaagaagggtgatgacatgactctaggaatgaagaaatggcattcggaaaaggtattttcttttatacttgggaaagcaaaggacagaagtaatgagcaaaactttatactaaagagtctcattctatattcagtggtcagaactaggaaaggttattttggaaagttgttctcttcctgtaggataggggttctcagtgcttatggaacctacttctgaactggccttaaaaataatcttggaaaggggatggttggtgccttgtggagcttaaaaaaaaaaaaggatagtcaatatacctgtgatggtcaattttatgtgtcaacttgaccagccaaagagtgtccagatatatgttcaaatattattctaagtattcctgcaacgttgtttttggatgagattaacatttaaatcagtagagtgagtaaagcaaattgacctctgtaatggtgggtgggcctcatccaatcagttgaaggcctgagtagaacaaaaagttaactctcccctgattaagacagaaattcctacctgaaggcctttgaactggagcatcaactcttcctggttctacagcagcctactagccttcggacttaaactgggacactggctctgcagacagtggaccagcctcaataatcacatgagccaatttcttataataaataaataaataaataaaaatctcctattggttccaattctccagagacccctgactaacataatacctattttacgatacttattagaaaaaataaaacccaaccaaatttgggtataagaaacaaacagagcaagaagacatttcaaaagcggtctgagttttaaaatgtcaacactgctggtgtgtcagcaacatttaattgccatcttatccatgcccttcctcttacatgttcagcaagtgtcatttagtcttcatttaagttaggaacaaaagttcaataataggtttaacccagttttctcctttcccagcctcttttaccctaaggtgcccttgaagcaagggcctctgcccagccattccctaacagaggatcatgggagtgaagtatagtgtctttcctgtccagattaaacattatcgttgagctataaagctagatgctgctttgggaagggatcacatacaggactcttgtattttactgacttttctgcaattaataatctacttctcatagtacatatcctaaaacttaaaaggagtgcagaagttagctagtcaatattgtttattttggatatggagaaacaaagcctcagaggagaaaaatgtcctatctgtaccatacagcaattattagcagatctgtaaagcctgctatataatgaagcctcaattcttagcatgtctttaagatgcaagaatttttaaaaagtgtagttggagcttcatgaaaatccactatgtctgctctgcaggaggggctatgcttctgaccctttaccatataaacttttgcttaaagatcaaatcaagaaaataaacctctgaatctctaagtagcactgcacaattggatagttcatgtcgtcctactcaaaaatgggccacctcctgtcaatgaaaccagacttccaaaacataggttatcatagcattccccattcaaacccctgcaatgattctccattgcttaggggggatgagggcaaatgttcaaatgcttagcctaaaatttaagaacctccataatcaaagcttaacctactctagcaacacatatttgttgaatactactgtgtactaggtacaataattgagacagtagataaaaatgcatctttggaagtgactcctccagcccagtcaaactttcaggtaactgcacatgcagaagtggtcacctgcttaacagcaatctcatgagagaccctgaaccagagccacccagctaagccgctcccaaatgtctggcccacagaaactgtgagataatgaatagttattttaagccactgagttttgggataatcttttatgcaataatggataatgtacacatccatgaacagataaatggataaacagactatggtatatccatacaatggaatacaactaagcaataacaagaggtgaactattattatatataacatgctttaaaatctcaaataattacatggagtgaagtaagcctagaagagacaaactaatcaattatgatggaaaacaagtagtgattgcctaaggatggagaggaggcaaagagagaaagagttcaaacacgtacaatgaaactctggggatgcaattgttatattcattaattttatcatggtaatagtttcatgtcaaaatttgtcaaattgtacattttaattgtgcacagtttgttgtaatctgtcaattaaacctcaatagagctataaaaaatcaagtaaaaatggtgatcaaagcattggcattggccctgtcctaatgtacttcagtttggaataaaggacattaacttcgctaatagccacagtgcagtggaagaagggctaacacagcaacatggaggaggaagaggaggaggaggagaagaaagaggaggaagaggaggaggaggaggaaagtctcctgttctctgcctcccactagggcttccatattgaagtcctttctttgtttttccttttccttcttttggtaccacttagccagtagggtttgctaatgctttttttttgcatttaggttttggtccctcttaagcctagtttctttctaattcagactgatttttttttaaagatctattctggatctcttctctaaatgactctggcctattgataaacttttcaccccaacaaataatctgtagggtgttgagaagctttaaactgatatatgtagcacctagctgccactttatgaatagttaatacattgtaattattatgttgatattgttactactataaggttatattctatgataaatatgaaaaaggtacttgaaaaaaataactaaggttttctttcaccaatagattttttacttgcaatgaaaattttagaattgtaatttcaccatccaaataacctttgttttaaatcatcagataaatcaggtcactgaggggaaagggtgagttggggttaaacattaacaaatcctttgggaggtcaggcaattgaatgatgtcttttccagcacatttatgcagcccttttttttctgcttacaaacgaagaaaaataatgaatgttgcctttgggttagaaaagtacagcacagggaaagaaccatctctcactttataatatgtaaaacaatttcatattcaccatatgatttcatccgcacagcaaccatgttgtaacaaaggcagggaatgttacccaatcacacagatgagagagctgaaggtaagtcagataaagtaacttgccaaataccacgcaagctagttttagaacaactgactctaaatcttgcacattttccataacactgaaatgtttaagaagaaagtttgattggaaaaggaggtaagaaaaggaagtattgtgtgacttaaagtaaagagtaatgtcttagaaaggtactgaggggaaatcaggtcaatgtcttacctgcatgctatggcctctccttatactaagagaatgattaaataaatgataattaaatccatcagatacattatttaagaatacttgatggtatggaaaaaaaatgctcatattttaatattaagtttgaaaggcagagaaagaacaacagtttagtcccaaatctgctaggtggcaggggagggcagaaaaataaatcatcatgtttattgcggcactattcacaatagcaaagacttggaaccaacccaaatgcccatcagtgatagactggacaaagaaaatgtgacacatagacaccatggaatactatgcagccataaaaaaggacgagttcatgttctttgcagggacaggggatgaagctggtaaccatcattcttggcaaactaacacaagaacagagtaccaaacactgtatgtctcactcataagtgggaattgaacaatgagaacaccgggacacagggagggaacatcacacaccagggcctgtcggcgggtgggggactaggggagggatagcattaggagaaatacctaatgtagatgatgggttaatgggtgcagcaaaccacaatggcacgtgtatacctatgtaacaaacctgcacattctgcacatgtatcccagaacttaaagtgtaataaaaaataaataaataaataatactaatggtagccatgctctttctggtggtgagacaataaacgattttgtgtttgtttattcttttctatacttttctacttttgaactgtgagcatattgtccttagtgcaagaaatagaatctttttttaaatgaacaaatggttctgagagtcattgtgcttatcttctaaatatttggccctttgtatgtactcggttccagcagcaaaacactcacaaagggtatatgtaacaaagtggaaacatgatcctgccaactttacctggaatgctatgtgcattttggcagtgttggagagatgaaaccagaacagacttagaaaaaagctgggacagagaacaaaggaagaggaaactctgccatatggcatagaggaattcactaaaatttaggaatcttaaatagagatcccttaagactaaagtgatatgattgaggttcataaaataatttgtcattatatatttgaatatctgaataccactgtactttactctcctgaataataactgttttactcatctttctaatctcacaatgatatgcatagtattggcaaatagcaggtgcctgaattgagttgtagtttataggttgaataaacatgtatttatccaagaagtcttaaaatactaatgtgaagtgttagataaagccctaaaaggatgcttcaattcaaacaaaacaaaagaaaatgctctttttatgacaagcagtaactatgggtaaatatttggctccaaagaaaggtgcagggagatagcaaggtctagtgaaaggggttatggttggcggggggcagggtatctaaaatagcaacattgtacattcacttcatgaaagataatcgtgttctctatggcaacaaaaaatatttttggtacatttgtctgaaagataatttcaaactctagttacctgtgtaatatcaaattaataccaagtaagtaatagtaaataaaaacactttgtttatgtagcaatcacaatgtgccagacactgctctaagcactttacatatattaactaatttagtcttcctaaacttccctgtcgataggtactattattctccttgttcctttctttttactggagtaaaggaagattgagtgatttgcccaaggtcacgcagctaggaaatatttagtaaagccaggatttaaacccaagtcttgtggctccagagtctgcattcttaaccctttactgtcttttaagataaaacaacaacaataacaacaatgcatatattcaaaacttatttattaactgctcttattccttaatttcatggcagttttgcctctcagattagatttgtaagtaggaagtgtgtctttaatttttgtcccacctaacctcagagacacccagtacttttagagccaagtaatagatattcttctgctatgatgtgtctgatctttacttgctggacattcaaatttcttttgataatattacctttttcactcaaattatcaaatgaaaagaaaaaaacaactccctggacagttaatgagaaaataagaactgggtcaccatatgtaaaatgatttgcggatttgattttagttctcctgttattgcaaagcgagtagctcatattattcccacctgcaaaggaacagccttcatgaactacattttcaccacatagacacacacatccactttctataagaatgctcagcccatctgctcacatttaaaaataccaattgaagacctcccacgctgccttggtttgtaaaatgtctatcaccaaatcttcattccaacactcctttaagtttataatttctttttctcttttcttttaatgattttcactagttctttttcaagtacctaatgttcatcattaaggtttttctgaaatagacaatggtctttaaaatacagggtttcaatgttatttccatctatgatgtgtcttcattttgaggaaacattttcctatttgggaaaaggttaccttgcaccctggtaataagcctgtttccaataaagaaaattaagatctctatctgttctcaaggtacaagacttgattacagcactatgaaaagcaattcttaaaacacacacacacatacatacacacacacaaagaaaagatgaaattgtgcagacaactcattctcaagatacatttaagagagtaaaaactgaattgcgcatatatattcctgaacaaggagtggaggtatttgttggggtaggcacttcctgtatctccatgaaaatatcccctggagggtaggtaagctcaggacacacaagcactgtttccatgttgctgtaaaccacatgttattattatcattattattgagacgaagtctctctctgtcacccaggttcgagtgcagtggcatgatcttggctcactgcaaccactgcctccggggttcaatgcctctgggattcaagtgattttcctgcctcagcctcccgagtagctgggactacaggtgtgtgccaccacacccagctagtttttgtatttttcaatagagacagttttctccatgttgcccaggctggtgttgaactcctgacctcaggtggtccgatcatctcggcctccccaaatgctcagattacaggtgtgagccactgcacctggccccacatgttattcttctaagagcctcaagctcagtattccttcattcattatttcttttatctattcactcattcattgaggtaacgtgcttttactgagggccgtttcctgggcattctcataggcagtagagagaaatggtgatgacagatgccatgctccctgacctcaaataacttacaatctgggagggaggcagactagggtcctcttgacttttaattcagtgcttgctctttcctttttctttttttagaaatccaagacatacaacgttgtagcttactctttatttgcttatatacttacttatttttctgaggcactttatgcaagatcttatgcagtgattcaagttcctgtgtgctatctcactggccataaaggtgacagccaatgtgcggtattagaagaagctactggaatttatcatggagtcaacatttctattttttttttttgcaaatgttatgaaatcccttataaaaaatgattagagatgaaaactgcttcaagctctccctgaaatccaactcaataatttttttaggaaacatctagtgaccgctgaactgtggagcagcttgctaaggaaatgtgtcataatatgtagataccgggatcctaaggtatagctccacatagtttatgtctgagaggaaaattggtctatgtcccacatgtggggcttttcaaaaaatccttctcaataaagagatttttttgttgttgttgttttgttttgttttgtttttgagacggagtctcattctgttacccaggctggagtgcagtggcccgatctcagctctctgtaacctccgcctcccaggttcaagcgattctcctgccttagcctcctgagtagctgggattacaggcatgcaccactgtgcccagataattttagtagagacagggtttcaccatgttggccaggctggtttcaaactcctgatctcaggcaatctgcctgcctcggcctcccaaagtgcttggattacaggcatgagccaccacttccggcctcaataaagaattttaatgacactaatacatgttgtgaggatttaatttgaagtagatttatttgaaatacatatgaaaagtcttaaaatgtccatgcattttgaacagcaatttgagatgaaggaaataatcagatatgcataaaatgtctattaaaatgttctatttttataatagagaaaaattggacataatatactcagtgagaagggaatggttaattatgaaatcattgtttcatagataattgttatcattaaacattatatagaagactttcaatgatgtgggccaataaacacaatttattactaaataaataaagtatgtagagaattataagactcaaagcatgttaaaatatatttcaacacatcttaatacagccgggcatagtggcttatgcctgtaatcccagaactttgggaggctgaggcaggaggatgtcttgagcccaggagtttgagactgtagcctaagcaacatgatgagacctcacctctctaaaatatatatatatgtgtgtgtatatatatatgtatatatatgtgtgtgtatatatatatgtatatatatgtgtgtgtgtgtatatatatatatatatatatatacaggaagaatacatgcaaaaatgtcaaaaatattaactctggacaattagagattctaaaatttcttgactttgtcatgctctctataattgaggtcaagtgttctctttccttccattgaaatattcaactcccatcactctttgtggactttgaagatttctaaaatgtaaatgaaaatattttagaggacttcaaatttttccattctttagaacccaaatggcatgatggcttttttatctaaatacactgtaattcaaatttttcctgcatccaaatctacatggcatggtgaattcttaattactcaatgtgctgagcacagttatctctaaaatatcattatctttaattacctaaaagattataaatacatataaaaatgcttaaaacaatgaatgccttactctcttcagggtactcaaatgtcctgatagactcaatgttttactctttgacaatatttctgcaacacttgtacttgttcaggatttgtgggaaaataaaattattctaggcccactaaagtagagtctttccaaactcttgatatattaagcagctatatatagctgtacagatgttaacctggttcaccgttgcattacactttgcattttatttcagaattactaaattatggcagctttaaaaatagttttaaactttcaaaaataattgtggctgtgtatttagaatctctataaagttatttttaggattgtagctaatctgccatagactgttaacataaaaaatttatgttttatttcatatcttcttccaaagcacatactataaatataaatgggagttgttagcctataaaggaggggaactctaactgaaagttagagtttgtatctttatcacgttcactcattgttattactggattactatttcctaccttaatacatagtttagcaagttatgaagaggatgggctgacgtttgacaaggatgaagccttccagctactaagcactgtgagatctggtccagcacaaagagaaatgaaaagaaaacttcaaatgccatgtaagaagtgagagcagtcctaagggtcaggagctaaactgacttgaatagctttgaaactaagtagaatttcagtcctggtggttggtgattagaaaatggagcaggaaatgcttccacagctagtaaaaaaaagaaaaaaaaaaatccttatcttactgtcattatgaacatagatataaaggtctgggtatgaaccaggatcaaggtgaagatgaatgaggcagttcaaatgcctgtgcctagcttctcagcttcatttgaccctaccacacctgagctctcggcaggtactccccaggcctaccccactctgtttcccttcctcacatccctagcctcaacacaaacatgcacactgtgcacttttcattcctggctctataatttgctcattttgttcctccttcccttccccctcatcacatatagcctggcctaaatgagattttatctgttcctcaatctttccagaccatcccctttcttcaagagctaggtcacatcacatctcctccatgaagagatccttagttctcattcatttctccagtttccaaatctttattttatgcattgctaaatgatatccagtttgctatctaattatacactgcctcaaataacacacacctttattttctctgcaggtcaacggtgaatatcactggcttcgtgctctcttatattctccatggggcctagtgtagggtggaaaacattgaaggtacataggatatcagatgagcgatgcgaatcgtttaatgatattattgcacaaaatagtttatacttttcaagcatcttcacaatatgatgttcttccttttctagagaaaatactgttaccggtcctaaaaaaatacttttggcagtgagagtgaacctatctttgatttgctttagtggtacttttcagcccttctgaattgacaagaacagtttcaaaaactcaagacttggatattaagtcacatataatagcagaaaaagactgaagcagttttgagtttcagaatactaaatgtgaatctttctaaaatggatcagaaaaaaaaatgtgactttcagaccccctgacttcatcctacctacaattgaagagcaacgtcacagtcttgacatctgacctgtttccttggtgcttccacactcagacaggtgtctaggagaggcatcagtaactagatttctatctctacagacatatttcacaaaggctctatctcctaactctgactttcaatttagcttgttttataggccttaaagggctgcttctgaaatgatcgttttatctttttctctgttaatttaaatcctggaaaaaaattcagtctgactagctttacaaagcctgctgagctgttgtgaagaatagggttctgctgacttaaaaaaaatctgagctcataatcttctttagaaatacataggaacatcaagctgatctaccatggaatcatggagtttaatgattccggtatttctaaattcaataaggagccatttaagagacgtggaactggcttcatcccacaccttcatttcctctgatattgcctatgctctgtttcagaaggagcaaaagagatgaataattactggcagattaaccttagtaattactgtttctttgatacctttgttaacctttgaaatctctgggcatttcctgagggcacaactctatacttgcaagtatggaaaagccatagccgttttctttgttgtatgccgatcttcttcggccttgtaaatttgcaccaattaagaatattatttgcagtcttatttttaatcatgataacataattataagaatttttatctagtatattagcgatccctgtggaaaacagaggcccagagaggtccagagatacactgaggccttatctcaagtcagaggcatccctgaagcagactgcgatgggttcagagtttgaggttctcaatgtgctgcctactgttgccctagatactttcagacgatttcacatagaggtttggctcttttagttgcataccagaatgtcagccacattttctatatttatttatccttcatccctggccttatcaccagagtttgtagacaaaatctgatactcctgtctcctacctttccggattgtgccaggctgccctgtattgtctgatcctcaggctatcctgtgatcagcttctaagattttttcctttctctgctctctctgcttggctaagacatttcctcaggtctcaagcttctcttgggcttttatgcaatgttgcttttcctctattgatgaattactgtaaagctgccaacaaaactctgcccctccataaagaatgccatccccatctctagacatctctgggatatgacatctgcttttcaatagtgtatgccaggccctagctaggtgccttgctgaagccagtgaattggttaaagacaagatgtggttcagttattttcagataaaaaaattctcattctggaaacaggtttattctgctgcattcaacatcaagtgagaaaaagttaccctgctttcaataaagtaatgtggcaatagcataggtgaattcaatatttaaggaacaaactgcatgccaagtcaattctttctaggtcgggtccaaacaatactatggagtgcctggtaaatgctggacactgtgcttcctgcctgcttgcactcaccactgtcttattttagactccacaaaaaccttggaagcaacaggatataacccaggtctcttcaactataaatctttatatgttctaccatatataataaattatctttgtgcctctttccagctgtaagcaggagtgaggggtgggagcagtttcagggatctcagtagagatcatatccaacacttagttgtggtttggcacaacctggtggcaagtttcctgctcccactctaatgtccataagagattctaggctcagtgattggctgaaacttctagacacctaacaagctggtaggtatctcaccagcttgacccaaggaggttgggcctgtagaactctggggactccaggacccaatttttttctccccacttactgaggaggggttgcgtgacatttcctgctcagccttatcttgccatccatgaactccccgagcccctcaacacccacaaccagcaaaacaacaacaataggtggaagactggggccaatagtcaattgtcttgaatggaggtggggaaggggataactgtatttatagcaatgtaatattatgtctaagagtttagcttcaccgatgaaaccccatgattacttatacttagtcgaatgtgtttacatacatttagttgaaatctagcaacatatctaagaactagtgaagaaagcatacagtagtagcagtaataatatatgaagagaaaatattgtattgaaaaaatttttcaaaagaaaataacttgacactggaaagtggggaatagtccataaaagaaaaaaatcattgttataatgattactaaacataaaaattaaccaagtgtacatgtgaaagccaccatacacaaactgaataaaaaggtatgagtctttgcttcttgtgcacttgtgatttttcaggggggtggggatataacccagatgagacaagcatgggtaacaagcaggtaaatcacatctcctaaaactgaagacctggaacaaatgaaatactgaagcagacagtatattaccctacactggatttctgctcatgagcttatgaaggctctggattcctgcttatgagctacctaatgaactctggaaatttacgcaagttaatttctctaaacctcaatttccatatctatatatgggccataataatatccatctcattggttgttaccaatgatttaatgaaagaatgtaaataaagaactcagtatagtacctgacaaatagtaaatgtagttatacaatcagctattgttattgatcttaatataattaaatcattccaaaatagtgcttggaaaattggtattagtgtctccagaaagagcttaattgcctctgacacagtctatgttgcaatataactttgcctgaactggatagcaaggaagaagccagcaaggaaggctctattttcctccagaagtgggtatcaaagactaaatttcatcctctcatttttgtagagaggctttagtaaatataaatgtaagtctaggtaacgccatagagatccatttgtttatgttggaaatgtgcatatgtcctgctgcagactagaccacactcatttttactctttaaaaaaatcattcaagtcttgttaaaattctttctattaaactgctgacaactgtacttcttgttagtgtggtttccatttgtacacatttccccctgtgtctctacattataaacctaataatgtattattttagaaagagtctaacatgataattcttacacttttttggaatcactgaccccggggggtctactcagaatatatatatataaaagctatagtttaaagcaatttatgaattgaattaaatctctaaggttaatgccagcaaggcatttgaagggaaagtgctgctcataactgctccatctagcatttctgttaatgaaaagacattaccttctggtagtaatggagccacttaatcctcaatgtagaacttggtaagagtggtactcaaaacggttaccagttagttctgcagggtcatcaatcagaatgaatgccttgtgatcaagcaagtttctagaggcccccacttattctaggagtggacccactttattgctgggctgtggagcgggcactcctggcagaggttgtggtggtagtaggagggtctttgaacagcagaatatggatatattgtaatattttaacaagcatgacagctaaatgtcagccttatgtttacatataataacaaagaaataaattcatgccgaaaatcaactcaagatactctcccaggttgggcatggtggttcatgtttgtaatcccagcactttgggaggctgaggcaggaggatcagtggagcccagaaatttgagaccagcctgggcaccatagtgagaccctatcactgtatttttaattttttaaaaatttgccagatgtggtggcacacagctgtagccctagctacttgaaaggctgaggcaggagaatcgcttgagttcaggacttcaaggttacagggagctatgactgcatcgctgtattccagctgggtgacacagggagaccctctttctcatcatatatacgtaatctctctcaaatctgaaaatgtgaggaaaaagaatttctaattctaaaactttgggcaccaccttcttaaaacatgggtgaaaaagacaaataatacttttatttttgccttcacttttggttacctaatttagttatttcatcactctatagactttctttgatcatctatgatttccttgtattttatagaagtttttaacaacaggggcatatttaagaatccaggccgggcgcagcagctcacgcctgtaatcgcagcactttaggaggccgaggtgggtgaataaccaggtcaggagaccgagaccatcctggctaacacggtgaaaccccgtctctactgaaaaaaaaatacaaaaaattagccgggtgtggtggcgggctcctgtagtcccagctactcgggaggctgaggcaggagaatggcgtgaacccgggaggcggagcttgcagtgagccgagatcgcgccactgcactccagcctgggcgacagagcaacaatccgtctcaaaaaaaaaaaaaaaaaagaaaaaaagaaaaaaaaaattcagcatctggataaaaaattaaataaaattaaaacagtaatgatgttaggaacaagaaagaaattcttttataaaacagtggcatattaaagaattcagcatctggataaaaaaattaaataaaattaaaacaataatagtaacgatgttaggaacaagaaagaagttattttataataatgctaatttttgtgttttagactttacagtgttattttacatatatcaactcttttaatccatgcaacatcctgggataccagggttattattcctactttatacatgaagatgttaaagctcagaaaattaactcaaattaactcaccaaggctatacagctagaaactgggagacagtatttatacccaggtcttcttatttgagttcactttccactacattaaagcacgctggaattcctgggatttttctttaggtgagaggtaaattagtaattataatgtttgttctagagagtaaaagaatgaaacatattatcatcttaccttattacctgttgtatgtatttgtgaccacttcttgagctccataacagaatactcaagtgctgagactaatagggatgtgtgtgacagaggtcgctagaaactgtatcagcatggtcaagaatttcacactttattagcttattttaagcttatttttaaggcgtggtggctcacgcctgtaatcccagcactttggcagtccgaggcaggtggatcacaaggtcaagagatggagaccatcctggccaacatagtgaaaccccatctctactaaaaacacaaaaaatagctgggtgtggtggtgcgcacctgcagtcccagctactcgggaggctgaggcaggagaatcacttgaacccaggaggcgaagtttgcaggaagccgagattgcaccactgccctccagcctggtgacagagtgagactccatctcaaaaaaaaaaaaaagtcctaaaattttttaaaaaaagaaaacaactgctactggattgtataacaccattttatacgagcaggttgtgctaaattgtcagaagatataaaattcttaaagacttgcaaatcacaatgttttggaatggaaaagaaagttagctaacaagaggaaaaacactgcctgctccatgagtaggtctcatcaaattctatcaacttatttctaggcttaaatctcatcagcaagtccaggatgtctgatatagaacacccattatgtaagtcacactgaaaccctataggattcatgggatggagggaggaaatggacagtcaaggaagagtggagtcaagaagtagatgaaatcccccaaactcactgaatgacactaatcgaagtaaggtcccctggcaatctcctttagtccctcactttacataaagagtgactgatgctcggaggacacaaatcactttcttaaggtcacacggtaggaggacttttcagagaaaatgacaatttttaggagaaagactatgcaagcaagtaatatattttatggaaaaagaagagggaagaatagtgattgttcagcacctgtgagagaaactcttatcttccttctctaccaagatggaggttggtattgtttttactactacacagatgagaaaaaaatgatcttgggagattttttttaattgctcaagggccactggactctgaagtggtagaatggggatcccaaccttggttcttctctctcaaagtcctttgctctttccaccctaccaccatatttaacctaaaactcaggcttcagatatcaaattcatgcattaatgagtgtaaaactagacaccatagtgattcattctagaaccagtatatgtatggaaccagggaaatatataaaatcagaacacagataaagagaaaaatttcaaaccatgaaaaaaatttgtaaagcctaaactgcattgcacattgtcatactttatagatagttaattcattcagaaaacatacatagttctcaggaaattaaattcctacatttcgaattcatttatccctatttttttgtgaacatatcagtagaactgcagataatcagaaaggtttatgaacacttgaaggtttttctttttagcaggaaaacaatatttttcagcagaacaaataaatgaaattatgtaggtaagtatttattctgaatcaaaaaccccatagaagtcaagtgctgcccaaaaattatcaacagaaattatttctacatccatctttaaaacgaatgacttccttttgcttcaaggccaaagatggaggtttggatcacaattactcatgttccactcctctctgtaccacacatctagcagataatcacatggaccttgccacattttcttgaattatggattttgtgaaatacagacttcttggccttagattttaaacctctcaaaagtggcaccatcaacttaagtttctgtcccaataaaacaaacaaaaaaacagctccagccacagtgatgacctgatagcttgctgttcttgacataaaccttgttctgctcccccttgctcacacagttctctgaatagttctctctctccctcttcctcccatgcatatcactttctaacaaaacaccaaactgtctgtctcctcaaggggccttgccttcctcagtccaatcaggtcacctctcttcattttctattcatatgctttgctatctcgtattggaaacaagtagtgtgagtctaagataaagtcagtgaagaaggcggtatctatggagaccaggcaaaacccagttccttcataggcacagtcggaccaaagcagcagtgttgctctaagaagtgtcttctatccgtcttctacttgagtgctcctggggattggaagtttctaattagcccttttgatgaccagttggagcactcttacatacattttttaaaaatagagactcaatttgtcatcatgagagaatctttcacttctggacatgctcggctcccagttttaatgccttaaaacagctgccagtgaaggaaaagagaagaaatgagaaaggtgcttattgtttttcctaaaggactaaaccagaaagtagctaagtggtggcactgaggaaaaagagacaggaaataagctggttgtggcttatttataatctggttccaatggagttcaggccaaggcccatcaagccctttacctcaacaaggccctacagtgggctcaggctgaagtcttctttctcatgcatcatttactcataaggcaaaaagatatttagtacccaacataagcaaggcattgtgccagacactgaggtgagtgacaggaaaggggatggtatagttggaaatgcttacgtggcaatagaaagtccaccatgtttagaattaaaggaactgtaattattttctgcacaagcccttcacgttatagatggagaatctgaagactttggggaaggatgggtggaagggtatgggtagagggaaagctgggactagattattcctaccacaaataaaattggaagctaagcattttttttctttttttgccacagtacataatctcagtggtttaaccagaaaaaaaaattataagaaaaactacttataagtgactactcttgctactctgttttgctacaggctgtgtaggcaatacaaataggttaggcagggggaaaaaaaaatctctattaggacaagtagccctgtatacctggatacttttacctagttcaaaattctagaattataattgctccccattcaactcgggcctgatagagtaaacagacattttgtctgaagttgttttatcagtattgtcttgttgatgaagattgcacacattttacaaagctctgttgggataaaccctcctttttgggagaagagattatgtcttcgttatttgcccctgtctttgctggtgtacactgtagcacatttcagactacctggttctaggtattggaatccaatcttatttgtctactgccaccagcatctctggccctttcacgggtcctggtaaagtggtatttgcaaactgtgtcctcctgatcctagtcacagatccttcttttctgctggttttttcccctcctatcgttgtttctttcttagggttatgggaaacttttagttgttcaccatgcgggatgcataggaatttgagaagcaacactcttgtccatcttcccaagctcctcgcccagttgttgctcctctaccatcataatatcatgcaggatgcaggatacttcacagggcatagttgtccttgcagaaaaaaacaaaacaaaaacaaaaccactttccagaattccctcaaatttctccaagggtctccatcttctctttatctccagagcttggtatcaagcaaagggaagaggggttgagcatttcatggagactcagtacacctcagctcgactcatagctcctctagtgctatttcctgcccattaggcacaaaattgtctgctttgatgtcacacgtttctgactgactatgataaatacatacagaagctgataattcctcacctgcctgccattacaataatggtctgagccaccatcatcctccacctgtactactgtgattgcctcctcactggtccatctgcttcctcttttgattctctagaacctatattcagaacagcagccatgtgatccctttaaaatgcaagtaacatagcatcattcttctgttccgcaaaatccttcattggtttccccttcattcttaataaaatccaaagctctgatattgacccaggaagccctatattatctgcccttcctgcctcctctctaacactctgctcttttgcctcaggcctctgcacaagctgtccccattgcttagactccagatatctttttcctgactgccttcaggtctggtcaactgccatgcacctgcgtgaccctcttccctcatgatcatacgtagaatagcaaccctatgccctctgtgaccctcttctccttctctctgcctcttcttccccacagcacttattatcacctgacatactatttgtttatttgctgatatatgctcatttccacccattggaacataaactccatgagaacacattattttgtttgctactgaatacccagtgcctggcactttacagatactcaataaatgtttgtaggatgagtgaatgaatgaatgaacaaactctaaattgggagttcaccaaactttgaatctttattagcaaagtcaatctttggaactaaacaaacaaacgaaccgaaaaacaatctcacaagaagcctgcattgggtttcaaaattattttttctgcggtgcacttttaaaagttcatttttcaattcaaagctaggcattgatttctttgttctgggttgcttctgccctccctctgaggcttgaaagatactggctcaaacggtagaaggctctggaacaaaggaaaaaccaggaaaaaaaattcctctttttataaaaatcctcaaattgcattactctgcctgagaatattgtaataaggatttaaatggttttggtcttactttgtctagacactttcattcttagtcttgccttgaattgcttaaatattaagagggtaagcagcttgtcggttagagtaaagttatgcaaaaagagcaaatctgctaaaattttccaaagaacgtagtggagctggggcttgaaatgtctggtaaggacatttgaacaggagactgcctattttcaaaagttggataacaggctttgatagtgaaacacggggtgcataactggacacaatggataaaatgaatagaatgagtgtcatcacatgatgaatgggctagttttagagtccacacattcactcaataatggttttacctggtttgcaaggtggcaatccacagttgccagtcctcaagcacactttatttagcctatatttgttaaagaaaaaatttcacatataaatcttgatctccattttcctttaaaagtagaaggtctgccacacttgcttgttaagaaaaaatcacccaggccttggaaataagacaaaaatgagacaaagggactacagcatgctcattcagtcataatagaatattgtctaaaaaatctgctgctatggtttggatatgtcccccaagtttcatgtgttggaaacgtaatccccaaattcatacgttgatggcttttggagatgaggcctttgtgagataattaggatcagataaggtctgatcctaaacagagttgggcccccatgatgggattggtggttttataagaagagcaagagagtcctgagctgacatgctctcgtcctttcaccatgtgatattttctgccatgttatgatgccgtaagaaggttctcaccagacgcaacccctcagtcttagacttcccagtctccagaactgtaagaaataaatttgtttataaattgccgaatctgtgatattctgttacagcaatagaaaatggactaagatacctgcctaagactcatacaattgtctaggccctagactctagtgatgcaatattgttacatttactgtgtactactgattagagttaaaagtctataaagttagatgccaacttgtagaagattgagtgattgtaaattatttttgtacaatagaataaataactccataggtaacagttttgtttccttgtagggtattaaccaattttttaactaactttattttctctcagtattcttatttctgttgactgtataaatattccagcctctcattttctcctttgaaccagctgtcatcttactaaattcttattatgagttaaattaatctttgacacgttcactgtatatttgtaagacagtcatgctttctttcagcttttggaaaattatatttggacctgcttcacattcctaaatgggaaccaatgtctagaataatcactagctgctcccattaagcaagggcagctctccaattcaacacagtttcctcctcccactcctgataatcttatttccagtcctttccctcattcatgtgtccttcttggcctcggtgagcctttgagttcttaacgtctgacttataccttgaggttttagtagagcagtggttcttactcttgaacatgtatgaaaatctccaggagggcttattaaaacacagattgctgggctacaccccagagtatctgactcagtaggcctggggtgagactcaagaattcgcatttctaacaatttctcagatgatgctgatgttgctagtgcagggaccacacttggaaaatcattgttgtagtaagtggtaggctttgaacttggtcttggtagattagaaggcatttttcactgtaacaatttgacaagttgaatgcaagacatagtaaagtaagacttatttttaaaaaactttgaaagccaagcacagtggctcacacctataatcccagtactttgggaggctgaggtgggtggattacttgagctaaagttcaagaccagcctgaccaacatggtgaaaccctgtttctaccaaaaatataaaaattagctaggtatggtggtgcacgcctgtagtcccagctacttgggaggctgaggtgggaggatggcttgagccagggaggcgggggttgcagttagccgatattgtaccactgtactccagcctggtgacacagccagaccctgactcaaaaatataatataatataatataatataatataatataatataatataatatactcttaaaatgtgaattacaacatattagataatagcatttctcatgatgcctactctacttgagaattaactgctgatgatattgaaaacaatgagtaatttttgtaaatttattgaaacgtcaagactgttcaatgactactttttttgtttgtctacattttaacttctttgaaggcaaagaaatcctagtagcctcctcagtgcagtgtctaacgtaggctaatgctatggacctggcaaacacctattgacttacaatgatacatttctatgtatgactgtggtttcctaagcttttcatattcattatctcattcaacatatacaacaatcctgtgaggtgaatagggtatgtgtattactctactttacagataaataagctaagttttagaggcttgacatgtctttccctaggatacaaagcaaatatatggcaaagccagggctagcacttgatctttagtcttgctcaccaggattatttactgacacacaatgaaaactagattaaaaatgccatgaggatttaggataagctaaaagattcttaaaatgcaattggacccataatacattactcacaaattacagaaagcatctattttacacacacacaattatttacacacggcagctttgcagtgaatactttgagtgagatttaaaaaatagactctattccacccaattaatcagcatcagatagcaaggaggctgctaaactttctggaatttaaaactttgcaaagaggaagatagtgtgtagaaagtggataaatgctggagtcaaacaaatcttcattctgtcattgaccagctatgataccttgaaaaaattcaccttaattctatgaatgttaagtcccttgcctgtaaaataaagtatatgtatatgttaaaattttaatctctaataaggattacgcaaaaatatatgtgaaactaagaatgtacatacagagtacctagtccagggccttgagtagtgagagtgcacaataagagttaattcctaccctaacttattggaagggcaaaaggatgtgctaggactgttaggatttgaacattaaagaacatattgagtgaagtgttattactcattcccactacatcctcaaaattctattgaatcgttcacgcaccaaaccacagtatattccagaaaaagcaaatataggcatattattgcaatactaatacagttttccattgactagtacactaagaaatcaccagcatgtattaccatcatggcaggtgatttaaatgaatgtcaggtgcaacatattgtatttccatttgactgttttgcagtgcaggaatcaatgagaaagaacaaggcaacagtttgagccacaaaggggaaaaaaggagaaaatggaataattgcattcaccctagtgcagaaatgtacaagtgtaagtggcatgaaaggaaatatacataattatagtctgcatagaactgggaacaaatggaaagagtggctgtgttgactgagaaagagaagaaaagtcggagaaactggccactctgcattccagacacaggcagatttcatctgcaaacagtgccctggccagacttgccagttacgtggatgacaaagcagaaaacaaatgcactgattaaagtgctgaattcatcctcagactgaaatacaacttacagcagaaaaagagggggcctaaactggagatgacaatctggcattttgatgcagacaggctgggatagatggcatacctggagtatcaaaattcattttcccttgtgtaaataaatgctcataaactgtaaagtgggtaacgaaggttgggtttgtttggaccagagatgttagaaaacagtcaacactttgttccctattgtaagaacacagcagcctcaagatgtgctaagattgaccacccacaacttccctggtggacatgcagtagctcttctgtgatttgtagtaaaatatcagcccttcctggcaatgcacattactgcataattgcagatgtactacagtctaactggtataacagaactctacacaactacagttagaaaagctaacatgacaccaaatgcccacgccaccagtgaatcacagcaagagaaaaagaaattgcattgtctatgcattattggaaaagaatattttatactgtcgaggggctagaggctggcttgttcaccctcagcaacactatctgccttactagctggctgatagttcattgcttgtataatttataataattctgggtgtgtattagtgctagcaagtgtgataagcatgagtaactatgacccctcctaaagtgcaaggtattctaaaagctaagatccttgtttgctcactagtcaaggacatgggagttttgggtcttgatattccttagagggcagtgtttctcaaacacacatatctcatgtatacaaagctgctggagattttgtttaaatgcaggttctgcatcagtaggcctggagtacagctaaaagtctgcatttctaagaaaagtcaggtgataaccctagagcacatggcacagcaaatagtagatgtgtaattattaaatggactagagttaaatatcaaggcacttagattaagcaaccgtatttcaaatccaaagagtggagtggattagctatacactttcctctcactctaaattccaacatacagtttaagaagacttggaaccaacccaaatgcccatcaatgatagactggacaaagaaaacgtggcacatatacaccatggaatactatgcagccataaaaaaggatgagtttatatcctttgcagggacatggatgaagttgaaaaccatcattctcagcaagctaacacaagaacagaaaaccaaacaccacatattctcactctaagtgggagttgaacaatgagaacacatggacacagggaggggaatatcacacaccggagcctgtagggggtgggggactaggagatggatagcattagaagaaatacctaatgtagatcacaggttgatgggtgcagcaaaccaccatggcacgtgtatacctatgtaacaaacttgtacattctgcacacgtaccccagaacttgaagtataataataataataataataataataataaagactgttacctttggaatcctacagtcctgaatttaggccttaactttgcaatttactaaatatgtgatcttcagtaagttaacttctctgaatctcatttttgtacctaaaaaatatctcgactacttatatactacctatattacctgttaaatgttacctacctcagaaggtagttctgagaattgaataaaataatgcacttagaatgtataccacagtgcctggcatctataagataataaaaatgacaaccaatattgttattgccactatgtaagtatttccaacgaccagtttctaatgttagcagaaggatgagagtaattataatggagggaagatttactcatttattaactaataaatatttattgaggacttttctgagacaatcatagtctagcactgaggatacgacatttaaaaagtaagagaatgactgtgctttcatgcagctgtcattctagagggagaaaaaaataaataataaaacatgtaaataatacaaatagtgatatatatgttttaaaaataaagtatccaactatatgacattatagagaaaaaaagtgtggagatagtaaagttagtggctagtctgatacaatcccatttgtttatatttacttttgttacctggattttgaggtcttattcataaaatcctttcctgtgccagtgtcctgaattgttttctctatgttttcttctagtagttttacagtttcaggtcttatatttcagtctttgattcattttgagttgatttttgtgtaggaagagaagcagggacctagttccattcttctgcatatagttatcctgttttcccagcactaattattgaagaaattgtccttcccacaatgactgttcctggcgcctttgtcaaaaattaaatgttggctgtagatatgtggattaatttctggaccctgtcatctgttccattggtctatgtgtctgtttttataacaacatcatgctattttagttactacagctttgtaatatattttgaagtctggtagtgtgatgccttcagctttgtttgttttgctcagaatcgttttggctatttggggtcttttgtggttccatacaaattttatgattaaaaaaaatcctgtgaagaatatcatcggtattttgatagagatttcactgaatctgtagattgctttgggtagtattaaataaccaacaaagtgaaaaggcaacctataaaatgaaataaaatatttgcaaactattcatacaacagaagattaatgtccagaatatacaagaaactcaaacatctcaacagcaaaaaacaaacaattcaatttaaaaatgggcaaatgaactgaaaagacatttttcaaaagaagatatgcaaatggccaagaaatacatgaaaaaaatgctcaacatcactaatcaacagggaaatgcaaatcaaaaccacaatgaagtatcacctcaccccaattataatggctgtaatcaaaaatacagaaaataacaaatgctggcagggatgcagaaaaaaggttactcttatatgctgttgatgaaaatgtaaactcataacaccgctatggaaaacagtatggaggttcctcaaaaaactacaaatagaactactgtacgacccagtaatcctactactgagcatctatcccaaggaagggaaattagcaatatcaaagagacatctgcaccccatgtttatggcagtactattcacaatagccaaaatatggagtcaatctaggtgtccaacaactgatgaatggataaagaacatatgatataaatacacaacgaaataccattcagccataaaaaagaataaaatctgtcattcacagcaacatggatggaagtggagggcattacattaaatgaaataagccaggaatagaaagttaaagttctcaatcatatgtagaagctgaaaaagttgatctcatagaagttaaaagtagaacagagaatactataggctgggaagagtagggtacaggggaaatagggagagatctgttaaaacataaaaattacagctagataggaagagtaagttctagtgttccataccactgtagtgtgattatagttaataataatatgtagtttcaaatagctacaaggaggatattgaatgttcccaacacaagaaaatgataaatgtttgagataatggatatcttaattacccttctctgatcatatacattacatgtattgcaaaatcacaatgtacccccacagatatgtacaattattataggtcagcttagaaaagaaaaaaaaagtcactggttgctaggggttagtgaagatggggagatcaatcggcaaagcacagaggactttaaacacagtgaaactacagtcatccagcagtattcctgggggactggttccagaacccctgtggataccaaaatccacatacaatggtgtagtatttgcatatcaccagtaaacattctcccatgtactttagatcatctctagattctttataatacctactacaatgcaaatactatgtaaatagttgttatacaatatttttcagggaataaggaaaacaaaagaagtctgtacatattcagtatagacacaactgtccattttttttaagtatttttgtttcacagttggttgaatccacagatgtagcacccatgaatatggagggctgactgtatgctgcatgttagttactataaaggtggatacatgtcattaaacatttgtttaaactgatagaatgtacaacacctagagagaaccctaatgtaaactatggactttggatgataatgatgtgtcaatgtaggttcaccaattcaattctaacaaatgtcttattctggcttaagatgttgatagtggggagattgtgtatgtggtgagagggagaggatatataggaactttctgctcaattttcctgagaacttaaaatggctcaaaacataaagtctattatttaagaagtaaaaaattagtaggcaaataaataatactaaagaggacagattacagctggctgggtcatgggtaaggtgaggggtatttgagacatcatggtcagggaagctccttcccaggaggtggtatttgtgcaaaacctaaaaaatgagaaggatccaactaagcaaatccttctaccaccttatccatcaaattctatgttgatgattacacatcctctcagagctgtgaagtgtagttgaattaacgctgataagaagtgtccactctcaggcatgtacaagttgctgccacagtgtgtatgcaactgtttctaaacagcaaagtttcaatagatacttgttaaggaaaagatctatgataccactgtgggacccaggaaaacgttgctgtttatgagtatctggcacttctaattaaattagtgcacaaaggcccaaaaaaaaaaaaaacacagaaaaatacaggtcaatatccctgattaagataaatgcaaaaatcctcatcaaaatactagcaaaccaaatccagcagcacacaaaaagtcaatttactatgatcaagtaagcttctttcctaggaggcaacgttggttcaacatatgaaaatcaataaatgtgattctctctataaatagaattaacaaaaaccatatgaccatctcaataaacacaggaaaagctttcaataaaatttaacatcccctcatgataaaaacccacaggaaactaggcatcaaaggaacatatctcaaaataataagaccttctatgacaaatctataggcaacatcatactgaataggtaaaagttggaagcattccccttgaaaactggaacaagacatgatgtccactctcaccactcctattcaatatagtgctggaagtcctagccagagcagtcggacaagagaaagaaatcaaaggcatccaaataggaaaataagaagttaaattatatctctttgctgacagtatcattctatgcctagaaaacattaaagactctgccaaaaggttcctggaactgattaatcacttcagtaaagttttaggatacaaaatcaatgcacaaaaatcagtagcatttctgtacaccaataatgttcaagctgagagccaaatcaagtacacaattccatttacaatatcaacaaaaaaataaagtaaaatatctagggatgtattgggggaacctgcccccaatatttcaacatagattctattttccataagtgttggccggctgagaaataaagagaaagagtacaaagagaggaattttacagctgggggtgctgggggtgacatcacatatcagtaggactgtgatgcccacctgagcctcaaaaccagcaggtttttattaaagatttcaaaaggggagggggtgtctgaacagggagtaggtcacaaagatcacatgcctcaaagggcaaaaagcagaacaaagatcacatgcttctgaggaaacaggacaaagggcaaaaggcagaactcctgataagggtctatgctcagtggtgcacgtattgtcttgataaacatcttaacagaaaacagggttcgagagcagagaactggtctgaccaaaaatttaccaggatggagttccccaatcctagtaagcctgagggtactgcagaagaccagggcgtatctcagtccttatctcaaccacacaggacagacattcccagagcggccgtttatagacctccccccaggaatgaattcctttcccagagtattaatatcaatagtctttgtgaggaaaagaatttagtgatacttccctacttgcacgttcatttatagtctctctgcaagaagaaaaatatggctctttttgcatgcacgtgcaggctgtcagaccttatgattgtcttcccttgttccctaaaaatcgctgttattctgttctttttcaaggtgcactgatttcatactgtttgaacacacatgttttacaatcaatttgtacagttaacacaattatcacagtggtcctgaggtgacgtacatcctcagcttatgaagataacaggattaagagattaaagtaaagataggcataagaaattataaaagtattatttgggaactgataaatgtccatgaaatcttcataatttatgttcctcttcttcagctccagccggtccctccgttcagggtccctgacttcccacaacaggaatgcatccaatcaaggaactgaaagatttctacaaggagaactacgaactactgctgaaataaatcatagaggacacaaacaaatgaaaaagcattccatgctcacggactggaagaatcaatattgttaaaatggtcattctgcccagagcaatctacagattcaatgctattcctatcaagctacaaatgtcattttttacagaactagaaaaaactattctaaaattcatatgcaaccacaaaagagcctgaatagcaaaaacaatcctaagcaaaaagaacaaagccagaggaatcacattacccaacttcaaactatgctataaggctatagtaactaaaacagcatagtatgggtacaaagcagatatagaccaatggaacagagtaaagaacccagaaataaagctgcacacctacaatcatctgatcttcagcagagtcaacaaaaacaagtaatagggaaaggattccctatttaatacatggtgctaggatagctggctagccacagtaaaactgggcccctgtctttcatgatatacaaaaactcaagctgaattaaagatttcagtgtaatacctcacactataagaatcctagaagagggtcaggggcagtggctcacacctttaattccagcactttgggaggtcgagataggcggatcatcaggtcaggagatcgagaccatcctggccaacatggtgaaaccctgtctctactaaaaatacaaaaattagcttggcatagtggcacacacttctagtcccagctactcgggaggctgaggcaggcaggagaatctcttgaacctgggaggtggaggttgcagtgagccaaggtcgcaccactgcactccagcctggggaaagagggagactccgtctcaaaaaaaaaaaaaaaaatcctagaagaaaacccaggaaacactgttttgtacattggcttggccttgggaaagaatctattactaagtcctcaaaagcaagtggaattgacaagcggaacctaatgaaacttaagagcttctgcacagcaaaacaactaacaacagagtaaacagacaacctacagaaagggagaaaatattcacaacttatgcatccaccaaaggtctaatatctggaatctatgagaaagctaaacaattgaacaagccaaaaacaaataatctcattttaaaaaggcccaacaaaaacagaaaaatacagatgcaaaagacatgaacacacacacttcttaaaagacatacaagcagctaacaaacatgaaaaaaatgttcaacatcactaattatcagagaaatgaaaatcaagaccacaatgacataccatctcacagcagtcagaatggctattattaaaaagtcaaaacacaatagatgttggtgagctgtagagaaaagggaatgcttataaactgttggtgggaatgtaaattagtatagccacaatggaaagaagtttggagatttctcaaagaacttaaaagagaactaccattcaacccagcaatccccattactgggtatatattcaaaaggaaataaattattctaccaaaaagacccatgcactcatatatgttcatcacagcactattcacaatagcaaacacatgaaatcaacctagatgtccatcaatggtggactggataaagaaaatgtgccacatatatgccatggaatactatgcagccaaaaaaagaacaaaatcatgtcctttgcagcaacatggatgcagctggagatcattatcctaagcaaattaatgcatgaacagaaaaccaaatactgcatgttctcgcttacaaatgggagctaaacattgggtgctcatggacatatagacggccgtaactgacactgaggactaccagaaagaggagggagaaagagggtgcaggggttgaaaaactaaccattgtgtattatgttcagtacttgggtgatgggatcaactgtacaccaaacctcagtatcacacaatatacccaggtaacaaacctgcacatgcaccccctgcatctaaaataaaagttgaaatttaaaataataataataaattagtgcacattaataatcactgttcactaggcactatctaatttatgtgccatgtacttgattctcattacttcattgatcatcacagagaatcttgtaacattgatatggttattttcctgttacacaggaagaaacaaggcttaaggggttaagtaagctgtccaaggtcatacagttatttaaaagcagtgcaaggatttgaacctggatctgttctattctcaagtctgggctatcaaacagcttccaactgggaattccctgctccacacctccagtaaacttcagtcttccccctgactcccaggtataaatccccctcttccaaacagcgtgaaatatcttaaagtaattgcagcagcatgttgaataagccaggtgaatacaaatgtttattactggaacttcataagaatgcagagacagcttcaaggacaaccccctcccccaacacacacgcaggtacacacacacgcaggtacactatccattcagtcacaattttaccatttatgctctgactgattctctgtaacttttgaaatgttttcactgttgtttatttaacagctacaaccagagtcattagccattgactactggacataagaggcttgctatttgactaaagttggacaaaaacccacatgaagctgccacatcctgcagcagttcccatgaaatccaccttatccaggaaaccccatgtgttcaggagcagtatcagaaagccgttctgctgagcaaagaagagaggagcacagagagaaggtgcttcaacaccacagaaagaaaattgaggcctggcataaggaagaacgaagaatgtggtggtatttggagttagtggaagaggaggagtttcaggggtgtcagacttgagttttcatcctgctttccactagagcttctgttaactagagctttagtttctttattacatgctgatagtagtgccagggtgaagggaagactaaatatgatgtcaatgccattacaaatgcctgacatatagcacgctttcaaaaatatgtcagttcctttgttggagtaaaaggttttcttcatttctaattgactgttttaaaaatacaatgattattactcttgttactctgatgtatgattcattaattttatttaagctccccatgtatttcaatagaactttgacaatttttaaaaaggacataaaaagttcgttggtggaaattttcttgtcagctctcttcgtttcaccatgagcaaataaaaatagttaacatacccagagaacactgaaaattaaaaaaaaaaaaaaaaaaaaagaagaagaagaatagttaacattccctgagcacttactttgagccagtccctcttctgactgaattccgcatcacaaaaacccagttaggaacatgtccttgccattattgtgcccattttacagatgagaaaactggatcattgaggccattgttaagtgaaataagccaggcacagaaagacaaacttcgcatgctctcgcttatttgtgggagctaaaaattaaaacaatcgaacctcatagagatagaaggtagaatgatggttaccagagttgggaagggtggtgggggcagtgggaagtgatgacagttaatgggtacaaaaaatataattagatagaatgaataggatctagcttttgacagcacagcagagtgactacagtcaacaataatttattgaacatgtaaaaataactaaaagagtataattggaatgtttgtgacacaaagaagtgataaatgtttgaggtgatggatattccatttaccttgatatgattattatgcattgcatgcctgtatcaaaatatctcatgtgctctgtatatatacacctacaatatacctacaaaaattaaaaattaaaaaaggagaggaatatgtaccaaatttgacaaactatccccttataaggagccatcagcacatgcagaccctcccttttaaatttatatggaatttattctcctatggcagaatcgtctcatatttcaggtcagataaacagtgtgtattaggcagagcccagaacacccaacagatagaaaaagctgcaaactccttctggccttccgagaagatgcttttacatctagaagcagatgatttcattattgctactttactgtgaacctcaaaattgctgacggttaaataattcagccctctgggaaaatccagcccccagttttaagtctctaacccttatgccaatttgataagcagtagagagagacataacatgactctttaggttgttctaaatttaccagctccgaaatatttaatgcagaagaagtgcatggtcagttccacatattctggcacttaaccagcttagtgaggcaggcttaaagaggaggatactaaaaaaggcatttggctgagctataatgggcatccagcttaagggacagaatctgtagttagctaactttggaaattctgtgttccttctggataaagctgtgatcattctcttcttcctctagattcttcttaatgacgggggttcaacaggtcaaataaactaaaattctgcaaactctccatatttgttatataagcctggtgtgttgattctggacggtagtcacaccctctacccagctaactgtgttacatgctgaatagatgatgcataggcagaccttgaccatacttgatcagatgccatacaacacagattttcctgaagccaatcataaacggggggtgaagcgtgtgaaaaggctgcatttgcaggactgcttctcccactctccagatatactttggcttatgattgttggttcttatagtgctgggaagcacccaaaccagggtaggagggagggatcatgaatatggaaaagatatattgccttatacggctgttgcctaagttagtgtgttgaacgctggcttgagacattgcatgtctgttcttaagatgccagcaagcatcatgaagtcaacaattcctaatatcttgcaagtaagcttgttcttctttcattattacactactctgaaatctcaggaaagacacagttaccgtgttaggggcaagctgctgggagccaagaacccgtaaaatagttgttatggcctcatatgttgcaacattcttaatttgttttgagtgcaaagtgttgtcttctgaaacagattaaaaacactcagaaggtcataactgtattttataccccttttaatatttttctcaaaatatcaggcacaaacctaggcaaaacatctgtgttcactgcacttgctcacttgacttggttcaaacagacgtagaactttgtcagaccatgtcagctaaaatataatttgatttgtacctgagcataagcacaactaatattcagcctgatgcatggctgtgcctgctgtttacagttggcatctgttctgactggtctgtgctaggacaggtgtgaaatattttaaatacatccatgatcattagtatttgcttccaatttattgtgacaattggtgccactatcatatataacttttcagtctttgaacattcaatttccagagttactaaggatcacagaatcacagaatctcagaattagaaagaatgctcacattcatctatttccacccgctgctgggtacagaaatctcctcttcagattctttcactcattggtcagtcagaatccaagcaaaagaagctgagagcttactgaatgtgaatcaaatttcccttttattgtacattgtctgcaattataaaaaggaagccattagaagtgtacactgagctccaagaaaatatgaacagtgatgatgtatatccagggaggaaattgtgtgttctctccagtcttgttatattggtccacagatcaaagggaagattcacataaaatctggccactgtttatctcccgttgttaacaccttattccaaaccacaattatctcatccggattattgcaattgctttctgcctggtctctttgctacatccattaccttgttcagtttattcaacatggaaaccagagtgatcctgttaaaatgtcagatcaggtcactcctttattcaaaagcctcaatgactttccatctctgtaagaattaaagccaatgtccatattagaacctgcaaggccctgcaagatctggcttccccatttcttctttgactatctcttactcctaataccctggctatttctcgaatataccaggtgtgtggtcatgtctcaaaacctctgctcttgctgtgccctcagcctggagaacgttgtcacccaaatattccttcacctcattccattgtttgctcaaatgacaccttctcagcagggcctaagctagcctccttatataaaaattgcagcctcatttatactccctataaccgtttctgttttactttcctctttagcccttatcatgatctttattttccccaattacattttaacttctgtaagggcaagaacttctgtctgttttgtccactagcataatctcaaagcctacaatagtgttcattacatattaatcacttaataatcagctatagaagaaagaaaagaagaaaagatggagggccagctccattgcaatgccatacgtggaagctacatacctagaagctctgctttctgctttgcttgtagaatttaaaactctttaagcctctgggaagatcagagtatccttgaaaagcatgtatggctacttattggaattatttctagcttttaaagcctacatacacagtggtcagaaaaggaggctgttatcagggattgtctttttaattttgattttagatcttactttgatactgtttgcattagcatgttttacgggtgtgttcattcattcaacaaatatctattgagaatctattatctacaaggtccttgcattagccttaaggatatctgaagctgtattgaatgtattctgtaaaatacataaagaaaaagtgcaccgtcaggcaatggttctgaacacagcttcataatagaattgcccaagaaactcaaaaccaaaccactgcctgggacctggtttcagaaagaagaacagaggaattcttaagtacttcccacgtaactgtcatattcactccaggttttactcctgctgtcatattaaaaggatgtatactgaaggagcaacagatataagtgctagaggagtacgagaaagagtaatgctgtctagtcagagctatgttcctcaaactatgttccaaaggacagtagtcatctgtgaaaggttaatagctattttaggtgagtaaatagccccacgttcaaataaatttgggaaattattcattctccatttcatggagattcagtgttttagggaatctctctgcactcaagtgagttgagggagatgaggcagacattctacggagagtcattgatgagttcaaccctgttaaacaggcctgcagaggctctgggattataatactacttgggcttcatgccaccacatgactctctatatacccatttatcttagccatgtagaattgcaaccaaggccagttcttggccacgaaaacaaaccagtcacagtagtagagaaatggctctatttttaaaggtttatagtgactggatgaagtatcctctgctttccttctatgaccctggactttgggtgctcctatctacctggattttttttatattttctccacatttttgcacttcttaattgactaggtttgtatatcatttcctttgttagccttttgaaagtaaatgaatcacttggaagacagagaaacgaagttttgctttattatgccgaactgggatctataacacacatctgaatttcataactgtgtttggcttacatggttgacttcatattcaattgatgatattcatcttaattaagaataaatagacaaatggctactaaaagggaggctgattaaatacattatgataaacctagatggtgaaatactttgcagaatgggaaatgtcacgggaaaatggtcaccataaagtaagaaaaaaatgtgagggtggaggatacaaagctacttctgatataaaaatgacctacaaattatagctatgaaataacattattagggctatatattttcatattctgcttatttcataccaactcttctaagctgaacatgtattaatttcaaaacataaaaaatagggacatttaagccaataacttgtggtgttttaatggaaaccaaataaatagaaatcagttttcctttataccccctgttccaagaaacatgctccttgcccaaatttttctttgagatttaaattggcataactcttctgagttgaatgtttccacaattttaaggcaaaaacaaattaatgctgataaaaatactttggaaccacaaactgtgggatagacaaataatcctgaaaacacacgctggtgacctttccctgctcatttttcttggtgggaagatctgtaggcactacttcttatttaccattttttttctgatctgttttttgttttgttttattttgttttacttcaaagcaaaaagtcttgctgaccagtggaaagcttgttgaagtcaattattccttgaagactttttgtacaattcatttgatgaaaattatctctgaaaagagattagtaactttattgtataatttctcccttattgattgcctccaaaccctttctcattttatttatgagcatttttataggaattgcttttatgatagaggaaattgtaacagacaaccccctcacaggtataccacagatatcttgctctgttttattttctggaacagtacgatgagaaagtgtttgctataaaaatatgacactaaagactgaaagcaaaacaatataggacttacttcatttacctttatctgaatagattattatatctaggttcggagaacatgtaataaataaatcgtccaataaaggactcttctgtggaacaaatgctatttgacctgtagaccttcaacacaattttccagatattttataaaaatttacaaatatttaccaagagtcttggcatgttcaaagaaaaaaataggtatgatcaattttcccagttaagagaagtcaaaggtgaatgatcctaggtacaccaagcaaactaccaagacacattcctacttacactcatattattggaaacatccaaaatgaaatctttgattagtaaaattccaaccctgtgtacaggctcaaaaatgcaaactttttttttcagtaattatgcataagatcctaaaacatcacttataaatttacaattgcaataaggccattacacaaaggaatgtaaattaattcatttatcagtggtaagaatgatcaaccttggaatgatggatgggtttcttattgaatcaaagtcataagagcatgctctcccctggcatcctagcatttcttgtccttccccattgcttcccactgaagacattgttattcatctctcctgaacatatacttgctccaggagtatgaggggtgaaaacgtgtgttcaatgtagcactctgtatatccctaccacagatcattttatttctaaatttttatttcctttttttttcctttaattgcatttacaaattttttcctaagggtcaacattttctatagttaaagctaatttttttcttttaaatcctccttttttcaaacaatctgctacaaagatcctttgctcatctgcccttgtatttctacatctagacgaaagtgaagagaataaaattagagttttagtattcagaatgcttttaattgggacaagaaggaagaaacctatatcctgccatggattttttaacttctaaaaaacttcagtggtagtttgaaaaggacttgagccatttcaagaaaaaaagaaactatttcattcaagttaatttatctagctttttctgtattattctttaaatttgcttattaccttagatacatgaacagagaatagtgtgttttctttgtattgctacaaatggtagaatttagattttttaaaactctaatccgtttttttctcagtcgtaggagactacattttaaaaggaaacatttctgaaggtgttatttagtattctttatgctgtaataaggcaaaggaagaacagagagacagagtttcaggtaactggcctttgaaaagtgagagagagaaaggttttctgtgagttcctggactttcctggttaagaaaaaaatcccatctaccgcaatctctagacagaggagcacttccagccttctaagtacttcaaccttcagaatggcctttacatactgtttttgttttatttgtttacaggggtttttttctccattatatcactctctaagaattttgatgaaaataaaatcatcttgaccagatctatttaatactccagaagtcacaaggaagagattctctacactgtccagatatctactgtgtactcttcatgtgtcaagagatctatgggggactgagatgcagagcccctgggacagccgccatcttttgccttcacggagtttacagtattgattttgtgtgtctttccttttatgacaggaagaaaataatataaaccttttaaaaaaattttaaagagattatacaatctcagtgttatgccaagataaacaactaattacacactttaaatgtgtgtgtttttttattctattagaagatgaaaagattcgaaattctcccttctctataattatagaattaagatttctcattataaaatcacattttagagtgtttagaattacttaatagctaagatcttgaatcatctactaacaaatgattttccttttctttccttgagaatatgtaactccaattctccatttcctcaccccttaccagccccgccagaccccatacacactatccactccacccaagtggcattttaattaatggacaaactaaaccacctacacatttaaaacatatgtatgacatgtccataatttttaactcactgattccaattcacagaatccattataaggaaataatcacagaagtgctcaaaatatatatacaagaatatgcattccagtgaaagcaataaaatgttaaaagaaatctaaatgtttggcaagaagataatggtaaaataaacaaagcatggcatattcttgtgctgctttgttatgcaagaattaaagacaaagaatatttaacaagatggaaatttatgccaggtgataaaagcagaatatgacattgcatagagtcaataaccatactcatgtatatgtttatatatttcattgattaaaaatgaaaaaagtacatcaaaatatcacatttatctacaagtaatgggattatggatgattttaatttctttgtaaatataatcaattatagcattaaaaattctacaataattattagttttatgcttacaaaatttttttcttaaaatctaacacatataacctcaaatgtaatataccaacaactaatatattttatagatacttacatgtaataaattccaatagagcaaattttactgaaaaaattatcttaagttgtatttattggaatcattggcaaagaaaagaaagtgtgccacattgtcacagcctcagagaagtttcaaaatcacttatggtttatttaacttatttttatttgtttaactaaaacaaataaacgtagtatgtctctaaagtcttacgatctacaatctgagaaatggaataccatcagtgaagcctatgaatctaagttagtttattgtttatttaggtatatacctcatcaacttataaaagcctcagccatcacaacatttcttacatcagatttattatgattcctaagcctattgtttttaacatccaataatttgagtagccctggacacacagagcctttgaggcatagactctcagaattttgttgtttgaagagttctcagcataagtgctgagaaactaaaatctagaatataaataaactggtgaaaaaaagtaatatgggcagtgatattttgagaagagaagatgagtagctcatctgtttgatgcatgagaggtagtaaagtaagagagttcttttccagcttggttgcatgtggaaatcttctacggcattatgtacaccctcatgtatatgagaatgtcctgtgttgttattctctgccttctgctatctcctgcttgtgatcatcaatttattttgtgatcaacttgtatcatccactctttagagagttaagctatattctggacaaataactgaaaaatcaaacatgagaaaaatgtgagagatgtcagaatgtgcagtgcagaaatgagaaagtttgggggacacaggcataaaaatgaccttcaaatacctaaagaacagatacatggaagagaggttaaaagtatattttttcatggcttcggaagacaaaaattagaaaatgaagaagtttttggaaggtatgtcagtacaatagaaatgaatacgggctggtccagttaaatccagaaggaattcaggcttatttgcatgtgtgtgatgtatgtgggtccacaagggtcttggcaccaactgatttctaggtaagcttttaaatttcagacttaaggagaataggctagggatatattaagaacctaaagagaagtttgaaaaagtcattggaaaaaacataatggtgtagatagcatttccaggatccctcagaaggaaagtgggggaggtgggaggttggaggatcaagttttatgaaaagctccacggagagagtggggttcaggacatggctgcctaggacactacaaagtgataaagggggtcataaaattggagaagtcattctcccactttctgtgcagaaccttctccaacttgaccattctggtttggaaatcagccagaagcacctctttcagtcttgaaattggtgttataagaatgggcaaagccacaggcatcataaggcactatttagacagaccaatccctctcaaacttacataagaatacaaccaacctgaggctcttattaaaatgctgatccaattcagtgggtctgaggtgggacccaagattccacctttcaaatgagctatcacgtaattttgatagtgctagtccaacaaccaccaggtagaagagttttagtagagattattgagatgagaagaaattgacaaggaaaatgctaagtaggagaggaaaaactgggtagatgctgaacagggtccgaaacccacatggtagtttatgaatactctggaaataccctccacacacaatccagacatacccagaaacgctgggagtactccagctatcctaggtattttaagaacatatatataggaaaggaaaataaatttgggttattgatataaatatgactccatctgtatacccaggatggcaaagaagaattgaggttgactaacaaaggaatgcgttaacttggaagataataaatcgcttggaatggaagtattcaagatgaacataagcaacccttacaggaatggtagagggcttgttgaagtgacagccaaggtcctttcttattgtacgtttttctgattttataatggaatcactaaggtgaaaaagagtacattcttttataaagagatatcatggggaactaaaaaaaaaaaaaaaaaattctgaagtccgctaagttaaccagagaatgctactgctgatagaattgcattccaaactggtacaggtctctaagctcaatgtgtatcccatgacctcagactcaagtccatcaagttctggcagattagtgccatttgatgtaaggcaagataataaatagattgatttttaaaaattatcacttctaggtgaaaagaaggaaggaaggaagggaggagacttacagtatgatagacaagatgagaagagttagttaatgtattaaaatggcagcatatcaataataaatttgaccgatttctcctcagaattaaagctaaaaatattctctctaaaactctggctcagaaatggactgcttcaaaattttaatttcagtctcatttgaagctgctaagtcttccagaacagattcacagatgaaaaagaaaggtaataacgctgttcaattacaaatgtggcttctgccttcatagatcaaagttcgactatcttataatactaaaaaaaaaacagtaagaggatttgctctttgggtgagaacagttccaagaatccgccttaaattagcaaacgttcaccaatccctactaagtgagaaacacttgctagggactgggaatgcacagacaagacctggcttacagtcggatagaggttccagccagccaattaaaaaatcatataacatgttaaccacttaaaataagcctataaaaaatatatatatgtcaatatataatatatatgtaatatatacaagggattggtaaatgtttgctaattaaattagctaattaaaggctaatttaattggtaaacatttgctaatttacatatacatattttttagtagtcctgttttaagtggttagcatgttattagattttttaattggctgcctgtaacctctatcaggcaaatgagatgagatgaaagagaaatttattcctccttcctcccctgatgggtgggaatctgaaagagatgttacagaacaggtgatgtttgagctgggcctcaaagaaggagcaagcatttccaggcacagaaaacaaaagcatatatgaaaagcaaagggaagtgaaaagtgtgggcaggaactgggaaaggtgattagactagtgcgtatagcaggaaggtgcaggacaaggctgaagaagtacatctgggccttgactggcgttcccatcagtcgctctagccaagcttcccccgagcacctcctgctgacatctttgaaacatttggtatcatagccatggcctttactgacctcagaacttttattggcaagtttgggctggcactaatttgaggactgttacctctgcatcttgctcaggtatgagattttagaatccaagtagtaaacccaattctgacactctctatgggaagttctttgattttgcttgtttgattttcctataatgtgcgaaattggagatacattgctctattccaaacgtatttggccataaattcttaacatcttgaaaaaataattaggaatacttgttagacctatgttttcttttgtcatatcttcaatcaggaaaccatctcctgctgggcgaattttcagctggagcagaagaatggattttagcaatggagtttaatcagttcccaaaccaacaagttgacagcttctccttaacccttggggacaggtagctgagatgggttgagaggacaaaaatacttattgagaaacctattgattgtttcagaccgggataccctgtggtcatttgtgctcagtgggcgagaagagcttactggaactcttattcaaatcccccacaacacaggttcactcccattggcatccacttcctgtcaacactccatttttgccgacctcactctcatcctcctcatcgagggggacgtgaaaatacattctggccctgaattcacaaaaaaaattcgtgattcagtttaacaagatcaattacacacacacgcgcgcgcgcgcgcacgcacacacacacacacactcaaacctgaaaaatatttcaaggtttcaatagactaaaaaagagcccacattcttcttccttttataagcactccttacagtaatcggagagtttgccaaaaaggcttccagggcccatatttcatctaccccagtggctgtaacatactagagaaaatctgcatccttccctgctgagaattatttgcttggagtgtgctctgcataaaaactatacggtaggaaaaatgccaccctgtctaagctagccagcatgccaccaacctgctgcccaagcttcttgcctggcaagctgctgatcaagagtccatattatttagcttttacgttctgaaacctaatgtgctgtgtcctccctgagtatatcattcactagactcactcttattttctttatgaggtctatttggtttcagaattgtccagatatattcttaagatcaaaatgtctgaactgtcatgtacccagctgtgagccccccaacatcaatgcagtgagctctggattcatttttgaggcaagttgaaagagctgggatatctacttccctaccaaagcctatcatggcagctcacaaaggagacctgggctcgagctcagtaagcttaggttctaggtctacgtatataccagtatgagctccaggtcataagcctccatctgtaaagttggagaattaactcccagcatcatctgactctaacatactacttatatatttttagtcaggtaaattaagggaatataattctatatgacttgaaaatttcaaacatctcctcccctcaaccttacattctcttcaagcaatccattgttgactttaaatccattaaaaaccattgtttttgttttcacccacccccaaaatgatatgtgcgcttttccctcacctttcctgcctgcatttagctggttaattttcataaataaatttccttcctcaaaaattttatagagaaatgtacttcctcaatgaaattcttttttcttgtataatttattttctgtccagaattttttcccataggtagcaggttgggtaaaagttactgtgtgaaattaattgtcaccttttgtaaaactaagtttctgtgtagttcagctatgcagtaatgcataccagaaaaagcatgggctttgaagcccgacaagagccatttggaattgaagttctgccactgtgatcttagagaaaatatggagtccctcactttcctcatagcatattgggaataatagcacccactctgcagggctattttagagtagagataatatagacgactcgtggagcatagtgcctgtcaaaaagtagatattcttattgatgagaaaattgtgtcttttgtttagggaagtagcagggttaaattaagttttcagcaatatcttaggcaagatacaaatacaaaaaaaaaaaaaaaaaaaaggaacatacacttgcacacatcctcctgcctccagccctaagaactgttgctctcagaaccagaaggggcctcaagaaatctggaaagcttggcaagacgcttggtactgtgctccaatgccactagtggaaatgatacaacgcaagttctttgggggcaataagggaaattggtacatatcttctatcccaaatatttaccctgtgacgagaagtcaaataatgccagatgtatatgaagaaagttgcagccatccaggattgagaactcagatctttccagttgttggtgagtagcccactgaggaaaaggcctcttttccaatttctttacaaatgcaagccaagtactaaattttgctgttgtcaaatggcatgggcacaaataaatacgcacagcatggcttctctgtgccaactggtatgtagatgtaatcatttccacagcatgccctccctcagcccaagggtatcaagcaaaatgtagcaactgagagacaggaaggctatggagcagtccaaagggaaagaaagagacatgcgggaacagagtcatccaggagtgctcctttcaacctcacatggagccattctagagttatcatcgaaccgatgagacagtaggtaagtcattggtagaatgccctgagcagaaaccactaaactaggagtccaatccttggatcagatatttccaatcctcacagtaccctaagacacccaagacatacaacattctctcatggaaacagtgactaggaaaaggaggggtcagggaccaccagtcagtgggagtcactgtggagttcaaggcaggtccccacataattcaagtttaccccagtcttggttccaatctttactaactaggagaacttaggcaaatcacttaactgttctgaagcttagtttacataattgtaaactagacaaagtattctcataccgttttgaacattaaatatgatcatggaaaagcacagatgcatttcataaactgtgaaacaccttgtacccacaaataaacagatttctcacttttcttcatcaggtgaggacccaaatgcacacacacttacacacagacacagacacacacacgtggctaaagaaatcaaggttttgttgttttcttagggtggccttcctggacaaccaaggagagcaagtcagtggcgtcttctctcctagatccagggaccacagaacaatctttctggattatgacatttgcagcaagcacttaatatattagaaataaaaccaatttctatatcaaacctggcatatctcccttcctttcccctctgtttacgttgggataatcaaagtgtcactcattattcaattaaatcaaataaacatcaaccatgtaacagctataagccaggtcccctgctagaggttatggtagataaagatagaaataacatggtctttgtcctctgtttgttcatgttcatgttcatgttgacatgaaagcaactaataacaaggcaaaagtgaagtcagtaccaaatggactacaagagcacagaggggggtatcatcttttttctgatgagacaacagaaagtaaaaatttaagcaagccaaatatgctttttgtgaacagctctggatgggatttctgatcaggggattacaatgtttgctaaaattacacgttttgatgcttggtatctgaatgccagtgtaaactgctactaatacagatttggggggtgatgcctcaaggtcaactgaatttcttcataatcctgtaaatataatgccctaaaaattgcgattgctcttttgttttgtacatagtccctggtgtttactttgtttgtattctgttttttatccagatgtattggttttgttttgcagaaagagcaaggctctatgaatgaaggaaaccagacttccattagtttctttcatacgtttgcctacagtagaatgctgtcctccttaggtgtaaagaacataaacgagtcactgcagtgcagattcagcagaaggaggagaggctgtaagaaaatcagccagagaccaaggaagtccaataacttcaccaacttcacctctctctcggctattattccctgttggattttttcatggtgcatcagagctgagcccttctttgacagccccttacaggagcctcagaagtaatcatgactagttgccaaaactgcatgtttcaaaaagtaattagtttatggagcctccaaaaacatgctcgactgtataatcaattttaagactaggttatcacaggatgtgacagaaggttaattaaatgtgaaaacacaccatatcttgaactagattgagatgacatgacattatgaggctccgtggtttaagttccttttttccatattttctttagagttggtaatagcaaaaattagtgaaatttgctaatactttccatagaaatatacatagggcatacaacccagtagcaaatgcggaacaatctcttagataaaaaaaaaaatcccacatgaaactgaatgaaaaactaataaaatccctattaaaataaggctggtatgtgcagaaaggcagttaggcctgtttctatttatatcaacataggaaaaacataatttagatgaatatctaaatattaatttacaattgtcatgcacatacctatattttgtgaatgtattttgaaaatccttccaataccagcgaatgctacagataaactagacaagaagaagatgaagaggaggagcagagagaagaggaggaaggagaagggggaaagtgattcacttatttaggtgttcatttatattttttctcatgtgaataatacaagtagaggtaataaactgacttcaatgctgcaaagctttattcttctctttaaactttaaaaaatcatttttcatcagtattataaaataattatatagcatcttccttgttaaaggactatattaggaaaaaattagcttcgtagcaaggagaaagttgcttttaaacatttccatttactatatattatgtgtgtatacaatgattgtaaaattaatttatttttgtgattaggtagcataatcacatagtttaaaaaccgaaagtgtaagagaccatacattttaaaagtctctatcccctatttgtgatccatcagtacccttccatagagcagccattttgtcatgttttactgcattcttccagagatactttatgaaaacattaataagaagcaaatagggtacagactactgtcatagtcctgtacctttgctctgtctacttaacaagcttgggaaatagtccatatagcacattaaaagctttgttatgtttcaaatatataggatttcattttatagatgtgccatcatttagttagtacttaggttgtgtctaatcttttgcttttatagatgattctatgatgtattactttacataatcatctttcacatgtcccaggatatctgaggtaaatttctggaagtagaattgctggatcaaaatatgtatatctgtaattttgacagatgttgccaaattgtccttgataaatattataccaattctcatacttgtattatgagtacctgttccccttgcaactgagtcaatagagtgtgttataaaattttctcatctttgaaaatttgtggatttaaaaatggtatattgatgtttaatttttagtttgcttttttcttattaagactgagattgagcatatttccatatgtttaatagccacttgaatgttttctgttttgaaattatttttctatattaaaaatttaaaaatgagaacctaataagttcaggctgttactgccttttaaaaattaaacaagaaacattagtgtcaaacactaatgcttttcagaaagcaatacagattctaggttttttcttaaaaactgagcaaatacataaaggaaaaatctctattttcagaaaataaactttttttaaaaagtcatattttttcaagtactttgttactaggtgtctagattatcccaaagggtatttaggtaataaaatattgaaaagaaaaacacaaaatacattcaaaaggaaaagggcatgaacaaatacaaatggaaacaaataatgggcaaaacagttattagatgtcatgtttctaaactttaaaaacctaataccatgaactgcaatttttcccaagatcccaaggttaggattaaagggttaaaagtaaattgatagctagcttgttgggtaaaattagataaatagatgatattagaaagatgagacagtccctgttgacccacattctgtagcttcttatttcctcagattgctctttgctctgacagtgctgcaatgcataaagtctacaaaattttctcacggctgctataatgactgccatttttaacacaaattaaatgctcaccaagaataagtaaatgattaaatgcttcataacctgacccagtaagtggttggaggtttcaatgccaatcaccaatgtatcatctcaatcttttgaaataattagcatatgttatttatttcatggtctcatcagtgattaattttccaggcagtcaattaattatctactaccaaaattaacagtaaatatttttcaacgcttttttttctgctcttcaggatcaaatcatattccttaagtatacaccctatatttgggcatagttaaaattaaaaattaaatactccattcaaagactctgtcactatccaagagaatctataaggaaaatttcagctgggtagacatttgcatgtctttttctctcagaaatggactaactgtaggcattttggatataaattaaatatcgacaggaattagtcatcattagagtaagaaggaataagttaaacgctacatatacatgccaatttgtttgtttgttgtttgtttatttagagaatgggccttgctctgtcacccaggctgaagtgcagtggtgctatcatagctccctgcagcctccaactcctgggctcaaacggtcctcccacctcagcctcctcagtagctaggtgtgctccaccatgtccagttaatttttaaacaaattttggtagaggtggtgtctcactgcattgcccaggctgatgtcgaactcctggcctcaagcaatcctctcacctcagcctccctaagtgctggggttacaggcatgagcactatgcctggcctatactaattatttttaaacaaaaagtatcacatgctcatgctcactgttaaagatttttaaaatacagaagagtgtaaatatgagacgtattactactaaccaaatacaactgctatttattatcagcttaaaaatctacatgctaggatatgcttggaagagctataatcatttaattaaaaaagaaaatgaacgattcctattgtattcctttgcacagataacaagtccatagagaggtttagcaattcacccaatatcacatagctagtagcataggagtcagatatctattttgatatatagtttgtaatataataaataaaattttatcttatattttgtacttaacattgtctcaggggcatttctccaattaacaaatatagttggaaaatataattttaataaaacatataaaatactatattttattatgtaggttatttttagttttattgctatcataatacactataccgaatactataattaaacacttatatgtaaattttattcatttttctgattattttcctaggacaatttcacaggtgtgaaattatcatgccaaaggattaaatatatcaaattattgttaaaagtacagcaatttctactcccatcagtacagtatagaagtatctattttcctctgtccttgacaacaacagaagcatacaaatatccttttgaggcacaagaaaaatactaacagttttctaacttgcttattagtagggatatcatttatttgaaatttttacaagataattgcagattcacatgcaactgtaagaaataatgtagagagaacccgtgtatactttacgtagtttcccccaatggtaatattttgcaaaactattacagtcttactaccaagatattaacatttatataattcacagacctcagtttgacttgtactctgtgtgtgtgcatgtgtgtgtgtgtgtgtgtgtgtgtgtttagttatatacaattttatcatatgtagaggttcatgtggaggccaccacaatcaaaatgagttttgtcacaggtatcttttatgttgcccttttataaacatactctcctttccttttcccaccctaccaactgatctctaacctctggaaaccactaatctgttttccacttctaaaattttgtcatttaaaaaacattacatgaacgtgattatacagtaaataacctttggtgactggcttttttcactcagtataattccctggagattcatccatgttgttagatatcaatagtttgtttctttttattgttgagtagtatttcatggtatgaatgtaacacagtttgttaaaccattctcctgttttaggatatttaggctgtttctacttcagagctattttagataaagctgctatgaacaatcatatacaggttcttgtgggaatacacttttgtttttctggaataaaactcaagagcataacataaataaaaactgccaaattgttttttccagagaggctatacaatttttcattccaaccaaaggaatacacacacacacacacacacacacacacacacacacacacacacagacatatatgtatatatatattagtgtgtgtgtgtatatatatatatactatttttcattccaaccaaagtttcatatatatacataaatatacaaagtaaattcggggcagcaaatagatggaggacactgtgagcctgtgatttcattatagatttaatgtatatatagcaaatatatacattaaaaaagtatatatacatttatgtatatatacacataaatatatacataaatacatatatacacatatatacataaatatatactttttactataaaagttgacgcaaaagtaattgtggtttttaccattactttctacatagatattaatatatatacacacacacacatacacaatcctatcggttccgtttctctggagaaccctgactaatataggtatggagaatattcttattatttttattggccactgaatgcagagctaagaaccagaggctgagactgtttttgccaccaatttactgtgtgatcttgagcaaaccatttcctctctctggaacatggtttctgtaaactacaaagtttctaataatgtttaattttaactttatatgaatataagataaaacagactatcatgactgactatgaggtttagaatctaggaagaatctgtaaattatttatcttctgaaagacaaagaattaatttgcttaatgagtaggaaatgctatttttggagaacaaggtaacatgtgggccctagagcatatcatgttctccaaaagtaacccactgaacacagcaagttgatttacttcatctgagacaaactccagaaagtttttcccttgtcctgcattactgcagaaatcacctaatcaccaccatgactgatcctatatttatttatgaaaactttttctctaaagagtttaaaatgttggggagatattactagttaggcttcagaaaagcctcataaaatagaaaaaggaaaccagcgatctcaagaatgcaaacttctgcatctgcaaaaatgggctcagaagtcagatgaaaacagattctagattggacttttgattgtttgtgctgctggggctgagtaagcaataaaaactaacttccctgcattatttggctcccagacttcaagtgactgctggaaagagtgtgccaataaacttctttattggatctttgagcatcatcccaattcatgaatacaaaaaagtacaaaggcaaatgatgataagagaaaatactacaaacagaatgttgcagagacttcacggtctctaaggtagtctcatctccattcctacctcagaaccacgtggagtgcctgttcaaagcacagatttctgggatctgtccgcgactatttcaagcacaatctgcgaggatataacacaagaacacgtatttttaacacgctccctaggtaatccttattagcaacttagtgccagcctgagatagtctggatgagctccggcccaaatcgcatgttgaactggaatccccggtatcagaagtggggcccagtgggaggtgattggatcatggggtggatttcttatgaatggtttcacaccatccccttggtgctgtcctcgtgatagtgagtgagtgctcaagaaatctgcttatttaaaagtgtggggtacctccctgcccgcctctcttgctcctgctctggccatgtgatgcgcctggtccctctttggcttctgccatcattgtaagtttcctggggcctccccagaagccaagcagatgccaacatcgtgcttcctgtacagcctgcaaaaccatgagccaattaaatctcttttctttataaattaccaagtctcaggtatttctttatagcaatgcgagaacagcctaacacacagcccatggcctgctatttgggaattattaatatagagaaatgctttcattttatagatacggaaatcagggctaaaaaaaaaaaattacccagggtcatgcccctgatacctaacaaaggctgaactagaactcttccacgcttcctgtgctcttaacgctgtgtgacacattgttgctataaaaaaattcaatttttttttttttttttagatggagtcttgctctgtcgcccaggctggagtgcagtggcgcgatctcggctcactgcaagctctgtctcccaggttcaccccattctcctgcctcagcctcccgagtagctgggactacaggcgcccgccaccacgcccggctaattttttttttttgtatttttagtagagacggggtttcaccatgttagccaggatggcctcaatctcctgacctcgagatctgcccgcctcgacctcccaaagtgctgggattacaggcatgagccaccgcgcccggcccacttttttttttcttagaaaaactatattatggcctagtctggttccaaacttcttcactcttcttccccccaacagctgaggctaaagctatgtttcacatctgcaggcacttccaattctggctttccccccaaattttgcctcataacacaatttactaaactgtctccggttccatattctggagttcaaacgtatcaagtccttgccagcagcttattccttatctctttctccagttcctgagccattgccactttttttgcctttgttcttatgagaaggatctttttttgctaacctgcttcagagttcagtgtcctccatctatttgctggcccgaatttgcttttcacttcccctttcatagagaagagtcctattcctaaacttcaggctagacactaggtcctacgactctgatgccagtgtctggatatttgagactaactgtgtcctcacactcctctagcatccatcacgacatctagcccaactactggaacgtaatgtcacttcatccagtatagcactcctggcttcccacagcaactgtttaactataactgaaaatcttgctaacatcatttgttcaccacattgagccctcatttgcagccacacctggataattttcctaactccttgtaccacaccagtgggcaagtttagcacctggatgttttggtctacataattcctccacattcttgctgaaagtaagtggccttgtctatttaaagtggagctctaaaaaatggcatgccacttcacacactgtgatttaacttcctctctccattactagacatgacacattgaaggcaggtggcataccccattatagttatcattgtatttctgcatataaggcagtggaatggaaactggaaggctaaagacagagcaaatgggttttgcaatatgtgatatactataaacctagaaaaattatttggccatttaaagcatggtcaggaatagtttgtgggtgctgcctggggtcttcacatgctagtgggggaagctcatcaatgagtagagccctaaactcctgggagtccagctccagcagcaatatctactccttttacatattagtaaatcactgaactgctccatttcagcttccatgttacaaaagaacccaactcatagttctctcaggagagcaacgcaaacaaattagccaacagttgccaaatcatctaaaaatgaactgagctaaatagctttacacatgcattttctcctggaattccatattacacttacgatgtggtacatggagctccttccccccatctaatccaaggcaaatgagaagtgtgactttcctaagagagggtgagtagtaattgaaaaccagagcatggaattcaacacccactgaaatttttattttaacttgatatacatattttacttattaaaccatagcatagcaattttgcttatctgtagagaaaaagaaatgattttgactaaaaaaaaccactgccagaaagtaaaaatgcattaatcatctcattttaaccactgcactcactttttcccccagtaagtaaagacttacaaaattttgttgacatcaagcttcaaatgccaagcaggtaaaatgacaactaaatattgctaattctactgtgagagagcaggcataatgtgcttaatgctttggttgatgcacagttaatgctcagtaatggttagatatatttcccaacactagaaaatggagttttaaattcgcagatatttgtagagcactttaaatgtgataaatgtattcttaatttgattctggttcattaattcttatcgaaactctcagaggtaaaaatcatcatccccattttacaatgaagtaaataaaggtttgaaggtgtatttgtttcctagggtcatcataacaaagtagcacaaaggggcaccttaaaacaacagaaatgcattttctcatggttatagaagccagaactctgaaatcaacgtgctgcaggggtggttccttctagaagctctgggggggaatctattccatgcctctctcctagcttccggtggttgcaggcaatacttggtgttcttggctcatcgatgcatcaattcagcctctgctttcatccccactttggcatttttctctgtgtgccctctcctttttgctttgttttgttttgttgtgttgtgtttgtttgttgaggcagagtctcgccctgttgcccaggctggagtgcagaggcatgatctcggctcactgcaacttccacctcccaggttcaagcagttctcttgcctcagcctcccgagtagctgggattacaggtgcacatgaccatgcccagctagtttttgtatttttagtagagacaaggtttcatcatgttggtcaggctggttttgaattcctgacctcaagtgatccgcctgcctctgcctcccaaagtgttgggattacaggtgtgagccctcgcgcccggcctctcctcgtcttatcaatcattggatttgggaccccctttaagctaatatggcttcatcttaattcaggatcctatttccaaataagatcgcatccttaggttcttggcggacattaatttgggaaaacacgattcatcactacggaagagttaaaagattcccccaaatcacacaagtaataggatgtggagccaagaccacaacaaaagtatattcaacccttatccaattcactccatttttctataacattatgctgcccaagtcagagaagttaggatgtgctgctgtagcactggagtcattccgtatcaccctgcaaaagcccccgcttcattcaacttcttttaatttacaataatcagcacaggattaactatctgtgacagtcctatatggaggctcaactcccttcagccaacagctgaaagtttagggtttttgttgctcatgatacccgaactggacacctggccatcattttcagtaacctctctcacatctcaacaacccttcatgcgcctttatgttaaaccaaggtgaattagacaggtgcctgcatctcctccacctttttataactgtatatcgttgttgcttctcctgaaatccctgtctgctcaggtcatatctgcatgctcaaaatccatttaggtctaaattcattcctaaaggcccagtgcagatataaatctgtctcctcaattaccatagcactacctctttgcttcaaaggatacgaaacaaaatgtaattttcatcatactttattcttccttcctttttctttcttttttccttttttctctctttcatctttttcttcctgtatacacatgatgcctacacacgtagattcatatacacatgcgcacatacacgtacgtccagtcagccctcatattcatgggttctacatccatggattcaaccaaatgcagatcgaaaatatccaaaaaataaaattaaaatgtaatacaataagaataaaattaaatttaaaaataatacagtataacaattatctacatagcatttacattgtattagaaattaaaagtaacttagacatgatttaaattatacagggaggatgtgcataggttatatgcaaatactacaccattttacataaaggacttgcgcatccatggattttggtatccacaggatgtcctcatggatactgagggatgactatatatacatatatgcacacacattcacatccacctaattccaaaagaagaaaccgacatctgagagaggaagccccataccttactatctctcaagagtgtatactgcagtatactttgttccaagaaggtgtacaataaatcactaataaatgaataaattactttatatatttaaatgactttatagaaacttaaattacttaaaattaattagctaaattaattaatttatatatttaagaagaaaataactgtgagtgtttaaaaagaataactgattttaggtataagttcacaatagggatgagaataattttttttcttttttgcaacagagtctcactctgtttcccaggctggagtgcagtggcatgatctccactcactgcaacctctgcctcccaggttcaagcgattctcccgcctcagcctcctgagtagctgggattacaggcgcgtgccaccacacacggctgatttttgtatttttactggagacgggtttttgccatgttggccaagctggtctcgaactcctgacctcaagtgatccacccacctcggcctcccaaagtgctggggttacaggcatgagccaccacgcctgacggagaataatttttaaaatactatgatctattactataatcacataataattgtaagacattcttacagttttaaaagatagagctataacatgatttagaatcacttgtcccccgtgttagtgtttagaatgttttaatttttttcaagtacctctttactcataactcttcttgctttaggccaacctgattgtgttttaaaaatcactgaaatccctacatatacacatgtacattttgatgctagaattgatacatatatatggtattgcatatatcacagagaattactgtttaacttaagtacaacctggtaaagctttgttgattttgctacgtcactttacaatacttaataacttgtcattaaaccctgtactataccagcacctaaaagtgcttgaccgtagtaagtttttataatgcttatgacttggcctgacaccgtgtatacattaatccagaaaccagagaaaacaatcagttatttgatatcacttcaaccaatagatggtttaaaatcttgctgtacatttttttctttctgttctttttttacgtgtggggagggagtttattggaagtagaggtccatccttttagtatatgttagtgctatagaggtggtttctcttctgaagttctatggagaagtctggataagatgtagaactgattctcttttaattgatggaatcatataatctcatgatcagaccttaaagatcgtttggtcatcaagtcttaattgatgatgtctgtatcaaagtacacaatatatgttgtctcaagcacctcaaagatagaaatcaggtgtctctctcttcacaaatacaaccaattgacactagctacccgaaacactgcactgaggaagattctgagactgagacagggagctggaggataaatggcatatgtgttcttccaataaatatttatagaatagaaatccttgatgtactgagacctttctgctcaaatacaatcatgtaatgtatagaaactcaccttatatgttatataactaggaagacactagatcaccctagattgtcagttctgaatatttggatactttgatccatagctaccctgttctatgtggtagccactagtcaaatgtttgaaattaaataaaagttgaaatttatttccttggttttatttcaagttccacattttgagggttcaaatgccacatgtggccactatattagacagcccagacagaggacatttccatcgctgcagaaagttctctgaacaaatttcaacaaccactataaactaccaccatttcatcatgttgaaatctgcacaagtcaattcttaacaaatagtttcataaatctcttccaaggtgtcatgctacatctttacttcttttctccttcatgagtcaaggatatgacagtgtctagtcccctgaaaatgggtgtgggtacatgtgtatgtatcagaattggtgcagagtttgaggaagagtcatagctattggctactctgcctgctgaatccttctgtgccatgaggtaacctagccatactggtcagcagaggtgacttcaggggacttctccctgatgactcaggcactcaggagagcaacagcgatgttatcagagaggacaattccaaaatgctatatgtgtatcatactaaattaaaagcagaaatggaaacaaggatacagtcagtgtggccagggtactaagaaaggccatgagaggagaagggcaatggcaatgaagagagtgttaactactgattagggaggtgggagaagggaggtgataggaagccaaagagctatgggcctgcacagaattacctgacaatccaccttagcctgattatcataggctgtcagctcagccaagtgagggatgactgagaacacagctgataaatagatgtttcctttattcttccttttatagcgtctctccctcgctcctatttctttggataaggcaatggaaatcttgcggaatgctgacaatgcttttggctggttttataatgacacttcagtgatgccaagcttctatggccctcttctcaggacgcccagaatagccatgttctgcacctctcctctggccaccgacgtgcaggccgcctggcatttctttcagtgctttcactcatatttcctttcagcttaaattatgaccataagctctaggaggacaaaatttgtatcatatttgtggcccctgacagttattagcatggtgccccaaacatctataggcaatatggcattgacattgcattcaggcactaaagtacatttgcctgggttcaaatttcacctctgccacttaccaaatgtgcctttcagaaggtagacctctctgcattcagcttcattttccttctctgttaaatggaccataggctctgtgctaagagctgtatttttaggaagtcttgtcaaagtttgtggtgtttagcttcttttgagagtaaagattataggacgccagaactggaagggatcttttgagtcacagaatagaattcttttcctaagtaataaaaatcttcagataaaagtgtaaaaggaaacaatatatataagaaaaaataataaatgagggttcttgggcatataagtctttaatatttgttggaaagtacttaactgttggtagaaattttgaagcatctgttctaagccttaaattccaaaaagcacaatttgaaaatcaagtataatcgtccaatttagcaagaaacctgaaatgcagaaagaaaagaaacttgctaagaaggggaaaagctgagtctctaaagaggtggcttgcctccaggccagtgttctttctattcatattataacatgctggctggctttcacattattgcaagtgagccttaaatggcatgacatctaaaaatggtaagccttgccaaagctatgtgtgtgtgtgtttgtgtgtgtctatatatgtgtgtgtatatatgtacatatataaataatagcagagtaacttagggcctgtctcaagtgactcttatctaaactataatgctgaccaacataaaaggtcaattacaactattagtgaattattgaatacaacttattgttcttccttccattagacatagccttagtgacaaaaaaattataaacaaggattaagttactaaatcacttggtcttagttggaaaaagattctttcttttgattctttttatagcaatgatgatgttacttaaatactactcaattgtgtaaagctttaagagaaggaggcagtatctgtgtacctaatgactctgcggggaagagggaaagatttcattaaaatgttacctgtagcttcatgcactctgcaaacaaagtcaaatgccagcttgtttcaaaattactgccattatatcctaacagtaaagcactcactggcaaatactagaggaaataataaacaatgatagctcttagcaattgaataatacattttatccacggatttgaaagttctttagaagcattaactaattaagtttcaccacatgcccacaaggtaggtattagttctctgttttatagatgtgctcatttagcatgagttacagcccacatttgtgggagtattggatgggaaaaatcccacggatcagattcactaggctgtgcagtaataacatggcagtgtcccaaatgattcccaggaggcattgaagaattaatgcacatccaaaacacctaatttaatagaaacttccgaaccaaggcaaactgaaccctaaaagatgtagaaattcacttctggctttccctgcatttaatgcttttgcactacaaaggaaacaatcagcaaaataaaatggaaacctatgaattgggaaaaaaatatttgcaaaccatacatctgataagggatcagtatccaagatttataaagaactcataccattcaatagtagaaaaacaaataacctgattttaaaacgggcagaggacttgaatagacatttctccaaagaagacagaaaaatgaccaataggtatataaaaaggtgctcagcgtcattaataatccgggaaatgtaactcaaaaccacaatgagatatcacctcacacctatgaggatggctattaccaaagagttaagagatagcaaacgttgacaaggatgtgaagaaaagagaagccttttacactattggtggaaatgtggattaacgtaaccattatcgaaagcagtatggagatttccaaataaattcaaaatagaattaccacaagacccagcaatccctcctctgggcatacgcccccaaaaatgaactcaccaccttgtaaacatatctgaactccacattcattgtaacgttattcacaatagccaagatatggaaacaatgtaagtgtccatcatcaacaaatagataaggaaacggtggtatacacagtctgccctccatgagttccacatctgtggattcaactaaccacagatgggaaacatttgagacaaaaactgcatctgtactgaacatgtacaggcttttttctcatcattattccctatataatgcagaaaaacaacttttataaaatttacattgtattagatattacaagtaatgtagatcttatgtcagagaattgaacatctgtggatttggtattcttgggaggtcctgaaaccaaacccctatagacactaaggtaggactgtatatacaatgaagtgttattcagccttagaaaagaaaaagatcctgccatttgccacaaaatggataaacctggaggccagtaagtgaaataggccaaacacagaaagaaaaatattgcctaatctcacttatatgtagaattaaaaaaaaaaagtgaaatatacagagatgagaataaaacagaggttaccaggggcacgggatgggaatgggggaaggaaatgggggatgtaggtcataggttgtgaggtagcagatctggaggatgtggtacaacatgaggactacagctaataaatgtgtgctgtatttgctgaatgggcagattttagctgctcttgacattaacaaacaaaaaaccatgggcaacgatgtgcaatgatggatatgtaaatctgatttgctctaggaaccatgttactatctatatgtatccataacatcatgttgtatatatcaaatatggacaataaattatattttaaatttaaagaaataaaaataaaagagtgaaataaaataaaatagaagccaaaagcttgccgggagaatgtttttcacaggctaattttatatatcacatataagtaaagatgaactccaacagaggtaggttattcagagccattaaatcacaaaatattagcaaaagaaagctgctaagaggtcatagaatggtacctccgttattttataggaggaaaagtgaggttcagaggataacatggcctgccagtgtccacacagtcagcccaatcttacataaaatgtgttaaaaacttgagtaaataaataaaaattttggttggtaaaagttcatttttctatatacaatttgctctaaattagtgtttggcaaattgtgacccatgggccaattttggactgtagcccatttttgtataggctgagagttaaaaccccttttttttgtttgtttgtttgtttgtttgtttgtttgtgtgagacagggtcttactctgttgcccaggttggagtgcagtgtcccgatcatggctcactgccccctcaatctcctggccttcagagatcctcatacctcagcctcccaaatagctgggaccacaggtacatgccaccatgcccagctagtttgttttatttttttgtagagacagaggctgtgttgcccaggatggtctcaatgatccacctgcctcagcctcccaaaatactgggactacagttgtgagccatagtgcctggcctttcacttttttttttttttttttttttgagacggagtctcactctgtcgcccaggctggagtgcagtggcgggatctcggctcactgcaagctccgcctcccgggttcacgccattctcctgcctcagcctcccaagtagctgggactacaggcacctgccactacgcccgcctaattttttgtatttttagtagagacggggtttcaccgttttagccgggatggtctcgatctcctgacctcgtgatccgcccgcctcggcctcccaaagtgctgggattacaggcgtgagccaccgcgcccggcctttttttttttttttttgagacagagtttcactcttgttgcacaggctggagtgcaatggtgcaatctcggctcatcacaacctctgtctcccgggttccagcgattctcctgcctcagcctcctgagtagctgggattacaggcatgcaccaccatgcccaactaattttttgtatttttagtagagacggggtttctccacgttggtcaggctggtcttgaactcccgacctcaggtgatccaccctccttggcctcccaaaatgctgggattacaggcgtgagccacagtgcctggccggcctttcacatttttatatggttgaaaagaaaacgtttttgattaatgaaaattatataaaattcaaatttccatgctcctaaataaaaagtgttattgaaacacagctatgaccatttgtttgctgactgtctacagcagccttcatgctacaatgacagtgagtagtggcaacagagaccacagcattcaaaagcctgaaatatttctatctgattcttcacagaaaacatttgctcaccccttctctaaatgacgtctgtgaagagatgtttaatatgttgatgtgtgtctgcaaacagcgtatcttttgtttataaattagacatacccagaacttgatttatatccttctgtgttttggttatacatccatgggcttatcaaactgtttcatcaaggataccaaatgtctgagaatttttcctaatttctcaatagtcgacacctccttttcaaaccatatttacgtcagtctttactgtctgtctcaaacactttcacatccattattccattaatctctcacatgaggagcccatggaaataattactattgctgcattacagagagggaaaccaggctccgagaattcgaaacactttcctaagagcactgttcagtcagcaagagattcctgccctgaccccagaacccaagtgctcctaagagaacagcactccacttgaaagatacaagataatcacagctgagattagagaagccaaaacataataaaggataatattataaaaacaatgacagtcctttcctgtgcatggttatctctggaaacataatcaggaataacttttgtctctggccaaagaagaagttaggaaagacttactattcttttgtttaaaatttataccatgcacatatattacttattcaacaaataaggttttcaaaagttgccaaactaagatgatcaagtgaaagcaactcccaccagtaagaattgcctctctctcaggaaagatttcacatagctccaatggttctcaaggaaaagagaatttccaattaaatgttaatcggaggtcagcatagcccttgccatgaaatccgttttgatgggccatttacttgtagcccaaagaaaatgatgaagcacatcactgctctttgacgccgtgccagctctggcaggaacctgatgaggagcttcatggggagtcctgcccaatccatctggagtcctactctttatttctttcctttgattcctttttactactaaatgctctgacttacagtaagatcacctatcaattacgttttcttaccagcagcaaattacctggctgtatattcacaatcattaagtgtttcttcatggaatgatattgcacaagagagttttctgcacatagctggcagacatgattttttaaaaataattcagacttggagttaaaatatcagagaaattctttactattctaagcttctgaaaacagtggtggatcatttagaatggatggatggatagatagataaatttagaatatatatccatttatctatctctagctagctagttagaatatcactaattgatcctgacatggagaattacaaaatttttaaaaaattatgattggatgaactattacagatcatctagtccaactgtcttaatcagtgaggaaactaccaccaaaggggattttgtccaatgtgaatcttgaaagtaaagattacatacacagtgaatgtatctgcaatctggccccaatctaccattttaatcttaccaccatgagctctctccttcatgcaaattatactttctgtccctcattctactcccaaaccagccatgttgtattacactatttttccttgttcttttaaataatatgaatgtcctttccttttaattttcatattctgatcctgtccactcttcaaggctctgcttccttgaattcttaatgaactttattagtgtccatttccagtggcacttatttttatacattcatcattctggtttttactgttttatatcagtatataaattataaatagtatatacattttttaaaccacagaaaagactatcaaataagggaaacttcttggcatctgaattttggtgaaacaatacaaatgaaaaaacagttgaactcatatactgtggtaaatcacctcagtgagttctcacaaaataaatgggtcttgatttatcggaagttttcttgttctgaaatcactgacaccccacttgaagagtaaaccaagtgacttcagaacttacaaagctaaaaaacctaaaggaccttctaggctgaacttccagccttacacataaaatatgaaggtctaaaaaagataaagcgacttacgcagcattaagactcgggtcttctggctctttgtgcccatacatccccgtttgatcatattgcttccctaacaattttttttagttggtgatgtccactgctaaaatgtaaatacatgttttgctgctttgctattgttatcatgtccatacatttttagaacaaaccataacttcattcaataacttagtctgaacatacctttggagtcctggattcttgtatgaattctttcagattttcagatctggccttcagcaagttgaggggaagcaaagtccaagtcacccagccctctctccagccactctaggctaaaacccctgttgtcgtatatttgtgcacctgttttctggatcacctcataagtttatgttcactcctattttattgcatgatggtttcatcatgattcaccaacaacaaagttaatttttgttgaatcattgattcaacaaatgttaccaaatgtcagttgctgtctcacacctaggacactgttgttacttctattattaaaaataatatgaataagaattatcattaagtaaatacttattgtacgtcaggtactataataggctctttacacacatcttctcagttagagttaaaggtctcacccaagctgtgggactgcaagtaagaatcaggatttaaacacaagtctgccatcatctgaagcctacgtcagcagagaagagcctttgcccttcaagggctcatgtctagtgttacagatcgctatcatgatgattaaattcacagggttcaagctattattcagataagtacaggtgtcgttgagcatggtggaaggaaacctaactcttctagggtagttagccaaatctttgagaaatatatgacatttgggcagaatcttaaaaaaatgactataagtttgttaagtagatgggagaaagagggctttgtgggtgaaggaaaccttatgggaaaaggcacacagtttttaaaaagtagcatatttcggggaataaaagcagtttggcatgactggaacatggctcctgctgaagccaaagaagcttggggcttgcaggccaagtaatgaagttgggatctcacctgtaagaaataatccccaaaggcttcgtaacaaagcagttgacatggtcaactattagatttagaaagctcacagcggtgtgaggtatgaattaaataagacttgggtggggtgaggcaagttaggaggatatcataacagcacaacagagagaaaagaagtaattaagatagtgatggtggaaataaaaacatattaaataaatgtttaggacacttaatcaactggaccttatgaccagttccatattaatagctgaagaaagaaaagaatttaagatgatgctcagatttctggcttaggtagtaagaagaatttttattccactaaagagggcaggtagaagcaaagttggtgaagaaagataatgagtccagtttcagaactgctgacttcggtgtacatgtggaacattcacatagagatgtcaagatgacagcccataccagaatggagcatcagatatgtctaggggagagattccaagtaggcagtcatcagagtacaggtggtaattaaagtcaaatgtttgttctacaaatatttactgaatgcctattctgtgccagaaactgttttagatgctgaggatacagcagttgacaaaacaggtaaaaaaaaaaaaaaaaaaaaaaaaaaaagtctagctttcttggaaccaacattctagtgaaggttacactttagagcatacaagcaaatccacgataacaaatttacgttaagttccagaaaggaaaggcgtagagtgctattaaaaaggaatagcaggggccatgtaatctagactgagttggggagtaggagatggtcagagcctctctgaaatatgggcatttaaactgaaacgaaagcctgataaagggttagctaagaaaaatcaccccaagtgggaacagcatatgtgaagaccccaaaacgagaaacagttttgtattcaagatactgaaaaggtcagtgtggttgggacatctcacatgtacccaggatgagaggtagaaaggggttagttcaaagagatctacttatgcagagaaaatgtataacttgagacacaatatcaatcaatcaatcaatcaatcatcagagtgtggaatgcaggaagtcaacgtttaataaaagaggcaggggaagtaaagcctacaaaagaaacctagattttgaccatttccagcacagtatggtatctactaatgagcccctttctcccaattaatataaatatatgagtcattatatatggctaatttgtccaccagaaatgttctcttctggggagtaggaagaggaatccacaaaacactttgatgaaactaaagaactcatggaatgaataaacaaaatgtgaaatagccatataagagaatactgtttaggtatgcaaaagaatgaaatactgatatgtactgcaagaatgacccttgaaagcaccacgttcagttaaagcagctagattcaaaaggccacatattgtatgattccaataatatgaaatgttcatagtaggcaaatcgttagagacaaagtagattaatggctgccaggtgctagggagaggggaaaatggggaatgactgctgaatgggtacaggttctcttttgcagtgctgaaagtgttctggaatttgataatggtggtagatgcacaactctacgaatatactgaaaaccagtacgttgtatgttttaaatgggtaaactttacggtatgtaaattatacatcaataaagttttttttaaatgtcatgggagacctccttgcatcctgttagtgtcaatatatgacacactaacatagagatagatctagagagcttgcttaggtaggattttaccagaattaattttgaaaaccgatattgtcttcaacgagttgtggctaaatgagttatgtctgtatttaacaatgactttggaaattcagtttcataagattaattttttacttggaaagaaactgaaaacgctttcagtaatccatcacaaatacatgaagatgacaagatccatgtgtcttatgaaacgttgccacttgctaccttataaaagtacagttaggaagtctcctccttcgtgctgaatgataagattgatcaaaaatgaggcagagttataacacattggggttttaatgaggttttgggttctatctcacataaaatattcatcaatgaactagaaggggtgttttgcactccatttattctgccagcactaacctacaagttcatttcattaagaagatagagaggggttaaattcatccaacattctgaagactgccaaggtaagatttaaaattttattatatttctagtttaagaaacctagtgacttatcaggatgctgaatccttataatggcaagtattcaggaagtattaaaaaaagtggacttatcaatttttcaactttcccttgatagtcaataatcaaagaatgaataattacctggaattcatatcaacctggggaacatagcttaacacatttattatggatgtttagagaaatgaagatacatatatacatatatatgtatatatgtgtatatatacatatatatatacacatatatacatacatgtatatatacacatatatatatacacacactatatatatacacacacgaatatatgatggagattccatcaaattaacgaactccttagaaaataagatgtgaataaatgaataaataaccaagcaaactaaataggaaagctgctcaagaatagcagattaaaaatatttatgaataaaaacactttagtatttgataggtccccacttacatctattatcaaatgtgatcctcatatctgctctatgaaatgagcagtgcagaaagaatagccccatttcacaaagggtcaaaatgaggcttggaaaagtaaggccactttatgtagactcacacttctaggaggtggcatattcagttttatatcaattcaaatcttctgacatcaagtccaatacattctgacatgacacaatattctatcattatttttactattattattgttatttttattattgtaggataaaaatatacacaaatgtcagatagaaagtaaataatggcataagatataacagaaatggtctataacaactgactagtggtccagataataatgtatcctagaaaaaataattgattttgttggttttgttgatttttgtcattgttttttgttcatttcacaaagaaaagtaaggcactgagatacatctatatacacaaaatgattgtctcccccacgatatggtcaattctcaactatccatggacttacaggaacaaagactatttagattttttttttttttagtctcttagaatttcaaattctcacatcagtagatatttccccttttaacaaaagcaaattgttttaaaaacccatgaattttctggcttttgttggttttcattcttctccaactagataaacatctcttaagcaaataatcattgcttcaatagagattattttattcatgattatgctttgtgctccaaaatttacgcaaaatatgaaggatgagaaatggcattagaagggagcaacagaaaaatagaaggaaaaaagactttttaaacaatgcttgcagaaagcagaataaattttctgtgaggtaaggctttccattgagtaacaactaaatataaactgaaattgaagtatggggccagaagccagttagggagttcaccaaacttggagctgattaatctccaatatggattctcaaataaatcaaggaactcattcttggaatgatttcaagtcatccttctctttggagggtagagtaaatgttattgagtatggaggaagggaagttgcaatcttaaggggtcactctatcatgttaaaaatcagcacaagcagggtgtcaaaagttgaaggcttttgagtcaccctatccaattgcagttgtcttagctctcaaatcaatacgcctataagtagccatgatatgatttaactgatagtgtcccagacagtgaaaaattcattactgtgacctgtgaagtgatttcacctatcccttatccaacagtagaggattgatcgccacagccaaaacctcagccactgcatacgatagtaagcacttatagtaagtagagtgaccccaatggtaatgtctattcaatgggcggaaagagctaggccctcccaaagtgcagtaaatctcattattcattgacttctccttaagcgttctgctgcttaactaatgaccgttttaattcttaattcatagggtgccttgacaatgtagttttattcttattattataactttgagttgtaataaatatatcgagttttctgtgttactaaaattacactgaaatatcattttaactatttatttttatttatttattattttttaatagagtctcaccctgtcttccaggatggaatacagtgccatcttggctcattgcaacctctgcctcccggttccagcgatcctcccacctcaccttcctaagtaggagtgcggaattataggcgtgcaccgtcacatgcctggctaattttttttttattttttgtggagatggggttttgccatgttagccagactggtctcaaacccctgacctcaagtgatctgcccaccccttcctcccaaagtgctggtattacaggtgtggtccctggccttttaacattttaacttatgaattattttcatacaagataatagtctttttaaaatgcagcttaagtttattctgtggtatattttgctcatatttttcttactagcagcttcaggggataagttggttttgaaggaaatgtattttctttgataacttggcaacatgcaaacctgttctctctctcacagacttcatgtaggaaacagtctttcactgttgcagactgtaaggaagaagaaccaaagagagtcatgggcgaagccccaaagaccctctttaagagtacatctgatcatgtcacatgtctctaaaattacacatactccaaactcctttttgcctgcagaatactttaaacattttaatgggccttcaaaggccttccaggaacttgtccttacctcctttttcaacctcagtttctactaccaacctacacaaattctgcatttcagaggtgtctaccgacttacaaccacttgaatatgccatactgtttcacatctccatgcctttgcacctgctatttccactactggaactgccatccttttcctagtttccacttttgataaactcctactcattctgaaagacagttcccatctgtatgagcttccctgagccacccaaacaacaacccactcccttgtacttgtgccaaccctatacctattatttatctcattgttgaatttattatacctcactgtcatactttgtccttaaatacatttttagtctgtctataagtttcttccaaacaagacctgtgtacctttcaaattcatattattagcaattagcacagttcctggcacacaaagatgttccataaaagtttctgaataaatctgaagtattcttgacctaaggaatgaaacagcatctcttcaagagtaatattttttaaaatatataataaaataatgccacatattaatgtatgtccaataggaaaattatgactttacatattctgtcctatcatccgacaagatagcttgaattttttacttgaaaaatatgaataacatgaatataaaaagtaaataatgggtttcattgaccaacatttaattctaaacagtgatcaagattttaagttaaatatatttctgtcctaatgtctcaagttgctaagaagatattgattatctggacaccaaaaaatagtttccagatgaaatctgtacatctatgtcctttgtattcgtaggcacagacacctactaggaagttaaatgtgtaaattcaggtgaatttccaaaacacacaaaacattctaattacttgggtcaatgggttgatagaaaccttagtcccaggactgatgagcaaacagaacattgaccttctcagactaaccgacatttgttgaagccttcagagtgggatattcaggtggggtgaattgggtacaaaccagtcatatgaacctggacaggggacttctttctgaactgcagctcctcttctgtaaaattaggggcctagatgatataccctagagtcttccaggtctcacaccctgtcaagctatggattgtttcaaattataataaatgacgagggaggttaagtgatatttactggtatatggcaaataagaggcctgcttctcaattcaacaatctcatttttcccctcgcctttgaagacaaaaaataaaaaataaaacaaattaaaaacaaaaataagatgcttttcttatatgcaacacatttaaaatgggtggacaaataaagcatttattctagttcattatagaaaatatattgaaaccactgtcactttgggtcattgtagaagatgtacatacttttgttatacatggaaatattaagcaactaacatattcatatttatataggatttacagttttccaaaacactcatgtgtaatgccttgtttaatctttgaaacaccgctgagagttaggaccctttgatttagacagaggatgggacagagaggttcagtgtactgcgtgaggtccagcaactaataaatgtagagctaagcttcaattgtcagtctctagattcaattcagcttcattctgttatcaatgcaacccctccctccagtcatattattcatgcagaggatgtggctaagtgagaagagaagagattggaaggctcatttatttattcaaaaactatttgccaggcacctactctatgccagacactctgctagatgccagggaatatcaaacctcacacgatccctgcccttctggacttctagatcttacacttccaggagagattaaagtggataaaacgaattgtatgccatgggcacatgttacaagtgggacataaagatataagcaaggaactatgggaacccattgaacaattcatcatgttcatgagaatcagagacagcctctggcatttagctaggccttgaagagggaggagtatttcaatagggagcatagcaagggaaggcgtgccaacatggaaagaagagcaggaatgacagcccggatggatgagagtgcaaagctcacccaggaaggtagttcttttggcctgtatggcaggagaaagactgagtgggcatcgttttgttcagagaaagccagaccagccctgaggcagcaaagtaaaatatcctctctatgtttttcattctccaagctttgccacagaggatgtttacttgctcttggcttcggaatatccttaagaacggttctcaaagtgtggtgcccaaatcaacagccttggtattatctggtaacttgtgagaaatacaaattctcaggctagtgtcacaaatttaccaaatcataaactctgagggtagggcccagaagtctgtgttttagcaagtactccaggagactgtgatgttcactcaaatttgagaatcactgctttgaaggacttccgcccatttgaatatccttataccaaaaaacgtcagttctaacccagaattaccaacacactcctgaaatctacaggctaactttgtatgctcatgtaagagaagcttgcaagatggactgtttgggaataaactaggaatttatgctgaggtggtgagtcatcactttttagggctactgaaagggagacttaagcacccattgttaatttgagtagatgccatctgtggccctactctccttggaataaacttctgttgtgacacagaacttactgttagccttctgtaacatcatatttcgaatggtgcactaatagaaattgtgaaatgctctttagggaacacctatgtcatatttaagcatgacagttacagaagagacggtgggcatatccatttctctgcagtctttgggtttggcttaaaactggttgtaattcagtttgataaatgatcaccaagctctctttatgtcatcactgtaactaggctaggagtggtgacgagaaataagtcatagctcttgtttttgaggcattcagtccatttctttagaataatcaaaaaatctcacttttcccaaatcatccccaggagtttctctggtccctacattttggtttcttcctggaatgctcagccagcctcgctttctgtgcccatcaaaatctgtcaaagccatgctccaacgccaccagttttcctcaactagatatgatctccttttaaacaatgcaggccaaataattatttttctcttacagagttttgtagccttctgagaacgcagtacagatctataatattaaaaatatccaaattagttcctgtatgtcctgtataaaaaccttgaagcaaataatttctaattaaaaatacaacagatcaaattttcattaaaccaaaataaataaataaaactctttcaatatatattcctcatttgaggcttttttttttttgagacggaatcatgctctatcgcccaggctggagtgcagtggcgctatctcagctcactgcaacctccgcctccccagttcaagtgattctcctgcctcagcctcctgagtagctgggattacaggtgcaagccaccatgcatggctaatttttgtgtatgggtttatttttcagtagagacggggtttcaccatgttggtctggctggtctagaactcctgacctcagttgatctacctgccttggcctcccaaaatgctgggattacaggcatgagccacagcacctggcctcatttgaagcttcttaaggtgagtgtgccactcagacttcacaaatatttaatgttgcctaacaagtatgtgaaggatttcaggattttgccactgtataaacaaataaataataaagttacttaagaattttaggcttggaagtaggcacaaaggaagctagtgttttgtggaagtttggaggccaagtaggagggctgggaataaactataggttatctggctgtgcttcccaggtccttcctaattagcattaatgggtaatacatagttgcagtgtcacacaggacagcagaatttttttgagataattgattgctactagaaatttttgagaaatagagtttatctgttgccaagaatggctaaaatctgatctggatctaaatgataaaaaaaataaataatctccatatcagcaacccaatagcactttgaatttacatatgattttctacaagatattttatttaagcataacaatagctctgtcctactctggtatcttgccacagatgggcattcaatgtatctttaagaagggacacaacaaatgatagccgagttaaggattagtcccattttatagatgaaaagcagaggcttacagtgattgaggaaaagtgacagagtcagaaatgttcaacgtgaagcagaagagaggcttcttgaacgtagtccgttcctttccccacaccaccctgcatcacagtttgacagacctgtgtaccactccttcccttacatgtagaaactggttatggttttcgtatattcaacagaaagagtgtcctcatgatatttctctgataaatgctagctatgtatagaaacccacagctaatcagccacttctgacagatcagtgtgaaaaaaaaaatagtcaactagattgatggaccacattttttacttttcagaggaatgtgacagttttccccctcattccttggagcaatgataaagaatccttccaattctgtatttgagcacaaggaacaaattttaggagtaataactcaatattaatatagtaaattttgctgtatagattatgaaacatcttcttaaagtcctattttgtatatggtgtataaaacatcgatgacataaattccactcaaaattctctgtgtgcagagacatctgctgcctggccaatatctattctcacttcctccttattaacacaatctctgtattgttgatagcaacaatgtgcccagctacatatcctagccacccttgtagataggtgttaaaatttaaacaattttaagagggacttcagagaagcagaaagcattccattgacaggcctttctttttttctacatctctatttctaaaactcagatgtgatggttggagctgcaatagacagacagacatctttagaccatgacttgaccttgaggatggaagctacagaataggaacgcagaatagaaggattgagaaaaactgagaggctgatgaaatcacaacatcaccataccagcctcttgacttctacatcaagggaaaattaattctatttagtttacaagtattacttagatttctgttactagttgacccatttaatcataactgatgagtcccccaaaatataagtaaaataaagagctagaaaattttgattaggactatattttgaaattaaagagctactgagtaatagatggacgagtgtcccatgctaatatggcctagaagaagaagatgattttccctaaataaggcaaccagaaatgaacgttatcaggagtctgagtcatgccagaaagaagatgatgatgtttgcaaacccgcataatgatgcaatagagatgggggaatgggaagaggtgaacacaagcatgaggattttagagcgaaaggtcagtgaagccataggaaaagaagctgtttgggactggaggggaagaataactagcactccagacacatgggccgagaaaagaaacgttacatgccagaaaagaaattccctcatccaggaggttcaggcaaaaaaaaaaaaaaaaaaaaaattcttttccttgcagtacctagcacaggactttttagaagggtatgcactcaataaatgtatgttaattaatgtacagccatccaaaaaatcagtgacggaagctcacctgggaagccttactctcaaaatactggataaaacacactgtttcatcccaatcctttcttagtatcctttaactgtcactaaacaacacctaaattataaggtgaaaagacacacacacacacacacacacacacacacacacacacacagagagagaattatagtaaagcagatacatgtagtcaaagcctcatagcacaaaaggaatgagaatttaaacacactcagcattcacttgtgaccactatttaaaacttcatgctccatatttacacatttgtttctctagtgcagtggttctcagccggggtgatctggcccccagggacattgagcaatgcctatatctctgattgttataactggggtgggaggaggggtgctactggcatccagtgggtagaggccagggatgctgttaaccaaccatcctgcaatgcacaggacagcctcccacctccaaaccaaagacttaagccatacatatccagtaacaatgccagctacttcaagattatggcatactctctccaatgttgacagtcttttagttcatgtaatatttttcagagtacccaacaagaaaacacctagcagtgtaggctcatgaaaatgtaatgtgtggtctgtaatccttgacgcgacctggcttccaatgtattttttgttcacaggaagcttgaaatgcataatagccacaattattaaatatatactaattggcaagtacaatgtgaaaaactttacaaagataaatcttggtgaatctacagaacattactgagggataggtattagtataaagtctcacggccaaggtcacagcacttataaacaacagaggtccccagtacatatcaacaatgggaaggttaatatgtaatcatacaatggttgctattctggatatctatgttctctgctgagttgaggttttttttttcctttacattcataaagacaataactttcttgcacagaatgcttcctgaaatgtactgtacatttctgaactttatttgatataacgtattgaacataatttaatcttcccttaacatgtcagggcggttatgatgaatatccacattgttctgtattagagcaaatgaaatattcagggcttcctgtcacttcactagatagtcccaatgcttttagagtttttctgtctgatttttatcatttttctttgtctgcctttctggcagagttggaactgcctctttttaactagagagaactattaaaaaaaaaaaacagagaactattagaactgtaaaacaagctcctaaaagaacctcccatagtgtagggggagaggggagggaggtgagaaggaagaagagctgagactatacaagcttctgggtatcaattttatctgcaccaaattccttttggctttatttcttggtttacaactgagttccaactacctgaatttgttaaatctatgagattcggactcatgtggtcttaaaatacaggtagtagacattttaatcataatttttaaaatcctacatttggctatagtataatgggatcttatgtatctaccaagctatgcatgtccactaacacttaaacccaaatttatcaataaaaccatatttcctagacatttccaaacaataattttagttttcaaacatgcagctcccatttttaaattgccaaaagatcaaaacactaataaaattttcagaagtaataagtgtggcaagataatatgaagttttaaaggcttttttactctgggctaaactatatttctgcaatgagtaccacgagactatttgggttttttttttcactctatcattgctcttttggaaaacagaaaggacctttatcagcactttgcaattgcagataaaaaacagtacactgacagagacgctgtgaagtttaactaggacaaaaatacaataggacacatcagtgattcttgaaaaatcacagaaaaaccatggtaaatgtgctacataatcaatcagtccactgtttaaaaaattacattgaaatagattttctatatagttttatacaaacaaaataggtggtaaaccggacccatgccttagcaggctgaaagctgatactgaacctgccagtggtcaggtacccagaacttggcatatcagactgctgcattgcttctgtagctcatcacttgcctctttcaactcaagatcagctgctggcttgtgagaacgttcccttgggtacctaaatgctgctaccagcagttttattacttctgccatgactttctgaagctgagcaagctgcagcctctgcacgaagatcctcatggagagcagagcaacgcagagtttggagcgtgctaaccagtaaacaaagttttagggtgcattagctttaccctagaaagcagggcacttggcttattttgaaataataggttagcttgagaataaataaaaattctgcttttcttttaaatcatagttttgcataacttaggttttcaatgaaaataatttatttgtccagtgcaataattagtatgaaattaccactgcacttaagatttttaaaaaacctcatttgctacatatcaaaatagttatcccattagaagctgaagacagagtgcctgaaaaggtgactgagtttttctctggaaattttataggctttccatttgttctaaaaaacaaacaaacaaacaaaaaaccataatttgatatattctagaaacccaggtgccaggccctttgcaaagtacacaggattcaaaggtaagtcatacatggcccctgccttccagggttagtggtccggccaggacgccaagctgcttccctatgtgccttgagtggatcatgggacaggacaaatcaggcttgaaagtcatcccaaaactgatggtttcagctgctgatgctagatttccacggataggaaaacatgagctcaacaatggacatcatctattctaaaatgatcccagaaaattataactactgagggtaagtttgtagcaatacattagtgtgacatcataaaaataaagtgttgatacatcttatggcatttcttctccctacatcccattaaaatacacaaaaacaaaaaatatgacctgacagaactatagcaatgaaaactaaactgataatatctaacaacagtttttcagcacccaggagaaatcagtactcatctgtataagatgagcatgtggcctcatccccagctgatgtgtatatacagggctagaaaagtagcagaaaccatcagtcgctcccactgtgtagctccctctccaacctgcagaaatcagaaatcttacatcccccttcccacatatattacaataagaaaatacaataaggaaatggttaactaagccatctaggatgattttctctctcccatgacatttgctttttccctaaagcagcattagtggattacccttatagaaaaagttgaagactgtaattcccagtggtacagaaattccaagtagggtcaaatggtatttctagttctagatcgttgaggaatcgccacactgacttccacaatggttgaactagtttacagtcccaccaacagtgtaaaagtgttcctatttctccacatcctctccagtacctgttgtttcctgactttttaatgatgccattctaactggtgtgagatggtatctcattgtggttttgatttgcatttctctgatggccagtgatgacgagcattttttcatgtgtcttttggctgcataaatgtctcctcttgagaaatatctgttcatatccttcatgatttataatcctttgggtatatatccattactgggtatatacccaaaggattataaatcatgctgctataaagacacacacacacgtatgtttattgtggcactattcacaatagcaaagacttggaaccaacccaaatgtccaacaatgatagactggattaagaaaatgtggcacatatacaccatggaatactatgcagccataaaaaaggatgagttcatgtcctttgtagggacatggatgaagctggaaaccatcattctcagcaaactatcgcaaggacaaaaaaccaaacacctcatgttctcactcataggtgggaattgaacaatgagaacacacggacacaagaaggggaacatcacacaccagggcctgttgtggggtggggggaggggggagggatagcattaggagatatacctcatgttaaatgatgagttaatgggtgcagcacaccaacacggcacatgtatacatatgtaacaaacctgcacgttgtgcacatgtaccctagaacttaaagtataaaaaaaaaaaaaaagaaagaaattccaagtaggacgtaatgtaaagttgttgagtgggcactagtgaagataggaagagctctgaccattgtatactctgtttttggaaaagtaagaactagaaaattttcaacttacaagggatgaaaaattatcttcttcagagccaaagaagtatcttctacattggaagcaggagatacttccttatttaggcagaaccatactaatagacctcctaaaaattagtgaagagctttgtacaaatctattacactctcatggaaattattggggaataagggaaaacagagaagcctcacttttggaaattccagggttggattcatgctcaaggaaaagtaaacatttgggggtgggggtggggcaaaaaaaaagcacaggctggacacatgctataaaattgaaataaggaaaagttgttctgaaagtgcagaagaaaaccctagttctttaaaaaaaaaataataatttaatattaagaaaaaaactgggaacgtctgttctgggttctcaagtaaatacatgaaatggtacgcttgttaaggttagggatgatgataagtgatgagataaaaagacaatttatggcaatatagtctaaaattattaagggacctggctgagaaaagcaaggtaacaaaatagccaaattaatcctaccctggaattggaaaagaacaaaactggcactataaaaaaattaaataggctgggcgctgtggctcacgcctgcaattccagcactttgggaggccaaggcgggcggatcacttgaggtcaggagtttgagaccagcctgaccaacagggtgaaaccccatctctactaaaaatacaaaacttagctgggcatggtggcatgggattaaaaataatcccagctacttgggagactgaggcaggagaattgcttgaactgggtggcagaggttgcagtgagctgagatctcaccactgcactccagcctgggtgacagagtgagactcggtctcagtaaaaattaaatcattgatgtaaagaggaaattctcccaagaatcagaaaaggtgaaagatatgaaagggaagataataaaaatagtaaatactggagatttatctttacaagtaatttttatccttaagaacaaatcttaagtagtggaatagaaataataatcaagaaaatatttcctaagctgaagactgactagagtctgagattaccatgttccagacaaaatgtaatcaatctagcaaataaaatgactgacatgttaaggttcaaccttctgctatccaaaaccaatgagagccagacctggtaaattccctggggcctctgcattcaagacaaacagacccagttcaaatcgtagctttactacttaaaagctgcataaatatgggcaagttacaatatcacgcttgccataaaattctacttcaagaagctttatcacatcaacacatcccactccctaatgaaaaatccctttcactgatctcctactgcatctgactcagcctgagtgggcttccttattcctcactccatattccacagtcttcattcaccagcgtatgtccaaaagaaatggtgaaagaaaagaaaaggaaaggtaagagaaagaaggaagtagcctcaaggtcattctccctggagtaatagcgactgccttcaaaagagagtcacagttaacttttaataaaatatctcaaatgatatgttattcatcctccagaggtaatatccttgtcttattgaaaaggcaggtttgctttggtagctgaacacttcctgtattagcttatttccaccattcattttcattacagattcattttcataaatctgaatcattgcaaaatccaaataaatagcctccaataacttcaataaccatattagccatctcatcaattcaacctctaaaatgctctttctcagggatgacttgaaagctacctaggtcagggtcagtctccaatacattcatttgctctgacaagctgatttccataggctaggaggtctgacttggatcctctacaaagaggagcccttgatagactcttttaaatacagcccaaactctgtctccagtttttacagattcagtgcctcaagctggggtttctacaactaatgcaagctttaaacagcttcttctcctctaagtatcattttcactatcaataaggacccagcctttatgctaagtctttttctaccaacattttcccttatttcattttgagtcagagtcttattgattaccagaaggaatagatcataattatactttttaaataattaaataatgatcgcaacaaatgcacaaatacttgtatgtttagtactgtttatctccaaagatcgttgggagacctggttctcaagaagcctgggttctcctctggattcttctaccaaatagctacagtagaggcaattcccttctcttttagggctttaagtaacaaagctaactggtgaaggagacaataccagaattctggttcatgatcatgcaatgttctttttaggtaggccaccagaactgagacagaaataacacactagcatgacttggaaaacttgcagacagaaaaagtaacaatcaagtaaggtaatttgtgtagaagtgctttgtaaatgcgtagttactaatacagttttatgtggttgtcaggcagttgtctataaaatgaaaagagtaccagatttagaattagaagatctgatgataattgtagtctagggaatatttgagtatcaattttcctacagacattaatggtacaatagtactctcttcgcagaattgttctgaaggtcaaatgtaataactttgtcaaagcacctactccagagggtagcacatagtagaatctcaataaatggggtccaaggctggtgggtgacttgttctcaggtcattcacatgccacagaacaggcctcctgtgaagcccataaaatcttaggcagatgagtaccctcagccaaacacactggtcaatcccatttacccttccatgtcatctctctgggggtagctttgcatcagtttatagctttcctgatttagggggctctcatgtcagagaagtcacttaaaagtcaaattattattatcattaaacatgaagaaacatgtccaagctgtcaaatatcaaacaggctctgatttctattcaacattattttctctctcagaacggtttccttccagctgcaatcaatatatatttttggcagaagagatgctaaagaaaaaaaaaaaatctcccagcttgtctccaaggatttcacttttgcacatacatagagatctgacaataatggtgacaacatccgtttgttctgtgtttgcaattagtctagcattttcacatgcattatataatcccattagacagacaggcaggtaatagtatccccatgttagataagaagcccctgaaggacatagtacacataagcttctccaatcctaccactagtaagtgataaagctgattgtgagtgtatggatgtgaagagtaaaaatgctcctacctttctcaagatacgtggaagaggaagtggttggaattatgaagttaagcaatgtggtcctcgttgtaatataccttaatatttcattttgtgtcaaccaaatgaatctatcatgagatataaaaagataccttaataataaaatgaagagacattataatccaacaaagttaccactgtgtggattagacaagtagtagcaactgagaagcattgagtgtgagcacttcctgttttaaatgagccacagacatgccaaatgagtgaaactcctccccagagttgttctaggaccttggcgcttctgattttagaggtcttatcagagcactaaaactaccaccagcattacttccctaatttatacaatgaggtttttaaaagtcaccaaaggcggggcacggtggctcacgcctgtaatcccagcactttgggaggccaaggagggtggatcacctgaggtcaggagttcaagaccaccctggttaaaatgatgaaaccctgtctctactaaaaatacaaaaaaaatacaaaaaaaaaaaaaagctgggcatggtggcatgcacctgtaatctcagctactcaggaggttgaagaggagaattgcttgaacctgggaggcggaggttgcagtgagctgggatcacgccattgcactccagcctgggcaacagagtgagactccgtctcacaacaacaactacaacaaaaagtcaccaaaaagccagccccaaatagtttgattatttattgttattccttctgcatggaataaagaatccagtacaaattgacgtaatgtctactatctagagttttactaacatttagtttttgtacagctaagtaatacctacccagtagagaagaactagaaaacacagaaaagcgcaaagaagaaaaacaaattatccagaaacctcatctggcgttcagtaagatttttagtgcattaatcctgaaaatccagcaaaatcaggaccatggtttatctaagggtaatgagaaataagatttctgtattagagagattgagctttttattgaaatacaggtagttacaaaatatttcttaaatgcatgttacacattagtaataggatggggcaggagagtgggtagagaataaaaaaataaattagacacagttgctctttatagacttttacctaaatatgaaaaaaatcaacttcatcatggttcatggaacaattataggaaaaggtaaggaaatgaagattgaactacagataagtcgaagcgagagaacagattgctatgccattaccataagtgataaacctgaaatcaataaaggatgtgccttcatataccccatggaatactatgcagccataaaaaagaatgagttcatatcctttgcagggacatggatgaagttgaaaaccttcattctcagcaagctaacacaaggacagaaaaccaaataccgcatgttctcataagtaggagttaaacaatgagaacacagggacacagggaggggaacgtcacacacgggggccttttgggggtggggggcaaggggagggagagcattaggacaaatacctaatgcatgcagggcttaaaacctagatgatgggttgataggtacagcaaacaaccatggcacatgtatacaaaccacatggcacatataacaaacctgcatgttctgcacatgtatcccagaacttaaagtaaaatttttaaaaaaagaatatgccttatctaaggtctcacatgtgggaccagcactcaaaaccgaattcaggatattcaattcaattagttatggaagaagacctttcatgaagaagacacaatcagtaatggtgaaattgaattgattctcaaagtttctagtagttttgtttgtttgttatgactgagtacatacatcaaattttaataccactaagaaataatccttagtacttatgcagttaaaacaaaaccaatataacttacctatgaagtagaagagagaaagatttttggaaatgaacataccccaaaacaatagctctcaatttgataacaatagctctcaatttgataacaataaaataaacattaaaaagtcatttaattttaaatacctttctttttcataatcaattaaggatgctttcttgagtttcatatctgttttcaactcagttttatatagctttgcttaatttaagaatttattttcagtctatgaactttctctacaaagcagcaaacagtttatcattttttgctatcactttcaaattcactagaaatatggatggatgctcatttgtagtcaaaacatttccagaaggatttacaagctttcttcccaggactttatacaatcatttttccagatgtaagttaaaacataaatacaagtgctgtgacttctattttagcactccacaaaatacaaatatactataaacaagtgccactatgaaacacagggctcacctattttttatagaacagggaccatagtctggctgttggacataggactgtaattatgagtaagaagatcaactattagaactggaaattaccatggaggtcttcaagtccaaagcctttgtttatgtctgaggaaactaagaaagggaaagaggctcatccaaagtgcatattcaatgcaaatgtcctgacagcctacagtgtaatgacctgcagcagaacttcataataagctcacttcaatctcaccaatactgtaattttgcttaatagtcaatcaaagagtaaatgtttagtgtgccaacaatatgattgacactacattagagattaaagaatacaatagtttagatggatggatagttggatagatagatgatagatagatagatagatagatagatagatagatagatagacataaagaacatcataatataatcttcacccaaaacaagtttattatgtggaagcaaaaggaaaaaaatcatgattcaacatgatacaattcacaaagtcatataatatcattcattcattgattaggcattgagtgagtacctactgtgtataatgcactctgctaagtgctgggattcagataacaattttttgagaatttcccaacctagtggtggagataatcttgtaaaacaactgtagtgaatgctttaatagaggatctatataatagcatagaagggagaaaagcttctggaaaggtcacagagggcttcacaggaaaaaacccacatgagcagagttttaaaggatgagtagaggctgggtgtggttgctcacacctgtaatcccagcagtttgggaggccaaagcgggtggatcacttgaagtcaggaattggagaccaggctggtcaatatggtgaaaccctgtctctaccaaaaatacaaaaaaaaaacttagccaggcttggtggcgtgtacctgtagtctcagctacccggaaggctgcggcaggagcatcactagaacccaggaggcggaggttgcactgagccgagatcgctgccactgcactccagcctgggcgacagagcgagactccgtaaaaaaaaaaaaaaaaaaaaaaaaaagtaggagattactatgcaaagagacggagtgaggggaagtatccctgatagaggggcaggcacagtgaaagacacagaggagtgaaacagcatagagtatctgcagaatggcagaatggcaagtgtggtagagaagacgggtataacaggaggcgagaggtcagaaagagtgagatattgacacattttgaacatcatgttatgttgttagtgctttatcctgaaggaaatgaaaagccaaggaggggttttaagctggaagaaaaatgttatcagacacacataatgaaaaggtaaaaattatcattagttttacttctgaaaatgtaatctagggatataataatgtatacatgcaaatggttagctataaagatgttcatcgttgtgatgtttgtaataaccagaaactaaaaacaccttaaatgtccaagaatggagaattggtttaataaatgttagtactttactaaaatggataaatgggtagaaatggcagattaagcacataccaaaaattccatcttccactctgaactccgaaaaaaaaaacggtagaataagtaactaaaagatgcaacaaaataagttatataaaattgaaaactgcatactctaagaatgaaaaaatttcttcatcgtggaaccagagcggcaacccacagctataagcggagacaaaactactattctacggggaactgggaaggaatataaacattgggtcaggattcttaatgggaatattcaatgggggacaaatatgactcctgcctagtaggagagtctgagataggctctccaaataaatgcagaagctgagattgcactgcctaccttcaaagagaagagttcttcccactctcctaggtctgtggccagaaatgtgccactctgagggcagaagcagaaattcggcttctgctggttttctgctggtacacagggtctgcgtggtacacagatgcaggacctgaaatttgactacccagaaacggcagaactcatcctgagatgctatcatgagacctggtttggagctgtgcatcgtgtaggtcccagaatttaaaaactgcagaactccctgcactactagagagcaatctccaaagaaaatgacacctcaaataagaatcctaaagcacatgaaaaagctcagcaatgggacataaagcaaccagatccaacaaacaggataatccatatccacgaaatagagaaaatagataaatctgaataagactttttaaaaggaggattagaaccctcagagaaaagaacagactaataaccatgataagaattgaaagaatcagcagttaggaaattagaataagcaaataagaaaaatgcaaaacgtgaaacacaaataaatatgctctaatatgtttcataggtattttaaaaattgttagagcataaaagaataggcaagcaaacaagataagatttttaaaaataaaatatggctattggaataagaatctcaatagatacgctaaatcgtatatgttagagtagaatattgtattagtgaaatggaagttaaaagattatgatagaaaatgcaaaacatgaaaaaatagaagagatgttattatggctaggacttttccagaaattgaacattgacatgagtgtgattgacagatggaacagctcttaaagtgtggtcccagcacagtggttcacgcctgtaatcccagcactttgggaagctgaggtgggcggatcatgaagtcaagagatcaagaccatcctggccaacataacaaaattccgtctctacagaaaatacaaaaatttagctgggcatggtggtggggacctatagtcccagctacttgggaaactgaggcaggagaatcgcttgaatccaggaggtggagattgcagggaggcagaggttgcagtgagccgaaattgtgccactacactctagcctggagacagagaaagactctgtcttaaaaaaaaaaaaaaaaaaaaaaaaaaaaaaattggtgtgatccagagaatcctggatgtccccagaaattctacaaggagtgcacaaggtcacagttatttttccaataatattaaattgttatttacctttttcattatcattttcttatgataatgtgttttccagaggctccatgacagatgatgacattgtgtaataaactgtgtcaacatacgaaagagctgcatgactcagtgaaccaatatttttcaaatgatcaatatatgatattaaagcatattccatcagcaaaacatccattcaaattacaaggtagctaatgtgaaagagcataaagagttaattgatatgactttgaattcccttttgtctctaatctttaagaaacaatcactggctgagttttgatgtagtgttaagaaaaatatccacaattatttaaaagaactattaaaatattcctccattttccaactatatcccatacgaggctggattttttagtatacctcaaccaaaacaatatttgccatatattgaatgcagaagtagattgacaatccagctgtcttttattaaggcagacattaaaagagacttataaaatataaaataatgctattcttcacactaattttttgttttcaaaaatatagttattttaataaaaatatattgcttatagtagcatgtaataattttagttacttatttttagtaaataactatttttgcattcctcagttttaatttttaataaggtaggtattaataaatataaatcaaataaaagcacattaaaatcttcaataattttgaagtatatagatcttctgagaccaaatgttttagagtaatcatcacacgtggacaatctttaacaacaatagtatttttgaaataataataataatgttgtgaataatataaattgccatacaataaaaaggccaggatatgatgtacatgtatccattgggatagatctacgggcagatcagcctttctacatataatatgagcacaataaatagaccagtgttcttggtttgttgattgcaaagtacttggactcacaaacagttaaagcactgaataaatgtttatagagtcccttaccttcaaagagtctgcagtctagtacatcaataagaatggttaaagcattatttttgttatcatagacatatatacaaagtataatggggacccgaaggatagtttgaatctcctcgagactcaaggaaaggcttcatgaaggggacagaaattgaattgcaaaggtgagtagatgttttccaggtacagtgaagatagataaaatgggagagcgatctgggctgagcagtaccaaatccatgacatctggctcagctggattgtagatggtaatctcagggaatcacctagatctatcttatttgtcagatttcatgtctatcctagcttggaaactggaatatcgtaagtacgaaaataggttttcaatgaataaatggaaggcatggaaagagagggaactgttgaggaagacaaagaccaggttatgaatgtttttacataccaagtaaaggaatttagattatcctgcagagctttgaagttagacagcaggaaaacattaaaagagagtgatgtgattgtttttgtgctttagaaaaaacatctctagtagtacagtaaaataatgttttgcaggggagaaaagtggagatcaggtgaacagttgggaaactagagattatatcccatttaccattgattctggattaggtaaacaggattcaaagatatcaattattaaagacaaaatatttgtggggctttcagcggaaattccatgtattggtcatgttctctaatcaccagttttctagcagtcaaaagttaacccaacgtttggtagacgcatgggactaataggcagaaacacccataaccatttaccagctgtgtgttttggggcaagtccataggcttcagttttttcttccactgtaagacggacatgaaatgccctttatgatatttacacactttctgtaaagatcacgtacaacgataaatgggataactctttataccttggaaatagtcttctagttaggggagaaactgaaggctgcggtgaagtggaggcattcaataaagcatcttgtgcttcttgaccaacacacacacacacacacacacacacatacacacacacacactcacaagaacattcagacatcatctaagaaatctgaatcccatggtcattgctaaaattatgtgattacaagtttagtttaaaggaataaataatttttcataattaactggatttaaataaaactatcaccatagcaaggaattcatacagacaaatttctttatttcactgatgaagaaactgagacccaaagacagagtgcggcttactcaacattaaagcaagttaacagccaagccagcactagagcgtagctctcttgacttccagtccaatagtcttctatagtaaactgcaggaatatgacaataaaaggaaataatacagaggctttatgtgtttcatagaatctcatagttgtgagaagagcctggggtgggtaggagtgggtgataaagtaaggcaactcctctgatacacacctcccagaccaaatgctttgagggcaactctggatttttataagtatttaaaaataagattttcctgttgtcataaataaataaagaaatcactaagttatctgaatgttctttttttttaaagtctggtatggacaaacctgaaaattccaagtagatgaacacacattaaaattgtcattctaggttgatatccatgcacccatctctacttacctcaaattcctgcacacgtattgccgtgcagcttggaaagatgcatacagcttttacccatgactaatcatcacattttaccacttcaaacacaggggacagatccgtgagaaggcacagttgtttatcaaaccgttgaagtgataacacaaacaagcttctttaaaagcaaaagagcacaagagtagactgtgtgggcttcgttttgttccctttattgacccatttgcttaaattttcataaatgtttcagttgttgaacattctgctgccaaggaattcatcaaggccatagaaatatgcagctcaggtacaaagatgaagtttggaactcttggcaagagctggccttgatccactgagtttccttgccttatctctcctgttcaactcaatttcagtggatattttatgagctcctactgtgtgctacattctaggcaagacacacttggaaatggagaaaaaaataaggcataaagtccaatccaaaaggcaataaaagaaatgcataagaaaggtgcagctgtagtggttttgcaatcacttcaagttggaggcttttagtgattgagtgatcacttcaagttgaagactctccctgggaaatgataatgttgaaccagtccttaataggaaattgaggattaaaagggcagtttttgtccaggaaatgagcaaatccaggtgatctaactccataggcttcctgacatgagaaggtgctctcctcactcatttactctttgcttatattagcaggttgtcttgaggagcattagaaaggggcaaccacaaagaggcctgtggtgctggcaagaaaaacgtaaagaacactgtaatacagagacaaatcagttaagtattataataaattgcccacatccataaaaactacatccagaaaccttttccttttttaaaaaattgtattttattttaggttctgggatacatgtgtagaacgtgcaggttggttacataggtaaacgtatgccatggtggtttgctgtacctgtcaacccatcacctaggtattaagccccccatgcattagccattagtcctgatgctctccctcctcctgcccccctgacaggctccagtgtgtgttgctcccctccctgtgtccatgtgttctcgctgttcagctcccacctatgagtgagaacatgtgatgtttggctttctgttcctgtgatagtctgctgatcattatggcttccaacttcatccatgcccctgcaaaggacatgatctcattccttttctatggctgcatagtattccatggtgtatatgtaccacatttcctatatccagtctatcattaatgggcatttgggtttgttccaagactttattattgtgaatagtgctgcattaagcatacatgtgcatgtatctttataatagaatgatctatatttcctttgggtatatacccagtaatgggattgttgagtcaaatagtatttctgtttctagatccttgaggaatcaccacactcagacagcttttcaaatcatctaattcttgactctaactcattcaaaagttattgctaagtgttttatgactagactctcttattgagtgattcctcctacatccaatgttgcaactcaaggaatttacattcatactcaggatttttttgtgccctatctcatgtaatccctagaacaacccatggggtagttattaaccttgtgacaaattattatgtaccatagacttgggtcagctgctttgtatctaatcaaaacaccatgaatgttaaaagtactgatgccaaagtctggccactgtaatccacaaaagcagcaaaaggcatgctatccactgactcaattcttgtgacacatatttagaaactatacagtccatccacaattgcattgttcattgctaaacacttattatattcagtaaactgggctaaaacaaaatgataaacaaatgactatgaatagtatgttagaaagaaaccctaggcctagagacctgcataaggcccatactctgtaattaaaggacggtttcgaacttctgagtactcattttcttctactgcataagggagatgagagcagtagattttgtgatccctaagttgctttccactgtaaaaaaaagtttttaattataatattaataagatacatgcagttagatgaataaaagtttctgtcaaatgattactctccaatctaaaaattctcaaaggtgaaaactgctcattcaaggaaagaatataacctgttactcagccttagttgaggaacaagactttaatggagaaatgctttttcccaaaagagaaaatgtactctaaactaggagagaactgtgtgtgtcccaggtttagccataaatgcagaagacagaagcccactggggtttacagtttctgtcacagcaagggtgtagagaaggataggttttaggccaaaccctttgcaagaacatcataccctttcctaagctttgcagcctttccatgtttttattctttttaccatcatctatctacctgtgtgatcatggtttttaatcctataaatagactgggcttcagtacttgtctttaggtgcagaaagaaaatgggcaaatgcagaaaccagtatcactttggagacagtcttagggatagagtaagtggtaggagcaaatcagttgagtgactaaagcctgtagatggcctgagcactggctagacctggatggtcccagtacactgcggcaacagggcctgcctgggatgcactgtggccaatgacagcaattacgtgaaagagtgtgggtataaaactcttattctgtccttcaaagtaagcaaaaaaaaaaaagtcctactttttttttcaagtgaggctaagaaaacaaaatttaagataatttacatagtgacataaatgataaaaccaagaatccttacattcattattttatgatataagaggattatataatttattatgcacactcagacatttttgagagtacaaggggatatcattaattatcaccccaaaacaatataaacagagacatatggctctcatccttaaaaccctgtgttcattatccaccatttcatctgctccatttttgtagcctaagaagggagcagaatacaggtttttatgcctgtcttatagatgaggaatctgttgctcagagagctgaagtgccttgtccaagatacacaaaaggtcaccttacaatatttgaagaataatgctcaaaggattcttaaagataggaaacattaaagaacaaactaggaatcaaaacacattattaaaatgttttcaagtcaacaattccctgatgtgcttcacgaggcactcaagaatagctaggcagatcagtggaaacaaccgaggtctgcacagcatggctcaccatttgcattggctgtgaatacttagcaaaatccactggtgcctatactcccctaatagggtcttaaacccaatacaccacaccaggtggtcagactcactcaggttgacatatcctaggtcaactgaaactggagagacacgcttttgacaaagcctgtccaaatggagaatgtagaggagaaagaagcctctactgggaacccatcacacagccaccaaaccagaagaccatatgagtattctcagtttcatttagcattaagttaaaataaaagcatgactcagttcttcctcccctcttgcgatgagtgcttggaatctgttggagcaacccctggcccagctcacatcactacaagacaaaaaagtaagtaagatggtatcacccaacatcacacttcctagacagaacaggagaacttcagagaaagagctgcagagtcctaggagcatagagttgaatgaaatctaagagaacaacaccaactcctctctttatgaaatggaaagaggccttaaaatcgtgtctgagtcacattgcaaattagtggtagagctggcaaattagaggtagacctcaagcttcctgttttgtggtccacagtgctttctaactctttccatgtaataatgtacgcaagtgaattagaatggattcattatatgtgagtttgtgggttgtactgtgtctccccaaaattcatatgttgaattcctcacctacagtaactcaaaatgtaaccatattttgagatagggcccttacacaggtaatcaagttaaaatgaggtcattagggtgggctttaatccagtatgattggcatcctcagaaaatggatatttacatgcaaatatacacacagggagaacactatggaaagatgaaggcagcagtgagggcaaggaatggcaaaaattgccaacaaacaacttgaagctaaggaagaggcatggaatggaacagactatccctaatatttctaagaaggatccatccttgctgatacctcagcctcagacttccagcctccagaatggggagaaaatacatttctgttattgaagccgctcagtttgtggtactttgttacagcagccctagaaaacgaattcggtgagtttgagatagaggcgcagtgttcctccagtgtctagtaagtcactcatctgccatatggatttgctcaccctgtagtgactgttgtcctaaccccagcctaaacatgtgccacaaagattgcttgactttacgtagcatgaaaagtccacacctcaacacatacaataaagacggcctgtcaaacagtgaccttcctccttcctcaccttccaaactattacctcccccaactcccacactgagagttaactgggcctagttctataggcaaaagtaagccccacattgataataactggtgaacttcagggttgagatgaccgtagccttccccctattcctgatctcacctatacagatgagtaggccaaagaaaaactcctgaggttgtgtcaggcaaacttgaggacataccgtgatgctgtcagagttctggcccagagcgttttatacatacacagggagagaatttttttcactttgaacagaatttccagttgtttcaatatgaatattttctaatcattttactagctagttcaatatattggtttttcttcttctaacagaaagatacaaaaggctccaaagaatagaaactctaaaattggaaactgaaaaaacaaaatagccatatgttctatgcctgagcagaatgctttggcaccaatggacgcaatgtgacctcaaccttttattatatttttcaatgcaagctgccccacccagagacatatgatgatgcaaaagacagatcctggcctgtcttccgtctcacacagagctggtaccctaagcggactcccaggcattagaagttctgaatttggcagtcctaatccatacgtctggggcaggctgactgagaatccattcatcagaagaggaaacactggagtcatttccagattaagtcctggcactatattctctacaaatagaaagtaattgtattggtagtgagtaagcctagccgggcttactgtctaaatgctttctaaagctactctatcataagtaaaacatcataagaacagttatacaatatagtcctcacttttgggttttcaattatacaagttgctatcacaacactcaatgacaaaatgactaacctctagttactatgagccttgactatgtgacaggctaaatgttccaaatgcttttcacttattattgtgtgctcatctttacaaaacccttgtgaggtaggtactcttactattcccacctcacaggtgaggaacacaggtaaagacatggttgagtaaattactcaaattcacccagctaataaatggcagatacagaatgtgaagccaagctgactgcagagctcatgcttagaaaccactatcctggtctgcttcttgcactgagggccaccattactgtcacttttttctctccaactctgaacttttttgaagtcagtgaggatccccttctcagctcttccacctgcatttaatgactgttgttgaaagactcaaactcgttcatgtccttatgctctaaccaggaaacaatttctccctccactcaactttctcagtttctcatcgatgacaatttttgcctggtagttgtttacataccttaaacctccctcctttccccacagcttatatatgtgcaaaattcatagctaagttatttctgcaatttccccgaagcccaccatattcccttgcatttagtaagaagttctccataaacatttacgggataaagaaaaacagggtcagtgcatggcggtaaagaatccagggccttcctgagagccagcccaggcccagcttatctttcgtaaggtccatttcaatgggcccttagacagtgctcactgggtaatgtggaagacctggaattcactccagagcagtggttctcaatctttaatatgcttcagagtcccctgaagaccttgctgggcctactccagagtttctgactcaggggttatgcgggtgaggcccaagaattttcattcttaagtagttccctggtgaggttaacagtgcagatttgggggccacacttttgagaatctccgctctggatcccagctttggagaataggaagtattttaagcgaaaaagaaatgagtagatagtgagaagctccttggtggagtaagggtatgcagcaaatagaggaggcacggaaggtcatatttagatgggaaatagaagcagcagggtaagtctgggatgcaagaatgtacaaagtgaggcacaggaagataggcagaaaatgtggagttgacacgaaagataagcagttctgctccaacttcagatcacaaagagatctagccaggcatggtggttcaatcctgtaatctcagcactttggcagggcaagacaggtggatcacttgaggtcaggagttcaagaccagcctggacaagatggcaaaagcccatctctacaaagaatacaaaaattagtcaggtgtggtggtgcatgcctgtaatcccagctactcaggaggtgggaggtcagaggtgggaggatggtttgagccctggagtttgaggctgcagtgagctgtgattgtgccaccgcactccaacctgggtgacagagcaggaccctttctcctcaccgtcccccaccccagcctgccaaccaaaaaaaaaaatcatagatagacatctagattcatcttctcatacagggaggccccagatcccgtccaccactgccaaccagggatcacacccaaaggccaaacaccttattattctaaagcttctaaatcacgatggctgctttttgtggcttctccatacagctgcacattatcaagggagccagctaaccaggccatggggcttcagacttgggagccgaggactttatgtttcagtggcagggaaggagagagtaattcttcctgagctggggcagcataaaatcctctcttctactccctgacaccaggtgtatgcctgatagtaaaacatcacattttaaaagtggaaataacaaaaacaaacattttatctggctcccatgttggtgaaagatttctatactaagggcttttttttcctttactggaaaaaatagcttatcgatgtttcgcattgcctcagtgtgaagaaagcagtttgtaaaagtcagaaacagataccgtagggagtcagaaatagatactgtcaagggaggaattttgttgggtcctcagaaaagtctggaagtggacaccactgttccaaaccttattttgaacaaagagctagaaaaagtggggaatgattagaagattaatgccataaccaggtgaaaaacaagatgactgctgccgaaggaaatggtgcaaagggcacaagggactatgcccaggacacaaggggaaagaggtccaaggagctggaagagctataaacccaacggactccagcaggaaagcaggtggtggtggccttcggttgggaggtggtagtggggggaggttatgaagaaaggagtttttgcaggggttattcaggtcatcacatggtgaaagccaaagaggtcagactgtgttgtgaggactggagcggacagaagaaaactttccgcaatgaaaaagaccagtgattgcacagcaggaaacccaataggaaacgtgagaggcataagaacagcccagccagacaagctgtggttcacaatgtgacttgcttcctctcttttaaccatagcatctacatttataaatgaatacattctattaagttttctctgagggtcctcctagctcccaaatccattaggaagtatattcttgcattcattcagtccacaagaacttaagcacttactatttgccaggtcattagatgctagactcataataataaacaaaagtgtccctacctataaagcccaggctcatgagcttccaggatcaaagaataggaatagttggaagctactctaaatgagactaaataatgtatttacataaagacatttagtaagggcctgtgctgggctcagctgaacaagtcttcaggttatttggttgttcaataatataggcagcttgggaatatacttgtaaacattttatttattcaatactgtttctgtctataagccacctggctcaatataatatagagcacagaattaatgtcttcttaaaaatgataaagggtcagaataagggaggccagttaggcctccactgcagaagataagaggtgaggaatgtgaactgagacagcagaaccaaagggatataacaatgtaaactagagacgataaaaggggtgacataaagtcagactaggtgaggaaagggctgccttaggaatgactaagtttccactctgagtgcctatgtagattgtggtgtcatttggcaaggtgagaaaagcagaagggagtgactgaggagaagacaaagagctcagctggagtcagtagagttcgaggtgctttggttctgaagtccaggagaaagttctagactggaagaatacaagtcgtgagattctaggcggcaggtgaagacaagaagtagatgatagtggctagattgaggcctctgccttgcctctaccaatctctaaaaatccctgtgaccagagggatttagaaatgaataaagaaagagcatgaaagagaaaaagtcagttaactggaagtcattttttaaagttttctattttttcctttcccaaatatcacccagatcctccttttttcaaggaaatatctttattcttgctttacagatgggcatacagggagcaatgatgtatgctcatcacccagatatttactccagaagctggctgaggtcataaaaatcatctagtcagccaacacctacatgcagaagaggaggaaaggcaacatgctgagggtcaccatagaatgactgcattttttaaaaatttgtgccccaagaaaaaaacacacatacaatgtttcatagacattccatagtgtcagattgggaagccattcttctctgcccaccctttttataaaaatggagatgttaagacagtgacaggtagaatggtttgcccatcattttctcatgagttgactgagtcagacagtcagaatctgggctcttgatttctcttttataataagtttccttagaccgggagaaatggtgacacacatctcaagttttatgtttcagtaattctcccagcagtggtctaaagaaccctcattaaccatatggcagccctggtacaagcaaggtaaacagcagacacccaatattatctgctataagcccctgaacgcacacagctggtgcacacacagtcatgcatgttttttccaatccccattgtttcccatgtaaattttgcatgaaaatttccgtccgggtcccaaatctgaggtcttgagataagaaaacctaaatctaaccctgactccagctccacctctgctgtttactaataactagcttgggagattctcttcacctctggatctcagtttcctcacctgtcaagtgagaggtttagactaaatgatttctaagattcattcctcctcaacattgtatgaggtcccaatagataacttatttaatatgaaatatcatcctctgagaattacagtgttatacaacaaagaatttggtctttgtcctgggcttctgggatggagactcgaaacctttgaaatttcccaaatcatcagagtgtctgtgattcatgctgggcccatgaaccacacctgagtttgagttaaggaggtgtctctggatgcgggctagtcctgccagaaagaccaaacatgtaattagagggttgcaactttgagccatgggtcagaaggagagggaagttgtaggttgacttcgttcatgtggccaatgactcaatcggtcatgcctaagtaataaaaccctaataaaaactctggaccttgaggctctggtgagcttccttgttggggaatgtatcaatgtgccagaagggtgacatgctgtcatggggagagggcataaaagctcaatatttgaaactcttagaaacctcactctatgtgtctcttcgtttggctgcttctgaatcgtatccctaataatagaactataatcctaatactttactgggttttgtgaattgttttaatgaattatctaacctgagagggtcatgggaaatccccttccaaatttgtattcagttggtgagcagtgaaagcagcccaaggaacccgaactggcagccagcgtctgaaatcagtgcaatcttgttggggattgcgtccttaacctgtggagtcagtgctaactctgagcggttagtgtcagatttgacttgcagcattacgtacaatatacctactagacaataattataatttatatgtgttctcagacaagtaaatggactctaaacaccttctacaagtgctccttggcttacagttactggtgtgctgtggtggcagcatcggtgttatgtgattataagagactagctactgatagtgttttcaaatcatggttatgttggtgtgatgaatgacataaaaaattgtttcaagatgtcaaagaggacacacttgtctgcaccagcacctcctaacagggcttaaaacagaaacatttccccgctctattaagcagctgttacaaagtttaaaaaaaaatttttttctagggggcagccatcattattcaggtgttgaataaagccctgcctaatatatcatctctttaaatgctactctgcggggcttatttttatcactctcaagcaattcaaatgttggtcatccagaaaattcatttctttctttccttcctaaaggcacaggcaacagaattgaaatcactgatgtaaactgagccaaaacagacttaggaatatctttctgttcggctgcaactcaacctccattccctgcgcaataggaagcatcaattaactgatcataaccagcagaagaaagaatatctggaattcttttgtgaaaggtcaacttaagttccagagtcgttctcatcctgtatgatgctgtaagagaccagcatctcccttccatgatacccagtccctgtattcctaagagtcatcttgggagtgcctgctctcgatgcaacatcttagaatcctctcccaaaggttatgaatcggtagttttaagtttgatcccattaacctgcatggttcaacccttccaggtaattctgacacaggcgatctgcagaaacactctctgttgcttttccccaaaggtcaccactgagagggcacatgctgtccaagctgcctgtgttaacggggttaaaacggaaatacgcatcagacccaccagaagatctgtgatacaatgttagtgagcagtgagtaatcatcacgagtgatttgttataaaaacagatctaaagctccttgactctgaacatgccaatcaagaccaactgatcagggtttgtttttttttcatttggaaaaaggtcaagcagctgcccgtttgcttttttctctccagggccattttaggaagttcatctgctctaaacagctgttctcaagtagaattgatccctgcagaaaaatgactgtgggaccacactccagaggtgacatatgttaaactatttttcagtttcagcttacctttgaaaagcatataagaatagcagtctctcttttcagtgattcaaaatcagggtttaaaagcgtattttgatgatcatcatcaaatttctataaagtgttatgtttataatgctctctttttagttgtcatgacttatatttagataacactttttctttatccattcaatatttttcagtctacaaagttcattcatatcatagtcttcattacaatccttcaagcaggcaaggaatctataataatattaacccagggcagatagtaataaacacaacgtggatgagggagactgaccttgttgttcaaatgtcaactcccctatttacttgtgttatgtggccttgggcatatttacctccttgtgcctcagtttcttcatctgtagaatgaagataatagtatccacatcatagtgttgttgtaaagattacaaagttagtatcttttttttttgagacagagtctcgttctgtcacccaggctggagtgcagtgacacgacctcagctcactgcaacctctgcctcccagttcacgccattctccagcctcagcctcccaagtagctgggattacaggggcccgccaccacgcccggctaatttttttgtatttttagtagagatggggtttcaccgtgttagtcaggatggttttgatctcttgacctcgtgatccgcccgcctcggcctcccaaagtgctgggattacaggcgtgagccactgtgcctggcctacaaagttaatatctctaaagtgtttagaacacagtaagcactataaaagtttgtgaaataaaattatactcaacaagcatttgagtgctcacaaccaaataacaaaggcacagggataaaagatttacaccccagttcctgttctccaagagctcgcaaagcagaactgagagggagacaaaaattcaaataactgtaaaacagtttcttaggtatcgtgagagagtagtgggggcacatcagacaaggggaaaggtagggaaggaggtgacagcaggtaccagcacggaggagagtataaatagatagcagaaatttcccaggaaaaccggaaggatggaagagggagagaatcggacttcaggctaagggtgcaatatttgagaaaaataataatacttccaaatctttcctatctattatatataaggactgtgataaaaagatttacttactttgtttttgaatcctgacaatagtattttaaggttgtcctcactgttatcattttttaaattaagaacatgggacttagaaaagcttacagtatatttctccaggagaatatactgtaagtggcagagcccatctgtctccatgactgacactgaacaggctgtctctcaggcactcctgagccctggaggcaaagcgtggcgcaatcagggatgttgtgaagaatggagaaggaaggagctagaaagagttggaaggtgaaaagaagggcttttcatgtgctgatttcgtattcatataggatagatgtgagcatgtcgattagctgagaagtcagtagagaggatgaaaatatcagcgtcttagaagtaggtgctgatgcagcatcccacaagacacaggaggtgacagcatctaggggaaaccttgactggcttaaaatgaaaggagagccaactcttgctctgaacaaagaagagagaaagacaggcacagaggcaagtttataaatgataaaaagggtcagaaagttggaaccgagactgaaatgtaggcttgtatgatcttagcgaggagagtcactgaagtcaatggaagacatcccacaccactccccatcaccacaaccccaaaaagtgtccagtttgggcacccaccattctatctcaccgacctcatgccccggttgttctgaatgtagtgccattgtttattaagatattaacttacatttgttcttctctttttcctgtgctatttgaagtgggttacttaaggtagtatttccttgactcaggtattttttcaataagaaaaacagaagttatttggagatcacaggtcttagaaaagactatactcagcaaggagatgtgtaaggctcagggatggaggtatatgagggaaagagatttcttaagaatatctatatgtaacaaaactgcacgttctgcacatgtaatcgagaacttaaagtacaaaaaaaagacaatgacttttttctctaatttttttttttttttttttttttttttttttgagacggagtgtccctctgtcacacaggctggagtgcagtggtgccatctcggctcactgcaagctccggcttctgggttcatgccattctcctgcctcagcctcccgagtagctgggactacaggcacccgccaccacaactggataatttttttgtatttttagtagagacggggtttcaccatcttagccaggatggtctccatctcctgacctcgtgatctgcccgccttggcctcccaaagtgctgggattacaggtgtgagtcaccgtgcccagccctctgatttatttttaataaaatagtctctcacatcaaaaaaaaaaaaaaaagaatctctagatgagacaaatatttgccttgggactaaaaacatatacacaggggtattaagaggaagcagggtggagacagtcagtagcattctggggagtgatggccatgtgacttgcctggggatctgaaccccaggcaaagggcagttcttggtggcagtgaagactctcacgccccacacatggcacatattccataacagtggccaatgaccacaaatgggttaaggctcataagacccaggcagaactttgactctgcctggtaggtgggataaggtccaatagtgactgacaaataattcaccaccaaggagaggtagtcaaagtcagaattgggttggcctaatttaaaggaaacaaagaacagctgctgtctctaaaggagctccggcccaggggcccagccatcaccaccatgtccacacccaaggttgtcccctgcagcaggctagggcatgcacccaaccctgcccctgtacctgtgcatgtgtaagtagcaggccccaccccccagctcctgcctccaccactattcttgtacccagaactggcccttgcagctgcctaggtgtgcatatctccagctcaggcccactactgcctacacacatgtagtcagcctgacccctgtcccaacccgcagctgacacctgccatcatgcatgtgtacactgccaacctctgccacaacatgtgcacatgcagtcagtcctagccccttcctttgctgccagcccttgccacgatgcacaagcttgccactgaccttggctgccacacacatgccttcagccagcaactgaccttggctgccacacacatgccttcagccagcaactgacctttgctgccacacacatgccttcagccagccgccacagctgagcacacgcacaccactgactatggtccccatcactttctgccccagccccttgccaccaaactcagagacactactgaggaccctcacagccatagcagacctcacacagctcttgccaccaagaacgacctaattgccaatgtcatggacccccagctttctgagccaatgagacaccacatccaccccttgacctggagctactgtatacttccattcatggtgccccacaccactacacctggtgccatggcacgccccagcatgcatccctctataaccaccccccaacctctgccacaggtgagggtcttctcttaccaaaaccagtctataaagtttggaaaaagaatgcacgcatcaaatgctacatttgtaaggctttgtaaggctacaagaattatgaagaatcagaggaatatgaaaccaaaggaacacaataaacttctaataagtgaccttaaagaattggacattgtctatggccataccactctgaatatgcccaatcctgtctgatctcagaagaattggagattcatgaattttataacaaagaattcaaaataattctctaaagaagctcagtaaaaaataaaacagtatagagatttctgaaaaactaaaaatactattactatataatccagcattttcaccaatggatatttattcaaagaaaaggaaatcagtatgtcaaaaggatacatgcacccccgtgtgtattgcagcagtattcacaatagcaaaaacatggaatcaacctaaaaattcatcagtggacaaacggataaataaaatgtgggatatatatataatgaaatactatctagccataaaaaaataaaattatgtcatttgcagcaacgtggactgaattggttggaggtgatgttaagtgaaataagccaatcacagaaagacatatgttctcactcatatgtgggagctaaacaagtcaatgtccaggatgtagagagtacaatgatagatatcagaagatggaaggggtatatggatgttggcgataaagtaaggttggttaataggtacaaacacatagatagatagaaggaatacattctaatgtttgataccagagtaaggtgactacaggtaacaacaatgtattatatatttcaaaatagctggaagggagaatttgaaatgttcccaacacatagaaatgataaatacttaaagtgatgtataccctaaatatcctgacttgatcattacacattctatgtatgtaacaaagtatcacatgcacctcatgaatatgtacaaatatgtatcgttttaaaagaagttcagcaaacaagagagcacaaaaaacagtttaaaaaattaggaaacaataaaagaacaaaattataagctcaacaaaatgatagaaaacattagaaaataaccaaacagaaattttggagctaaataatacaatgactgaacaacagaatggaatagagagcttgaagaagaatagatcatgcagaagaaataataagcaaactagaagacagattgttttatatcatatagtaagagtagaaaaaagaaaaaaaggaatgaaaattttatgtgatatataaaacaccatcaagagagctattttttgcataataggattttcagaagaacagagagagaaagggacagaaaaccattatttagaaaaataatggctaaaaacttcccacctggggaaagaaatgaacatgcaggtacatgaagctcaaaggaattcaaccaaattcaacccaaagaagagttcaccaagatacattacaataaaaaattaagaactaagaaagaactttaaaagcaggaagaaaaaaaaagcaaatcacatacaagtgaataccaataaggccattatagatttcttagtagaaaccttgcaagccaagtgagagtgatgatgtactcaaaatgtggaaagaaataaaactgccagccaaaaatacattacatagcaaagctgtctttcagaaaagagggagaaaaaagacattcacagacaaataaaagctgagggagttcatcaccactggaattgctttataagaaatgctaaagagacttatttgggatgaaacaaaaggcttactaattagtaacataaaaacatatgaaagcataaaactcactgaaaatgtaaatatatagtcaaaatcagaataccataatactgaaatggttgtgtgtaagttgcttatagtgccactataaagattgaaaggaaaaaaagtatttgaaataactacagctacattaacttgttaatggtgatatacaatataaaaagaaataaactgtgacatcaacaacataaaatgtggggaaatggtaaaaccataaagctttgcctgtgatcaaagtgggtatcagcttaaagtagacatacaggtataactataaaatgttttacataagcttcatggtaactacaaagcaaaaacttatagtagatgcagaaaagataagaaagaaatcaaaccacaacactacaaaaaaaaaaaaaaaaaaatcacccaatcacaaagtaagacagcaagagaggaaggaaggatctacaaaatatccagaaaatgattaatgaaatatcaatagtaaatccttatctatcaataattactttaaatgtaagtggactacatttgtcaatcaaaagacatagagtggataaattatttaaaaaagacaagacccaaatatatgctgctgacatgagactcatttcacctttaagaacatacacagactgaagatatttagtgcaaatggaaacttaaagagagcagaggtagcttttatattggaaaagctagacgttaagccaaaaactgttataagggacaaataaggtcattatataatgatgaaggggtcaatgcatcaagagtctaccacaatgataaatatataggtatccaacataagaacaccaaaacatataaagcaaatattaacagatccgaagggggaaataaacaggaatacaataatagaagtgggtgtcaatacccactttcaacaatggatagattatctagacaaaatatcaatcataaactattagacttgaattactcttcagtacaaatgagcctaacagccatttacagaacattctatccatcagcaacagaaaacacattcttcttaatggcacacggaacattgtcgagtatagattaaatgtggggtcacaaaacaaggctgtgtaaatgcaagaatattgaaatcatattaagtatcttttccaaccacaatggtatgaaactagaaaccaataaaaggagaaaaatctagaaaattcataaatatgtggaaattaaagtaaatacttctaaacaaccgatgagtcaaagaaaaaaatcaaaagtgaaattttaaactctcttaaatcaaacaaaaatggaaatacaacacactaaaaactatggatactgtaaaagcactcctaagtaggatgttggcagcagtgaatgcctacattaaaaagaagaaagaccttaaataaacaacttaacattctacctcaaaaaactagaaaaagaaaaagaaactaagtccaaagttagcagaagaaaaaaagtaataaagctcacagcagaaataaatcaaatagaaactagaactatttaaaaatcaaaactaagagttgagtttttgaaaaaataaaattaacaaacttttagcttgaatcactaagaatttaaaaaaagacacgagataaaaaacgaaagtggaaacattacaataaatgcctcagaaataaaaaggacatgaaggactatcatgaaaaattatctgtaaacaaatttgatagcctaagagaaatggaaaattcctagaaacatacaaccttctaagattgaatcacaaagaaagagaaatcatgaacatacaaataacacataaagagattaatgtagtaattaaaaacctctcaacaaagtaaagcccaggaccagatgccttgatggttgaattctaccagacatttaaggaataattaatatccatcctattcatctattttaaaaaatagaagtagagaaaatacatacaaacccattttatgaggccactattatcctgatatgaaggccggaaaaatatagcacaggaaaggaaaacaacaggccaatacctctgatgaacatcgatgcaaaaatcttcaataaaatactagtaaaccaagttttacaactcatctaaaaagttatacattgtgactatgtgagattatccctggggagcaaggttggtttaacataggtaaattaaccaatgtgatacaccactttaacaatataaaagattaaaaaccacatgatcaggccagatgcggtggctcacacctgtattcccagcactttggaagccaaggcaggcagatcgctagagctcaggcattcaagaccagcctggacaatgtggtgaaaccctgtctctactaaaaatacaaaaattagccaggtgtggtggtgtggttcctgtggtcctggctacctgggaggctgagctgggaggatcacttgagcctgcagagtggaagttgcagtgagctaagatcacaccactataatccagcagcctgggtgacagagtcagcagaccctgtctaaaaaaaaaaaaaaaaatcattttaataaatgcagaaaaagcatttgacaaagtttgacatcgtttcatgataaaaactcacaaaaaataggcatcaaagaaaatttactcaacatattataagccatttatgaatagtctacatgacaatcaatgggagaaaaccagaagcttttctctagggtctggcttaaggcaaggatgcctactctcaccacttctattcaacacagtattggaagtaccagcaagaataaccagaaaagaaaaaaaaaaataaaaggtatccaaatataaactatcctatttgcaggtgacatgatcctttatgtagaaaaccctaaagacttcacaacaaactcttagaatggttttagtaaagttgcaggattaaaaaaatacaaaaatcaattgtatatctttacactaaatattacctgtccaaaaaagaaatcaagaaaataagcccatttataatagcattaaaaaaatacaatggttagaaataaattcaaccaaagaggtgaaagatctgtatactgaaaaccataaggtgaaataaattgaagaagatacaaataaaagatatgtcttgttcatatattgaaatattaataatgttaaaatttttatactcaaagcaatatacagattcaacacaatccctcttataatttcacttttcatggaaattggaaaattaattctaaaatttttatggaacaacaaaagtccctgaatagccaaagcagtcctgtaaaagaaaaacaaagttggaggcatcacacttcccgatttcaaattatattaccaagataaaaacaatatagtactaccatgaaaaccgacacatagactaatggaatagaatagggaggccagaaataaacccaggcatatatagtcaactaatttctgaaaggggaagaaaatacaatgaagaaaggagagtctcttcaataaatgatgttgggaaatctatatatccacatcaaaacaataaaatcagaaccttatcttacactacaaaatactcaactcaatatgaattaaagatctaaacacagagccgtaaaactcctagaagaatacatgtgaaaaagacttactaatattttcctttgcagtgatttttattattgttttttggctgagacatcaagcatgggcaacaaaagaaaaaataaacaagtgtcactacattaaacaaaaaaatttctgcccagcaaagaaaacaataaacagaatggaaaagcagactaaagattgggagaaaatatttgtgaaccatgtatctgataaggagttaatatccaaaatataaggaactcacaactcaataacaaaaatcaaataactcacttttaaaataggtgagagacctgaatagacatttctccaaggaggacataaaaatataaaacaggtatgtgaaaaggtgctcaacgtcattacgatatgcaaatcaaaactacgatgagatatcacctcacacctgttaggatggttattattaaaaggacaagacataaaaaatgttggcaagggtggtgagaaaggagaacagttatacgttgttagtgggaatgtaaattggtgtagctattatgacgaacagtatgaaagttcctcaaaaaattaaaaatacaactatcacatgtcccagcaatccctcttctgggtatacacccaaaggaaatgaaatcagtactttatcaagatacctgcattcccatgttcacttcagcattattcacaatagccaagataatggaaacaatctacgtgttcatcaacagatgaatggaaaagaaattgtggtgtatatacatatatgtgtgtgtacatatatacacatacatatatatacatatacgtacatatatacatatatatgtacgtagagatggggtatatacgtatacgtacatatatatacatatatatgtacacagtaaaatagtatacagtaaaatagtatacagccttcaaaaaaggagaccctgctatttgcaacaacatggatgaacctggagaacattatgctaagtgaaataagccaggcacagagaggcatacactgtatcactcttatatgtggaaactaaaaaacagtcaaatacatagaaacagagagaggaatgctggttaccaaagttggaaggtggggagaaatggggaggtgaaggtcaaagggtaaagagttgcagttgtgtaggataagtagagatctagtgtacagcataaggactactgtgaataatatttgtacatatactaaaaatttgctaggggagtagattttaggtgttcttaacaaaaaaaaagataactatgtgagacgacagatgtgtcaactggcttgacagtagtaatcatttcactgtgtctatgtgtatcaaaacatcatgtaaccttaaatatatacaatcagaaaaaaagaaaacaaaagcatatttatctctgagttgatagattacaagtcatattcaacacattatttgctattccaaatacaaacctagcatttttcgttgtgtcttattcacattgttcctttcaccttgcccatgactttctctactctgcagactctgaatgtcccaaacttaccttctgtccataaataattcaaatgccacctcctagattaagacttcattctttgaggtggaaggtaagggagaaatgtccctttgtgttccattatcattttgcatgtacatatacgtgaattctgttaaactgcaggctcttagggaagatatcactcataccagaaactttcctatcacctactctgatgaccttcatgtatgtagtaggttcacaggaaatgtcttatgtcagttttttcagttaacaaactaactaataaaatgtgagaattcaacctgagatcagtgagctttacttacttaaggaattctagttcaggatttatcaatcaaatatttaaaattctattagaattttccctcactcaaagtatgattcctatggatgaggggttgtttacccagcagactaagttttgcctacttattgggtcaattagttggcgaggatgaggcactcactttctgcacgttttatatccttaagggctgggtgccagtggctaatgccagtgatactagtactttaggaggccatggagggtggatcacttaaggtcagaagttcaagaccagcctggccaacatggtgaaaccccatctctactaaaaatacaaaaattagccagtcatggtggcatgcaccagtaatcccagctacttgggaggctaaggcaggagaatcacttgaatccaggaggcagcggttgcactgagctgagatctcactactgcactccaacctgggtgacggagaaagattctgtttaatggtgggctatgaagctctctgcacatgtgtttttctgtgatgctaagctcagctttttttttttttttaatcatttcctaacagtaagcaatagtggaaaaccccatttgtacccaccagtatgttccagctgcatgatctctgttgtcttgttctgaattcttaccctttcctataagtgaggccagaaggtttttgcagagaagctctgagcaagtgactgatgctagcaattcttatcagattcactcattgagggcaccatgtgggcaatggctgcagagcttttcagtgtgtttgcacttctagaatcagcaaacagatgagggaggagcccagaacagctggtggagaaaataagagcaggtgggttcagagaaaaagggttgtttttctttcaaaagctagtacattgcaggcatgctatgaagggattgtggagtgggaagtgactgcagccaagagactgctggaacaagaggcacaaagcttgggtatgaagcctgacttcactacttactaaatgggtgaccttggcttagtcacccaatgaggctaattctctatttccttaccgtaatcagaagaaattattgttctgtaggctttatagcaatgttcttaaacttaaaggggctagcggtcttgttaaatgtgaattctagctcagtaggtctgtgtggggcatttctaacaagattcgggtgatacagatgtgctggtttgtatcattttatataacaaggccacactagattgaagaggagactaaatgaggtaagggatagggaaaagctttataaactgtaatgcattttttttaaaagtgattttatgattagcaataataaaaacaggtgctttctatttagtacagcatttcctaggattgtttgccccccacactaccctgaagatctgaacttctttttaagggcttccccaccctcccccgcctctcagttagttctcaatatggttggttccagcccaagggctgacttctcctgctgacagaagcaatgggatcagcattttccagaaggcagcaggctaatgtggtgatttagcaatgcaatgattccccaaaggttactagaggggctctgaggaaccttgtagaaaaacacacagctctcttaaatgaaagatggtctgagtctacaacaactcttcgaaggtatacattagacttgcattgcttttggaaacagaatagaaagaatttcacttcttgcaaactactttgcatttcttgtctctcccatcagcaatctgaggctcttgcatcagaagagaaatgcacattctctaaggggaaattattgatactgtcccaaatttctgatatacaagggcactcactgaaggtcaactcccatccccagtttagtattcaggaggcacttattatttcaacctggcagaaggctcaaatgttacttgcctgaaggagctggttatggcagaaagcaccctataatagggagaaggtggactgactagtcccaggagtgttgccttgcatatctgagatttgactgtgacagaagccactggtcaggagacatgggccatgaagatggagatgtactgtggcctcaccaaagttcatctccaacattctcactttcactgacttcactggcttccttgatgctttgcaaatatgccaagcacacgactccttagaggacttgcatttgctgttccctccatctgaaatgctgctctcccaaatagaccattgtttgctcattgctgctcccttgcctaattcaagtgcttgtgcaaatgttgcctcttcagtgaggtctttcatgacctacctaagtaaaattctaaattaatccgctaatgtctcctaaaatcccctgtccccttgcctgatcttttttttttcatgatacttgccaacatctgacataaaatgttctatttatttgatagtctctctcccatcacagaaggtaaacttcataaactcagacaactctattggcttttgttcactgctctatataaagcagtgcttagcacacaataagtctcaagaaatattggtgaattaacaaatcaatattttaatgaattaactaatcaattaataagagggttattaaagtattgaatctcagataatgtgcatgctcatcaaaactatatactatatatgacctcctctaacaaagttgtttactcaaaaatgtattgttctggactaggagataaatgaagtcagtataaccaagttttgtttatgtagctgtataagtttatacaggccctttcctagcctcagtcttttatcacaaaatacaggaattacaccaggttctaagtcccttctaaacaccaatatcatataataccaaaaataagaatagcaatggctgtatacacaacaacaataataaaaatatttactgagtgttaatatgcgtcagacattatcctgaggacacagaagccataaaagtgagtaaacatagacttcattcaattccattaaaccttactcactgacagtgggaagaagacaaaatacaaaaatttaatgaatcattaaatattaatccaaattcatacactgagcagaaatgatgaatttttatattcctgtcagctttataatttacctttggttctctggagatgtgaaacagttagatacttgccaatgatggtcaaatagcaacagatcttcccccaaaaggtgagaatcacctccatttttcaaaaagaaaccacaaaataccagtgagaagaccttagttgtcaatacacctcaccctttcagagtgctcatcacattgttcacttccattttcagtattagtcccctttgaccctttcagaaaagttccgtatgttaatgctttaaagagagttatatgtcatgaaagagttgtcttccctctttctgtataaagatatgggtgataactttgtcttagccactaaaaacctgccatcagtgtttcccgataaatccttataacccatttgcagctttcagttttgtttttccttcttattcctggtttctagtcctcacctatctccaaataccagccatgtctttttcctggcttcaagttttacatctctcagaggagggtttgggcaacacatcatccatgccatttgcaactctttcattttgttataccttagtgttttctgcaacaaggaaatctctttaaacttatctactcttccctttcctacacgatttcaagtcatagaaaaggaatgagtcagtggtaatcatggctctcaaaaagctatacttgaaacatcagcaccactgctaggtgtgaaaaattccaagtaataactattcggtcatggtggggtgcaatatatccacgcctacacgcttatttctattttataaaagaagagcacaatgatctaggacacgttacaaatattgcataatttctaaatgcaaatcaatcaaaatcaacacatctgttcctcttcagccacactagcagaaagtcaccactctaacaaaataagccatcacctgcagtacttggaaagaggtgcatttctcaatttatcctgagcttgacctcccattccaattaattttgtgtagtcaactctaatgaaatattagatcactcagtaagtattcagaagtagtgcagagacatgcaaaagccctgatgtaaggcttgatgcaagatcttgatgtaagttctctctccagcactctctgagcttctagttcctcatctttaggaggaaggcctgagagacaatgtcccatgctggagtaagttatttcatcatacctaatcatttcattgtatccttctcttaagagatattaacagatgaaaactgcaattacccttgctgaatccctgagatgctcccatcacctctaacacaagatagaacccaaatctctcctttctaagtggaaagaaaaactacagtacttcttacaaaatcacttcagatgcctgagggtggtaattagcacgtttccagagctctctctttttcaggttaagcaacgtcagttctcttaacctgccattaaagtgctcattttatatacatactctgtctatttttatgagcttcttctaaactgcagtccaaaaatggacacaatgctttaacaatatccaagtaatataacatataaacaaagatcacattcataaaaccagaaaattgggcttttcttagaaaaaattaaattgtagccacagttattgaaatttaaggctcactatatttaatgtgttcatataaagtaaaattagaattttacttagcaataaaacaaatccaaataaagtcctgtcacatcataataaaaagatacatttcatttttaaagatttgtcactgaaactgaggcaaggatggaagcaataactctgaccaccatatctccttgttttatgtttaactacttaacatgtttgagcagatacattattaaaggcatttgaggccacaaaagagtcaaacttccttgaaatgttagtactgtacaatatgaaaaccagaaataaaattctaaggcctccaacaacttatagaacccttcttggctaaaagcattccaaataaacctggaactctagtttaggccatgatgggaagaggggggtcggacatgcctcattatacattgctcctttggaattcaggcacaactgaccagcattaacattcaaacagagatcttaagattgacaaaatagactctttgtagcaataaaattccaacatgactggtagcaggccctgaaagaaattgaagtatgttactccaaaatatatttttttgacatattttgaaatggccctgtaaagctgtctcttgtaaggaaatctacattatgtagagaatcctcttcccttttctgatcttttccctagtccaggagataattcactaagaggagtctggcacctttttaagtctgataaaagctcagatgcctggtacctggaggtttcatttgcatgataaaaccccttggtttccacaaccctttatcttaacccagacactccttgctattgattccaggtgttcagataataactgtttcaagcaattgtcaatcagaaaatctttgaatctacctatgacctgggagccctgcccctttgagttgtcctgtctttccagatggaaccaacatacatcttacaggtattgactgatgacatgtctccctaaaacgtataaaaccaagccgtagcccgaccactctgggcacatgttcttggtatctcctctggctatgtcatgggttatggtcctcatatttggctcagaataaatttaatcaaatattttacacagtgaaactcttttcatcaacaagcagtagtaactttaaacaccacattaattatttttcaaagaattcatgtaaaaatattgtgctgacagaaaaacagcaaccaagagaattttaggcacctcccatatcaaatgaagttctacttgctgcgatctttactctgactgtggtatagcggcaagaaaactggtctcagagaccataattatagtcctgattttgtgattgagcaagacacatcttttatgaaaataattttattttatgaaaaaaggcatattatattcattatctgtaaagttagattattttttaaattatatatttaaagtatacaacatgatgttttcatatatagtgaaatgattactacagtcaagccaattaccatttccatcatctcagatagcatttttttgtaagagcacctaaaatctgctcttagcaaattcccagtatataatacaatacaatgttattaacaatagccctcattctgtacattagatcttcaaacttattcatcctacataactgaaactttttaccctccctcccttagcacctcccaccacaactctaataacctggtaaccaccattctactgtctatttctatgtattcgactttttaaaaaatattccacgtataagtgagatcatgcatactttcctttctgtgtctggcttatttcccttaatgggatgatctccaagttcatccatgttgtcacaaatgtcaggctctcctttcttaaaggctgaattgtagtttattatatatataccacagtttcttcatccatttacctttctatggacacttaggttgtttccatatcttggctattgtggataattctaaagttaggtaatggaactaaggtttctcctagctttgtgatcacaaacaaatgtgctataagtgttagagaaattcaccttgaaaatatacatagaactaaatacctacattatgtaagttgaaaactttcttatagccttcttatttaaaaagagaatgactaatagggtaatattcatgcccaaatgtaaaaaggccaggcacagtggatcacgcctgtaatcccagcattttgggagaatgagggaggtagattgcttgagtccaggagtttaagatcagcctgggcaacatggcgaaaccctagctttgcaaaaatacaaaaattagccaggtatggtggcatgcacctgtggtcctagctactcgggaggctgaggtggcaggatcactagaacccgggaggaggagattgcagtgagctgagactgcaccactgcactccagcctgagcaagggaaacagggcaagactctgttaaaaaataaaaatttaaatttaaaaaaaactagtctaagtcattttaggcaaaactttcagaaattttaaagagttgattacatataactatccaccttaattatttaaataacaatatatgttattagtattttctctacattgctcaggctttgagagttgcaggagattccaaactgattaccaaaagatggtatttcgttctatacctgacaaagtctgtttaatatttaaataaaacggtacataagaaacacttataatctataaagcattttaaatatgctgtttttatattccctctatcttttcagcaaagttaatcccttatcctataattttggaattgtgttttatcttccttatacaggcataccttacagatatagtgggttgggttccggacaaccacaataaagtgaatattgcaataaagcaagtgacacaaattttttggctactagtgcatagaaaagttatatttacatgatactacagtctattaagtgtataagagcattatgtctaaaaaataatgtacacaccttaatttgaaaacacatcattgctaaaaaattgctaacaatcatctgagccttcagcaattcgtaatctttttgctggtgaagaatctggccttgatgctcatggctgctgattgatcatgatggtagttgctgaagattgggatggctttagcagttcctcaaaatgagacaacactcaagtttgtcacatcgattgactctccctttcacaaaagttttttatagaatatgatactgtttgatagcattttacccacagtagaacttctttcaaaactggagtaaatcctctcaaaccctgtgatatggtttggttctgtgtccccacccaaatctcatcagtaattttaatccccataatcttcacatgtcaagggagaaacctagtgggaggtgattggattgtagggacagtttttcctccatgctgttctcattatagtgagagagttctcaggagatctgatggttttataagtgtttgacagttcctcctacaggattgcatgactgtgcccagctaatttttaaaaatttttttgtagagacaaggtctcactgtgttgcccaggctggtctcaaactcctggactgaagcaatcctcttgtctttgcctcccaaagcactgggattatagacataagccaaagtcttgaaaccttcaaagttattcatgaggattgaaatcaactccttccaaactactgttaatgttgatactttggcctactcttacgaatcataaatattcttaatatcatctcaaatgatgactcctttccagaagatgttcaatttactttgcccagatccatcagaggaatcattatctacagcaagtaagccttatgaaatatatttcttaaataaaaagacttgaaagtcataattactctttgatccatagctatttgatccatagctataggatggctgttgatcattcatggatcataactgtttgatccatggctgcagaatggctgttgtgttagcaggcataaaaacaacattaatctccttgtatttctccatgagaagtcttggatgaccaggtgcattgtaaatgtgcagtaatattttaaaagaaatctttctttttctgggcagtaagtctcaatagtgggcttaaaatattcagtaagccatcctttaaacaaatggcctttcatcaaggatttgttgttccatttatagaacacaggcagagtatatttaacataattctcaagggccctactattttcagaatggtgcatgagcattggcttccatttaaagtcaccagctgcattagcccctaacaaaaaagtgagcctgtcctttgaagctttgaagccagacattgacttctttctcactatgaaagttgtagttggtattttcttcaatagaagactatgaagtctccattgaaaatctgctgtttagtgtagccacctttgtcaattatctcagctagatatttttgtataacttgctgcagcttctacattagcacttgcagcttttccttgtgcactatgttacaaagatggcttctttccttaaacctcatgaaccaccctctgctagtttctaacttttattgtgcagcttcctcatctctctcagccttcacagaattgaagagagagccttgctctgtattaggctttggcttaaggaaatgttgtgactgatttgatcttctatccagatcactacaactttctcatcagcaataaggctgtttcatttccttatccttcctgtgttcactggagtagcactttcaatttctttcaataatttttcctttacatacaccacttggctaactgtttagggcaagtggcccagctttcagcgtatttcagccttcaatatgccttcctcactaagtttaatcattactagcttttgattttaagtgagagacatgtgactcttcctttcacttgaacatttaagggccattttagggtgactaattggcttaattttaatatcttcgtgtctcaggaaataggcctgagaagagggagaaagatggggaacagacagtcagtcagaacacacacaagaattaacaggtgaaattctgtttgagaagtcaattatgtctacaacactggaaacagattttggtgtgatatattctctagtaactttaaatttgtttctcttccttcagcagtcagaacacatacaacatttatggattaagttgttgtcttatgtgggcatggcttgtggcactcccaaaacaattacaataatagcatcaaatattacagatcaccatgaaagttataataatagaataacttaaaagactgtaagaattaccaaaatgtgacacaaagacctgaagtgagcacgtgctttagaaaaatggtgccaatagacttgctcaactctcggtttccacagagcttcaatatgcgacgcatgcaacatctgcaaagtacaatgacacgaggcatccctgtataatttttaagccatgttgctttctacactagatcaaccatgtcttataataggaattatcttaactacagtgattaacatagtgcctgattctttacaattattcattttttggttaaatgaaggaaaacaaacaaatttaaagtaactagagaatatatcacaacagaatgtgctttaggtgctgtagacacaattggtttctcatacagaatttcatctgttaatccttagcctccctttaaatacacacattccttccaaatacaatacaaaaatgtagtgaataggagacttcattagttccttttcagtggttaaaagatgaagttttggcattttctttaaaataattcattgaaattatatattcaaaatatgtatattatttgggcccactattggtaagacttatgatttaataatctaaactcaatgatatccttaaataaataataatctcataatttaaactctaataatcacatgcttttataaactggaaaaaagtctctggatcatcttttctttcgcccacctcatattaccaatgacgtaacagaagcacatgaggcaaagcgactttgccaaggtcacgttaagtcaccgactgaccgccgaacagcacccggatgaattccagatcacccggctccccgcccagtgccacttccttcctttctgtcctctccaatttactcatctagaactaactgaccaagcagaaacaattgggagtagtcaggcctctattaataacaacttgcttgtcatatagtacaatatcgtttacaaagcacttcccaaatactttctctccttgaatccccgccgcaagaaccccagatgcaagatatttacctccgcttacaacacactaaggcctagaaagataaaatgaaatgtccaaggtcacagagctaaacttgaaccctgacctttttacaacatatctagttttctatacataaatccacagcaatttttgttacagagatagaatcaaagaaaaagaattattcactataatcccattaagccaagattctaaggcgacttcaccaatagatttgtgaagtgtttattaatatagaagatgatttcaaaagaatgttaatactaaccagatgaataacccatgcaaaagtaacagatgaattgttgaggaaaaggacaagacagtcacagaaatgaatgtccagaaaatggattcacacatcaaggacaagaaaggccttcattacccatttatttcagtttccgcttttgagttgaggaaactgaaacatctctaacctcaggcctcaagaagcagaaatcccaggttatcttcaacaacaaaggttgtaatagttgtagctccagaaatgccaccctttgaactgatgcagaagtctcttttttgggactcacaaaaggtcctgagaagtgcaatctcagtcactaatgccaggggtgtaactaatgacaaggctgtacttagaatgcaaggaggtgttcagagctggcttcatgggagctgaccgagaatggcacatccagtctttgtcaagaaggaagagaaccagaagacaggtcacaacacagatacacaaataataataaagaatcatgctgttccccattgttcaagaatgagaacaatagctgggtgcggtggctcacgcctgtaatcccagcactttgggaggctgaggcaaatgaatcacgaggtcaggagatcgagaccatcctggccaacatggtgaaaccccgtctctactaaaaacacaaaaattagctgggtgtggtggcaggtgcctgtaatcccagctactctggaggctgaggcaggagaatcgcttgaacttgggaggtggagattgcaataagccaagattgtgccactgcacactagcctgacaacaaagcgagactccttctcaaaaaaaaaaaaaaaaaagaatgagaacaacagagaatgttttcttttctttttctttctcatttttagaaacagcacaggaatttcttccaccaaggtgcaggagaaagtttttatgccgagccagatttcccagggatgaggattgatgattctcttccatggacaacaggaagttcagtcatatggaatagcatccattattattattatttatttatttatttatttttgagacggagtctcgctctgtcacccaggctggagtgctgtggcgcgatctcggctcactgcaagctccgcctcctgggttcactccattcttctgcctcagcctcccaagtagctgggactacaggcgcctgccaccacacccggccaattttttgtatttttagtagagacgggatttcaccgtgttagccaggttggtctcgatctcctgacctcgtgatccacccacctcggcctcccaaagtgctgggattacaggtgtgaactgccttgtccagccaataggatccgttatttagagggctctaacagcctagggtgagagatgaaaggcgtttcaaaagtgaaagaaggaaatcttgaagcatgtgtgttacatgtacatcatccctgagactttagctactttatgcctcagatataatgaaaagtgctataaaaattaaataaacaaagattttatgttaatatattgagggctttatagtactcactcaatttaccttctattgtatacttaacatgtgccaagtcactgaaattacaaagcagaatgacatagtccctatagaattaactcaatttaccttctattatatgcttaacatgtgccaagccactgaaattacaaagaagaagacagcccttgccttcatgaaattcacagcctagaaaacaagctaggacccaaggaactatagtatagcacagaaagaaatcaacactacaggagagatttgaaggaccagggaaagaaggacttcttaccagaagaggatcaagcaaaagctttattgagaaaattacaatctaagcatttgtggaaataaaaagttaatatactttgggaagatattataatatcacttgcaagatgtattgtgctttgaatgagtaatgtaattattgttaatattatattactgataaagaactgacaattgaacaatatatttttatagttcttagctttcccataatataccatttgctaatcattaattaagtcatgaaaccatacatttaacagaatacattacattcttaagtgttcactgaagacaacattgtctgcctctccaaaatgtttaaattatatgtttatacatctgttgtgtactttcaaggcaatgtaaacacagaaatgtctcaaaaatatattgcaaaatgacacaccgaagcttcatccagacaactatcccctgaatttgctggctgatttgaagttcaatcaatactaacctgtacaaataagaagagccctgttcttctagcttaagaatggtagccctgctttcaaaagaagcaatgaaaactccaagccattctctctttatggcattacatgaacgagtttggagtcctgtatctgtatccaaagtacagctccttcatttaagttactgttttgaaagaacttcttagaggtctttaaaatcagtatgtccagatctctgagactcagagctactgattaaaatttcagtcatatcaaaaaataattgggcttttgggtgggggctcaatataatttagtggaaagtatattactatgagactcaagaaacctaagtttcagtcttgacttcaccaggattgagccaggttttcccagataaaatgaagaagctgaaaatcactttcaaattctcttctgaccaagttaagactctattatggtgctgggaaattattaagttttccagttataaattggccaggggattgttctggaaaattattgcttgaatagtgagagttaagacacatttccaatcatgagttttgaagaccgacttaatcacttccaccccctagagcctccagcacttgttaatatctttatgatggcatttaccatattgcatcttgaacactggtgtctgtcttccgtgatagcatggaaggttcatgaggtcagtctcttattcattatcctgttttgccaactcatggcaatatgcatggctcaggctatgtgtccaatgtatgcttgaaaagtggaagaacagacaaatgagaatgtcaaaggtaactttaaaaacctgtctggagatgaccttggtaattttcttaagccagtaactttttaaagctatttgcatggtgttttctcaagggaagaataccttaatgacccttacgtctgacagcctacagtatattggataaactgagggagctggccagggcactgctgagaactccccaaaatgctacatcaagcacttctgagttgagagtatctttccatggggttatttagtatttttggatgtaagtatttagtatttaatattatttagtattttgtattttatcctttcaagtaaggataaaatattgaacactggcttttactttcattcctacttgaaacataattaaaagtacaataaatggatgcaggtgtgtttatatgttttgcataattctttaaagatggaacaaaagagagagaagaaaacaacaacaacaaaattttagaactggaaaaccagctggtgaagatatatttttcagatctgagaaagctgaggtcctaagtcagcagtggagaaagccaacaggcaactaacttggattgcacaatcttcaaaagtttagacagtggtagcaccagatttgtctagaagtgagctgaaggagaaaagggtaaattatgcaaaaatggtggaaaggttgtttttaggacggtattataacctcaaatcctctcccaaacatcaagcatctagccaactgctctccacaatcccaggagaagactagatatttattctttgtagtggatagagcagaaactctctgcatagtggacagagtgaataccacactgaaaatcaggagattaagtgaacatttctacggatttccaaaacccacaggaccctcacagccaggtctttcccattcaggcaagagaatggaagagtcttctttgaggaatcttggaaacgtaagaggtaagacctaaagatacggacctcaggagctccacagtgaaaagcccaccaacatcactctacaactaagatcattgacaacaagccccacccatgaacacagagcttccagtcacctttttagccccctacacccacttttaaatatgaacaggtaaccaaatataaaaatatcttcgggaaatctctaacatgaaagatagaaatgaaaacaaacaaaaagcttactggaaacagaggttatagagggagattaaaacttctttaaaaatgtaaatcccgtccgggagggaggtgggggccagcccctgcccggccagccgccccgtccgggagggaggtggggggcagcccccacccagccagccgccccatccgggaggtggggggcatctccgcccagccgccgtcccgtccgggaggtggggggcgcctctgcccggccgccccttctgggaagtgaggagcccctctgcccggccgccaccccgtctgggaggtgtacccaacagctcattgagaacgggccatgatgaagatggcggttttgtcgaatagaaaagggggaaatgtggggaaaagatagagaaatcagattgttgctgtgtctgtgtagaaagaagtagacataggagactccattttgttctgtactaagaaaaattcttctgccttgggatgctgttgatctatgaccttaccccccaacccggtgctctctgaaacatgtaccgtgtccactcagggttaaatggattaagggctgtgcaagatgtgctttgttaaacagatgcttgaaggcagcatgctccttaagagtcatcaccactccctaatctcaagtacccagggacacaaacactgcggaagttcccagggtcctctgcctaggaaaaccagagacctttgttcacttgtttatctgctgaccttccctccactattgtcctatgaccctgccaaatccccctctgcgagaaacacccaagaacgatcaaaaaaaaaaaaaaaaaaaaaatgtaaatcataattattctcagcaaagtattagaaaatatcgcatctgtgaaataagacggcataatataaaactgaacaattaaagaaaacagacaaataagcctcttggaaattaaaaatctgataccagaaattaaagaaaacatctaagaaaaagattaaaagataaacttgagcccataatctagaaaatagagaaaagacaaaagaggtagagaacaggaaataaaacatatgaaaaatagaaacctatgaaaaataatccaaaatataaacaagtaagatttccagaataccagaacaaaacaacaataacaaaaaaaagagagtaggagatcattaagaaaatattttcaaaaactaaattattttcaattttctagagattaaagaattaaagaaaaaaattctagaattaaagaagagtttccacagtaaatacacagcataatgagtgaaaatgaaactataagaaggcaaattactatcaattttcaaaacactgagaaaaaagaatagacactaaaagttttcagagaaaaaaaaatcaagcatgtacaaaaaataagaaatcagaatgttagaatgatatcagaccagaacaacaaaactggcagaaaaaaagatgttgtaatggtgtaatttaagttctgaagaaaacttattttaaatctagaattctatacctaaccacacgattgttcaaatatgaggaaaaatgaagatattttccgatatgaaaaggctcagaaattttactgtgtatccttttttttttaggaagctgttggagaatgtattccaccaaaataagagagtgaactaatacagaggatgcaggagaacaagagatccaagcagagacctgcaaaaattttctagggtgatggaaaaagagaccctgggaccaaagcaatgcacagaaaaagggtgcacatagcacccagtcatcaggttctgagggatattacttcacgatgaaattgatagaatatctgtgcatctgagtgtcttcagatgagattcagataactggcagggacttggagttaaatatagtacaaagtatgtagaaagctgggcacgtaaaaacaagacagttatcaaccacagaaaaaaaacaaaatcttatgacaaaagtaatcatagtttaatttgtcttagtcatgaaagtatttacataatcataatcatgcaactactaaatactgatctaacaaaaataacaatgtaacagccttggaaagatggtgagatggaaaggaggcatgttgtggtaagaatgtgataaagggagagacttgaaagctatttccttggtgggacgctgagaaattaagaggtagtaagaagagaatattgtttagcatatgaaggtaaatatcaacaagagtcgaaagtgattgtagaggaaaaaatgggagagaggacaagaaagtactatatttcacaatatactttgtataactgtgacaaaaatagcaagtaaaaacagaaaaagaaagaagaaatcacctcaaatgttatgcatgagagattgtttttatactgcttttgctctaaaagcatttctgatggaattgagtatcacaggagattgcagtgtgttccccaacatcctcccatctttactaagacacgattcactggggtcagttgagattaaaagaggttgctcagagacaagacaaggctgtcgttgccatctgtctaactgcaccttatggttattagatgaaaatcatctgctgaccttcatcttcaaaatcttgttcataaatcttttaccaatcaagctgagaccttccctgtacaaggtgctttctagacttcaaccattgatcacgatgatgcagtttggtatgatgtgtcttcctggagcagttttaagtgtttgattcaaaagtgaaatctttgtggagctgccatactttacagcactacactgagctacaactaaaggcacacattgcaagtgtggtgcttgaatttcatttaaacaattaagcaaactcgaatccatcagactcagcaaaaccccatggcgatgatttcgtaccagagcagttctgagatacttaaaataataatatctacattttattgaatgcttattatatgccaggtagtgtggtaaatacttacactatcttatttagtagtaaaaacaactctataaatagctactattattatctccattatatagataaggaaatccaggattatggagattaggacccttgcccaatgtctttggctaggaattaggaaaacaaaaatcaagaccagaattggattcagaaactgttcttttagaactctgtcttcgctaaggaagggtcatcataatatcaaaaatatgccattgaaagtgatgggtgagtttggagacaaacatatttctgaagtgagtcttcatatatttaagcatagatgagtttgagaaaattcatatagcacagttgcaaaatgcacgtatattagtacttgcatagtttttagtctgttataattctgagtcttatttatagatcttaaggaaataatttttttttttttttttttttttgagacggaatctcgctctgtcgcccaggctggagtgcagcggcgcaatctcggctcactgcaagctccgcctcccgggttcacgccattctcctgcctcagcctcccgagtagctgggactacaggcgcccgccactacgtccggctaattttttgtatttttagtagagacggggtttcatcgttttagccgggatggtctcgatctcctgacctcgtgatccgcccgcctcggcctcccaaagtgctgggattacaggcgtgagccaccgcgcccggccaaggaaataatttttaagcctgacacttttcgaaaggttattttcaaaaggaactttaccctagaatactagtctataagtttcaacgctagaattttagagagttgagagccaaaagtgaacagaaatgaaactcattgttccattaagcaagagaagtgtgttagcagcagagactggcaaaaatcagagtgaaatactgggtcactgcatttcttctggccctgacagtgttcttgtacgtatatcttgctttgcacagtagatgtgttcttgaaaagctagtgaataattaaagctttgtaagtagaattgtattctagaagacctaggaatctaattttttaaagatgattacagtagtcaatgtttttgaaatgtaaatgaaatcatcacctacattacataatttgtaacaggcttccacaatttgcttccaacctttcttccttatatgattcatcatctactgtgtcctgtcccaacccttacatggttcatgaggaaagagtgtcagtactatattcagcacctaaaacagtgtccagcacaataaatggacactggatgaatgaactaagcaatccattaatcttctcctggctactacatgtatatcaatgtctctctacctttgcatataatatttcatcagcctagaatgattttccaatgttttcattttatcccttctgcaagagtgagttcaaatgccaactccttcctagatgtcaaattcctctctatattcccaaaagattacatttagatatttagtgtaataggggataattgaaaccttgtcttagtccttggttcctagcctctaatgcctagccagagcaatccacacagacaatgtgatggtaaaagtaaatttaatctaaattttcacatgtattgccagctgtcagttcttcctaggtttctctttatgcatatcttcaaaagctaatttgtgaggtgttcttgaggtcagtaactgcatggtttttcatgtctagccccagtaacaagcaatgtgcatggcacagataaatggatacgtccaagcatggatccttgtattaattaattaaccagtgtggttgtggataatgctgggctaattgtctatacgtgatatcactgactcttttaagctatggaattccctcatgagaatgctatccctgatcccttattctgatatttctgaataaccagcaaaatacacatctatttctagattgaattcccaagtgcaagagaatcttagactagattgtctacaccaggttttctcaaagatctagactagcagcatcaacaccttctgggaacttgtagaaaagtaaactcaaaagcccgggctaaccctgggttcactgaatcagaaaccctaggggtggggcccagtgatctgtgtttttgtacacacttaagttggaaaactggtcagaaagttgtccttacgattctgacataaacaatgcaatgtttcctggacccagccaacaacgtcaacatccctgttaaaatagtcaggttctttcttctgaagaaattagacttcattgtaagccagataatgggaaaaaaatagtaaaactatgatttaaaaaatcagtataggaatcaattgatgtcactgccactcagtttttattgcataatttaaaacgagtatatcttaactacattgttttaaactgcataccacagctgcatggcattctctggttccaaacagataaaaatgagcaaaataaaactaggtaagatgaagaggaatcttagggattttaaggaaagaatccagccccatacagaagcagaggaagtagtaagcctaagggtcaaatgctaacaacaagaataacaacagtagcagctgtaattattaagtactaattttaagcttggttctttatatatattttcctcgtttgtctcattaacctagaaagagcgtcattgtacaaattaggaagcaaggatacagaaatatatcttacccaagttacagagactaaaaagttgttagttgtgtgtttgatttcaagtcttacgatctttctaccacaccactgagctgcccaggtaaacagaacagttattcaatgtgagggttagaaaaagaagctgcaacccaatgcttaattaagcccctaggggtggaagccaacttaaggcacataagagcagtgggttctttcttgaacccacctgataacaggcaggaaggcccagtgattcctcaagtctgtatcttattggcccagggcttgagtgagactaagcctgcagagattgggtattctgaaggttaataaaatctgtacatacacagtgggactagtttttcagtaacaaaggaaggttgattggcttataagactatactaaagtatgccttgggtgttaagtagtggttaagctcatagactctgaagccagtctgcaacttactagctgtgtgacctgggcaaattacttaacatctctatgcttgacttttctcatccctgaaatagggatgacaatagtgcctgcctcattgggtttttatgaggcttaagtgagtcaatatatgtaaagtacagtgcctaaacatagtaaaagctgcaaaagcattatttcaaaagactcagttatctttccaaatgtcctttcaatgtttgacatgaataaagcatgaaagcatgaagaataaagagcttttttaagtttagctggatctgtttaagtttataactgaacccaacacctattacagtttttttccccataaagcatagaaagaaaatctgctttatgggaaaaaaactgtaataaaatatgtgaaaaaggataaaactccacttataattcaatcgtcattatccaaatattgtcactttttgcataatacaatctactatttgccaatgaccaaattttacattataattagtgcatatatccacatgtactatttttataattaccattatgtcataaacacttctgattataacccatgttcataaacatgttaatggctgttagatatttccctttcttttattcttcgcataatcaagaaattcagtttattaaccatgaaacccttagaccttggatagctttcatctggtggtagaaaatgcttcttctatctaaaatgatcagtagccaatcaaacattggaagacatagttattggtttttaaattgtttgaaggcaatgaaggattgagtgcaattgttttttagtaatatattactaatgattgagaactaaagaaaatcagacttcctatcaataatgtcagtaaaacactcagcccttggactgtttgtcattattctgttagtctttcttttttttttttttttttttttttagcaagaaggtgctggttagggctggcagagagaagaaaaccatatccaccaaatcaacttcacatatgactgttgtataaataaactcatcttaattgtaaagaggacacatatgagggtgaagaaaagacgttataaaaacataatgtacaatctgctaagcaaaaatgccatcaagttcgccaaaagagataggagagaacaagcagctgatcataaatctttaaacagaatgtatccactgtagttcctatataaacacttcacaaatgctggttctttcaatcccagaagtgaaaagaatcttgcctctaatccactcttgttttgcagatgaagaacaaggccatagaaagaaagccacgagctcaaactgaagatggggcgggaattaggattcaaatccaggtctccggatccccaagacagcgtcttttccacaaggccactgcagccatccatcaatttagacatgaacctgttacctatgtggtcacaatcatgccatatacaaactttagccaagtagcacttttttcctcttagtgctttctcactcagaatcaaattaattcctcaataaagttataaatccaacaacttcagttgcacaattcacagcattaaaaagctagctcaaacccacactgagtccttaaaatttgatgtggtaattatgatcaccctgtttattttctgtagaagttaagcctaaagaggatcaagaaagaatacaaacaagcttaaaataacaatttctttgtaacaagaaaataaaaatcaataatgggcaaaccgagttaaaaaaaaaaaagagagagaggtttagtacactgaggttcatccatggaatagaagaacgagaacctgatcccagatcttctagcatttaatagattagattagaataatctaagtagtctgttagattaatacattagaatattagttatatttcattggaacatgcaccatgtgtattttatgcctcagtgtatcaccagagtatacaatgtcataattccaccagtgtgcatactacagttagaaaagctcagccttagaacagctaacaaacagcaggttctaaggaaatactgcttattgaatcaatcaaccaatggtctcattttaaaagactggcactgattggtctgtgctattgctttagttgtctccttcatgtttacgttattgttattgagggtcttgctatatttgcataatcgtttgttttttatgctgatgcaaatcaaagcccatagtaaaaaagtactcatttcatctcatgttaagttatttgtaggcttgaaaataaagagtgatttacatgaaaacctttatcttgatacatagcaaatatttctcttttaaatcccagaagaaagaagtaaaccaaattcaattttaaatagtgctagaaatgttgaacatgttttgaaatgaaggaaaagcctttagataaaatgtgtaaatagtctaattttaaattttccagatttaaacaattagaatgatcatataataaatcttatataatagtcttgtttgtagagtatctaaccccaatttattataatatgtgaaagagactaagggcaaaaaaaaaaaaaaaaaagaaaaacaagaaaaacaacccaacacattttgaagcaggaagcatatctagatttttcagttcccaagtatctgaaaagaaatttcccaaattacctgtgttgaggtttgttcaatctgttagagtgctatcagtactggaggattcgaggaaaacctgtttcacgtgggtgataattgtagaagtgaatgaggtagggagagattggcattgctgcctcttcctgcctgcttggtaaaggactctttggtgcatttagttatcttctgaacagcctctgaaagtttctggattctttttctgcagtctagtccctttgggttgcttctcaggctaatggccaatccacaaacaagaaagaaacaaaaacctaaccacagaatggcagcatgcctttacttctatcacgtagtttaaagtcccactttcaattatgtgtgctttttcaatcattagtaatggggcttgtttcaggtaaaaagccaggcagagtatgcgctaaagaaaaaagaaaagatctgtgaaggggcaacaggtgtcctttgggacttctgcctaggtgccatcagcagcatcgcagcagttaaataccacggcctccctgggtgggagtctcacattcccaaagacaaggagacagagactatttcaaaaagtaactggagagatgagaaagctaaaattagaactattgacatagatccttaaaaaatcctaccgtgctctgcatgcaaggatgctaataaggagatgaggaagatgatgctggggaaaatggcatgtcatcttagcctcaaactcttgccatctattttgcatatctattttcaatcccaagtctgtagtacagaaatgaaatctctcttctacacacactctcttaacactaaagagggtggtaataaaagacaaggcccaggcagtagaagtcctatagtgctcctgataaagaacacatgtatgtgttatagtttcctagtaaccatcttggagcttatcgatggattcataattgaggacatacatcatcacctgagtgtttcttaaatatctgacttgcaggtattacaggatgtctggtggttctgagatgtaccccgattaagaccattgttagtggccagaatttacacagtttatgttttaaacccatccaaggtgtaatacttgactcaatatatctccatccccaaacccataagatgtagagacaaattcaggtgttggagacgttactattaaaactgtagaataagcacacaagaaatcccttttggtaaagtgaagtttttgtgggagttaatgaagggtgatttattgagtgtcgtgcagtatacttgctgctaaaactacaaaaatggcagaggaccaatttctaccatccaggatctcacagtctagtgtaaagagagatacagctaaaaatgatgaaagtcagattataattctaaagagttctaaatactttattagcatgagttttatttcataatcatgatattatggtacagcacttgggatgggtataagaatttttattttgcagagaaacagaggtaagatgagttgcctaagtcatttagtctttatgatcctttgttttgttatctataaaataaagttaaaatgccaaatcacagggttttaagggagattgtatatattaaaagccttttgaaaaagtacaaagtgtttcacgaacgttatttatgggtgtaaatatgtgacaaatcaggaaacccaatattaagagatgcaataaaccattattggtcaatcagtagcacaaaacaccaaacctaataaggttggtacttcaaaaacttaaaagcacaaaagaaaaaggataagggaatggcaagtaggttggcctcccccagacctattactgagggtaacaagcctcataataacctaaagcaagaaacaggttaggcaggtagctagtcaggtggaatagcttttatagtagatacatagcttgagttcaaatgttctcccacacaataattttgtttaaataaaccaaaggggaaacaaaaggcaggaattattgctgtggaatgttaagtgcctctttggagctcattaatcactgtaagactttatattctagcctcccggataacctactagaactctgaaagatgaatggagaagacacataaaatgctagaaatcaacagctcttgatcctgttcatatatccctacattgtaagcttttagagggcaagtcaataaactatttatacctctgtcccccacatttaataatgtgcctggaacaatgtggcaactcggtattttaaattaaatgaactggaccccctttgatatttaagaatcttgagacccaaagaggaaaagatttgtccaaatttacaccatgacaggtggagtaagaaactgtatttcctacactcagtgactatacatcatgattttactgaattatgttttacttatctcactatactggctcagtcttttattattgttgttgttattgtttaaccacaaaatggctcttcttaaaatcgctttccagttctgatatactaatgattgcatagacatttcctttctctgctgcagagtaaatcatcctggcttcagagaaatgactgttctataccttaagtgtgttggttcatggccctgactgaactctgatggctggtatgaaatctagaacaaagaattgaatcttccttggaaatacatgtgcaggtctctcttgagagagtgggtcaaattactcccttccatgttctggaatcacactgatgtttctgggagccctcctggtagctaagtttcccacacttctcccaacttacaatcttctggatccatgaagttggcctaaaaaaactaattaaggctatccaacgcatataattcgaatccctactatgcaaacttaaatattctacctgagatagacacttaggtggttgctggaatgttaaaggctcagattttgcccacgagaaggttaatatattagtgaagatagaagagtgaaattgtcaagttcagagattgcatcttagttttctttcacattctcagaaataagcacattgggtacatatcagatgctcaataaatatttgtttaaataaaaagcacaaaaattacaatgttgactgtaagaaacgcagtatgtgagggacaaacgagtacttaggtcataggaatctcaaaagggttgaacagagaggtatgacaatagaaaaggataaaactatattcactctgtttagaagtgccttgatttaagtagtcaaatatcatcacattaccatgagttaacagcagactttgtcaggagcttaaaatgaatgtagagaataaatatttagggtaattgggggttgaaagtaagtgattggaggatgagcagcaagggtatttaaaagtaagtttgttttctgatctaactatgagttagatcacgcagtttctttttcatttcatttttgttgtatccaaaaacaaccagaagacctagaacatgatcacatatccatgagccttcataatgattagacagataatatcaaatcttctctactgaggtgcctggagtggtgtcattcattctcaggtgcaatcagttccctgagatctacaccagtgcttcttaaatgttaaagtgcatagaaatgaccattagattttgttgaaatccagatttgatttggtagatgtggtgtagggactgagattctgcatttctaacaagctcccaggtgatgcaaatgctgctggtctgtggaccaccagcagtaatgccctacatcagtggttaactctggccatccattagcatcacttgggagccatttaaaactacttatgcccagatcccaccccagaactaattaaactcacattattaggggtatggcctaagcatctttacatttgaaaagctctacaggtgtttctataggtagtatgccagcttgaggctggaaatctacctagacaaagaaaaatgtgatataggtgggggtcagtgggaggtgagagtgtgtgtgtgtgtgtgagagagagagagagaggagaggagaggagaggagaggaaaggggaggggagaataggggagaaaggagggaagaggaaaggaggggaggggaggagaggaaggaggggaggggaggagaggaagggagggagggggaaggaagaaagggaggaagggaaaagggagggagaaagggaggaagggaaagggagggaagagggaaagaaggaaggaagaaaggaaggaaggaagaaaggaaggaaggaaagaaggaaggaaggaaggaggaaaggaaggaaaaagcctgtttcctcactccaaatcatgcttctcaaacattaatgtgcatacaaattgcctaggtactttgtcaaaattctaattctgactcaatagacctggagtaaatatggagattctgcagttctaaaaaatttgtctgcaaaccacattttgactatcaagagtctaaatcagtggtttccaaacactgctgtacatagggacctctaaaggaaacatatatgcttttttcttccaccccaatattctaatttcattggtatgcggtgccatctcaggatgagtatgttcagaaagtatgtcaggtgattctagtgtgcagcaaactttgtgaaccactcctctaaatactaaacattttaactcatttaagaatctcaagcccttaagatacgcaaggcacaaattccgtcagagctgctcggactgcgtaccaacccaaatctttgagacaatgttaagtacatggtgcacaaaaatcgctgaaattagatcatgaattgaacctcaggtcaactgatgtattttcctctcttctttaccctgtatgacagggagtgatgcaaagttgtaaataaggaagcaaaaataaattgatcttatttgtaaatagctgaagttcaactttctggatgctggacaaatgctctaagaaaggctgtcaaatgctagaggtaatgtgaaagttgtcaagtgttggcgatgggattcaagattaaacaggccattagatctgggtatgggatagagaactcttgaaccctcaactgagtcacgcaatatgactctatctttaaagagtttctactagaaaagtattatatatacatacatttgagaatgtcttcctagaattagatttgaatctgttgggggaagaagtttgtacacggcagcataaaatgtgaaagatgcaccaattacagtattgcacaaatacacatttctcttaatacactctttttggctggaataaaaatttcaagttagctaccatcgttagctgtgccatttgcaccaacttagaaagtgaggccaatgtataagtaattagccatttttaatctgattgccaagcagctaacacagcttcattaagaaagtccaggaactaacatgcataaagactttcatcatgttttttttttttttcagaggcaattatgggacctctgcaaaatgaccacaatgttggcctacagcaaaagtcttcgttgcctttggatcagtgctgtgattcactatatcattgctgtctggattgacatagaacttctgaactgattcttttcggatgtatttctgagattctttctcctttctgaattcaaaagactgaaagaacagctagaactctactgttagcaatatgatcattaaaccacctggaatgctaagtgacacgtagcatgttttatgggcaacgaaggaaaataaaagattactgccgagagatatagcctctttttatgattgaacaggaattagtatacacattggaggcaaaactgttaccaagaacctttgtcaaataactaaatttagtgaccaaataccaggtgtcatctaagcaagaaaaactgtttcatagtaaaatgatattctttttctgttgttaaccttatgtcccagaaatacttagtcagctagaatattacaaacctttatatgttaaggactgcctttttattttaaaatggagtataatagagttaataatatatgcctcaaatatacttatagacatggattctctcatatgtgtacatcattgtcagacgtggagatgcccatcaatgtatcataagaataatctgcctgaactgaaaattgcctgctagtcttaatccatgttgattcagctctttttatactataaatgcttgcctaggttcaaatactttaaatctaccaattaaatacttaaaacactttattgaacatagaactgctatcattcaacactccagtttcattaatcagcccagaaataggtaactcaccaccattccctgatcctaagtacattaccacagtgactgacattcctggtttaaaaataaaatcttgtttcaaatatagcttcccgagttctgggtaatgaatatagtttcataaaagttgacatcatttcttctgatttcgccagaattaaatacatccagtatgcctcctggatatctgaccaccatatcactcaaggctctcacaacctggtgggcgttttaaggagaaggagaaacagacctgcatagatggggttaaatccaaaagatatctaatcttgtggttagaatagtcgttgtgtttatgtgtgttcaatatgccattcagaagttgatttttacagttcatttatcagttggcatgcatacattatgcagatttgcttatgaggagaacattaatatgtacatgtccagaactagtaaatgcattatgcttggaagccaagcagtactcccatacactgttcttcttagaggtcagttctaacgcatgctgttccaaatagacccaatttctctgctgatatatattcaaaatgcagtaggatgtggtcatacacacccagaaataccatcttcatgaggtgggggtggtgaaattcaaacattttttttttagcaatgcattattggatatcaggtacaaacgtgcctgtcagcaattctaaagcaaatgaaatagatttatttgagtccatccattatacagaaaagatattgctttactaacacatacctcctcctcctcctccattttggggggactctccccacctccccccaaaaaactcatcacagttcactacgcaactgatggagtattaaacactgtcttccaagctgtgggagttaaaaagaagtcgccttcctgccacacttccccagtgctgcaatggacatagcatctcctcctctatcgacctagtatgatgctcgctccccaagcactgcagtcccctcgccgaggattgccttggccacacgcacatgcagcgggaagtcccccgatagggacaaccacatacctttgctctccatttcggtccctttcgagtgctgggaagttcaatggaagttggccggaagatgtgggcccgcttcagattcccaaatctgggaagccaatctgatgatttcgcccgtacttccttccttcccctcaggcttcctgaaagatgggatttcttaaaccttgaagctgcaatcagccaccaaaggacacttaggagcagcagcagattgcctctacaggggatacgttgcgacgcgcatctgatactgaaatgcatgcacagtgcccgctcagatttttttttttttttttttacctgggtctggaagctgcaggcaggagctgtcctccgagcgtggtgctgcaggtgtagtgacagatcatcccactttgctctctggatgcacagcagatttgcatgggcgctggcac

SEQ ID NO: 393 - DNA, 83689 bp, Homo sapiens
tctatgagtgtaccaccattggaagaaagtgagcagaggtgtttttccttcgtgttttctgtcctctccttggagctccttttccattcaatgccacatacatttgcctcccattatgctgccagttaaatgatgcataggtattgtatccattttcctctatcctctccttcagcttacagtcattgttaaattctttctgcaaaggaaaaacagaatcttttattcctatggtgattgtacttgatttcatttgatacaagccatccagagaactccagtccaaggattctgtttgtagttgccatttgtacctaagttgtgcacttaatacataatgtcaacaatagaaaagtaaatctcagaaccacaaaacacattctgtttgaaagcacatgatacattttaattgatcatcatagccactttttgaaagcccttttaaaaagctgatgtgctttgaatattatatggtttaagtgcctagagtgattgtcaagaagtagacatctcactaacaatatttgtgatgagtcagtaataaagaatagtgttataatgcttcttttacagtaataaccaggggccccatgggaaaaaatagaactgaaggaaagatatgggcttgtcaagtttgcaaactttacctacaaatccataataaatacacacacacattcataagaaagcagagcttatagcaaaaccacaatagttctgcataaccaaaagggggggatgtctttcttccaaatatcaaatttcttaatttaatgaaattatttgcaatattctatagcttggaattttgacagattttgctcgtgaactctagggattgaaaactaggacatggaattcctcgttttgtgaactactatgttgaagaaattatgagcatggtgaatagcaatgcctacattgtatcttaaggacttggatcctgggaagttccatcccatagccatagagctttggttttgttcaggaggccaattggatttaaggagacattcctggacaaggcttcgctctcactcactccacaaatccaggttcttactctggagttaataacaaagaggaagtagctcaatgatctcaagactctggctttagaagtagcctccgcagtgcctcacgcctgtaatcccagcactttgggaggctgaggcaggcgaatcacaaggtcaggagttcaagaccagcctggccaacatggtgaaaccccgtctatactaaaaatagaaaaaattagccaggcgtattggtgggcgcctgtaatctcagctactcggcaggctgaggcaggagagtagtttgaagctgggatgcggaggttgcagtgagccgagatcattccactgcactgcagcctgggcaacagaacgagactccgtctcaaaacaaaacaaaacaaaaacaaacagaaaaagagaagtagcttcttttcttatactcaaactaaagtagttaagaagctaaggaattggagcacttgccctctggttctatcttcttcatccaaagcaagggccccgtgggcatagttcagttgaggactgtacttggcagtttctctcaccttgagactttttgaaatttctacaaaattccaaattcctgaaaatgtatatgtttatatacctaggtgtctgtaggatttatcacagtttagaacattatcagaaccataagaagcagatgtattctatgttaatgctaccagctcaagttatctgtcctgaaattttttagtcttaaatgcttctcttctataaagtaatatttaaatataacattcaaatgatgatttaactggctgaaagtaagaaggaaaggtaaattatttaaggtaaggattttgataaaacaaaaataattctgtatttgaaaggaatataaatccttagtgtggatttacttttattctctttatctcagtctgtctaaaactatatacttttcaaagcagagtaatttttaaaatatggataattatgttcatttcaatcaataaatggggtacagtttagagactaatgaaggactgagattgtttgaggtgatttcatatttcagatgaagctaggtatacaaaagtgggagtgtatgcttaatgttaattttcctccccaaaattaatttatagagtaatgtttcttaaattgaagtgcacatgtatcagcctttttatttcagatgttttaaatatttgggccaaaggtaccaaatctctagaggaggggcctcaaaatatatgttgttgacaggatctaagcaaatcataagcagttatgtataaaaagaaaattcaggctacagcaaggactcaaaagcagggttcagggagtttttttaaaagaagtttggattttttccagctacctgaaaattttctttggtccttaaatcatgctctatgaagacctattctatttaattcagttttatactttatttactgaatcccatcagtcaggagaaaactcaaaatacaatagataaattgcttagagaatgaataatgaaaatataagaaaggtatacagtttccaaaaaggaatagaggaagataattcaagagaatagatataaaactggtttaatcagtcagtctgaatctttgcccaagtcagatttttaggagggcttacggaattgatggatactgtatgaaacaaaaaatgaaggtaggaattacaagagttgtcacctaatatacagaattatattagatatgcacttataaattttgatgttagttctattccactctgagcagaatattgaacttgaataaatttttcgtttaatttgaacaaaccataatttttcattattcctagtagaaatgtaaagttacacaaaaaagaatgttatggttagagaatgagtttctttctgagacaggctggaagtggaaagtatgttctgtaattggctgagcttctaccagaggttaggtttatgcagtgtataactgtgctctgtatggttctaagtgctgaacaaatagtgggggacaagactgacctcactctctccaaggtcacaatctattgggagaagacagtgaacaacaaacacattaatgagagaaatctcagataagtgccactgcagataatagaaagccaccggactctactttaaataaagaatttgaatgaaataattcacagagcttagagctcaagatgaagcataagcacagtccatgagctgtgttggggcagaagaaaaaaagaggagaaatgtgaagaaaagtattaaatatttttatgtcagagtttatttgaaagttatccatttctccttgatgtcatgtttttaaataagtatattttatcaattaaaagtatttaaaatcttttatattcattaaaattatttacattttcttccttaatctaaattagtgttagctggctttaggacgttgggtctagactaagtatgtgtgttgttatctcttcaaagaatatgtacctggttctcttccccaataattctgatatagtagatcaaggaagaacctggacatgtttaatgaaaacattaaacatgcctcaaaagagattatgatgtgaacccctaaatggaaccactttttataatggtctgttattcctctgggttcattaggggagcaatggtaatggagaaattttactaaaattcctctgacccccatgcaaaaaaaagcatttgccctagtcccagggaccaactcaaagcatgcctgactccccagttaaaagtggacctgatattagtaaaatacaaggctactctacatccagaccagcggttctcaaattgtggttactgcaccagcagcatcaggaacacctgggaccatgtgagaaatggaaattgaactgcaccacagacttattgaatcagaaaatatggctgtgggtcccattattctgtcttttaataagcccttccactgattctgatgcatactcaagtttaagagctgctggttctaaatggtcactaaatggttctaaatggttctctcagccttatgctaatcaacaaagtaagtttatttacaaatttaaagtgaaattcctttttgattacataaaaatgtaaaaatgacacaggatctgtttacaaaagtaaaaattatttaaaagatttgtgtcacaggttttatttctggccatatataatattacatgtcctccaaaaaattaaattaaaatttttccaagtttatagttgccttcaatacactccccttcagtagaatccagagaaaaaaatgaaattcagttagcatccccttgatctgtctctgggagggacacaataagatggatccacatgcacaaactaatatactcctgtcatcattcaaatgacagctaagagattgaaacctagttcccaactttattatagggctgctttgctatagctgatcctttcatacatgtaacaaccaatcatgctgtaattatttcatatttgttaacatttcccctaaatatattataaattatttgaagtcaaggcccatttctatacttctttcttatgcatctttgatatgtcaaacaatatctggcatatagtagatgttgatatgattgattgatgcatttttttctaaggacttgagcaggataaattgtctcactgcttgtaatttaattattattacaattgcaattataaaacaactatttggcattttaagtgagatcttaaatttctaagaaattggtttaaaagagtttgatccaagattgcagaagtggtattccaaatacttaacacctggtatggaatataggcatggatgtgcccaaagcactgcagggatacctgctccacaaggaccctattgcaaagaatatttcccacatatatatatatgattttgaggcataatttgaattaaaggttattgtctaggtaaataaaattctagagttgattgaacaacaagcaaaatggtgtttcttgacacatttccccatttcagattttaacaaaatgcaaaacatctgagcccttgtttcatcttcagccgtaacgcatatataatacatgggtttctactcaattcaagatctttgtttttagtgttttttctccaagttgtcttcattttccatgccaatctgaccggatgcttccgtgagagcctgacttggttagcagtttagaacattcacagacaaatgccagcagcagcctgtgtggtagactaatgggtgaacaacagaggagattacagaattggaagagctgctttgccagcccttgaaacagtggtgactaacccactgtggctctatttactagcaatagaaggataacaaagctattcggtgtctggaggaaactttccaaaactatggtaatggtttactggagtggatttgaaaacaaaagcagaatacttactgagccatagagtttccccttcttgttcatggctaagtaatagttgctgttaatggctttgacggcaacaactccgatttctactgatgttatctccaggatgcctaaaacatacaattttaaaaggctaaataaagaatcctaaatatatttggaagaaaagtaaaatcaaaagaaactattgagttgttttttgtgtggttctaaaaacaaaaggcacaaaacattggtaaacaaacaagcaaacaagcaaatctttttcaatgtgtcttaaaacccggcaagtatttccagcaaatatatagaaaaaagtaataaggctttaaaagaattccccttcattttactctgagcatacatagaaaatattgttttaattaaaatgcttcctttgctaactctgcattttcaaccctataaatattgaaacaactctactcatcttagcctagatttcaaaataacttatcagagcccatatctgtactatggtattaaattaaatctgtagcacatgtcaataatatgccagattacctcaatctctaaaaacagtgataaactatttcttcttgctaggatatagataatctaaatctcttggctacatttaactgatagattcatttttggcaaatgtgttgacattctgagatacagggagactaatcccaacatctgcactgtccctgaaatagcagaattactgctctgtgttgggggaaaatccataaacatggatttttaaggtttttttttttcctaggaaaaatggaaaatcgagggaagtagtaagaggtagacaagagctccttttccccttatacacaagtttcgattgctgcatctaaagataattttctcggaaaagtttgtagatcacaatagggaagtcagtttatcgtctactaaaagtgcccacccattttagtttaagaagacctagggaactaaaactacttatttcataactctcagcagtttgttcagggtagagaagtagcatcgtgattagcatgtggcctctggagccaaaatgtctgggttcaactcctggctctacatttattagtgaattaccataggagaagtcactgaagtgtcccatgactcaattttatttgcaaaatgggcaacataatagtacctccctcataattttgttgtgaatattaaatgagatagtacctataaaattattagaatttgcctggagcttagtatcttcttaattatcatcagagggtagtttttctccaacagtgctagattttggaaattcttcaatgggctatgtaaatcctgaacaatacatacaaattcccattggcttaatacatgaaatctgaaagttgagcatattatcatttgtcatgtatcatgagaaacaccatccccaatgcagtctacagattatatgttttcactcttcccatagagatagagtggcttagcttattctcgagagatgaataccttctttcctattccttcacaggttagccttatggaggccaatagaaatgcttgagtttcccctgttgccaagttgacataaccagagactttgccaagactacatgtcagagacccttctgtccatgtatctgtaggaagtctctgacctaacacagcactccttttcatcaaaagagatatatctcactctatttgcaagccaaaaccaaggaaagattgtgaaggatgaaggagacattatttgtgtttttttacatccatttcccttatgctggtagtttccctaaggtacacacacacacacacacacacgcacatttatttgcatattctgaaaaatattttcttaattcacacaatagccctctaaggatactgttgttagtctcgattacaaatataaaaacggaagatacttaggttatttaactcacacacacacaggtggtaaggtgataaaggtcggtaataatggatgttaacacttaagcctctgacttttagactctattgctccccatctctgactactttgcctctccatcacatcttcctcctctttcccattcctacaagggaaccctgttgcaaaccatctgacaaaatgactcatcaagataattttctttaatgacttaatgtgctgttcctcccaaggatgatggcatgccatagaggataacgtctgaatcttagagaacaaaatctaacatactttatttatgtcataagcagaagatacagagcagagcaggaggtagaattcaggggcaaaagattaggcagctgcttacattgtctggccaaaagacaagaaagtactgtcagtaaactgcaagatattctcttatgtatacttttgaaactgaaaattaatagaacaaagaggaatgaaggatgattttaagcaaaaaataaaccaatatttgtgaaggtgcatgcaacgtcctgggattaaactatactaacagactgagctatagtaatagtataagatacaactgaatttttgacccgttatttctgaggatgaactgcaagtggtattgtagattatatttagcttagatacccctttgtttctttctgctttacctgaaatgggagcacaatattcaaagactcaatcaaccattttttttccactttgcaactagtttaggcaagcttaaaaaggtttagctattatttttatattattatttagttattgtttcaaaatagagggaagacataggtgatttaatatcctttcgaattttgaaaataattttgggacgcagcgtatggtcaggtaagttataatttgatcatcttgtgagtaatggacaatgactgcacctattataaacatctgtgaatgtgaaaggggagttctgaaggactgaagcctagaggacttctttactttttgtaaggaatcactccagtttttctgttctttggtgaggatgatcaagtttgcctatcaaattatttttggaaaggagctccagaattttgtttgaggattgttggatcagtagcttatagttctatatgtgtatattttgaatcaaaactaaatgccagttaaaagagcctcctggaggaaagtgagttaagggcatactggatctccccgtgtttcttacaagtttatgactctacaattaccttaacattaaaagctataaaaaaaggtttttttttttttaactcaaagaaacacctgaaaattatattattaatgaaaggacacatgaattatatttcccattcatgtaaaacagatattttgtaaatttataggcatattcttgtagtgaaattctattatttatattaagttgtaactatattagtttttatgtcccttaaaacatgaatagcccaggtagtattgtgaatctatttaagggtctttggacaatttagttcaatcacttaggaagacctaggaggagaagggtacgcttttagaaaatgaaaatataaagtcaaatacgtaatggcttttctattgataagtctatgtactattgggaataaaagacaaacacagataattacaataaaacatgttacatggcagtaagtgatgacttaagatgatgacaaggggactatggggcaaaggtaaaggcaggtcatactggctggggttccacgatcaaattattgttggagatgagacctgaactgagtcatgaaggttaagaagtgtccaggggaaggctgggaagggtgggaaggcaagagcaaattattaaggtaaaacagtatggtgttttcaaatatcataagaggtttgatttaccaactggagtacaaggaacaagtcaggaagctgggaaaagtgaagttgggagataatgagactcagtttagtaaacatcttgtgcagattctaagaattttggcaactaggaaggattttgtctacaaatataaaattgtttaaagaatacattagaaataaagtaatatttagcaaatttcttcagtaaatagtagcaatctataaagcttattttagattatatttaaaatcttaaaaaataaagtttgatagtcaacattacaaaagcgattatgacaaaaatcagttcatattactttgcgaatgttccctcatgatgcatcatcaccttagtaatggagaaaattttgtgacttgataatctctgagtggaaataacttagaagtcacaattttcgtgtaaatgcatttttttcttttaatactcatatatataattgtttgggctggtaatgttttgatgagtgactaaatagttaatctgagaaggtggccattcacaagcatctttcccagctgctgcttctcattcttctccagaagaggagcatctgacctattgtccccctagcaatcatgttggacaaaggcttcttctgttttggtgctattagaatgaaaaagctattggtctggagggtaagtttctcactaaatatttttccataaacacaaaaggagaaagtatatggcaaataaaacttgtatttaatagaatggatatagacaaggaaaactagatgtgaaaaataagtgcaaaatccttctatccactcctagataaatagaacataaatatacaatggaattctatagactgagtaaattaattcagctaatgtgtattaagcaccagtgtgcagggtaggtgttagctctcattctgaaggttacaaaggcaaacaagatgtggtccttgcctcaaggagttttaaagctcaataaaataaagacccaaataagtaatgacaatacaaaaaaaaaaaaaaaccagaaagaaaatatattaagtgtggtatgagagataaaatatgttatacattactttaaatagtgaagccatcctgaagaagacagctggtgtttgaggtgacttttcaagagcagggttttaataggggggatttgggaagttgagaaggaacattccagggagagaaagtgcatgcataaaaacaggcttggagagagaaagagctcaagtgcttgagccacatttctccccacctcccccaatggcactttgaggtggccactagctaaaactaaaggttctgcttcattgagtggtagtggtgcttttctgggtgaggaatgtactttccaaaaaaaaattattgtgaaacgtggaaagtctcattaattcagaatcagtcacatctatttttctctaaacattttaacttgaaattgattataatgctatatagttttatagttttaatcaaggtgctgaaacatatcatagttagcacaatgtaagacacaaatactaacctctctaaatgaaacctctctctcccaagaattgttgtcagtgtcctaagttcatctattatatcctagcacagaaggacttagggagctccttggggttgttatcacattttcactaatacctctgggattatgtggccataccatagtgtgagtctaaatggctctaaatgtggttttacctctctttaaaaatgaaacaaagttaaatgaagtgaagcctcaaaacattatgggaactgtaatgtcccatggaccaatattggaactgggccacacagcgggaggcaagccataggcaagcgagagcgaggtttcaactgtatttagccactctccatcactagcattactgcctgagcactgcctcttatcagatcagtggcagcattagattctcacaggagtgcgaaccctactgtgaacaatgcaaggaagggatctaggttgcacactccatatgagaatctaactaatacctgataatctggggtggaacagtttcatctacaaaccatctcctcattccctttcgtgtaaaaaattgtcttccacgaaaccagtctctgctgccaaaaaggttggggaccgctggcctatagctcatagggttgcaaagaatctcagagagtgggtgctaaatatatatttactgtgtgctcaatcagaatagtggcaagttaaccaaccttctataccaatagttctcaaatatgaacgtgcatcagaatcatctggaagacttgcttaaagacagattgctgggatttttgacttagtaattctagattggagtagagaattagaattcctggcatatttccaaacagtgctgattctgcttttccaaggaccacacactgttctatacaatatgattcagagacaaagcacagctttgatgcaaaaaagcattgacagaacgtgtgcatagaagcagaaccacagacaggaatacacacaagtaatagcggcagcttaacaacaagaaaaattttaaacaatgtggaaaattagtaacctcatttttgaacaggtatgggatttttaacatctacataactatggtattgtgaatttgggatttgtgtacagatatactgcattgttgttgatagtcatcagaatctttattttcttctccattttaaaagtgtggaaatgttggtggaaacttaagtgccttcaactactcataagaattttatgggctttttcaaagggctaactgtgttaacaccaagaattaaaggactatatggcccccttaaatatatgcacatggtcaagaaattgtctcaaagcaatagggctccactttatccttcaccctacacccagtgttgaaagcatgtattaatacttgctctagaatgatctcattgccattaaaaggagggtactagactgggctaatcagtaatctatgtctagtccacctcctaccattatacactctggttgcctttttagtataatgtatttgagttatttagtttctctatcttccacagttctgtcaatacgcttgacatgcatttggaattacagatagaaatgagatctgaatttgcagaaaatcctttctatctctggataagatgatatatctttcacagtatgctaaataccaaaatgacattttacattctcacctgataattcaagtcataggataaatacagtgcctagcttagccttattgatgagtacagtggcagatcccaaaacacttgtcaatttaagactatatttaaccaatattgtcattcagccattgtcattgatctaacattaaaagtatcagaaacttacaatgcaatatagggacaatattcttaagtggtaaattaattgttaaagtgtgttaaagatcaatttcttactgcatttttattacaaatgaaatatgactccagatctttcacagtgatcataagtgaacaaatatttgcagatgaccatctaataggtttcttcacaacactgtgctagatcaatagatttggtaaacttgactttttttttctaattttttcctcactggtagagattttttaaatgtatttaacattatggaaatatttcaggaaataattacttatcaatattgtaataatgtcatgttttcaaacattatcctctctgttcttaggatacattcacagtgagacacaaatgacacgtgtctaggacagaaatggatttgtaattcttgagaactgttcataataagtgctgatataaattgaattcacaaagtgtgaaatgattctatcgctagttttgggtaaaataaagatctagaaaagcttgtgttcccctggagatagaaactctacccttattcccaactaccagcaatccagcaaacaaacaaaaaaacaacaactactggaaacacttacatgtttgagtcatttgctgtgacccaagataactgacttttgatcccattttgcaatgggataaattgcgggaaatggtacaagacagaaaagttaagaaaagaagcctgaacgattacgttagaaaagtcctgcacaattcatttgaatggtaacaaagccatgagcaaggcagagagtaattcttcccgataggtaaacatttctgtatcagaaaacatatttctatataaagttttatgtagcaatttattggtttttctttcccctcatttcctttagtagataactcaacccttcaaaaattctgaaaagttcgaaatcctggctttttgccagagcatcatggccacatcccacttttgtctctattcttatctaatgcatttcatattttaaggaaaatcccaagggaatctttgtgtggtttgtgtcttctcgcgagcattggaaggacagaaagtctgccagtctgtacagaaagtttcatatactgaccatgcaaaaataaggcacaatcattgcaatgttatcacttctgggaaaatatatccagaatgcaaaataatgttagaaacatgttatgcatcagtagaagccaacttactacctagattagatctattatgatacagaagctttggcaagcatgtcaactgtcatatttttccccaaagtactaagttattttacattattttgagatatcttctatgttcaatcaaaacctctgatcaatctaatttgagctaaaattactaaatttaaaaaatacttgttattttagtgagaaaagttcagatcatttaaggcttggtcttagcaaattgtagagtcagagaagatttcgaagaaatctagatattgtctgtttcatatccaattctctttcgtaatagatgacattgggaaatccagagagattgagggacttacctgtaaaggttacttagagccttaagtaaatacttagtctacctcaccatgaggctcctgctaacatttacaaacagttggcagccaggcaaagattttatatcttgttcattacacagaaacaattcattctatttgggcttggccactgcattttatttataaagagagaaaaaaaattaagccacataaagggttagaggagttactgcatggcatattttaataaatgatcaacatgttaatatagacatttaccctaaagacattgctataaactgtctaccacatttactcaggtttttatgaatttctttaatataactaattataatatagagtatcttttctcctcaatttaaggaaaataataaaatgggtcagtagagcacatcttgatattgggtttcctgtaagaaaaagtcttacttgatgcattaaagtgttcacaaatttgctaatcatgaacagccctgagtagttttaaatacttaatatggaataagtttgaggggttcaagctgtaggctcactttgaacatgtgtattgtaaatttgacaagcttccaacatggtatagaataatacataattggcctcttaattccttcaaagattatttccatgattacttagtgggtaatcataatacttataagaaatatatattccactgtgtggtatgtgaattttgatttgattgtgcagaaagacaatttatctatttatgtatacttgacaaatggcaacattgattcatttgccataactatatatttatgtaactcaggggcctccaaccactgggccatggactggtactggtccatggcctggtaggaaccaggctgcacagcaggaagtggccggtggtgagtgagtgaagctccatctgtatttgcagccactccacagctactgcccatcagtcgttactgcctgatctctgcctcccatcagatcagcagcagcattagattctcataggagctcgaacactattgtgaactgcatatgtgagggactgggttgcatgcttcttatgacaatctaatgcctgatgatctgaggtgaagctgaggtggtgatgctagcactgaggagcagatgcaaatatagatgaacgttagcagacagatttgactgcacagagaccatcataaatcagttgcttacagactcatatcaaaaccctatctgtgctgcatctggtgtcaggctttaagtcagaatctagcacttaatttagtccatgtatggcccatccattattgtatttaccacttccacccatgcttctttcctgcactgtgcacttgtttcagtcacagttttggtaagccctcaagctaacccagccaaaatgagtaaaaaacaaacatcactggagtgcttctttgaaggagggaaagacccagtgatgcaacagcggaagacttctaagactgcctacaaaaattcagcatttaaaagaaaataacaagagtcccacttaaattatgggttcactgcaacaggtgattcacattcattctgcaagcctgctttgtataatatgtgatgactggctatccaaaaaagccataaaacctttaaaacttcttcaccacatgcagattaagcaccctgtgtcaaaagtcaagttcaagtctttggaggttttctttttttttctttttctctactttttttttctttttgaggtagggtctcactctgtcacccaggctggagtgcagtggcacaacctctgcctcccggactcaagtgatccttccatctcagtatccctagtagctggaaccacaggcatgtgccgccatgcctgatttttgtattttttgtatatatggggtttcaccatgttgctcaggctggtctcaaactcctggcctcaagcaatccacccacctaggcctcccaaagtgccagtccattttgaagtttttcaaaagaaaaaaaaaaagatgaacatgaagaacagaagcaaacattgaaggacaccacttcatcaaatgtgtctaaactgagagcatcattcttagtggctaaccacattgctacagctaagagaccctttactattggtgaagagttgatccttcctgctgctaaggacatttgtcatgaacttacagaagaggctgcagttcaaaagttggcacatgttcctctttcagctagcaccataactagaccaattgatgaaatagcaggggatatcagggcacaattgttagagaggactaatgagtcaccatggtatgtagtctaggttgatgtgtctattgatgttgacaaggcaacaatgcttgttttagtgcaatatatttttcaggaggatgtgcatgaggatttgttatgtgcacttttgttggcaatcaacaccacagctgcataaacattcaagtctttgaatgaatatatatcaagaaaactgaattggtcattttgtgtcagtatatgcatagacagagtagctgccgtgactaaaatggctttctgatttcactgctcgggtcaaagaggtcgcttctgaatgtgagtctatgcactgtgtcatctacagagaaatgctggctagccaaaaaatgtcacttgaacttaacaacattttgcaggatgtgattaaaattatcaaccacattaaagtacatgctcttaactcatgtctgtttgcacagttctgtgaggagacagacagagagcacacacatcttctcttttttttgagacagaatctcactctgttgcccaggccagagtgcagtggcacgatctcagttcaccacaacctctgcctcctgggttccagtgattctcctgcctcagcctcccaagtagctgagattatagggtgcccatcaccatgcccggctaatttttgtggttttagtagagacagggtttctccatgttggccaggctggcattgaactcctgacctcaagtgatctgcccgccttagcctcccaaagtgctgggattacaggtgtgagccactgcgcccagctacatcttcccttatacacagaagtgagatggctttttaaaggtagatccctggccagagtttttgagttatgagaactactccagagatttttagaacaacaatcaccactggcagcacatttcagtgacacagaatgggtcccaaaacttgcctatttgtgtgacatattcaacctagtcaacaaactcaatctgtcacttcaggggagaatgagaactgtgttcaagtcagcaaaagggtctgcattaaaagccaaagtagaattatgggggtgatgagtgaacattgggatttctgatatgttttaaacattagctgtgatttataaagaggctgagccagggccttctttctcacagctggtacatgatcacttacctcagctttcaaaagcatttgagtattactcaaaagaccccaaactgggaagaaatggatccatgacccatttatgaataagccaggtgaatggactttgtccatgttagaaaaggatcaactgcttgagatcacaaatgacagtggactttaaaatatatttgagacaacttcaaatctccatatgttctggattaaagtcaaggcagaatatcttgtaattgccacaaaagcaccaaagagcctgcttcaatttccaacattctatctttgtgaagcagggttttctgcagtgacagcaaccaaaatgagattatggagtagatgggactatctagttgcaggaaaacaagctcagggctcccactgattctacattatggtgagttgtataattatgttattatatattacaatgtaataataataatagaaataaagtacgcaataaaagtaatgtgactgaatccccctgacaccatctccttcaccggtccatggaaacattgtcttccacaaaatcagtccctggtgccaaaaaagttggggaacactgctataacttataatattggcaataaagatttttggcttctgctgtaaaggagatgtttaatcaatatgttttggaaggtcctggctttctggactacagatcaccccctttgggatgattaccaagactgaagtggttctttatccctaaagtccatggaaatgtcctatttttgccacaactcacacttggcaaagaaagaaaacagaacccataggttggaaatacaagaagagagcatcacacatcatttctgactactaaatacaatgtgactactagtaaagcatgcagccagtattttgtaggaaatgttagagaaagtactttcatagaaattagtttaaagggttttcctggtgcttaaaaattgtattttaagaaagtaattaaacaaatattagaactcagcatgaaaatctgacattatagtacagataacatgggaaaagcaacactgggctagagatggtctaagaacaggtactattaccttaaccacatgtggggagggagcattactcattctttagtaagatgcaactaaggattgatattagaatccaacatatatgcattattgttttttgtaattaaatgtgggaaatggattgttaggtaagatgtttttctaaagctcatgaaacacttttattaagtcttgagttaacaaactatctataaagaaattcctagagaggatgagtgcaatctggcacattatgatctgtttcctcttgatagaaaagaccagaaattatcccattatcctgttttactttttaaaaatgcttacattgttttaaagtagtatgttcttgagaaagtgctcatgccctttaagaaaaaacatgatctatctgatccaatttgaaaatgaaaactgatgggtaagggacacattttatgtgggaattggtgctacaaaatcaacaggaaacattaagagagttttaaaaatgcaaagagaatagtaagtggataaaaataatgtatatccctatctatctacctatctatctacacacaaacaagtgttatttcatactcctcttggtgtcttagtaaatgattctaaatggaatatgttgaaatttcattatttaagaatagatgatagattaaaactactatgtacttgagttctcatgcacataaaatattgctgggatccagattaaaggacaagggacataaagggaaaggcaaaagctaaaagttaaaagagaagaaacactgaaaaaaaagaaaattattgaactgacttgactttgtatatattacattattaaatgcattattaaaatatatatccaagccatgttaactgtaaatgtctaactttcctcgtcaaattttatctgaaactgtcaaaacttttaaaacttagaagaagaatattgagaaaaacattaccttaaacttctttttaacgtacctgggttcagctagataaaaccgcacaatatcatatcttgaagaaatgtttttatttacatttattcgtcaaaatctgaaggcattccttccagaagaaagactctcttaatattatttattgcatataatgaattgtaagaaggactttaaattgattttctcaaatctgactagcttataaagtgttgtcagataattattaaattcaactgaaataaaataatttataataatgcatgatgattaaaatgttggtacataaatatgagacagggaaaaacaaaggctggaaaagactggacaaatttgaaaacaacttttcaacttgccaccaaaatggcaaaacctaattctaggtaaagtggttgactttttcaagtcagattaataaattaatgtaaacatctataaggaataagcaacatccaacagtttcatactattcaatttcttttgcaaatgtttcctctttttttgctaattcttaaagatcaggaaaaaaactgtgtgtaacataatttcaatgtagattattccttggtaaaattcaaagtaaaccctgtttatttgtttttatataaggatcttataaatgatatccaaatagacatcaaatttagtgtcataataagtgggcgaaggatatgagcagacacaaaagaaggcatttatgcagccaaaagacacatgaaaaaatgctcatcatcactggccatcagagaaatgcaaatcaaaaccacagtgagataccatctcacacgagttagaatggcggtcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacctagccatcccattactgggtatatacccaaaggattatcaatcatgctgctataaagacacatgcacacgtatgtttattgcggcactattcacaatagcaaagacttggaaccaacgcaaatgtccaacaatgatagactggattaaaaaaatgtggcacatatacaccatggaatactatgcagccatcaaaaatgatgagttcatgtcctttgtagggacatggatgaagctggaaaccatcattctcagcaaactatcacaaggacaaaaaaccaaacactgcatgttctcactcataggtgggaattgaacaatgagaacatttggacacaggaagggaacatcacacaccagggcctggggaggggggagggatagcattaggacatatacctaatgtaaatgacgagttaatgggtgcagcacaccaacatggcacatgtatacatatgttacaaacctgcacgttgtgcacatgtaccctaaaacttaaagtataatacaaaattttaaaaaaaagaaaagatatatttgaagtctctatatttcaacaaaatagactcaaattcagtacccatcatacagcatatatttcacagtcactattattcaataggtatgtatatgaatagatacacatctatcttatacaaaaacaggtcaaaaagcatttaaaaataaaaataaaacttaaccaaaacagaaataaataaaaatagacatgcccttaaaaagcttgagaaacttaattaaactctggcaaaccatggaaatggaactcaggaatagaactctattaagcaatttttccttatgtatagattatagctactgtgtagctgagcctatttcttaatgcactgatacaagaactaggtatcttttagtttagaggagaaatgtttagtgtgcagatttcaaactctttcaacattctgatctctgatcatgtagtacaattgagaagtatgatgaagaggatggcatatttagcttgaagttaaaagagatccaacttgcccttagtttattacgtatttattgttgagacagggtctcactctgtcacccatgctggagtgcagttccatgatcatggctcattacagcttcaacctcccaggctcaagcgatcctcccaactctgcctcccaagtagctgggactacaggcacaaaccaccatgcccagctaatttttttttttttaatattgtttgtagagacagaggtctcactatgttgcctaagctgttctcaatctcccaggatcaagcaatcctcccatctcagcctcccaaagtgttgagaccacccttagtttattgaaagcatacttctttcttcatatggacctcatctgcctctcttacctgatgctgtactaccagcaccgggatcatatttcatatgtatatatgtaaacaaattaataaatttatctgaagaaactcatgtgaaaagtacttgtttcaacttggcaaactcattttttcctagaaaaaggaaagaagaaagaagtgctcggtgttctttctgttcaattctcaagttgaaaggggacactacaggaaaagggaagctgttcctctgttggcaggtattccctatttaattgtgtctcaactctgcccagggtactcagtggggtaaaatcagaagcccttccagggtaggcaggactatagagcagcactccccacccactgccccaagttttcttcagtcttcagcgtggtttccagcctgaggctgaatcctcccattatttaacatatgcatattcaactcaaaataataaacgtgtaccatgagggactgactgctaaatgtatccctgtgaaaaatcacactgacaatatttgatgtttactgggtataaaagccatctacgaaacataagaaggatttcttgtgacttgtatgctataggaagagaactaataaaagagtcccaagcctaaaccagaattattctgctcagtctttttcttctaaattcacttgcttcaaccacaacaaaagccaaggaccactttggctcccttttcttacccaagtttgcagtcataataaccttttaaaaaaggtttttaaaaagagtcccttaaccacaaagtccaatatctcagtccacaccctggatattctttgtctcacaaacttggtcaaggatgttaaggtaataaggtccactgcaaacatccaaatataaacaactgcttgttgattctaaaatcctgatgagtgttttcatcttgagtgtttaacagctttctgacatggtaggatatcctatctttcttcctctagacaacaaacagctttctcatccctctttgccttctcagtcattcaacactttagctaaagggaggagcacaaattcttttctgtatgtggagacttaaagactactaggaagcacacaaccatttcacacccttcctctttcatcatcaccagctcctctttttattgtttctccaacttgcctgttgacaaagacagctgctaacaattgcatttgtggtactaggatatgcagtctaattgcataggcttgtggccaggggtcttgtccagttaagattgattttcaaaaggagagctacagagacatttccttagatgtcttcccactcacaaagttcaagggacattcatactatactcttaaatggctgcacttgaaaattgttttcatgttttgttttgtttttttcctttcacctttatgtaacccctccaaaaatcctggcatagatgttgagtgaagagagtactgctcattagaatcaacagttttcttttgttcagttgcccttgctggctaactactaaacaacgtaatcgcattggaaagtcagagatatttttgcctttgaaactgaagcaaaatggtgacacaaattctttaggtagcaaatttgctggcaaatttattacagacataaaaacatataaccagttgttttctttacaagatacttatttatcagattctgtacatttcccttaacccttacaattatcttatctatgagatcttaacccatactgacaatctcatgtatattcctaaaatacttttaaaaagtctaatggtcgggcatggtggctcactcttgtaatcccagcactttgggaagccaatgcaggaggattgcttgagcctaggaatttgagagcagcctgggcaccatagtgagaccgcgtcactacaaaacacacacagaaaaattagctgggcatggtgatgcatgcctgtggtcccagatgctcagaaggctgaggtaggaaaatcacttgagccaaggaggtagaggctgcagtgagctgtgattgcattactgcactccatctgagtgtcttttgcagcaacgtggatggaacaggaagctgttattttaagtgaaacaagtcagacacaaaaagacaaatatgtattctcactgataagtggagaggatacaaaattatctgggtatggcagcgcacacctgtagttgcagctactgaggaagctgagttgggaggatgtttgagcccaggagtttgaagctgcagtgagccacgattgcaccattacaatccagcctaggtgacagagtgagactctgtctctgaataaataaatagcctaagaagaggaaaaccttataagaaaaattatttcaagtggattccaacccagaataactagttgacgtatttgaagaattaataatgtagattgtgctcttactgttagtaaataggtgcatttcattgattccttttggttttaccaagtacagtcttttgttttgttttgaagtggagtctcactctgtctcccaggctggcctggctggagtgcgctagtgcaatctcagatcactgcaacctctgcctcccgagttcaagtgattcttctgcctcagcctcctgagtagctgggattacaggtgcatgccaccacacctggctaatttttgtatttttagtagacgcggggtttcaccatgtttgtcaggctggtctcaaacttctgacctcttgatcctcccgcctcggcaccccaaagtgctgggattacaggtgtgagccaccgtgcctggcctagtcttttctatatttgtagaagtagatctttctcattggctggcatagattggtgatagtttcttaacttggcatcactatctgctatttcatcaacacctccaacctaaactagaacgcatattcacatgaaaatttaaatgaaaaaaaatcacaaaaatgagcatgtacccaatataagaaacatttgctttgaaattgatggcttggaccttttaagtggttttggcaaaattaccatctggtctccaacacaaaacagctgttttaggtggcaaaatcttgtcaagctaaagctcccaacccttaagcacgggtaattggcaagaccttgttccagttcatctttagtccctactgaatctgggcaaacaactgtgaatttgcgctaaattcctcttcctataataggcagcctggcttcccatggagacacagagttttcagagccttagtgtcctcagggtatctgccagtacaaagctggtctaggataagccacattaatagcagtttcctcttttcattcataagctgtccttttatatttatgagctcattcttgtgagttaaatattttggatgtatttctgcaactttagtatttacccaatacttactcaaaaacagtaagttgtctaatcctttagtagtttttcaacattttcaaaagtattgcattttcaaaagaaagttaaaggagcattataaacaaggtgcaaggagacagtggcagttgagacttcgctttctcaacatatggcttatgttacaactgagcaagcccccagcttttatctctgggagctgtgaagttgactgcttataaggtctcaatgtctaattaatccttacttaaaattcacctaagtaagtataacagggataggaagttggtttctgttagcagttccacctttcaccctaccaaacatctgggaaatattcagtttaagatcagatccaagccttttggcattaactaccttaaaacattaagatatcaccagcaatttgcctctgtttcagaaaattaaaagcatatttgagatataaacatgagtgtgtcactaatattactggcaataattgagagctattcttttattataatgaggggaaaacagaggatattctcagatgaaataggtagagtaagtccaaatggtaacattactttcctaaaataactgtgtatgtaatgaatgctgaaggtaaagcatattaaatgctagtgttttctttcatggctgttgcactatttgttaggatagagagcatacatagcttatgtaagcaatataaagcctcatctgtctcttagaaaaatgtcaaaattacaatttaaactgttcaaaatataaactaagaattatcaacttcattgatcagacgtcattttttgtgagattattgactgtttgcttaaaattaaaaaaatggacgttttcttcagactttgtctcacaaacagtaatttgcattcatattcttaataattaatggtgagatcatggggaaaagacatcataagtaatgattcctggtaaaattatgatggttatgacttcatttatatactaaagctaatggtaaaaggagagagagacaaatgagaagtgcttttctgtggtttgaagacatagttctgaaaaatttctttgggagctaaatttaaatttctgacaagcctcttccttttgtccagatacaaattaagccagactagatagtgcttaaaatttttgtgcacttattttaggagctccttttttctggggccactccaccaagactttgcttattacatttttcactttggagctttgcttaacaattcagtctctttcttagaaactgtttgtaaacatctatcagtatccaaattcttacatccataaacttcatgtgattttaggctttattaaataattccattgataataagagaaagaggaaaaggaaactggaaatgtgactgtgcctttaattggagattgcaaaatttttctcaagcaattttcatgtttgattcaatgttttctaaaaaagcattgacatttaaaacattctttaaaaggtcattttaaagacatgtgagcaagttgtactgagggtgttgtatgtgcaattagggttctttcctctgtaaagccttgccaattccttagatgaatgagaatccatcagctcagttttcatcaccttttgtgtctctgagtctgacacaatgttgttgatcccattttgcatgcaaaatacatgtgggattgaaaattaaaagcagttaccagccggctgttaataacacataaccaaagatcatcgagagcagaaatcatgctagcatcatgctaaaaagaatgtctaacagtgccatgaatattgtggttactcaatacttagtgattggttgatatttaatgtggacacttttgggcttgagatggagacatgcaagctgtgttctgatggcagtgcagcagaatataaataacttgaagggaaaaaaaaaacctaccaattcctccctatctccccacctcttcagaaacaacgaatactattaaacccaatagatgtgtaaagcacaagtatgaaccccagttttccatttaaataatacaaagaggtgtttagcatcgtgttaaagtctctctctctctcttaatctttgggtagggattttgttggtagaagttccagctttggattggcaagttggaagctgtatgaatttgaaacagccagttaatgtctaggagtttccttcctcatctgtaaaataagttggttgccccagtgagtatcaaagacttttccagctttataattctatgatctatgaacaagagccaaaatcacaatttaggatttggcacctgattttatactatgctagtgccatggaactgcttatttcattaatctcacatgttgaatttctctatgtaacctggtttgactttgttgttttttcctttaaaggaaccaagcatactatccatttggcaactgagagtggttcttaaaagagcttttaattgggaaataaatgcaatgccagtggtacatatgtcctactgccctctagtggataaaaccatatcttccctagagtagttaacaagtttggttaaaatagcgcttctcaagctatacacatcacctggggtgacgccttagcttctgcattacaaactcccaggtgatttcagtgctgctggtcctaggaccacactttgagtagcatgagtttaagtgattttctttggtatataattactttaagtaaggaaggaaacatatttggcacaggatatgaaagaagtttctagttagcagaagatgcagaggaagaaaaagaaacagaaggaggggaaggaggaggaggagagaaaagggcaagagaatgagaaggagacggggaagaatatgaagaaggaattaaatccaccagattgaaagggctcatgtggcaaaactacatagttcttgatcactagcaatctctagaaagtttctatatctaggcttaataggacagtatatgcattaggacttacattgtgttcctcttatcttttattatattttagtaaattttaattaaaaagaagtcctgaccccccccaaaaaaattacaacttcttgaatcaaagttaagattttacaattctataattatgtaaacatacatattaaaatcagtctagagagaaaatactcactacttttgtgtattttattacagaagtaagctgtgttggtggaacactgagtatatatagctagatgcacttaactcttgcatagtgagatttcttcccagacagtagaatagtcaaagtttagcaacaaaaacctgtatgttcaaagcactgttctgagtactgagaatatagacctaagcaaggaagccaacccagcagtggcattttgtcatgagttaattccagagaagaagagaataaacaactatgttaaagtataacaaaatttatagaagattaatagtcatcccatttatggagcatcactatgtccttgaccctatgctaagcaaacatcggccattattttgatggccccattatattctccattatatacataaggaagctgaaactaaaagaggttaaagtcaaggtccaaactcatgtatgacatcaaaccttaaccactggattgtgttgcatttcattgattttcaaaatgttaactccagctaatcaacagatgaaggggaatccttcccctctgtgttccatattttcaacagctgcctctttagtgcaatggaaggagataatgtgaggctgccagtttgagtaataaataatgtgtgttggtgtctcagcatctcttcatttttattcgatctgtgaggagcgtggctgtaggaagaggcagcgggagggaaagcagaacctgagacttgtatctctgttttaagtttggttccctactctaccccttcagcgtagctttcatcctcttcagtagattaaatcttctggcccacaccctctttattttcagaaacaaatggtcacgtggggcaaaaggtgattctcttttgctgctacaactaggaggggcatcatttccttataataatggtaaatattacttcaaatttaccttcccagttttccacttccaggcaagcatcagttacttgtcttgaaactttgttatgccccatttttttattttgaatgaggatatagtgccctatccttatgtccacaaccttaggccttgtatccgttcctgttttgccatatcatctctgtactccagagtaagaatccattttaaaatactgcttcttctcattctttcatagaatattctaagtttgtttctggaatagtctcaggcattgtctacaaagaaatcttgaaatccaaaaccaacataaaggctctcccaggtcacttaaaaaaagaaatgtaagccaccttcttatcccaactacataggggaatatggttacttcccacagggaaattttttttttattatactttaagttctagggcacatgtgcacaacgttagaagcttaccaatggaaatgtctttagaggtcatattaaagaatgtcagtaatttggattggacacaataaatgtcctaatggttgaatgaattacctagcttaacacaactggtggttaagccagctgaaattcaaactcatgtttttttcaatatcagccaaatgctcttttcactagctctaaaaaaatgatactattgcagagtagttaccacctgatatggtaatgcctagcgaaagctggtgcctgacattgtttagtcagctgacaaataaagatacttgcataaacaagcccaggaaaggctcagtggaaattgatcatgaatgttgggagaaaatcatgagtaagcataagataaatccctgtatcacagaagaacttttccctttctttgtctcccttaatcattctcacttgaacattttcccctactaatgttaggattttaaaaagatataatattgtatttgatttaatttaatcttttccaagtacttccagactcaaaatttaacttcatcatgaaagagtgataaataacagcaagacaggaacatataaatctgaatagtctttttctaatcatcagttataaatgaaatttggttttcaaactaggcttacaggtaggaatatgtggctcataacataacaataatcactcataacaatgatcactcaccaagaggcattcatgcatcttttcttaatggtgagaagaaatgacctactctcccttcccttccctcaagcatgcccaagtagactggagatcttcagattttcctttttgtatcaagttaaactctagtggctgtattttccattctatttatagctagtgttctacttagtatgtatcttagtataaaacaaaaaacatactttcatattaagggtactaaacaaaagttctcttgggaattctactggtaacaatcattcagattttatgttcccaattctatgtgacaaatataatgtttggcatgttaaacatattcattgatttacaacctgagtgttattaagaaaggccaattacattctatttatttaggttaaattattttttagcacatggaagctaattatggaaaacacatcctttgtaccaattcatacaggagtcaagccatgattagagttgcctgtctagctttaatatactgctttccactttattgactatacagattgggaaagtacatattgaaaatgaaagacaatctgtaaacaaatgttatagaatatgctactttacctaggcatacccattttagtaactcatataaacattcatattattgaatatttaaaatatcagaatataattggtaaatattaataacagtaataacttcaacagaggtctaacaaataggacaattctatggattcaaatgtttgaccaactagaaagtaaaagggaagaaaactgaaataagataacataaaatatgtaccatttgaatcacaaatttgtagatgaataaggtagaattgttttatctttatcattgtatattaatgaacttgcatgtttttcatcatattttaaaaccaaattttcatcagtatttcattaatgtttttggagagctgtgctttttataactgctaatttttaagttctttgtaagtttgattctctttctttttttctaattcattttatctctttaatgagagttactcaaaatatataatttttgtctgaaaatgatttaaatagtctaagaaatactggtgtttttcaaaatttctttcatggtatttaaatgcataattttgtgctagtttatatattttattctcgtctttttgtggtttgatttcataatattcagagataatcagtttcaaatacttactgtgatcaaaattactgattgtcagattctatgtttgtcttctttgttttgttgtaatcatatcacttcatttccccacaccctcctcctccggggagaggtggagaagaactgtctcatggaaagatttctctaatgagtaccctaagtgacagaaagaccatatagagcaatgcttatacatttggactttggaaagctggagttcaaatcctgggtccacaaattatttaagcttgctaagcccagttttttcatctgtaatatgaaataaaaatagaatttagaactgtggtaagaattaaatgagatgatgccttaaaagtatatagaagaatgataaaagaatatggtaaaatgacagttacttttattaatctccttgttttgcatatttcagaagtcagcaacttttcatcttagttacgttccatctaaggtgaaatctagatagaggaagtgacatggaagacaaagagcgcttactaaccaatttggggaagtggcaaggcagaatggtaaacctgaaaataaccaaagatgagcctcaaattttcttagatcctatattccctgacagctgactcaaactgagaaagaggctatcttaaataagatagagtaccactatttctgccactactattataacaaattttaatcccaaaaataggctttaacatctagtggtttcacctgtgaatgttattacattttttttctaaaataggtaagcttatgttatattagtgatcccaatttattttgcaaaaaagtagcataactctgatactgaaatattaagataacacaaaaagaaagatactattgaatcctagataaaacattaattaattgaattccacagtctattatagaagatctcattatgatcaattgaggcatatcccaggaattcaaatgaagttcactcttagtaaactacaccgactgacgcaactagtatttaacattaactcactagtccaggttaatgcaatgtaacattaaacaaaaattagaaagataagtattaaaaagaggaaaccataccatcattaccttttgatgatagaactgcctagctaaaacacaaaaataatctactgaaaacatttatttcagtttgttgaattaaaagtactttaaatcaacatttttctatgcgtgaagcactattagaaaataaaatggtcagagatgccaaaaacagatttggacattaaaaagcatattagggcccagcgtggtggctcacgcctgtaatcccagcactttgggaggctgagacaggtggatcacgaggtcaggagatcgagaccatcctggctaacacagtgaaaacccgtctctactaaaaatacaaaaaattagccaggcgtagtggcatgcgcctgtagtcccagctacatgggaggctgacgcaggagaatcacttgaacccgggaggtggaggttgcagtgagttgaattgtgccactgcactccagcctgggcgacacagcgagactctgtctcagaaaaaaaaatgcatattacaattattatgtgtaatgatgacaaagtgaaaacaatctaaatgtccaaataaatgtatgtattaaataaattattattctaacatgtaattattatgtttccaccaacaatcatataacatgttagaaaaaggttaaaaatagcattaatgagttgaggaattgctaataatgtaagctttaaatttgatattttatgctcacaattctataaaagctaccatttaatatattatcttaaataacacatatagtttttacatatctgaaagaaggaagataatctaaaataatgattgcttctgtgtgatgacattattggttatttttattttctttgtactcttctgtattttctacaaccaatatttagtacttgtttttcagagtacaaaattgattttcagaaaatatgacaataatcaaatttgagggataccaaaagaaattatgaagctctgtgtagacctcctggtttagagtccctgcagtgaccggaggtcttctgccatttagaggagataaatgccatatctacattgaaagatgcggcacagatactattcaggttgacaaaagcatccgtccagcatgtttagcttcctaaggctttgatgtgtttaaaagatcagcaaagcttttcccttgtcttccctcatcacaacacaagttcaaagaaacatttattatgaaaaggctaaattctaacaaatgtatctccccagatttgaattacaatttaagtttctctataactttatcagaatttccccaacagctgagttaaagtactctattaattttcattagctgtttgtgattaatttgttctgttttaagtatcaaagtcaaaagaatgagacatgttattgttattgagcgaggaatgtaagaagataacagagaattaatgtagaaaagcaaactgtatctagattgagattgtctaactagctacttagtaatgaatttaaggcatgttaggaacatcagttagaatgtgggtaaatggtcatgtaaagccaaatccatgaatctgatttcctgttcatttaagaccaactatatttaattttaaacagcttctttccttttactattttttctaaaagcgatcaaagcacacaatgaatatgatttaaagagggtattttatgaaaatttccaaaatatctaatctgtctttaaatagagactaaaatccaaacacaaagaacattttaagctttatttaattatttttatttgaagtctttacatctcaggttctaaatgttgtacaaatatgaccagaatagttaaattattttagagttcagtagtaccagtaagtataaactaacccactactcaaaaaatgttacacatattataatttaattggcttttaacttttgaatgtagaaattatgataattgttctcacagtatattaaagacatttagagttgaggacaagagaaaaaccccacaaattaaaaaaacttttagcataaggcgttctgttggggataagagctttctttatataagtgggctttgttctggtatagcaagacaattttccttgcgtatttgcaaattatctaaaatgcaatgataaccttctatcaacactctatttgtgaaacagtaacctatgaggcccatactgagaaatttccacttctttttccactttgcaattctttgaatgatgtcttcttatcttcaaggtttcctctggccatttgacccctatctttaatgtcatgctttctgttctgtgctgttcagctcctcaccttcccacttttggttaaattcttcccttctttcagagtccttattatctcagacaaaggactggcacttcaggctatatgcccccattcttttcatgttcctatcaatgtccatctcttgcatcattcttatacattgctttaaattaaggtagaactttgctcatttctcttgagttgaactttctttctccactatttggttagttaataggacaggaaaacggtaagaaatcaagataatcaagatttatgagaggctgggagtgaagaactttagaaagtagcctcatctttgtcccagtgaccacttgccactactaagccaaagtggccatgaaattttccatttcgcacacatctaccactttggacagttaaggagaaatggagttaaagaagaaaggagtgtataaaaatgacgggagcagatgagactgaaatagcagtggaggggaaaagcaggagttggcatcaacacagaatttgggaggtgaatgaactgaaagtagcccaaagaataggaataacactcctttccctgtcccttcaagaattgcccaaaagttatacactttagtgagggttataagcctttgaaatctacccttgtatccataaagtgccaacattttagcttcttggtgtactttctttagctttttaaaaaagatacagcaccaacctaatagaaaaatattatgagatataataaaattttgaaagttcaatgacattatatgcagcatgaaaagaagtgtttaataataggacacagataaatgtttctttgttgtgatggctacaggtattgtcttttatcagtataattttaattttcattattctgacaatactgacttaaatgattgatagttgttggttttcactttaggacagcagagtgttacttaacatgaaattctgaaagaaaatgcttttgagaatttagactctggtggaataactttcttgatacacagctaacctttttttctaggaatttaaaatctaccgcctttggtaaactcagaaatgttgagaagaaaagagaattaggaatgtatgtgttgtcctttgctcaaaagaaaaaaaaaaaagaaaaaagaattgacagtcaaagaaagaatcaatccaaggtggaaggggagagacaaaacaaaagaaagaaagaaagaaaaaccatgtccatgtataaaccttagaaattaacatgagaaccacccccaagttaaggattggtttacatgatgacttgaaatatactttccatttaatatgagaaaaatatattctaatcaagtcttcctttgttcttattttttagcatttctagagtctatctgatttctcagttctagcgtaaaagtttgcatatgagttctaggtgaaataaatggcagtaaatgcttgttaatctaataactattatagcataatgttttacaatggaaaacattatgcttgcttctttcctacagatattatgcagattcattgaacatgtctttttgaaaatgtggtatacataaggaatgctgcattggataaaaattggtaaaatttcacttgtagggaatacttaggagcaagaatgtaaaaaaactacaccactccgttatacttcattaggtcatgtatctggtttactgaatacaatgaagaagaaatatgatatggtttattattttatatattcagatagataatagatagtctgagctatttccataattcactgccttgttattaaaaaaaaaacataaacctgatgagtgttttcaagtaggtaagttattttagtctattctttgaagcagagcaatgaaagctctataatgtccacataatagaccaacttactgtaatgtaataatcttggaggagatttaacacccattatctgaagacctaaaacctctagggaactgttatggttgctcagcactgctataggacctaaatgtaagaacagaaacatttctgaataagatccaaagtgactggggagaaatcatgggacagtgggttcatcatggaatttaaaatcagacagagctgaaccaggtctgccttatactcttttgattgatattgaacaaccctacttcatagaatttatgtaagtaatacattatttaaggtatggaaagtattcaacaaatagtggttattttatttctaaattccaactaatcttgtatgctttgcagaaataccatttggtgatgattgaaggtagagaggggaaagcaatattgtcttttctataatattctttaaaaagagtgtatgcatatcttgataacctcactctagcaataacatttgtgaatttaaaactatctggaagttagtaaatttttattctcagtccatgctaccacgtattccttaattagctgtctcctttataaaattatattattttagtcttaaatttgatcttcatgagtatcacaaacaaatcaatgcacacttatgaagtagcccttatgtattattaactataggatacaaagaagtagaagtcacactccagcatctagaccttacttttacttcagtcattgaaattcagtgtacattgtgttaggcacattctgtcaaaggacaaaacaatttgtgaaagttaataaatattagatatagatgtcacaaattcttttataacatataagtttctgaataaattgtatcaaaaataacttcaattggagttcaagggaacaaggattttggattaagaaatttatagaaagttttaggaaaaaaaaaaaaactaaccagaattcatttttcaaagtgctgtgtttactgattgccacgtataggttaagcactctagtaaaccacaggcaggaggaagacagagtacccttacataaagggaatgaaaatatttaggaagttcgttaccttgcccacactaaagttcatctacattaaaaaaaataagttgcttgctttgagatatttcagtaatttaagttggagaatgttgccgtctaaaggaaatccatgatgtctccaaatttggggatgtcagtctctctgttttacatgagtaaacagaatctagaacagtaagccaattctagcggagtaaagtgagtctctagattttattgcattgtctactagctccaaagcattaatcctcttccccaaatgcatcacatagtttggtaggatctcattagttatataataatttcctcaccattccatcaaagttccgaacttcaggaaagaagcatttccagagatgggtgcagattcaaatagaggtgggtgggtgtgtgttgcccttacatgaacaaataaaaataactcgtctagagtttatagttcatgacaggcattttgtttacaaaaataatttttcatttaaaagctctacttaaaaaatttttttgaatttaaatttccactttatgtacaagttaggtacaagtacttattccccactgaaatctatgctatgaatcctaaagtcttatcaaatgacaagaaaacaaagaatcattacaatcataacttatcttggatcccttaagtctaaagatccttaaagcctattgctaatattatagctcaaccataggaaatacgactgaagatcatgcattacctgattgtattatccagttttattcatgtttagcacaaactctctgatagctaattttacattaaaattctgtcttctaaaatgtgggacacataacattctagatgtttcatgctatgttgagggtatatgagatgcttctgaggtggcacatacaagtagtatgaaataacattaaatcataaaatgaaacacttcctgtttttcagttcttctggttatgtcaaggaaaatctcagtttattactaatatgtccttaacacctctggaaaacttgcttatctccctttccaacaaatgaaatctgaggcctcagacttagattcttttgccaaaacatagcatatagccacaatttaaccatggtatcttgtttttattatatttaattatgtgatcaccttctatttatggcaacagatattggctttccctttattagagtgatataataatttgtctttaaaaatacattaattttagtatacaaagtgagtcaatttgcaggaaaagaattaaggaaataataggatagggcctgacaaatatggcaacatttgtagtagtggtatgtgaatgactggtgttgagaaaatactgctaatgatggtttaacaacccaggaaagtaaaagctcttgctgaatgcagacagatcaaagcacaactctgattaaagaactagaggtgaacaaatgtgaatccagacataggggccaacagaacaagccaggttggatggccagagatctggtcagagtgcaagcaaagagacgtccatagagaacagagagacaggtgagactgaaaacacagaaaagctgtcagctccaagtctgaggcaagctgctagtccagcccaagtactttaatgcatcccattgccacagtccaattttatggattcatgcttgaatggggataaattcaggcagatgataataccatgtctgaataaagacaaactgttaggaaaatagcattttaagcaattgtatttgttactagggtactataaaaaccacaagatgtgtcatttgaaagttgttaaaaagattaaatgaatttttttattacaaaatttcaaacaaacagtaaaaatatcagatttgagatgagttatagttggggcaaaagttaaccttttttttttcctttaccaaaattagggttttactgttttgttttctctgtgtgtgtgtgtgtgtgtgtgtgtgtgtgtgtgttaaaccaactctctgacccacttctgcttccagggtcaaatattttgcatttccaatactcaggattgagagagtacaagttttccttcatgatgattttctgtggaacatttgctaataataactaagtttcagcattgttatgattttatagtatgtactgggtcagtggtttctaggggtcagtaaaagaaaggaagttttggaactttcaaaggatttcatttgaaaaaataacttttcgaatttggataatagcacttgtatattccttgtagtttccctgattcaaggcaataagcagtatatacaattacttgttagctcccttcttttcatgttgatagggaccacccatctgtggccttgggtgcctaaaaaactttagttattacaatcgagagtcacattagagattgtctgtaacttaaatcagcatatattatgtatatacactattttcaaatatatttggatatttttagtgacaaaataataaaatttattttaaagcatccacactagcttttcatcataatgtaggtataatgaccccatgtgggagtctgcaaaatatcttgaccttaaaaatagtcttcaaattccaaaacaaacaatatactgctggaaaataatgaatatagaatgagaaaatgggaagacttgatttgaagataccttgaggaaaaaaatcagtaaaataaaactgaacaaatagaatttaaccaagaatataatacttcagctaggttttatattttctgtttacaagactattaatgcattacaattttccattattattgaacttccattcatcttaaccaaagtgaatgaccattaccatcatcaatatctgacaatgtacaggatcattctctgcaacatgcttggggatctcttcacaaaaacaaccttattttgacctcaagctttcctcaaaatttctctccttttttttctttgcttcccttctcagaaatagaaagtttttccccattgtttcactgttcattccctttctcagctcaaaaaaaaaaaaaaaaaatcgaacttctacttgcctttcatcaggcaccaacaatgctgctcaatttcaactgtcttttctcatcttacccctccttgcatggcattcaacatagctgaccttctatacttggaaagttttctcatccatcttctgagatatcactctcttgatttttctcccatccctttagtacttctaagtcatttttctgttttcttctcttgctctactcagtatgaaaatattgggttgacgttggactcaggcctaagtgttctatgctgcctccacaggcacttctgtttcatgactttaaattcaatacatatgttgatgatgcccaaacatacatctccagccttgacctattctctaacctcataaacctctaatcacttaacggctgcccttgaaattctaatagtgatcttatctccaaaattaactgatttgtcctcctgaagctgttccttgtcccacagccttaatctcagcacaaaacaacaccacttactcttttcctcttatctatgtacctcccacccccatttacagtcaaacatgaacacttacttgttctgcctccaaaatgtcttgactctttcacttctctacagctccactgtcagtgctatccaaaaccatcatttttttctcatttgtatatttccttcatttttcccagtccccaaaataaagtgaattaaaaaaaacaaatataaaattatatcatgtttttcacttacatcaatccattcactagcttcccaaattaacatgtcaattaattttggagataacatcactacttagttagaataaatgtcagattttctagcatggcctacatgaccaggatctactttccaaacttctcccactactctctacttcacacaacattctccagcccacttggccttctttctttttcacacattgatttcattcttcagaactcatgcactctgcctgagctttatttccttgatttttgtatagcttactctacactttgtcattcaggtctcagtacatcgcctcataagtaaataatctgatacaaataatcggtctcaaagtagctccatcttgaactttttgcaataatagaaatgtttgataacttatgctatccaatatgtgagtgttgagcatttaaaatatgactaataatattgagaaacagaataattttatttagttttcttttactgtgtcaactaatttaaattaaaatagctatgcttggctagtgactactgaattgaataatgcagttctagcacagcatcttattttgtttcttaaaaaataaaattataaattataaatttcaaaaaatgaattaatatgcttttgaaaaatttatttctgttctctacagcataatcaccatgagggtggggatgtctttgttggtttgctttcatataatcagtacctagaggaaggccaagaacatagtaaatactcaataaatatttgtagaaaaaaatagataattgaatgaatggatgaatctatccctcatgaagttaagcatgagtcataatatctccctttcagactagtataactgcgtcctccctatgcttcctgggatgactcctgcctcactcgactctctccttcacgtcactgtcaaaagtgatcactctgagttacatatgggatcaagtcacactctcctgcctaaaacactttggtttttatgtcaccatcatgaagaaatgcgagcaaccctttataatatggtaacttttgcctagtctggctctgcccacctcatattttactcaagcaatattgatgtacttgccatttttcacacatcttagggcagtatgaatagaacttctttttgtttagcaaaactatatccatccttcaaaaactctgagggctgttctttgtgatgcttcgtccctggcaaatctttcttctcttgctaagaatcactcttttttggggggcaccttttatactttgcccaaatattgattgccacatgaataaatcatacaggacagcatggactgacctactttgcaattttagcacagagcaaaaggtctagctatagcacaaaataagtgctcaatcaatacttgctaattaaactcatctcatgcccttatagtaggattccattgtgctggtggaggggacccaatggctctgtctcaaggtttttattgttcctatagaaaaactattattttcttttttaccatttgtcttatatagaacaactgtttttagtgtctataatatgattttctttatgttgggaacatgctatatttttatttaatttagaaggtcagtataggagtcttacacacaatccctctggaatatgtcttttcctaagactgccacgatttgctataaaatgtaaatagaatgtgtctgggcaaaaatgtttgacaatatgtggatggttaacagaagctcctgaggattctacctgccatctctctataccatgaatgaagtagttaataaggcacaagtagacttgcaacttttttttaaaagaaatgtctcatatgttctgaaaagttgtgcatataaaggtgggttaacagtgagttattaaaaatataatttgcttttgtgaaaccactggcaatagtaggatgaaatattccataagtattaaacaaagttaacactaataaaacttactaatgggatagtcttgccatacttccttgccatagtaacacaacttactaatggagtagtctcacctagttctgaaaacagaactagggacagaagaaagggcacttaacatgggatctggattttataatcattttgacactaattgtgcatatttgtgttcaccagaccttctgagttgtaaagaaagttcagtgcaagtttctatcactcccatcccagataaggtggaacttccagccttcccattatctctagaggttcttaggagcaggttcctagacttagcaaataaaaatacagaattcccaattaaatttgaatttaagatatataacgaatggctttttattttaagtgtatttatattacatgcaatattttggacatatttataaaaagaatctgttatttatctgaagtccatatttaattggaagccatttaatagaaatccatatttaatttttatctggcagctctacatggggagaattctgggaagtggtgacttatgtttcccctcatcacctctgattctaaattctggcttaccctaaatgctcaatcttatgtgtccactacaattctgatttcattttctatgactcttcttccttatgctctgcactagttgcatggtgaaccagggtttctcttctttaatgtttccttccaaaactcgttcaagaaatttatgaacacagcagactttgcttaacatttgcagctaaaaagagactatagatctgtccagcttaaataatttaagattaaattaaagttgtgtttattttctaggatactttggttacattctctgcccctctcccactttctactttgagcaaatttctcataggcacttgtctctataatcttttgcctcattctgttttgtttcacctcctatttcttcagccatctcatctgtcttgctgcttaccccagcagccagataattattaaattcatatggaaagcaatttagctatcttttttttaccaccactttacaaattaaggtctttgtggtcttaatacttttaacaatgataattcttgcctaagaaaatgggaaagcattttctttatatatatatatatatatatatatatatatatatatatatatatatcagaatatatatatatatcagaatatatatatatgtgtgtgtgtatatatctctatatatgccattttatttgctctgctaggctttagtctcttattttgaaatcactaagttagatatggccaaagtgtacatgacatatcagtttgactcatacttcattttgaaaatagcttgatattctacttttgctaaggctaaatatattcatagaaaactaaaaaaactctttgggaatatctatcaataacttaaaaattttgaatactcttagacctaaacagttggcttctagacaagtatttgaaagtaataaagttgagtagttaaggtcatagtctttggattcctacagacctgggttcaaatcctagttttgccatctaaagttatgaaaagtctaagtctcatttgtttagtagtttgttatttggatgtactgtattgaatcatgtgagtgtctatttttctagaatatatttggaaaagtatactcaatagtgtatggctcagtgtaataatttatgacaaaagatgaacaacaggttcattccttttttaaaattaaacaaacacacacacacacgcacacacacatacacatctagagttgaaattgtccacgtcaaaaactgagataataagaatatcaaacaggattattgtgaatattttaactattgatatgtatctcttctaaatatatataataaatgtatattatctattatatacataaatggttaagtaaactaagatataactagaagtcagaatataagaatcttaaactaatacatatgaatattttaatgatatgaaaaagtatccatgagaaaagcctaaacccaggataaaatgtactgtatacagtatgatgtctcctcagattatccatttaatgtgtaattatataatcatagatacagggaaaaaaataaaaagaaattcaccaaaatagaacaacaggtacttctaggtagtagaattatgagtagctattttaatacctctttatctacatatttctaacaatgggcatgcaatactattagcaataaaaaagtaatgtttacatgtataaacatatgtatgcataacatatacatacatacaacacataggtgtgtgtatatatataatatacatatatgtccttaagttttatatattattgctgtgtattattttaaagaaatgtatccaatttaaaatgatgtatcaaatttttttaaataaaaatgttttattctatccatcattcatttcatgaaaaaaaaaatcagtatctaggtttagcaaagagattattaaattactatggctcattcttggttttgttccatgtattagatagcactttggttatttctttaaaagaatgtgattttggtaacttccaggttgaaagtttccaagttcagaaaacttgtttttatttgtatcatttggtagcttagtaaataatgcccgctgataattattatatttcacatggctaagaattttaaaagtacttaaagtaggtaaatatctattaattaaaattaaccttcttgggtaagactgcttactctggcattgttaaatgaagaaaagtgagctaattaagtttagcccgcattaaaatttgaattttattgtgtctaaaaatactcttattctcttatcctttttctttaggaagaagatgctaatctatggcagaatttcttatttatctcattcaaaatacactaatcagatacaaaagacatgctttaaacacatgacagtatgtgtcaattttcttatataaataagtggtttgatttctcacccaacaataaacagataataagatagatagacacataattggcaaaatgagtcagcagttcattctcatatttttgataattagagattatattgagatgtcctatatcaataacagatgtcaccttctctgatttatcccatttgatagaatctttttttaacagttcagtggttttccaaagatttaaaaatagaaatatctctgacgatttgagaactataagtaaaactaaagttaaatgttagatcaaaaataccgtttaattaaacaaagaaacatgctactctgtaaacttttcctctgaaaaccagaaatcaatgctttccaagtcagtcccatcgttggaatcttatctgtaaggaagaagacttccagattacctgtgactactttctatactaacatttctattaatattttactaccattattagtttgaaccctatgaatttccattcttgcaggataaatttggagagatggagtcaatagtttatgattcagtgtaataatttttgccaaaagataaacaacagttacattccttttttaaattacacacacacgtgcacacacatctagagttaaatatttactgatttatatcttgatttttacgtttaaggtctggattttccaagtgtgaaattctaatactactaatactactactactaattttaatactactaactcagtagtaaaagaaactaataaatatttatagaatcaatcagttatgccattatcagtgattccatctcagactaagtagggccaaaaattaattagaagcatagtccatgaaagaggagcacatttggggatgcactgcatgggtgaccatcattcagcactgggcacaacattgggactgataaagataacgccatgccacttacaccgttagcagggtgaggatttgagggactttcgatgcaattctttgattgaaatcttgtgctctgacagtagatttcaatggtttagtcaaagagttgcttgtacacaatgcaaaagctgccacagagggaactcatgcctggcccttcatacctctaaaaggggacaccaatacagaggtagcatgacccttaccagggccagggtacaagcctagctcttacattttaggaacaaaatatccactgtgcatttcgggaactccacctgactcctactcagctgctgacataactctgattgagacagctaatttttgagatcaacagtctaaagctcaaaaacatctatgaaagtatcttaaaacccacccctgtgctagtttagattggcaggagtacatgatttggacattctcctggggaaatgtctaagttctataattatgtttacccaggcttcttatgctgagaaaacattttccaggtacatttgattctaccaagagaacctttcaatttagaagatacctgagaagctctcattacggtatttgaaagtgctcccaggattccctctgtgactctttttcctcatcaataaaatattatttgtacctaacagaaggatttttctgagatttgaacgagttaattataatatgtcctcaataaatgctaacagaagttgtttttgacactattaaaaataaaaactttcagtcttcctaatattatatgctaggcttctcacaagaattgttgagatacgttcttagagaaaatgttttgtaatttaaaaaagatttcttagtatgacacaatgccatctgtaggtgcaatgaaaccaaatagtctctgtgttctcatttttattacagagacgcaactgatttcatagcgatcttatgatgattatgaatgagattatgcaggtaaatttcctagaacagtgtcttgtgaacactttcttcttagttaatattagattcccaatgcatagtccatagtccctcttcaatatccatgtaagaatccagtgccaggatatatttgtttatcgtctaaatgacctgtttgttattgttgttgttagttttcatgctttgcttgctgtgctttgtttttttgttgagaactatatggtttgttctgcgttttcttttttctttacatttcaataagcttggagctaaatgttatgatttatagcaatctccagtacagtttccaataaaactgttgtaactaaaccctcattatttagcttttattctcattttctcacttcattagttttgttttgtgtttgtatttttaaattgcgtcaagccccttggtaattatgtagaaataataaattttaaaaagtaaatcctgagggtacatttcaaatattatgagagctcaggtaccttctaatttaaaagattctcttaacaaaattagaatgtatctagaaactttttcctcagcaaaaatagctggtaagtaaggaaagtggtagaagttccaccatctctccctatttgctttaagattaagtgacctatctactaagccatcaatgggaagagaaaactcaataatttaatatgaaaaaagctggggggcgggggctcttcttttctctgctagaatacagccagacttgaaagagtagttccggtttatccagccagctaacatgcttccatttctgaaataaaataaatttgcaaaaagtgcacctattatgtcataagtaatttgaggattttttcctctatttttttctttcatattggtagcaatacaaccaagtaataatataaagatagagtaagatagtgaataataagctataactctctctggagttcttagtttaggtgaattaaaatatgatggatctaccttgcctttgaatatcaaaatgttcccttttcttaagagaatacaaacagactccttaacaaagaatatactagatccttaagttgcatctctagtaacacctttgtaagtaaaactcttaaatagaaagtagagagtggatggcatgttgaacactcatgtgttcttactaaaatgcttttgtctagcatatatgttgccttaatattataattaatggcatttctcacatggactaagaggaaggcatatttttaattaaaagtgcttattaaatcattaaaataatataatcagtagtatattatagttaatactctgttatatcttccctgtctctacaactatctcatactaaaggacagttatgtgggcttttttaggtcaaataatcaacttactcttacatctaattgcatctgaaaatcttcagagacactaattttgttcattgttacagcagaaccataagcatcaccgcgcagatgtaagtaaactttctatcctgctcagaaagtatccaaatagaacctgtcctcataccagggttaaaatctctaaaagcagtggtaggtgtgtttggctgttgcagcaagtcatgtgttggaatttgctccattaggaaagttataacacagctgaagttttaatactaaatttgtgatggataaaacccagtgctactgattcagctgctgcctaccctgagtcacactatctcctctccaagacacatgtaatataataacaatccaacaattagtgcacagtcctgcctgcttcttaaaacctcactcccagatgcagcttcgatcagatcttggttttattagctgtcttaattaactaccattataataccagttccctttttcattcatcaggctatctagctagacagtgttgatgtaaacacagagctttaaaaggcagtgactttattctcttcgcatgtacctagtctctaaattatgtgtgcacatagtgtatagaactatggtctaaaagccataaaaagaaagtacaatttacaagaacattcatttcacttgtatttagagttggaaaaatggggtaggaaagaagacaatttgattcaccaagtataaccattctctcctggacttttcaagatgtgtaaaatctcatcttaccaaaccactctgatgtatgtggcttcaaactagtattaaaaatgatcttcaaaaggcagtatataaagtcaaattatattccctttgtacataggttaaacatctttgttgtagacatgataaaagaacagatcaaacacaaagagaaaacagtataaggatctgatatgaaaagtctcaagtagaacagagagcttatagaggactctgagtatgcatatatatttctatgtatttataatatatatttaaatatctatgcaatatatatttacaatctattttaaatggtaccatttactaagaaagcagagaactaacaaacgtttcagactcatagtgcaaaacaaaggaagactaattgttagtgcacagaaggtaaaataaaaacagggagaatataatggtccatatttttccgcaatacttaaacaaaactaaaatgataaaagtaaaatacaatgcagcgtggaagagaggacctctttcatatgactctgcaggaatatgctgagaacagagtgtatttatatttaaagcgtcatgattcagtttcctattctgcatcttataaataaaataaattcagataaattatcctaagtggtactgtgggtcaaatgttcaaagtacattgcagcttttcccaaaagacttgatccactaatactttaacaagagagtgttggtcatacaattcttagtgtcaggaaaaagagcgaggtgaaattgttacaatttcccttaggaaataaatgatgggaatctaagcatttaattccagctccattcctaaactttcaccaactctattccagctcatagtccataggtcagccaacaggggcaataaaaaatattctttgccaactgcattttaacaaatttgagaatcaaaatcaattaaatagatgaccattagcaattcagttgagaatggcaggcttttcccactgaaagggagtggttcccgtgggtaatatctaaaggctcttacactctgttatcaacaaaaagttgggtatgtttcagtttatcagaaaaccaactcactttgtccccattgggtagtgaattaaacctaaattcaacttatctaagtctaaaataagtaattttattagctgatctacctaacactttattacacaatgcattcagtgttgtaaacatggtttttggcaatctcttactttagctcaggaacttagttggaaaacactagacaacatttggataatgacaatttcatcttgtcttctttggagagtaataatgtaaacaaaatgagctctttactggcagccaaatgcaatggagtttgtgtctgttccttttctaatatcggtgtcccagggctattttctgactatgtttctcaaggcagaaagactccacgcctttattcaatataagaatattgtacagcattatcaactttgtttctcagtcagactcttctagtgaaaagtgttactcaagaacatcattaatttatctgctatttttaaaagcagttctaaagttctggtgctttaatggagggagtgtccatgaaaaggtgtctaggatggttttagttgttaggaagggcaaggcagccttatcaaactgatgcagtattacccaactgccattctgaagaagccagaatgaggtgagagagaaaagaattacacacttcaaactaaccaggtgaccttacatccctttcccccagtacacttggctttcaaaaatctaatgtttcacttctttctgcttcaactgccaaaactgtttgaaaaaaagattattacaaaaaaaatatgtatgtgtaggtaagagatgccatttagatcaccgacactacctccaatttcctaagattttcataaaaaaaaaacaacattctaatgtaatttcgaaacatgatgagttatttttgtttagcaacaacaaaaccctaaagttggaaaaacttaatgttagaccagaaaggggccataccagtgatctacttcaacctttcttttacagaggaggaatcttaaaccctgaaagatcatgtttttgcacaaagtcacagcttcccagtgttgggctaagagcaagaagttatcttgtagttttgtcaggtttttttcttattagtttatagatataaaagttgatctatacataaatgactaataatgaactttctatcagagaaatggatggaattgagaattcacagttgaaactgtttaacacttaccaagtgacaaatatcaagtaatttaaccatcatgatagccttgagtgaggtacaattagtatccctgttttacattttactgagaggtaataggcacatgaggctcaataacttgtctacggtcacatacctcttaagtggtgaagccaggattcaaactcagcatctgatccagtgtccttgctcttaaccattatgctattttgcctctctttgtgaggtgcttaggtagtttagagacaaagatgccaattgggggcaaaattctcctgcttttcaacatcttggtgaatacagatttctccttatagctaagtatagccaaataagtgctttttcacttaaaaggccatcaggaccctcaagcttcctagtcttttctgccatgaaggttcttaggaagacctgttggaataatgcattcccctctgtctcctccagaacttaccaaacccaccacattataagatgatgcagagttcgtgccaggtaaagtagaaatcgtgtacccaagaggctgagtgactttaaagtcaggagtcttgaggggggcaagggcatttctggattagcttagactaatgttcttccaccctacttttgtttaggaacagaaagaatattatacataagaacattatggttaattgacaattaggaagattctacatggcagaagttccaacagataagatacgacatacacaagggagaagatctttaacgtatgttcattggctaatttcttcatagcacttctgcaggttaggatggcttccagtgccacaatgtatgttgaaattctgggtaaacattggcatgctttcccccagattcagtgggctgctgtcctggggcacataatcttaaattaagaattgttcttagacatagggaatttatgttcaagatttgaacctcttgactcttcattatttggcttaataagcacatatttgattaagaatacattaaataaaacagaagggctacatgagtcagaagctctaaaaaacaaaggacattatagaacacagacagctagctgctttcttgctctgctaataaaggtctccctccagactgtttatgtagtatgcacagagtgtcaactgatgtggattgtactgaaaactttcagacataattaaccccagtagcctcgtaatgcagtttcaccaataatccacagcccaggctgtaccccagaagaatctaacagctagctcaccccaggcttgcaacatttcatgaagaatctgtgattaaagccagacatgtagacagtaagaaaccatgtggtgcatattacctccgcacatcagttttaatggtacatgctctactcatgacaacataaaaagtcagtacattgtatctaaaattgatacatctactttagaagccaagagaaaaatggaaattagataattaataggattaccctcctaaaataaaaatctcagaataacattctccaataaagaccctctgcttttgtggtacatttgttctctatgtgatgcaatacatatacgcttatccttggcatacacaatggctcaagccttttagcagttgattatgtgcagtgttataccccaatgagagcctcctaacaagatctgaagtcagcaaagtcaaattatcatcttgtacttcttttgcaccatctaagcacctttggagagtgcttatatttaatttatgtgccagtaaagttttgaggattgctactaggtaatgctattaacttgcatatttttgcataaaagattttggaagaaaaagttatattggcacacagggaatgggatagcattgcaaaaatcacatgcatattcaaagataatgacatatgatattctgaatcctacagggaaatcaattcttaattactcttcctgacatttgtcattgcatagcattccaggaaaatcactgaatctcaaaaacttccacattacctggaagaaggaaaatgtgaattagataaatcttttctagaccaatcctgcagattgaatctgagggagggtgttgtacagtggacttttcagtctaatagactgggctaaagtgttaaattattagtggggtaacttcagtaaattggcttaatgtctcaaaatcttatttttcctcattataaaatggtgataatgccactttcttcagtggcttactgtagggaccttactggactggaaaatctctttttgaaaaattcatataaatttatgggatacaagtggaattttgttacatgtgtaatggtcaagtgagggctttgatggtacctatcatctgaataacatacatcatacccattatgtaatttctcatcatccactccaactttcaccccctaacccttccaagtctcatggtctatcattctactttctactggactagaaaatctaattccatcttgaaaatatgtgatccagggttagtcctgtgattgtttagaaaatgccaccttcctgaactgaatcaccttggaatacctatatccttttaagaaccctaagagttgcccttcaaatcatccccatcctgacagcactgaaaaacagaaacaaatttgcattgaccagtattcattcaatgctttggttcttgacgacagattatgacttcatggaatagcttttgccaaaatgcacttggagaattttgaagtccaagtgttacaattcatcatgccactgtaaaatgacagcttaatcacatcagaagaatctttaattaaaacaggtttcacttaattgtttaaaatatactccatcaagaaaagtagttttaaagggcaaaacatttaatgtgttaatgagttttcctacttatcctgacatttgatatcttctgatggcttttgatatgcccatttagttttccctgctaatctttaacactcccttccctagggcaatcattcattcaaccataagcatctgatccttgatccctgaacagaacagcaacatttgtaatttaagtcaaggccatcactttgaattccctgcagccacttctctagactacaggcttccttcaaagaatacctcttgtctacctcatggcttctcatacctacctctgtattaattttatatgtcatttcttttgcatcaacaattaggaatttttataggtacttatcagaatactagctgtcttgttttctaaatttaattgcaagactttaaagcatgggagctgaaatcttaatgtctctttatatgatgcctgcaaggatgtaattaatatttgcaaggcatgatgacaatcattaacactaccactaaaaagaagcaagtcacctgtagcaacacaatcaccaagtgaataattgtgaaagaatattaatggcctgactactttatcgaccaaatattctgtcctaatgatatttcaaaatttggatcttttaaagaggcctgctgctgcagaaagcataggtaaattctctaattttcctaacttcaacttctaacttttctgaatgaatgtcatccttgttatctcattgacccaataaagaattcaaaccaaagttcccagaaatgtctttgttaaaaggtactctgtatacttaaaaggaatagtaaacattttatatgataagagttgccttgcagcagcaactctcaaggttattcttcagtgctgaaatcttgactggaatgatgacaatcagagggtttgctagttcagctaaaagcagcttctgctgccccacagaagctccttgggtcttcttagcttgtagtttattgctttctgagttcaaacatttttaagctggagaaataacagctgagatttttcaggcactcatgagagctttctattttaatgctgaggcatttgaaggccactcaaggggtccacccatccttctcctccctagaggcaatgtcatagatatgagagcctgacagtccagtctctaagaactactgggtgcatggggatgacccacagtgttaattaggagagcaaagtttggtgcatcactctgaaacctcaatggggagtaagagttccactccagatgactgatcatcaaataagaatttggaaggggtcagagcatctggaattatctctgcagataatagctctgtttaggagctgagccagggaggagagagaagtctgtcttgcatagtctggcaagatttggaaacactgggcttctacagattctttatgccttacaaactcattattatatttcacttaataaatctgcatttgctattttctgtaagtttgcttgaaaattttccctgattttggtttgcctattcagcagttttgtagtctctacttcctaagcacctatataccattctcatttcctttcgtctgcatctgcaaaaggtctctttctcaaatccatatggacacaaagtcacctcctatcactctctcaactgctccctttaccagaaaggtgatctgtatttatttttcccaaacaaatctcatgtctttatgcctcctgcttctattccctgaagatcccttgaagagactatactctctaaaaagccatgccaaaccagataaaacacatagaagagagatgatatttcatgaaaatcggagtcaagcagacctagcttggcatcatggctctgctatttaccatctttgtgaacttggactagttactccttaattcttctgaaaaatgaaaataacatcatctgctccatgatgtgtgctactttccgtcttctattcacaatgtccccaatgtcttggagatagtccatatatcttttatcctttgctaaagagattccttcttgaaacttgaattgacaccattcctttcctagtattcttgctccaaacactcagacctaggcagggttaactcttctctctttttttgtacctctgctgccctgttattctagcactcactgtaatgttacaatttttgataaaattaactaggacatagggagaactcctataacccagcaaacagcacaaagcaacttactatatttcctcatatttgacaacactagtgttattcacaggagctagtcctgtattccttttgtcctcttatcccatatagagatatcatagagtatcaatggatactatatgttagagaacaaatactccctcagcatgacaaattgttgtaatcttatctgcccttatagatgctgcttccctcctctactcaaaatgtccctaatgtcttggagatatcctatatatcctttaccctctgctaaagaaatttcctcttggagaaatttgaattgacactattcagctctgagtgttcctaccctaaacactcagacctaggcagggttatctcttcccctctctttttgtgcctccactgccctgttattccagcacttactgtactgtatgattatgtgtttatgcgtctgtctctggttttagtgggagacagcaattattaattatgttgtccccaaaatatttcacggggcctggcatgtagtaagtactgaaagtagttgttgaataatgaatgtacttctaaatagtgtcctctgtaacttttccaatattctacaacaatatcaattttcctggagttagtttttgtgaaaaacaacagatgaatatgatttcctaggtattgcatgtcattaaaaagttttcattagcctcagacctctaaatttccttcactgaattcaccgttaatacagttttcaacttgcaatataaaacataactgctctttaagtgaaaacttgtattaaagccactggtaaatctcaattaaacacaatcatttttaatggctaattgtgaatgacacctggaaacttagataaatggaagaaatgaaatgggaattttaaccttcataaggaaatacaattatacttacagtgaagcaacaggactcagccattaggcattcttgaactcaacagtaattttcaaaacatagattggaaaatttaaagacatttcaaagctttatgctctaaattttctgttatttgtacaagcaaatttcacagagtttgaaacttcccatgaaatgtcttatacactcaagaagcaccaaaaaagatatgtttgttgaagggcaaaaatagagcatgaaggattcacccaccttaaatgtgactttccaataaggtcattgataatatctttcttcattgaaacagcctctttacaatatggaagaagtaactttcagcaacctggtatttgtcctatgtcattaagaaatctatttttaacttagaaggtgggcaatcactaactacatattcacgtgaaattattcattatttcatatacacttttggtctccacatacattttccttcatagttgatatctctcctataacctcagttacacaaataagatagccctggatcacatggtaatgaagcaacaagtttgcacctggtaataaacaagacttccttatatttgaattgcattgtagaattcactatatatttcagacactcacaacctcagggaccaccataaaaaaagaaagaaaacaccagggctgagatcctggctatccaccaaggctgaggtggctgagactttcaaaacccatctgagttacattttcttcttttgaaaattaaatttctaagaaaaaaagaaatagcatttcttactgtgactctttttaaagcaaaagtggaaaattactttttgatggagaaccaaagcccttagacgtattaagaaaacgtattggatgatatcctctgtgaggtgacaggcattgtcataatcaaaaaaatgataactcagcaatcttatgtatattaacaggaagatgcacatcttatatttagagaatctcatgacactcaatattaattgaatgcaattattctccaaatatagtcagattttcaattcctcagcctacaacagtttttgactgtcacaactgggagggaggtgttactggcattcagtaggtggagaccagggatgctgctagatgtgctacaaaacccagggcaggctcctaccacaaagaattacctggttcgaaatagtgctgtggctaacaaatctttatttaagattaatatgatagtgcagtggaaagattactgattagaaatcaaagaaagagaattctagtttaagtgaaatatgatgaggtttctcacatacataatgaagatactaccacatatgctacctaattgatggcgttatggtgaaaactaaataacatcatacatgtaaaatgatcctgtaaaccaaataaagtatcaaaatgaattgaaacacagtgtgaatcctttgagtttaaggaaaccaagatagaaatctgataatattatctgtgtaggtggttttcacatagaatatgtaaagattttaagtaagttatttaaacccaattacttctcatgcttactgaggagaaaccaaggcaaaatgagctaaaatgagagaataagagatatgagttaaaaaatatatagataaaaataggtatagccaaacactagaattggaaattaatggatactgtcaagtttccaattatagttattactgtaaaatgtcggcatggttgggagctgtctaaaataacaaagagtgtgatttgtggagagagattgaagtgacctaaatgacctctgaaagctccttccatacctaagacctccactcagactttataccccaagatgagctgtcaacaggctttggtaggttgtcttgtaggattccagactttgccacattcaggagctcactctttaatcagtcagctccttttggtctcctcatgtctcttttctggtggtcaatttcatcctcaaataatttgcaaaaaaaaaaaaaaaagagagaggtaaaaagctcctttttgttattgcttctttctttataaatcctgatgctgtaatgctatttaaaaatacatttagtaggaaactcaaaaccttcttcttgcacctcccctttcttgctccataaaattcctattgcagtctgagccatgactaacacgtacagtatgcttgcaatgaaaatggttttttcccctacatgccctaactccagattttcaatcttatgactctacgctttgattaagacttaggttgaaagtaagactctgttgtcatcccagtctcaggtcctttgccactgaagtccttgattggaagatctaaccttactgcatattacagttcatttcagtgtggagaaccacaaatagctaatgctactaaaaggggaaaatgcacatggttagaagggggagaactaaatacaaatatagttagccacaaatgtgattgtgtgtatctgggcaataagagtcagagaacatttggctcttccttcaaagtacaaaaatacatgtaaatatgagaagtgttaaaaataatatagttggggcaccactgaccacagttggaaaatttctgggcgcataaaattaagataaattatttcctccccatttattggtgttatatgaatcacctttgatttgatcttttgaaattgctcttctattattctgattataatattcccagattttagccaatccaatgttaaaagttcactctctcacctctatatcaattatttccttttttttttttttttttttttttgctgttttacttttccctccctcctcctaatggaaaccaattagaataatgagggcaaaaggttatatatacatctggtccctgcatttaacatcctgatttatcttttatgctttgttgagaacaatggtgaaaggtgggcaaggatacccccttgcatatattgtcaatgaaaattttttttaaaggcatcctgcattttcacaattttcacatatgtgacatctgaaataactcagacatggcaacattaaggaaagcattgcttcttagtttcatgtttaattgtcagagccaggaaagaaggaggtgaagaaagaaggcaggacttgtatgggctgacgctttaagggactaagctggggcaggcatggctttcattatatttaagtgaattagtctgtttcctttaaacaggagagattaacaagctaccaagggcctgctgtgggattctgacacttttagtggcttgtgacatatgatttgtgaatatcaatttgccttcaaaagcaaaaaagcaaatcttccattagtacaaggttcgccaaaagctgattctaggttagtttggttgaaattcattggaaaaagcgtttgctaagatggggattttatttgatagtgtctggataatttttaatttatactttagacttaaaaatggctacatatagatgtgggagtttaatatgaatactttctttaataaagataatatttcaagttctgaacttgggaactatgggaagattaaataaagaagaaaataaatgtcagcaaccctaagttaacttctcttaaaattttgctttctttgtaaaagagtatgtcttcaggcagtttggcatcaagacaaatatttctcaaactgcaagaaaataaaataaatagtgttcctcatatgtgagaaggttaaaaatctttgatattaaacaaataacaaaagaaatttcaaactgaaagaactgatagaaaatgaattcacactataaaagtattttttaaatgtttccatttatcatcctttgaaaagtaactactgaaaaaaatccatttttttcatctgtttcttttttagccatcaggagtttcaaaataaaagtggtcaggagccagacttttttaactgcaggtaaacatttgtagatggcaagaagagatctttttttgttctttatgtaggcaaactttgtcaagaaagcacagaatactctatggaagtttcctctagctataaagtttaatttgctgatgtagcatagtgactaatttgcctctgtctaattgaaggatttcaaattagactagttgcatcttatcaaagggcacaatagcttagtgattaagtgcacaggaactgaagccatactacctgggttcaaatcctagtctcatcaattattaactactcagtgaagttactcggcttctcagtagcttcaaattttcccatcagtacaataggataacctagtatccacactctaggattgttttgagcattaagtgagtgtacatataaagtacataggcctaagcattcaatatcattagttattattattttctcctattctaaaaacagaactgaaacaatatctaaaaccaggagctagatatcagtagttaagaccattcacccagtttgcattaatcattcaatgctgcctaagaaaattttgtatgctgttttttttttttttaagtctatctgttttttaaatgtaatgtgctaatacacaaagtaatttaaaaaaaacacagtggcacataaagaacacatatgttgattaaaactgaattgcctcaaaaccttgcccaagatcaacatagggaaacaaggatttttttatagttaatgtaacagactataaaaatatgactttaataacaacctattccaaattctaatttttccctttctagtccccagtctgcttcttcacaaaatgtcaatgttactaatttaaaattttactaattcaatcagagtgccagtcactaataaggacatgagagggtaggatggtctaggactgaggcaatatatttctattctatctataatcatagtcactaataggggaaaatatataataagacaattgatggatggcatttttcaatgagtaaaattggaagtatgcaattcagattctttaataataatttgatgccttctttggagcacaaaacattaggaaaaagatgtctttggctaagtgcctcatacaacatagcaccgcatataacaaataatttcaaacctccacacctccatgaagtcttttgggactgtgaaaaacccaaccacactactttaggttgttcagtacaataatcatctcagactaattagttatggccattgtcagtggttacatactgctaaattcagctgaaactataggtcaagcttattaaatgactttgaagcctttgatatgaagaaaaaatatttttaaaaatctgtacagaagaaaaatgcgtcagtgtgtattgtgctgtcaatttttttgttgttttgtttttttgagacagggtctcactcttgcccaggctagggttcagtggcaccatcagggctcactgcagcctcatcctaagtgaaagggatcctcccgcctcagactctcgagtagctaggactaccagcaagcaccatcatgattggctaatttttttttattttttgtagagatgaggtctccttatgttgtccagactgatctcaaattcctgggctgaagcaatcctcctgctttggtcttccaaagtgttgagattacaggtatgggccactgcttccagcccatgtggtcaattctttattaatattttcatattcatgtttcctatgactttacaggagatattccatgaattatatggaatatgaatctggtattatgtgtattttgtaggtataaagaaatgtcacttacatagacatgagcctataatttgtatactcatgaaacacccaaggtggacagagtcacagctttgactgtagtcccagttcactcgtctgagaaaaggtcatctacaggaactgaaactcaaataatctccacagctgaaggaaagaatttctcacaatagaggacttttttctcaataaaccataagacattaaagaactctttgagttcaaaagatggttcctgaggaaactatagaatctcgtcaatattccttcttcatgtttccagttttggaggctgggctgcaaattcaagtgatcactttgagggctaggttcccgccaacactcttggggttagacgcacatacgcataaattcctgtggcttaaaaaagaagaagggaagagctctcaatccctaaaagtttgtttacacgactgtcatttggtgtagcatccccagctcttcctcataaatagcagtggcggagcactctgacatggtgagaaaacagccagcttttgatgaatatcatatcttctcttccctccctccagctttagcacacacgcactcagacacttacaagagtgagctgaaaactgacctaatctcagatttatcagaaaatctctttcaccaaacagggagcatttaaacttaagcatgtgttttaacttactttaaaaattaccccctttttatagaatatactggaactttctccctttccagaatatgtgcaaaaatacaaaatgtgcaaacctggaatatgtgtatgaaattcattctgccaaatttttcagattatctcaagctcaaaagacctttgtcctttcctcccatcacctctacacttaatttagtgttactcttaattttattgttttttagagattattaaagttcagatttctatgtgtgaacatatttgcccccctcctccaccgccaactgtgtgcagtgcatctagaatgagacttttataattttcattttgagcaagcacactagttcattctgagcatgtggtccatagacccaagtttgagaaatatctattactgcctgttattactacctatttccaatctggctttcctctccttctccaagcctgttttctaaatgctcattagaaagaatcttcttataaagagaaataggtagggtatggatctcaaatcagaatgcacaactcttatctgtgggcattctatctctaagaaagtttcagaaacctcctggggattggaatgaacatatgcatttatttgcctagtctcagataatataagtaaaaatccttgaatggcactggggttggtagaattgatcctcatgtgctctttgtgctcaaggtaatcctgggtcacatttcttatctcgttcccttgcactggagccccattcctaattgcaccacctttcccaatatcacaaccatcatctctcttctcaaattactatagtcccagcactcagtagacaaagagtgttgaggagaaaaagaagtaagctccataacactctaaattagcagctgtttcagtcagcctcagctccataaaagctccattaccctaagacttgacaacaaaacatttgtctgctgtctctaacttcatagcccctattactatgagagaaacaaattttctgtaagaggaaatgccagttttagaatcttatttttttccaagccataaaaattcaagtgatgtaaacaaagatgttaataaattttaggagagttgtactatgtattatggaaacattttgagatgtgagaggcttaaaggtaggatgttaaaggaaatctacacatagtgagagaagatagatgataaaagatgttagtttcaaagagtaaatacacagtaatgtcaacataaatgttgaaaaatccttcagaatgtaccagttactgaaatttaattacatttgctatggtttgaatatttgtcccctccaaaattcattttgaaatttaatccccagtatggcaccaggaaccaaaaggtgattggttcatgaatgctctgccctcatgattggattaattcattgatggattaattgattaatggattataatgggagtagaactggcggctttataagaagagaaagaggaacctgaactaccacactcagcccctttgatgtgtgatgttctctgctgccacggtgccctgcagaaagtccacagtagcaagaataccctcaacagatgcggctccatgactttggacttctcagacttcagaagtataagaaacaaactttgtttcttataaattgcccagtttcaggtagtctcttacaagcaacagaaaatgaactaaggcaacactaattacccatttttaaaaattggtcttctctcacctttaaatataaaggggcttctttaaataggaaaggttcccattggtttagcgcctatcttcagaaaaggggcttttgggccaggttaatggaaaccctttaatcaagtcagattgaatgtatcgcccaaaggaaaaacaggctacttttatggataggttctgtatcaaacaaccaaagccctttgcttttgtagtgcctagcagtcaaggtattgtaagcaaataaactatattttaaaataacgttttaaaagcatatagtcaactaaatttgttatccctttagattcaactaaaatttgaggttccattataagcctgatactttcctagatacttttcatagattatttcatttaatcctcatagacggaatgagaaaacaaaagtttagagacatttctgactcacaccattcgttaagaggttagaacttacatctatttgagtccatgcttagtactatctaccacaagatagtgctttgtttttgtcaaattatccttaatttgggctgcacaaagttgtcttagattcctgtattacttttctagggccgatataacaaattactacaaagttgatggcttaaagcaacggaaatttattctctcacagttctggaggccagaactctaatatctgtttccctcggctgaaattaaggtgttggcagggctgtattccatctagaagctctccaggggacagcgtccattgcctgcctctttcagcttctggtgccacattccttggccacattccttggctcatggccttaccactatgttgaaagccaacagtgtagcatcttcaaatctctgcttccatcctcaaatcatcttctgccttctgtgtgtacatctaatctccctctgcttctctcttataaggacatttgtcatggtatatgaggcccacttgaataatccaggataatctcctcatctcaaaatccttaatttaatcacatctgcaaaactttaccatataaggtaatagtcacacattccagggattacagcctgatatttttgggtggccattattcagccttctgtatcctacctaaattaaagcccaaaatctcatttaagtaacagcagctcaaaaatctcaaattgtgtaatgtaaataatggaattcagatatggataagactctgggtatgatctatcctgggcaaaattattctccattactgagtccataaaactagaaaaaaagttatcagttcctaaaatgcaatggtagaacaagcgtagtataacagttataaacattcttattccaaaaggagaaaaatgtaaagaagaaagaagtcactggtcccaagcaatttcaaaatccagcagggtaaactccactaggtttcaaggcctgggaatcagcctctgtgacttgagggtcctgcctcagggcacatggctagagtctctgcttctatgcctctgcacttcctttgtacccaaggctctgcactcatggtgatcctttttctttaaagctatcatgtgtttgcagctgaatagttttatcaacttgcctgtagaattttgggagtctgacagccttccttcaacttgctctgtctttgtctattttagttccagctggcagtgtttctgctgatacaacattctcaaaaactctgtggtcctcccatgtatgtcacagggattcatgccatgagagggttctctacaaatctttcctaggtaacctcatctctattcctgacttctgctgaggtggctgagggaatccatccatcacatgtttcatttcttcagcactatcataaggttgtctagtcgtacccttagccttctcttcagagcatgctttcctaacagtgaatctcccaacttagcatcttttgcaatctggataggctgagaatttcccaaatcatcaagtgctattttgattctgcttaacagttcttttttcactttatctccttctttttgcattttactataaacaggaagaagaaaccaggctgatccttcaacactttgcttggaaatttcctcagctaaatatccaaattcatcacttacacgttctgtttttcatacaacgtagaacacagttcagctacatttctgtagctgaaaggattgcctttcttctagttttcaataacatattcttaatttccttctgagccctcaaaaaaagcactgttaatattaatatgtccaccagctttctgtttatgatgttatatgtattctctaaatgaggtaggcattctctactgtgcctcacacctcctcctaaatcctcaccttagcaccttttatcctcatatttctaacagaagtctgtttaaagaaatccaggtttctttatcatgtgcttcaaaatccatccagcttatgtccactgtccacgtcccaagccactttcacatttttaggttgagttacagcaggaccctgctctaagtaccatatctgtattggtttcttatggcttctgcaacaaattaccacaaagttggtgtcttagactaatataaatctattctctcaatgttctggggactagaaatccaatatcaatttttctgggcctagagcaaggtgtcagcagggccaaactcctctgtaggttctagggagacaatctgttcctttcctcttccagtctccttggctcatgactcctttgtccatcttcaaagacaacaacattgtatctttaaatctttctgtttccattttcaaaatgccttctgccttctgtgcttctacgtatgtctaatctccttgtgtctctcttataagggcacttgtgatggcattaagggcctacctggacaatgacaataatctcctcatttcaagatccttaacttgatcacatttgcaaaaactttacaaatacagtaacattcacaggttccaggattagaacctgatgtctttgggtgctcattattcagcataatatagctttatttcctaatataggtacactccaggaatctggtccttagtctgtgaaataaatatactaaactaaaatattttaataataatgtagttcaatacactcatattatagattaagtctctgaggccaagataaagtaaatgacctgcttaagatccacagtaaatgttttgacacagacaagaccactccctttactcccactctttacagcactttattcttcctctctaaaataattactaagaattgctcattttttaataaccaccaaattatccaagaatccataaacacaactctgaaactagaaataactgtctcatagtcagcaggaattttaaaggggataaagtaatttttaatccccactgaatgttatcagtagtaaccttaggaaaagtagagaaacatgaaaaatgattcacttcatgattacacatttttttaattcagaaattttaatgaatttaagtacttaacagtctcttaaataatgatagccctactaacttatttttcaggttctcagaattgtagaacttagaactaagtgaaattttaagagctaatttacttcaaccatcattttaggtaggtagcatattaatcacctttccagaccaggtgactgaactttgagagtctaagtaagttgaccaagatcatatggttaaaagcagttatttacctaataatatatagaaagaggacttattatatgccaaatactatcttaagtgcatgcatgtaaaagtcagtgaggtgtggttctcactctcaacaagttttctgtttatgaggaaactagatgggtaaacagtcaactaatcaagtgtggtattgcattataatgctaggtatatggtttttggaagcacaggttttgagaggacagcaggaaggtttcccagagatgacatctaagtgaaatttgaaaagaagaagagctgggaaagagggcagggacatcattccaggccgacctagcagtgtctggcaaggctgaacaggaagggacaaggcaggttctagaactgaaatcaacataaaatagctataatgggcactgtagtaacaaacgaggccagggagttggtagggagtaaatcatgagggtcttatatgacatgtgaaggaatatagagattacatgatattatatgacatatgacatgggatgtgatggaatgtagtagtatctaagagggaactagcttgtgtggatttgtgccttacatagaccacactgattaagactaggatggtcttgtgatagtacactgagactgaacaggtgttaataataaaatgccagaacaagagacatttactgggactgtcccaggcaagcaaagatagaagatcaccatcactaagactggcctaggttttatcctcaattatgttaactctataatgtcagtctggcacaataacttttaggcctaattttctcatctaaacatagtatgggtataacaacgatgatcttacccatattacaaaatttttttgagaatcaattgatgaaagcattaatctgctgaagtttttattattcaatgatttagggaatttttcacataatggaataattagtaacaacacaagcagtcatggcataaaagagtaatgagaactaacattgtcaaactcttacatggtgttaggtcctatatttaatacaactttacatttatagtatcatttgtaaatttatgactcattcttccaacagtggtgaggttggtttatctaaacttaaaagatgcagagaccaagacccagggagtaacttggctacgatcacacaactatgaagttttataaataacccagattctacaccaagaagtctgactcaagagctcatagtgtcagtaggggggtgtagtcgtatatatgctgtctgtatgtttctcctagtttgtttaaaaaacacttacatgtactccttttccagaaaaagaagtttagcatactttgtttctttttctgattatctaaaccaagtaaatctaagacaagttagaatacaaatgccaaaaaaaaaaaaaaaaaaaaaaaaaaacaaaaaacccacaactagagcaagaaatactgatgcttcaggtgttccttttggggatttgctggaaattacaaaacctcttcacagtgaaatatacatattaagaacttttgaagttccaagtattttaaattgtaaaataatgatcatttggcaaatcagaaatatgaagaataatgtcattttagtgaagagcagaagaactcttcttttccatgtccctagtataaaattagttcttttttcttttgattaagctacaatttcttgctacttactatatttagattgtcaattataatatagataatactcttttgaaatattcttccactttctttctttttttacttcaaaaagtaaaaatgaaaaaaaaaagtaaagggcaagtttaaataaaaatcatgtcaatgtaatattttgccagaaagtttagatccgcaaatgtaaggatacatttacagacttccctctcacatgataccaccttctactgtactttgctttgtctgtcagaagatgcccacctgcatgcaaactttgtttcctccctgtgatttcctgaaaacttcatgtttgactctgcacccacacacttatgtgccttcgtttagaatattcttccttctcttgttttatctctgtctagctggagtcccttatcctcagtgtgacctcctgatgtcatgcatctctccctcagttagagactgctgtttacttaaattctgccctgcttcttggcattgagtagaaactgccttatatgctcttccaactccctgtgatgatctcctctttctacttctagactacaaatgctttaagggtatgagccaaaaaggtcacagtaataggatgagaaacaaaaaacaactaccaagtttaataagaactaagtatctgtgataatgctgtctcgaaactgtaagttgaaatataagacttattctgaaatatttaaaaattaagaattacttttctttgttgccttttattctatagtcatcaaatctccacggttacctatttcgctattctttttttctttcttttaaccttttacagcttgtgtccttgaaaatattcatcttctattctttattttaagcaccttgttctctcctcaagttaccttcagttttcaaatacaggttgagtatcctttatctgaaatgcttgggatcagaaaggtttcagattttggaattttcagtttttgaaatatttgcatatacataatgtgatatcttggggatgggacccaagtctaaacacaaaactaatttgtggtttacatacacacagcctggaagtaattttttaaaatattttaaatcattttgttcatgaaacaaagtccatatacattgaaccatcagaaagcaaagatgtcactatcttagccgttgatgtaggtaatctgtggttgtttggcatcaccatcattcctgactctgaatttaaatgctactgataagcaatcattttcttacacttattcatacataagtacttaagagtaaacaacatgacataccactattacagtgaaaaaatcatgtgttgggggtaactaggcagcacagtagcatcaccagaatacctgtatcagctgttaagcaacagcagctgaagggggatgggagggtcttttttccccttggggatgctgaataaactgtgcccctgtgtttggactgtgatctgttatatgaggacaggtttggaattttctacttgtggcatcatgttggcactcaaaaagttttggactttggagcattttggatttgagaattttggattagaagtgctcaatctgtttcttctaccaatttcttaaagaaccaggcctctaactttttccccaaaacttcagaacagtatgaatattacaattccaaatcaaatttcaggtagttctattttgagacagagtctcgctctgtcgcccaggctggagtgctgtggcacaatctcggctcagtgcaagctctgcctcccgggttcacaccattctcctgcctcagcctccccagtagctgggaccacaggcgcccgccaccgcgcccggctaattttttgtatttttagtagagacggggtttcaccgtgttagccaggatggtcttgatctcctgacctcatgatctgccctcctcggcctccaaaagtgctgggattacagggtcagccactgcgcctggccgatatttccctttttaaacaaaaaccaagtatatttctccttcctgcctctttcctcaattccagcattgttaatttccacttcatcgaataatataattgttgctttcctgatgtttccccttgaaataagaggaagcatcgtatttactttttcttcatatagtatccttttgattaaggcttatgatgtgacaggcaccattaagctgtgtgtgtgtcaattcagatttcaaacttctgccacatccagcctcaatgtgccttctctgtacttcttgaatgaggcaccaaactctccctttgcagttcccttctcacctcttcaaaaggcttctctagcagtgctctttggggtagttcccttctcacctcttcaaaaggcttctctagcagtgctctttggggtagttcccagttgttttctattaaaacactgtacttgtgtcattgataacactcacttcaatttttcatcatatcacctcttggttaacgtttttgacattatctgtggagagtgtaagctctatgagagcagaaagaccaacttttttcaacaatgcatttattcgtgcctcacacactatctgacacaaagcaagcactcaaatttcagatgaatgaatcaatgaatgaatatacgatctcatttcatctttaccatgtagtaaaaaggtaggtattgttaatatccttgttttactgatgacaacttgcccaaagttatcaactcttacctcgcagtttgcctacaggtctgcggcttcaaagcctgctttcactccgggactatactttttatccctttgaatcaaagcccatacttttaatcactctatcatacctcctctttagcaggaactgggacttagctttccttactttgatagcctggctgcgatgacttctgtgggacttctcttagatcataggttctcatttcagttaatttaacatccagttgaatgccagggcttgggttatatttccctcacacctttcttgtcatgtcagccctttcgcagtgctactcattagcttgatctctttcctgagagttcaaaacccttgtcttcatcactccagcaaagcatctcctcctcctttcacagtatgtgtctaaacactctagggcctcttctctttttctacttttccctctggcttctaaaaaatttcattatgtgatctttaccgtctctcttgcttcctggacgtcagcatatttgagctctaaaacactatttttgttcatcaagtttttatactataatgtgattaacatcactagcacttttctttaatacttgtggaatcatatccttctgcagagatattcccaaaaaatgacacccaaaatctggtaattactgctatgaataccattataaaggtatcttactttagactatcaatagtatgtaaatcagtgtccatatgttaccatttaccccatgttacagaatattaattcttcttttaataattctatcagtaaattaaagttacttaaaatttggaaacaattgtaaaaacaagcttgacttttattattattaaaacataaatttaacatatgtcaatagtcagattctgcatatgatagacttaaatctaattcatcaatcagtgccaaaaaattcttagaagtatatgaaaacacttatggaattaattcagattctaactcctgttggtgtttcaaaaattcctagtaaaggcatacgtatttctatatttgtttcacctgacatacatatacctattttacattgtttcctgatttaaaaagttttattgagaacctaggttttatttttaaaagccacatatatttgacaggggtacacagagaagcttgataatctaagtgccattctggaagttgggaatatcaaagacctccaaatcagcattcatcttttttaaaataaatgaaaactaaagtagaaaaatataagtgttcaggctgggtatggtggctcacacccgtaatcccagccctttgggtggccgaggctggaggattgcttgagcccaggaatttgagacaagcctgggcaacatagtgagaccctgtctctacaaaacgaacaaacaaaaatcagcaaattatccaggcagggtggtacatgcctgcagttccaactgcttgggaggatcgcctgagcccagcaggttgaggctacagtaagctgtgatcatgagtgagaccctgtcttcaaaatcatcttcactttctttctttcatggtagcccagacaaaggcaaaaatgtgagaaaaatggcaaagtagctagtaagtgttatgtatgcaaataatttaaaagaaaataggaaaagcaggaagagttattgggagcaaaaatttaacttggaggaaaaatgcagaatgatgatctagtaatgggataatcagcactctgaagggggcttatcagtggtttgtccacttcacttacagcagagcttaaaagaaattgacctggaatgctgggataagaaggaattcactgcagaatcgaaatgagaagacggtcctgatggagtatattgaatttacaccattgaagatttttatgcaaaataaaaacaaaactatcagctttagatgctacgcatctgaaaatgtctaggcctctggccctgaatgtcaccttgggtgccaagtaatactaatgaatgactttccctgggcttaaaggtatgtagccagttcagaaaccagataaaagtaataaaaaaaaaaacacacacaaaaccaagaaggtgaaaataatggagtgaggaagggacgataaactattagggatttacaatggctcagaagcagggttgtcacagactaactcaaaacaaagctattagaaagaagtcaatgagccttgaattgtaaagactctatgaacatgtcaagttgtcctcaacacaggagcaaaaaaggttaaggatgaaataacatgtctgcttatcagtaaagcatgttaacacaaggtccttgaagaaaagtaataataattacagaaaaacattaaaaatacctttttaaaaaagttctaaatcttgcagcaatcccacactattcagaattagatggaatttaacccaccctattcagaattaggttctagttgtggtgcaattattaggtttagttgacaattctttgaaatttggggtatatcaagttaatcaatactttgccttctattagggttagatgattccttaagagctcaatgacatcattctttgcaggaagcatgccaaaactttgaaaattattcattaataatgcacatactgacagaatgggtataggtaaaggtggacaggtttaggttgaagaattattaggtgaactataaaataaggcaatgctttactgccagcactatgaatctatcagatagtaattggatgcacgtgttagcggcagtaaaaagtcactgtccagttgtccaccttacatgggaatctactctgagtgtcttctttgatgtattgtgccaattagaacacagcgttcaaagaaagaacacaattgatctgatttaaaaggaagggagcctttaaggtcattattttgtgggtgacctggctcccttttagatgtcttgaaactttctatttgtgtaaaatctatacaaattaagtactgggttttaaactgattctgtaaaacatcaacattttgtattcattaattcagtatcagagtgtcactagtggctttccaagatgcaggtatatttcctttcgcaaattttaaaagtacatttctaagctattctttgttgtactgactgactgacacagataaaggtaacatgcactgagaagaaagagtgccgattacaaaataatgttttaaatctgtgaaacaaagtaataaacacccttggtcaaatgtcaaatgtaaattatcttagatcattgcaatataccatgaaagatttaaatccttctgcataaatgacttgagacaaaatgaagttgattacttgtctatattgtgataaaactgtattaaaattacataaacatgaattgtatattccatcttactgtaaaataaaatagatttataatttctggaaggaaaattctaatattttacttatattaagcaaacatcaactataaatgttgacagatgttggaacagtaatactaaaaatgtcatctgaattactcttcattgcaaagttcacagaattaatgttaagatagattaaaatcactttgaactaatacacatatattactcttctttctgaagcataataaagaaatatcatttgcactacaatgtcagataagcatacagacattaaggcttaggaaagatgtagttattcacaggcagctcataaatgggaggaacattagttccatttcaaatgagctgtcaactttttttcaacattttggcttgtggaaagttagacatttggataataaatggggtttgcttctggacattaaagtaattgtatagaaatttaaagtgttcattcatgttctactatcagttctttaaattctaaagaaatgcactggaataaagcttttcactctaaactggatagcataaatgtagaagaaactatgaagacagtggagtttatttgatcctataagacacgcttcttctacttctttttcttttgttaaaattctgtgcctaaacatcattttgaaaacaactgcttttaaagagtcattcacacctttaggtaataggttactgaaatatccaagacctagaatttggtgtctctgaattctcatgctccaatacgggcatctgattcctgacaactgtttccttaggtttctcctcgtaggaggttataaatcaggtttatgaagaggaaactctcttgaattgtgcatttttaatagatttatgataaatccatcaaagtggagggtccatatggtaggaatgcagtaaaggtaacaggacaatgtcatgtaaacattaaatacagtgtcttccaccttcataaatcctcaatgctcgtgattaaatgctgccggttataaattatgcaaccaaattctagaaacaaccacaactgaaataagataccagtggaagccataaattgtttttcttcacagaaaactcttgtgtcgttattagaagatcacttctgagttcctattttcctcaacaattatttttttctcacttcatttagcttcctacaataagctctagtcctggttaaaaagtaataatcccagataataatctatcattttatatggtaaagtgtctttttgatttgcaggtttattttaaaattttcttaatatgtatggcttaagtctctaagacgtcgccctttttagagtcatatatcagaagtttctgcaacagtccaatttatcacaggtatttacaatcaaattattttattacacatgggaacaattaaacatttggccctcagctgtaaacaattactatataaaatgacattcatggatttttcttaaatagtcatgtattcctaatgacctctgttaacatgagtgagattgatgtatgtgtattttgtgtgtatccataagcaattatattcccaaatatcaaaagagagagtttacctagagaatacactaaccttgtctgatatcatgtggccacctgcaatgacacgtttaatgtatttgtttttctgcaattgtcattttatttctgttccaatttaattctaaagaactgcgggtgttcacagcaagaagcaagtaaagatttggataatttgttttttagagatttgaggtgtcaaattctaataaattgatattaatgttggaagtagcagaaaggtacaataagaaaggagagatacaaccaataggctggggcttgaatcctggttctgcccatgtctagttgaatgaccttggacaatttacttttttcagtatgagttttcaaatttgaaaaatgttgatagttgtaggactattatgactattaaatgaagtgtgtatttaaagagataaagcctatactacatactctttacatattgatttctctattgcctcccattcttctttcccagaaaggcccaggagccttttttgtgagtttccctttttggaatatctattcttaattgtctcaagtttagggtacattttcctttcactagatccctcttttctacaaatgacaaccatgggagaagctcacagctgttttactcacatccagaaataagtcaactggtcccagttgcaaggatacctaacagctgtatccagcctttctaagaggtcagaactaaagccgagtggtaaggtttcaagggcaaagctctagatgtaaagaatgataaaacaaaacctaaatgagcctacacatatctagtgacagatacaccacagctattctaaattattcaagctttctcagacttctagcaggagaaacataattcatctctgctctctttattctactctcatatcatggcaaagaagcaaacaaaaagtatagccccccaccctcaaaaattataataatcacccatatagagaagagctttgttaacgcatgtagtctttttagaaccatcgaatttctgggaactagctttgaaagtagaagttaaaaatgattttgcaatacttatgaatgattgtcttacttcccttttgttagcattctgctggcaaaaagccagaaaacagttgtttaattacccaggacaacaaaaacatataacctcttagataagctgttactgtattttagcagcaataatactagggtcaaaagtaacaaagaaaattaatcttcaaataagcaaacctcaaaagaacagctttgtgtattgagaataattaataacttgtttaggaaaatgttactgaaatgtggtttttggaaaaggaattgacactcttcagaggttagagatcctagtatttaacaagctaccatttggtggacagctggctggctaccctgtaggcatggtaaaagtttgttcacatgttattatgcaacgtttagacaatatcttaatgataccatgtagttcagctgaatcagtccagctggaaatcgtagcagcatttagattacctggccacatgtgaaattaaggctttttcaatctctaattttcacttgctatgttttgacacagatgttcttggaaagcctaaattatttatggtttgacaatatttagcagagtgaacccctcccctttcactgttaaccgttgattaagattgcattaccatataagatatttagcttgtcattataacaagtaatatatgttatcacagagaaaataaaatattagtatattttggacagttaggatggaacttttctacaccccttttatacaatatatattgtatacttttcttctttgcagatagttcttattgtaaagatgaaattcagtgtgtactgtggaaatcattttactctgcagctaatcacacgtgattattattctagaaaatagcaatttaggttgtgtaaactaaaacagagcagatttgaccttaagtcatatcataaagacatttaaagtatagcacaaacattttttaaaaagaaaaatgtttgctcaaggataacactctgaaactttatcatattcttttgagttttctccatgaaaaataagaaatgagtccatcagaattttttgttgttgttgttaattcccagctcactctgtccagcccaatgtttggatagcttcttccccatcctgctaactgaatgacaccacaactattttattttagaagtaaataaagtttttaaatttttaatcgaaaaaccttaaaggttatatacataggatctaatgaattcgggtaacaaatgatttttaagcaaaaataattgtcatcattatgacattatttcagctactttctttgaatcagataatgtggtacttaatatctttagtatgaaacataaaatgaaacactttaaaagcacctctacacgtatttttattacttataaacatattgtgaattttagtaaatagaaccagtggctgaggagaaacagaagttaatgttgaatgtgtgtgcatccccacagaagaaaactaaattcttaattcttgtaaatttgtattcaaaaataaaatgctaaattctggtcaactgtcattcccattagtacctggtactttctaaaccaaggaatcttgaaatgtttgactgacgtatttaagttaactgacaagacaatctatgcttagaattcctgaacaactaacacaaaaatgtcccctttaaaggtgacttggaatttaccattgagataatgccaaatggtcactaaagatgtttaaacatcattgtctactgtcttcagtgtgccattacagagccttgggttcctttcacataacaatcaatagtggatgaataagtctcaccacttgaaagtatctgagaaaggaagtcaacagagtaatctgggtttgctgggttgattcaagaagagacacaatatccacccctcttcttctagttctcttcccccaaccagcccacacccctgcaagaaagaaagaagggaaagagagaaagaaggaaagagagagggaaaaggcaagaccaaaatgtagggatcccaggcataatttacgctgaggagaaaatgtcacactgtgggataaaatatagccatggaaacagacttatgacttttactttgaaaataaaagaatgacaatgaaatttgtgtgaggtctgtgtgaatccagtcccagatgtttacaatgctgtagtagtatggctctgcaatatgagaggtttcagaagaaacagtacaacaggacaccacaaagcagtgcatacgctattgacaatgcagacatgagcatcatgttaccaagagggaaggcaggcagaagacaaatagcagcggtggtgcctgaaaagctaacttcatggactgcaatcactcaaactaacataagggacccaaaacaaaacaaaacaaaacaaaaatcaaaaccagaaaaatgcttttcgctcatatctagaggtagtggggtaaagggatgggggtggggagagagtggaattgacttttctttcttaaataaagttcccacaaagcccctataattgacagcggataattattttcagcttgaggagcctgtcccaaaactcttaacaagattgccagggaaaagaaacaaaatgtgtttacttgagccatttccagaaggaaggaaaaattgctctttggatgaggtgggaaaggcggtggagagagaaaggggcatctttgcactgcaacaactctcttgagcgccctgcgtggtccggctagtgacaggctggagggaaggggtgggtagagcggcaaggggtgggggatgtgaagggagcgcgcttaggggaggggatgcggcagcacaatgtatacacgggggttggggggtgaattagtgtgaaagtattccacttaatcattttacaggggttggggacgtaaatatttagctggccacatctggaacagatttttcccccccgtgtgggctgggggtggataattggaaggaggggagcatgcatttgttacttactgtacgggcagttctccttcttggtcccgctgaccttcccgttcttctcaatcttgagaaagtacttggtgaaagagaatagctttctccagcggacatctccttgaaggtgattgtagctccgcacatgccttcccgcgctggaaggagaggagaaggaggaggaagaagagttggtggcctctggtgacaccatgtcctgaccaagggcttggcaggtgacagggacggaagacaccaagaacagcaacaaaaagcagcagcagcagcagccgggcaggtggggaaaggctgaggcacaatgtgtcagtatccatttccacat

SEQ ID NO: 394 - DNA, 172171 bp, Homo sapiens
tttctgtcttttttaacagtttatttttcaaattttctaccattggtatgtattaaacagacttatggttaatatataccatttctgtatattttatgattccaatatataattatatgggttgtctcttgcttctctcctctgtcttttccctgtcttcacatgtataccaaacagggcaaacccatcaaaagtaaatatacaaaaatcttacagtcttcaaggaaggtgataagaatgtttaatttacttttcatagttcatattttctgaatttttataacagcatatatcactgacaaaatattgaaaccatactttaaaaaataaattcagaaattgttttaacaaaataagcaggaaatatataaaagcaggtaataaaagtcatcaacgtacacagtgtcttaataaaagtcagcagttggagtagaaattactattctaaggtttccagaaaaacctaaattagcttatgaattgctatatttagaaagaatatgaaacagaatatcagcaatgtcattgcaacattgtctgcaatacattaaatcagtttaattgttccttaggcatctgatctaagaaatttttcagaggtgctaagtcaactttaagttaaattatgaccaataagagaaacattttaactaatctttatatttttagaagacttatatataaatccatcttgtgatgtagagtatttcttgctttagagtattatttcaaattccttcaactaaaaataatgactataatttaagatgatcataggatgtgatctggcattgattcattttatcagtccattgggaactttaaagtctaaatttgttttcacaattgctacttttgttttagcatcttgaagtctttcacaggctttttcaaaggcaatcatatccataacaaatttttcttcacaatgtcttttatatatttcttgagatctaagaggagaaagaaaggtaatagaatgagatacttttaaatactgaaaccatggcaatctattagactattaatgataataattagatgtcttcgaaataggcatatacaagtgagaaagacacaactccatttatataacttggttatatcattaaacaatactcagacaagtatttatgagatatctataagctataattaaaaattctcacaaactatggcttagatttccaaagaggcatctaaactaccctatgtcatcacctaaaatacatctccttaagcctcactaaacccaagctacttcttcgactctgttatggtctgaatgcattccaccatattcatatgtcaaagtcctaactcccagtgtctttgaatgtgactatttggagataaggcctttaagaagtagttaaggctaaatgacattatatgggtaggtcctaatccaatataatttgtgtacttataagaagaggaagcaagagcagagatgtgagtgtacagaagaaaggccatgggaggacacaaggcaaaggtggccatctgcaagccaaggagagagggctcaatagaaaccacacctgctgacactttgttcttggacttccaacctccagaactgggagaaaataaattactgtttaagccacccagcctgtgatattttgttatggcagtcctagtagactaataccctgccaaaccggggaaatgtcacaggtcttaggagatttcattcattcatccttatttattcaacaattatgtattgtgatgcatggcactaaccttagatgctggagacataaatatgacatgatgtaactacatgaagcttatcaaaagttaagagaaataaatgtatataaatatacaaatgagatattatggttcatcgtgaaaacattatgtaacaagtcagagtgaggaaaaacttgagtaaaaacttggtaaatataaactaaagagcaaggaggggaagataaaaaaaagtttaaagttaaaataacctttgaactgaatcttgaaagatgtgtattttccagtcagaaagtggaagagaattttgttcaaactatttttatatcacgaacatggtcaaaacaaaggtagagagggtagcacagcttggaatgctccaagaactggcatcaatctaattgtctgggtcttacagtctgggaaggagaacaaggcagcaggcaaggctggagaaacaaatttaggccagatcataaaatactttatttatgtgtaggtatactcagaaatctgaagttgaggagaaaaagagagggtgaagtctaaaaagcctgcagcttattgatgatgtgattttagacaagatattcatgttctttctctctcattttcttcattgttaaggagataacctaactcatagggttagtaaaggactaagtgggttgatacattaaaaattcttaggtgaatgcctaatattaaataattaattttactggatggataatagtggccttcaacagaaagaaatgtaggtagagcaacaagacgggaagaaagattagagttctgactggaaatggttagtgttaagagcctgcttattcatgtggtgatgcccagggtgttgaatatagagaagtgaaggcttatagttaagagtacaggtagtaaagccattctgcttggctctgaaatgtattgttggtgtgattttagataggttatttaagttgtctctgtattattttttttcatctttataaagaggacatttcaactcacagggtttagtaggaagtaaataaactaacacatttaaaatccttaaaggagtgcctagcatttaataatcattttagtagtagctaaaagttagctactagtactataagcctagaaatcaggagagtagtcaggtctggacgtgtagcagagtagaaatcatagcaaaggaatcttgcacatgtaattaaggatagtaattaagtcaataaatgtactaaaatagccctcttacagataaacattataagctgtgaagaaaatgtaagtaaaataactatttaaaagtcttaaagatttttgcacattgattttgtatcctgagactttgctgaagttgcttatcagcttaaggagattttgggctgagacaatggggttttctagatatacaatcacgtcatctgcaaacagggacaatttgacttcctcttttcctaattgaataccctttatttctttctcctgcctgcttgccctggccagaacttccaacactatgttgaataggagtggcgagagagggcatccctgtcttgtgccagttttcaaagggaatgcttccagtttttgcccattcagtatgacattggctgtgggtttgtcataaatagctcttcttattttgaggtaatttattgagagtttttagcatgaacagctcttgaattttgtcaaaggccttttctgcatctattgagataatcatgtggtttttgtctttggttctgtttatatgctggattacgtttattgatttgagtatgttgaaccagccttgcatcccagggatgaagcccacttgatcatggtggataagatttttgatctactgctggacttggtatgccagtattttattgaggatttttgcatcgatgttcaccagggatattggtctaaaattctcttttttgtgtgtgtctctgctaggctttggcatcaggatgatgctggtctcataaattgagttagggaggattccttctttttctattgattggaataatttcggaagaaatggtaccagctccttcttgtacctctggtagaattcggctgtgaatccatctggtcctggactttttttggttggtaagctataaactattgcctcaatttcagagcctgttattggtctattaagagattcaacttcttcctagtttagtcttgggagggtgtatgtgtcaaggaatttatccatttcttctagattttctagtttatttgctcagagagccaaatcatgagtgaactcccattcacaatcgtttcaaagagaataaaatacctagggatccaacttaccagggatgtgaaggacctcttcaaggagaactacaaaccactgctcaacaaaataaaagaggacacaaacaaatggtagactattccatgctcatggataggagaatcaatatcatgaaaatggtcatattgcccaaggtaatttatagattcagtgccatccccatcaagctaccaatgactttcttggaaaaaactactttaaagttcatatggaaccaaaaaagagcccgcaatgccaagtcaatcctaagccaaaagaacaaagctggaggcatcatgctacctgacttcaaactatactacaaggctacagtaaccaaaacagcatggtactggtaccaaaacagagatatagaccaatggaatagaacagagccctcagaaataataccacacatctacaactatctgatccttgacaaacctgacaaaaacaataaatggggaaaagattccctatttaacaaatggtggtgggaaaactggctagccatatgtagaaagctgaaactggatcccttccttacaccttatacaaaaattaattcaagatggattaaagacttaaatgttagacctaaaaccataaaaaccctaaaagaaaacctaggcaataccattcaggacataggcatgggcaaggacttcatgtctaaaacaccaaacgcaatggcaacaaaagccgaaattgacaaatggggtctaattaaactaaagagcttctgcacagcaaaagaaactaccatcagaatgaacagacaacctacagaatgtgagaaaacttttgcaatctactcatctgacaaagggctaatatctagaatctacaaagaactcaaacaaatttacaagaaaataacaaacaaccccatcaaaaagtgggcaaaggatataaacagacacttctcaaaagaagacatttatgcagccaacagacacatgaaataatgctcatcatcactgtccatcagagaaatgcaaatcaaaaccacagtgagatatcatctcacaccagttagaatggcgatcattaaaaagtcaggaaacaacaggtgctggagaggatgtggagaaataggaacacttttacattgttggtgggactgtagactagttccaccattgtggaagacagtgtggcaattcctcagggatctagaactagaaataccatttgacccagccatcccattactgggtatatacccaaaggattataaatcatgctgctataaagacacatgcacacgtttgtttattgcagcactattcacaaaagcaaagacttggaactaacccagatgtccaacaatgatagactggattaagaaaatgtggcacatatacaccatggaatactatgcagccacaaaaaatgatgagttcatgtcctttgtagggacatggatgaagctggaaaccatcattctcagcaaactatcacaaggacaaaaaaccaaacaccgcatgttctcactcataggtgggaattgaacaatgagaacacttgaacacaggaaggggaacatcacacactggggcctgttgtggggtgaggggaggggggagggatagcattaggagatatacctaatgtaaatgaggagttactgggtgcagcacaccaacatggcacatgtatacatatgtaacaaacctgcacgttgtgcacatgtaccctagaacttaaagtataataaaaaatatatttaaaaaagtcttagagaatgagaaatatgaaataatcaattatatcattatatccatgtataccaatgtcaaacaattggaaaataaaatcaagtgattccacttacactgtgaccagaaaagcataaaatatttagacataaatgtaataaaagataggcaaggtctatacctaaaaatgataaaatattgctaaaagaaatttaaaaagatctaaattaatggggagttatatcatctcagagattataagataatattatgatgtcaatttttcccaagtggatctatggataaataaaattacaattaatatgccaagagcctctatgatagaaattagaaattaacatttacatttgttttaaatatatattaatttaattcagatttattttaaatgtgttaaatttaaatgttttgaatttattaaaatttaaatttatatgaaaatgcaaaggtcctagaacaaccaatacaatcttgggaaaacagaacaaagttggaatctatttttcattccacataacaatttacccataaatgtattggcttacaacaaccaccttataatacctcatagtttcattaggtcagaagtccaggcacattgtggctagttgggttttctgcttaggtctcacaaggctgaaatcaaggtgtcagccagagcaatggttctcatttaggtcttgggtcctcatccagatcagtggttgttgtcagaattaattttatcatcactctttccctgtgcttccctctatttttaagtcagcaatatcatgtaaaacccttcttatactttgaatctgatgttctcttttgtctctgtatttgaaaggctcatgtgatacattgggcgcatctggataatccagaataatttccttatgttaaggttaattaagcaatattcttaattacatatttaaagtccctttaccaacacattcacaggtgtgctatctcatcatattcatagtcctgggaatcaaggagggcatggtatctatcttcttggtagccataattctgactaacacagcagccttacattacttgattttaaagattataagaattataagaggagagtttattagctttttacagaaaaatggaaacctaatcatgagacagcagaaaaggaaactgtggtaaatataaaatatatagaattttataaatatggatataggaagttgaatgaattaaagcttgaagtcctaaaatttcgttgggaaatagataaattatcttgttgagaaggagaggccataagtggtgtttgaatagaaagctgtactgttgaagattttaaatggctcttgtaggtaacaggagaaagagcaagcaactgtgggagcagctcaagttggagaccataaaattaatattggcataaatctgtggggcattgatttcttctagacatttttatccaaatacaggaaataaagatagatagttgaaatgttccaagggttgtaaggaacattttagcataatcaaggcaatgaaatgaaagaactttagagacactggagagaatggacaaaataataattgaattaaagaacctcggagcctacactagaaatgaaaataaaagtgtataaaggaggttatttgatggatgggtgtcaccatatatttggaggatatgtgtggtggaagtaaaggaagaaaggagttgaggaagaaaggagttgaaaagatagattttagttataaataaatatataggagttgaagatttaagaggtggggcagttccaagtgataagaggatctttgtatgtgtctatggaaatcagtttattaacgtccggtaggataaagattgttggtgtccaaaaatgttgatattaggtaattgggagggctgttcttatgaatttggaagttaacaatgattatggcagaaattggatggagagaaaaagcttcataagtcaaaatgatgtaaagaccacagtaaatgaagatggtagtatgggaggtcaattgatgaccaaataaggacaagttgaagatgatgtaattgaaaaaccactttattttctagctcttccatgctaagtgataccctacttcaaaatggacaccctgctctcctggcttgaacagtatcatcactttctcagagtacagacatgaatatcttagaaaaacccctgactagcttttatctgatacatagattctttcatttcaaagtctatctttaattaatgcttaaatactcctgtgggtattttattaactttctaaattagagctttatggttccccttttttcttttactctttctcattccacatagcaggattagggagctacattctcaataatgacttcactagttatggaaatttatcagaatgcttttaggtcaagagaataaagaatcatcagcggaaaaagtatcagaattgaaaaatttcagaagtctccagttagatttcactttttgatcacatcttctttctgtatattgatacctaatctttatttgaaaatatttagagtaaaactcaaagatgcctactggaacatactactcgcataaccaaaacattgccctattcttatgtgctctgcaggttaatacttttgcagtagcttatgagagaagataattcagttaacatatattaggatgcttgtttgagtctgtattctttaaaaattaattatggccagatattcattttactgtgaaaaaactaagctgattaaattagattgatttgcactagatttgtatttcaatacatactagctttcattttcttttccaaaatacttttttaaattaaaataagttataggaaatatttccaaagcacacacagacacacacacacacacacacacacacacaccacaaagtgtacactaaagaaaatgattttaaatatggagggggaaataaatagtatttttcatacgtaataaagtattacataaaacacatcagtaaatagcttaaattgcttataagtaggaaaaggcaaatgcttttttttatttaaaacttctttctagcacaggcttttaaaaacaatgttgtttaaaaatttaaataaaataagcagttctgaagatctctaaatgtttctatacaagccttaaatatgtatgtacataatttggccatttgaaatagcactaggataaaactgtggctgaccagtttcaatctaatatcagagaaaaaatgtgtgaaagactttgaaagggtaaaataaaattactaggagtcctggctagtacacccttcagaactatctgtgcctttcaatctccgtgaacaattttacaactctaaattaagaaaaactgtgagcaatacaaatgattcttctttatagagatataaataattgtgttcagctaagttacgtttgattattgcccagtgaatattgactagttttgcacctatctgtgaatttagttcagcatttttgattgccaatatcaatatagacatagaagtagacatagacatagacatagatataatatatagatagataaatgttctttgaattctcataactgatttattctttaatgagttaaatgatatctttggcatgtgctcattttatatttatatgggtcatggttttatgttcttaaaaatgttccttggcaattaataaaatttaaattgactagctgtaagttaaaatattttgagtcaacaaagctcctactttaccaaatttggtttaaaactttaaaaccttcaccataaaacaatttctatttttgcaattctttgagaaagttttgtccaaagtgtgccctaagaattattttctgagatatttcttgaaaggaaagttttatggtaaaatacatgtgtaaaatgcaatatatctttctggtaggaatcctaatggtctttactgcacaactgtctactgagacttagaggctctttttaatcaagttgatgtttctcaagcaattgcactgtcaactactcttcataaactttctgctataggtacaggaatattcacgatctccttgatctcccctagctttacctattttgaactttccaactttgcttatcctcttctccttgcctcacctctctactataatggtctcctctcacctctctgcttttccaatgtgaatcaacaattgtacttctcctactactattttttgtaacaattgaaatgtatgcttatgtttgccactggactgtgagttcttagaggatcaagaatatcttattcatctttgtatggcagggcaagggagaatttaagtgaagtaacactctggtttagttaaggcttctctttgaaggttttgattttggagtagcaaaaaatgctgcccccaaatatggcacattggcacactatgtattttaagctgaaggaaactgagaaacttgcagaagcagaaagattgctctcaacttccgcctcctgtcttttaaacactgtgacaagtgccatgctttaaaccatgagggaaggaatattatatagaaaggccaagaagaatctgaacaaacaggccttgcttggtacccctcatccccagtttattaccattaggtcatacccttttctttttgttccaatcatacttctacaaaattgtctattcttcatcaaatctaagcataaaaatagttgtccctgggtcttcattttagaaagcttctaggtcacataacattttgatgaaataaatttgttatgcctttttcttgctaatctgtctttattatagaagtgtcagccataaacccattaatgtacccgaaattttaattgtctattcgtaatgtttgtgttattgctggtattattatgtaactctgttaatctcattgctttttgccatatttcccacctcaattttcagtttcttgggccaaatgatctttacatgactacatcacctgtaagagaactcttcaagagctagaaatgaattactacttgaattatttgaattgaaggtaggtactacttagtagaagcaccaatgatcacagaggggcagaaaaaaatgtgcagggcaaatttactgccatgaattaagcacttgtactaagaagtttacttagtctaatgattagtgaagctactttcgtaacttggttaattacatttttactctatgtttaatattattctgattatcttcattgtaaaagcatttagaaaaaatatacattgcttcttattctaaatgacttaagtacaaatatgtaaaaagcactctcttctcagtggttgttatatgacttaaatgagtttatatacaacctttactaattgaggttctcgcctattttcctcaagaaatgtgtgttgaataaatttgttaactaggtactatactgggcattgaaatagaaagatggagtgaataatacaaagacttgattattttcttgagggggtggggccaaaatggctgactagaagcagcagtgattggaggctgtcatcaaaaagaaccataactgcctccaaatcctgcactggcaactgaggtatgcagggtcttcatcaaaactgactagggccaggtgaggtgactcacacctgtaatcccagcaatttgggaggctgagggggacggatcacctgaggtcaggagctggagaccagtctggccaacgtggtgaaaccttgtctctactaaaaatacaaaaaacggcttggtgtggtggcggacgcttgtaatcccatactcaggaggctgaggcaggagaatcatttgggaggtgaagggtgcagtgagccaagatcatgccattgcactccagcttgggcaacaagagtgaaactgtgtctcaaaacaaaacaaaacaaaaaacaaacaaacaacaacaacaacaaaaaacaagaactgactaggcagctggtatgacccatggagaggaaggaagagcagtgtgctgtggtggcccacctaagagccacacggggcaggggagcccccacaccccagtcaagggaggtggtgagtgtgctacccagcctaggaaaccgtgctttttccatggaactgtgcaacccaaggattggaggatcccactcatgaacccatgccaccgggaagccatgcagattctcaacagccactcaactagaatctgcttaagactcccaggggaggggcaaccagcaccacagctgccgctgcctaatgtctaagctgcctgaggtccttaggggagaggcaccagccaacactgagactgatagctgcctaacacattaagctcccagggcgggtatggggcagcagccatctctatagctccaggatatgcttttcccctgatggagccagggagtctggatagcttcgtcccaagaggtatcccccacagcccaacacaccggctgtggcagactgcagccagaatgcctcttcaggcctgaacctgacccatccctcctcactgggtggggtctccctgcaggaactccaacaactccagccaggggctcagggacagaagcctgatctccctgggcctgagcccccagggtgaggggtggccacagtctctgcagaccagcagacttaacctttcctcctgctagttctgaggaatctgggcagcccagacaagtgggtttcccccccagcaaaacacacctttcaccaagggatggtcaaagtgcttcgctaaacaggtcctgctccctgtgccactcaactgggtgagactcttaaacagggattgtcagacaccctatacatgagcattcctactgagatcaggtaggtgcctctcgaggtcagagatcccaaaagaagaagcaggcactcatctctgctgttctccaacctcctcaagtgacatctccaggcacaggagtgaaccagatgaatagtgcttgaagcgaacctctggcaaacctcagcagccctacagaagagggacttgaccattgaaataaaaacaatcaaacagaaaacaacaacaatagcatcagcaaaaaagagttcccaactaaagccctatccaagggtgagcagcctcaaacatcaaaactagacatattcatgaagatgagaacgaatcaatgaaaaaatgctgcaaaaccaaaaggccagagttcctcctctcctccaaatgatcataatgcctctccagcaagggtgcagaactggacagaggatgagatgggtggattgacagaagtaggcttcagaaggtgggtaataataaacgccactaagctaaagaagcatgtgctaaagttcttagcaaagaaggtaagaaccttgataaaaagttagagaaggtgctaactagaataaccagtttagagaggaacataaatgccctgatggagctaaaaacataggacgagaacttagtgaagcatacacaagtatcaacaggtgaatcgaccaagtagaagaaacgatatcagagtttgaagactaccttgctgaaataagtcatgaagacaggattagagaaaacagaatgaaaggaatgaacaaaatctctgagaaatatgggactatgtaaaaaaaaatgaacctatgactgactggagtacctgaaggagatggggagaagggaatcaagctggaaaacacatgtcaggatactatctagaagaacttcccaaacctagcaagaaaagccaacattcaaattcaggaaatacagagaacaccactaagatactccatgagaagatcaaccccaagacacatatgggcagccagagagaaaggccaagtaatctacaaagggaagcacatcagactaacagtggacctctcagcagaaactctacaagccagaagagagtggggaccaatattcatcattcttaaagaaaagaattttcaacacagaatttcatattcagccaaactaagcttcataagtgaaggagaaataaaatcctttccagacaagcaaatgctgagggatttcatcaccaccaggcctgccttgcaagagctcctgaaggaagcactaaacatggaaaggaaaaaccggtaccagccactgcaaaaacacaccaaaatataatgaccaatgacactatgaagaaactgtaccaactagtgtgcaaaataaccagatagcatcatgatgacaggatcaaattcacacataaaaatattaacctaaagtgtaaatgggctaaatgccccaattaaaagacacagactggcaaatagtataaagagccaagacccatcagtgtgctgtgttcaggagacccatctcacgtgcagacacacataggctcaaaataaaggaatggaggaacatttaccaagcaaatggaaaggaaaaaagaaaaacaagcaagggttgcaatcctagtctctgacaaaacagactttaaaccaacaaaaatcagaaagacaaagaagggcattacataatggtaaagagatcaatgcaacaagaagagctaactatcctaaatatatacgcacccaatacagcagcacctggatccataaaacaagttcttagagacctacaaagagacatagtctcccacacaataatagtgggagactttaataccccactgtcaatattagaccgattaatgagacataaaattaacaaggatattcaggactttaacacagctctggatcaagtggacctaatagacatctacagaattctctacaccaaatcaacagaatatacattcttctcagtgccacatggcacttattctaaaattgaccacataattggaagtaaaaccatcctcagcaaatgcaaaagaactgaaatcatagcaaacagtctctcacaccacagtgcaatcaaagtagagctcaggattaagacactcactcaaaaccacacaattacatggaaattgaacaacatgctcctgaatgactcctgagtaactaatgaaattaaggcagaaatcagtgttatttgaaaccagtgagaacaaagacacaacataccagaatttctgggacacagctaaagcagtattaagagggaaatttatagcactaaatacctacattggaaagctggagaaagatcacaaaatgacaccctaacatcagaattaaaagagctagaggccggacacgttggctcatgccaactgaggttgatagcactggtcaagaggctgatgatgatgccatttgtgataataagaacaactcataactaagaggtagataggttttgttgcacaggtggagagatggggaaagacagagttattttattgccttatctttggtaatatattagtatattatttgttctttgttttaatttttcaaagtagaatgtactatgttacaaacagcatactaattattaggtcttaaaatttagcatgcaatattcacatgtaattgactttaatgcctctgttatatctaaattgtacctacctaacttttttcatttctttaagtaaattctttctatatttttctgcttttagtttttgcttaacaatcaggcttttctcttttaggacagcctcattcttctccagtctgtcaattttaagtagtcctctggtcaaaagagtgcgctcattatttaagttttgaactaataaacgctctgaagccttttgggatttttcttttagaaacagagcttttctctctctagctttttcaaggtagttgaatctgttttgccaaacttgtcgtaaactgttctgaattgtctctttattttcttcaattagtttttgtgtagcatattttttctgattcaaatgttcattaacagctactctaactctttctcgagcaacttgtgccatggctacaactcttactttttctttatggtattcctgcttcttttgttctgtgtaatatttgtcaatatcactaaatgttcggagtttcataccagctctttgtggtgcaaaaaactctttcatactccgctccaatcgtatgtcttttttaatgattggctttggatgagtagtatagattggctgaggatatgcaggaaaaaaatgttgttttttctctctcaatactgcattattcttcaatgaacctgaagtgtatatgggtagtttgaaaactgatatcctaaaactggtatccaatttttcatccacaatttcatcttcagactcctgacctacatcaaacagaagcaaatattatacattatacaagagctaagtacattttattttctctccaaatatatcaataaacttgataagaaccttttatttactttactaagaagaatttttcccaagtaccttttcaacttgtgatttaatagtaactttggagaagaaaatcactattaaaacattttcacatagaaatgcactgaatctaattcttatattttctgtattatcttccacaattacttaacttgcagtgactcaatagcagcaacttatcacatacttagtactacttaaccacacatattattttttcatatagtttgctaaaagaaacaaagtttaattaagcaaagaataattcatgaactgggtagcactgagaaccagtgaaaatttagaaaactctgcgtaataaatgagcagggagtatttatagatagaaaatggaagaaatatagaaacagcttgattggttatggttcaattttgccttatttggacataatcatatcagttggtggcctgtgattggctgaagcttgactgctgtgattggctatgacttagttatcttttacaaaaatatacctgtaagttaggctttcagtttgtttacatactaagttaggttgcaattcattatgtaaggactcaaggaacagaggcagccttaggccacatttaacaagttattagtatgtcatatttgcaaagggcattgtaatccattttaccttatttttcttaactctggtggaaaatagtagcagccatcaatcgtttttcccttttttggacagacaaaattactaaaactcttagcttcctttgctttcctttgtgtgaccatgggctaagtcctttttaatagagtgtgaacacaattgttatgtgttattccttgtccaagagattgttttaagaaacaatgtgcaccttctttccactacgtagagatgagaatgaaaccccaaaagatggtggaaccataagatagaagctgcctgcctgcctgaatcacttgttgaaaaaacttctcatggaccagaatcatccaagttgggtcatttatgaagccagaaatcaaaagtaattatgtttcagtcaatatgcatttctgggtctatttgttactatacccaacctaattaatacaataaattgaatcacattgttgtttgcatatttactttttgacaaacctactaatgaattcagaatcaggtgacaaatacaagtataaaagttatgcttgttaatttaggagaaaaaggtgtttcttgatttcttccacttattaaaattacattcctgctaactctagtctacaagggtttgatcttccttagaaaattaccttgtctttatgtgtaaaaatgtcaaatatgatgctggtggttttatggaagttaagtgaactatgaagaagggcagggcttgtagtctagacggacagtagaaaataattgaataggcaagattttcacgaaaggctacaggagtatcaacgttggaaaagtaagtaaattctacagcaaagtaggaaatcaagtctagcaaatagaaaaggcagtccatcaggatagaaagccaaagtgtccagaaataaacactaaatatgtgtgtccaaagcaagagactgaggagccaaagtgtcaaaagtcagagtctctcattagttggttgaacatagtcccattaacacttttaaaagtctcctaatttctttctctgttttcagaatctctgtttcaagaaatcactcactgctatatttatctttcttaagtagggttctaacaacattgtaccttatacacaaacaaaggaagacaaaatctttatggctttccacccatagtctgaagaatagtttccatttttggcctaggattatataataccagaaaagagcgacatatttttccccaacatatgcatcatatcttatcatcattgggcctttgcttctattattttaagttttgctcagtatgctgtttttcttatctgtatctgttcatattctatgcattcttccatgtcttttcacgtcatattttccttattgcttaaaaaagaattcatatgttttaaactatcacatatgtttttcctgatagaattaatcatattccacttacattaaagctctatgtagtagtttttagctataggatcgaacttgatataaccttcttatgagtaaggatctactcctttggtctttgatgctacattcccagcccctagcctactattttgcacagtttggtttgtgcagcaatgtagtttagatgtgtgtcccctccaaatcccatgttgaaatgcaatccccaatgttggatattgggcctagtgagaggtgtttgggacatggggtagacccctcatgagtggcttggtgccctctcgtgataatgagagagttcctgttatggtagttcatatgagagctagttgtttaaaaaagtctggcacctctgtcttcatgtgatatgccagctcccacatcaccttctgccataatattaagggaaatttatagctctaaatgcccacaggagaaagcaaaaagatctaaaatttacaccctaatatcacaattaaaagaactagagaagaaagagcaaacaaattcaaaagctagcagaagacaagaaataactaagatcaaagcagaactgaaggagacagagtcacaaaaaacccttcaaaaaatcaatgaatccaggagctggatttttgaaaacatcaacaaaatagaccactagccagactaataagaataaaagagaggagaatcaaatagatgcaatcaaaaatgataaaggggatatcaccaccgattccacagaaaatacaaactaccatcagagaatacgataaacacctctatgcaaataaactagaaaatctagaaggaatggataaattcctggacactacactcttccaagactaaaccatgaagaatttgaatccctgaatagaccaataactagttctgaaattgaggcagtaattaatagcctaccaaccaaaaaaagtccaggaccagagggattcacagccgaattctactagaggtactaagaggagctggtaccattccttctgaaactatttcaaacaagagaaaaagagcgaatcctccttaactcattttatggggcaagcatcatcctgataccaagacctggcacagacacaacaaaaaaagaaaatttcaggccactatccctgatgaacattgatccgaaaatcctcaataaaatactggcgaactgaatccagcagcacatcaaaaagcttatccaccactatcaagtcagcttcatccttgagatgcaagccttgttcaacatatgcaaatcaataaacataatctagcacataaacggaaccagtgataaaagccacatgattatctcaatagttgcagaaaaggccttcgacaaaattcagcaggcttcatgctaaaaatgttcaatatactaggcattgatggaacgtatctcaaaataataagagctatttatgacaaacccacagccaacatcatactgaatgggcaaaaaccggcagcattccctttgaaaaccggcacaagacaagcttgccctctctcaccactcctattcaacatagtattggaagttctggccagggcaatcagacaagagaaagaaataaacggtattcaagtaggaaaagaggaagtcaaattgtctctgtttgcagatgacatgattgtatatttaggaaaacccatcatctcagcccaaaatctccttaaactgataagcaacttcagcaaagtctcagggtacaaaatcaatgtgcaaaatacacaagtactcctatataccaataaaagacaaacagccaattcatgagtgaactcccatttacaaccactgcaaagagaataaaatacctaggagtacagctaacaagggatgtgagggacctcttcaaggagaactacaagccactgctcaaggaaataagagaggacacaaacaaacggaaaaacattccatcctcatggataggaagaatgaatgtcattaaaatggccacactgcccaaagcaatttatagatttaatgctattccgatcaggctaccattgactttcttcacagaattggaaaaaactactttaaagttcatatggaaccaaaaaagagcctgcatagccaagacaatcctaagcaaaaagaacaaagctggaggcatcatgctacctgacttcaaactatactacaaggctacagtaacacaaacagcatggtactggtaccaaaacagatatatagaccaatggaacagaacagaggcctcagaaatcatgccacatatctacaacaatctgatcttcaacaaacctgacaaaaacaagaaatggggaaagggtaccctaattaataaatggtgctaggaaaactggctagccatatgctagctgaaactggatccctaccttacaccttatacaaaaattaactcaagatggattaaagacttaaacctaaagccataaaaaccctagaagaaaacctaggcaataccattcaggacattggaatgggcaaaggcttcatgactaaaacaccaaaagcaacagcaacaaaagccaaaatagacaaatgggatctgattaaactaaagagcttctgcacagcaaaagaaactatcatcagagtgaacaggcaacctatagaatgggagaaaaattttgcaatctgtccatctgatgtaggcctaatatccagaatctacaaagagcttaaacagatttacaagaaaaaaaacaaacaaacccatcaaaaagtgggcaaaggatatgaacagacatttctcaaaagaaggcatttatgtggccaaaaaacatatgagaaaaagctcatcatctttggtcattatagaaatgcaacacaaaaccacaatgagataccatctcacaccagtaagaatggcaatcattaaaaagtcaggaaacaacagatgctggagaggatgtggggaaataggaatgcttttacactgttggtggaagtgtaaattagttcaaccattgtgggagacagtgtggcgattcctccaggatatagaaccagaaatacccagcaatcctattactaggtatatgcccaaaggattataaatcattctactataaagacacatacacacgtatgtttattgtggcactgttcactataggaaagacttggaaccaacccaaatgcccatcactgatagactggataaagaaaatgtggcacatatacaccacagaatactatgcagccataaaaaaggatgagttcatattctttgtggggacatggatgacactggaaaccatcattctcagcaaactaacacaagaatagataaccaaacaccacatgttctcactcataagtgggagttgaacaatgagaacacatgggcacagggagaggaacatcacatactgggacctgttggggtgtgatgggctaggggacggatagcattaggagaaatacctaatgtatctgatgggttgatgggtgcagcataccaccatggcacgtgtatacctatggaacaaacctgcacgttctgcacatgtaccccagaaattaaagaaattaaagtatatatatataaaaaagaggcctgatagaggtccttcaccctctaccatctgtgagcacacagccagaaggcaccatgtataaaccagaaagtgggttttcaacagacaccaaatttgttggtgtcttgttcttggacttcctagcctccagaatgattttaaaaaatctgttgtttataagctacccagtttatggtattttgttataacagcccaaatagagccccaacccccagtgtggctttatttggtagtgggacccctcagaaactgattaaggttaaatttggtcataaagtgaaaccctgattgaatcaggttagtgttctcatgagaagaaatatcagatagctcactttcccttctcactatgcacacatatcaaagaaaggccatatggacacagcaagatggtggttttctaaaaggcagagagccctcactagaaacttaccatgttggcatcctgatctcagactcagactccagaattgtaagaaaacaaatttctgttccttaagtcacccagtctggaattttgttatgacagcttgaacagactaacacaaaggaagttccctctcctgaatttttaagtaaagttgcccaactggtatgctgtggcaaactagtgtgttattaatggataataggagtgctcagagacattgatcaccctgggatggttatttatttccattttacttcaattttaattgatcctagcatgtcaataattcttctaatttggagaggggagtataatgttcctagaatgtccaaaatgtgaccatttgtccagtcttgggtctcatatctcaatttcattgtgttattaatgtaacagataacaatttcccccataacctcccagcagctacttaaaattacatatgatctcagtgaacgattaagtagcttctggcttcctagaatcattttgattcattcaccaattaattcatctatctatccttccatccattcattcatattttagtagcttgcaaattctatggaaattcagggatcacaaatataaaagttattattcaaactttctttagttcttaactttttatgtaaattttttttcctttgtgtttgagagttgttttccatgaatattagcagtctgtctttactcgtaaatgttttctttgttaaatatagaagtccaataataatataatgtgtgaacagtgtatacataaaattgaatgtttgttgtgtataagacacttttctaaacaaaatacatgaggtatttactaagaaatgcactatcccagggctcatgaaacttctagtggagaagatggataacaaatttataaataagaaaatatcaaatagaaataaatgctctgataaaaattaattggcagtgagagggtctagtaattagattgggtggataggaatgggtttttagaggatatctgatttaaccctagatgagaaaagataagtaagaacaagcaaggagaaaaaatgaacattccagaagaaaagagaagctaatataaaggcagtagacagaagcacatttagcctgctagggatacagagagaaagccacctgaaatccactaagtaagaggagagtggtgctggagacgctcacagaggtaaggcaggggccagattctatgcggcatggtaggtcacagaataaaagttttggatttcattctgagatttgaagtcgttgaagtaggggactgatatggtatgtgatttaccatgaagacaatggatttgaatgtggaccgtaaaattctaagtaggggactggttaagaggctactctagtggcccaggtaagattttatgataggaagggcctagatgaaagcaataaattcacagagaagtagaaagatttggcatatgttttacaagtatagtcagaaggggctgctgataacttagatagcagaagtgagaaagaaaaaaatcaaagatgaatggtagcattttggcttgagaaaccaggtgaatggtgatgccatttgctgacatgggaaaaactgcaggaaaagcagatttggtgagctagaagaaatatttttatatgtattactgttttgcagttcatacttttcatatttaaacacataactaacattttcctaattcaacgtcatattcaaattgtttatattaaaaaatcatttaaaactttcactaatgtaatgtcattttaaagtattttattcttaaaataaaatcattttgaacaaataccatttatttccatttacatgattcctagtaatactcaggttaaaactgaggaaaatgacacctttgtgtcttttttttcttttttttttttttttgagacggagtctcactctgttgcccaggctagagtgcaatggcatgatctcagctcactgcaacctccgcctcccggattcaagcaattctcctgcctcagcctcctgagtagctgggattacaggcacacaccaccatacctggctaatttttgtatttttagtagagatggggtttcaccatgttgatcaggctgctctcaaactcctgacctcatgatctgcccacctcggcctcccaaagtgctgggactacaggagtgagccaccacacccaccttgcatactttttaaataataataccagataatacttgaagtacaggttctcctttctccagccataacttccacaaactgaattttttgacacaaaggcaacaaaatggcttgttttagatatagtattaaagaaaagcttgctaaaaagcaattattcttatatttataccttatatgtacctctcaacttaagagcaaaacaactggatcatatcagccaatttactttcagttttctgaacagatagttggatcttttaggactcagagcaacacagaagccaataccatttgtggtcaacagagcttgtttgattcttctgaacgtattgcagatttatgaaccatctgtgaagaaacaaatggtccaaacctatttaaaatcagcatagctgtgatttgaatgctcacaagtgggtctgaagcagttgctttcctcagcaaactggcctgacacctttgcacaagcttatagccttatgtgatacataagctttaagtttaggtgaagcaaagaacaggaaaataaggaaaatgaaacgaatataaggaagaaagcagtggcataaacttctgtcacgtactgagttcttcctgatttgctagatgcaaaaagttcacttatagcaatggttgcaatttcttcctattttcttagtagcaaatgttttcaatgaagtctctcccattacacacgcacatatactctggtataaatgacttatctaagatatggtataagatcaccataataaagaatatagtttatgaaacatcttacatctcacatgtaataaagctctcctggggatttattgtaatagaatagaaaattacagagatgcacaggcgttacccctctcactttacatctttaatcaatttctgaaaattagacattctgtaaagaagtgctatgctggagcctatttctttatattctacatgggaaaattgtaacacattaaatgttaaccaccaacccttattggatttccaaaaatgaaaatagagcattaaaacattaaagcaggaaaacacactaaaacatgaatttataagtaccgttcacactaatgtacaaattgcttaaaacattgctttttgattatcagttattaaggctgcttacaaatagtatccattgcaatgatgtgactgttagtgacaacgtctcaaatagccatacctattgttgacatttggcatgctttaaaagttcctacatacgattttaaaaacatccgtattgagatatacttaatattccatattagtggtatattaaatcattaaagtgtacaatgtaattgttttaatacatttatagagttgtgcaaccataagttatcaccacagtctaggtttagagcattttcatcaccccaaacagaaaccccatacgcattagagtcattcaccatcccctgtctcctaccatctcccccaccttaagcaaccactaatctactttctgtctgccagattttcctattctggacatttcttataaatgcaatcacacaatatgtgatcttttataaggggtttcattattctaaggtagtaaattacagctttatgatacgttcccttttaaaatttgccttttatacagtttgccttcgccactccactctgagttctacctgtctggtaattttaggtagaacaaaatatttaaaccaatttcatacctggccataaagagtgaaaaaaatagactgggcaagtttgacttaggattaaggtcaaactttctacaggttcctgaataactatgaatcagtccgttaataattatattatttcccttttcccaagcttaccatttctttcatcttctaaggatcatgacgcttcaatctttttttcctctaagatcaggatcttaatttgaagatctaaatttctctacttgatatcttaggcccaaatatgtgagttccaccaggaccgcgctgactacataagtcttactagtccgatgtccactgaaacagtgctttggatctaactttctctttttttgagccattggacagctacagccactgttggatagtagttagggtgaaaaaccaggagcacaatcacttgcatatctgaaatgccacatcctatcatttcagaaagtaacttcatggaagttactcaaattcacgatgccatagtttcttcatctataaaatgggagaatgaaagtgcccaccttatagatttgctgtgagggttgagtgaaatctgcttggcactgaggaagaaattataaaatttagttgttcttcttatatcagctctcaatttcattttttgatctaaaacttcttatgttctcgataatggtagacatctctaatatcctcaaaagcctttctcacactgcttttctcacactctgggcagagagcggttattcattggagaagattataagccaatacagatttactatctttatctgatataataaattttgcttaatctcttattatataacaattacaaatccctctctgagctcttctctctgtggaatatattcaatctgcagttcctttttttcataatgtgtattatatctgacttctttaaaacaaaataaattctagattgtaggaatcttacacttgatcttaagtcttcaattaattttgatttaacaatttccttgttcactattctttctggtttttaaaaataacatcttctttgagatacaattcatatgccaaagaatgtatctttttaaagtgtacaattacaataatcaaaacagtttggtattggcaagagtattgacaaatagatcaatggaacaaagtagagagcccagaaatagatctgtcccgtgatatagtcaacttatctttaacaaaagagcaaaggcaaaacaatgaagtgagacagtcttttcaacaaacggtaatgaaataaccggtcctccacatgccaaaaaaaaaaaaaaaaacaaattaatctagacatagaccttacacccatgacaaaaatcagtttgaaatggctcatagatttaaatataaaatgcaaaactataaactcagagaagaaaatggaagaaatcctatataattttgagtatgacaataacttctttaaaaaaaccaaagttccatgaaagaaataactgttaatctggatttcattaaaattaaaatttctgccctgcaaaagagactatccagagaatgagagagcagccacagacttagaaaactatttcaaaacacacagttgataaagaacgttattaaaactcaacaataataaaataaacaaccagatgaaaaaatgagcaaggggctgggtgcactgactcacccctgtaatctcagtactttggctaaggcaggaggattgcttgagccagagtttcaggttgcaacaggatatgatggcaccactgcactccagcctgagcaacacagccagaccttgtctctaaaagcaaataaataaataaataaacaaatggacaagagacttccttaaagaaaatatacagatagcaagaaagtatataaaaagatgctccacatcatatgttattagagaattgtaacttcataagataacactacacacctactagaatggccaaaattcaaaacattgacaacaccaaatactgatgaggttatggaacaacaggacctctcattcattgctggtaggatgcaaaatggtaccaccactttggaagactggcagtgtttacaaaactaaagatattctcactgtaaaatccagctgtcatgttccttggtacccatcaaaatgaattgaaaactttgaaaacttgtgtctgtacaaaaacctgcacatggatatttatatttaatagcagctttattcataattggcaaaatatggaaactaccaaatatactttagtaggtgaatggataaataaaccttggtatatccagaccatggaatattattcagtgctaaagacttgtgctatcaagccataaaaaaaaaccacgaaaaataaatgcatattattgagtgaaagaagccaatctaaaaaggctacatactgtatgattccagatactggtatacaatatgtgtgaacaggtaaacctgtaaataatagtaaaaacatcagtggtagccagggataaggtggggaggataggatgaataaggagtgtagaaaggatttttagggcagtgaaatgattctaaatgataccgcgatgttggataaatatcattgtacgtttttcaaaactcatagaatgtacaccaagagtaaaccctaaggtaaattatgatcttttgcagataataatgtgttagtttaagttcatctattgtaacaattgtaccactatattatatgtggtgtgggatgtggataatgaaagaggttctgcgtatattgaaacagactgttatggaaaaatctctgtattttctgctcaattttgctatgaacaaaaactgtcctaaaagtttattaattacaaaaaggaagaaaacacaaatatatatatatatatatctatatatctacatacacatacatataaatacacacatacatacatacatatacacacatacatccacatttttaatgcatgtgtatatatgtatatattgatgtgcaattataaatataatttaaaatacaattatgaattacaactataaattatataaaatgtataattgtattacatattatgaattatataattatataaaatattataaatatataattatataaaatttaaaaatatattttaaataatatgtaaatataaatatagcttatataaatacccacatacatattaagtgtgtaatccagtgggtctttgccactttttatcacagaataacacaaccatcatgacatgtatgcacatacatacacatgcatacatacacatacacacacatacatacatatacactttatatatatatatatatatatatatatatatacacacacatacatataaagggtatgattcagtgtttttctgacactttgtcacagaataatgcaactatcatgaatacctaattcaagaacattttcatcaccgtagaaagaaagcaggtatctattagcagtcatttcttgttcccccctctcttctgcccctgacaactacaaacctattttatatctctataggtttgtattttctgggcaattcatatacatggagtcataaaatatgtgttttttgtgtcttctctcttatttaacatgtttgcaagaatcatccatgttgtaacatttatcagtatttcattcctctttgtaattgagtatcattcattatacatattcattatatgcccaggactgggcaatgcattttttacttactggttgatggatatttgatttttttatttgtttccacctttgaactgctttaagtactgcttctttcatatacaatttttatgtggacatatgtttatgattctcttggctatactgctagaaataaaattaggggttcatatggcaactgtttaatgtttgaagactgccaatctgtttttcaaaagtggctgtatcagatgcaggaaaagcactcatgaaattaaacaccctttcttgataaaaattgaataaagtcctggcatgttggctcacgcctgtaattccagcactttgggaggccgaggtgggcacatcacgaggtcaggtgatcaagatcatcctggctaacacggagaaagcccgtctctactaaaaatacaaaaaaattagccgggtgtggtggtgggtgcctgtagtcccagctactcaggaggctgaggcaggagaattgctccaagtcgggaggtggaggttgcagtgagccgagatcatgccactgcactccagtctcggtgacagagtgagaatctgtctcaaaaataaataaataaataaataaataaataaataaataaataaactcaacaaattagatatagcaggaacatacttcaacacagtaaagaccatatatgacaaaaccatagctcatatcatacacaatgggaaaaattttaaagctttttctgtaagatctggaaaaagataaggatgcccactctcaccacttgtattcaacatagtactagaagttgcagccagagcaattaggcaagagggaaaatagggatccaaattggaatagagaaagtcaaactgtccctccttgcagatgacatgatcatacatataaaaaactaggaagactccaccaaaaaactcttagaactaataaatcaattcagtaaagttgcagacacaaaatcaacatacaaaaatcagtagtgttttaatacaccaatagtgaactgtctgaataataaatcaagaatgcaatcccatttacaataactacaaaaataaaataactagaaataaatttaaccatgaaaagaaaatatttatataacataaaatacaaaatactgatgaaatagtttcaggaacacaaaaataaatggaaaactatcctgtgttcatggattgtcagaattagtattgttaaaatgtccatactacccgatatgtgtccccaaccaagtctcaacttgaattgttacccccacatgttgagggagggacctggtgggatgtaattggatcatggaggtggtttctcccatgctgttctcatgataatgaggaagttctctcaagatctgatgttttaaaagtggcagtttcccctgcactcactctctgtctcctgccaccatgtaagatgtaccttgcttcccctttgccttcgctatgattgtaagtttcctggggcctccccagccatgcagaactgtgagtcaattaaacctcttttgtttatagattacccagtttcaggtaatatctttatagcagtgtgagaatggtctaatatactacccaaagtggtctacagattcattgctattcctatcaaaatactaacgacattcttcacagaaatagaaaaaaattccccaaattatataagatcctgaatatccaaagcaactctgagccaaaagaatacaagttactatagctttttagtatattttaatgtcaggtagtggaagcatagtacctgacattaaaatatactaaaacggtatagtaaccaaagcagaatggtactggcataaatggagacacatagatcagtggaacataatagagagcccataaataaattcatacattcacagccaactgattttagacataggtggcaagaatactcattcaacaaggacagtctttttaataaatggtgctgcaaacactaaatattcacatgcagaagaatgaaactagacccctatctctcaccatataaaaaatctactcaaaatgcattaaagacttatatgtaagacttgaaactttgaaactactagaaaacaaaagagaaatgctgcatgacataggactgggcaaggactttttgaaatagacttcaaaggcacaggtaacaaaagcaaaaatagacaaatgggattacaccaaactgaaaagctgctgcacagcaaaggaaccaatcagcagaattggagaacatattcacaaactatacatgtgataaggggttaatatcaaaaatacatagggaactcaaactcaatagctaaaaaaacaagcaacccaactaaaaaatagtcaaaatccctgactagacatttatcaaaagaagatataaaacttgccagcaggtatatgacaaaatgcttaatatcaccaatcattaggaaaatgcaaatcaaaacagtgagatattgcctcacccctcttagaatggctattatcaaaaaaacaaaaaacaaaaaacaaatactagtgagaacacagctaatggagaactcttatacactgttggtaggagcatacattagtacaatgactatggaaaatagtatggaggttcttcaaaaaactaaaaatagaagtatcatatgatccagcagttccactactgggtgttcatccaaaggaaatgaaattagtattcagagacatctgaactcccatgtttgttgcagcactattcacaatagccaagaaatggaataaacctttgttcatcaatagatgaatggataatgaaaatgtggtatatatacacaatggaatattatgcagaaataaaatggaatgaaatcttgtcattcgctacaacatggatgagcttggagaatgttatattaagtgatataagccaggtacagaaagacaaatattacatgttatcttgcatatatggaagctaaaaaagtttgtctcatagaagtaaagaataaaacagtggtttccagaggctggagagtgttggagaagggaaatagtcagaggttggttaacagatacacaaatagataggaggaataggtaagttctagtgttttgtagcactggggagtgactatcatcaacaacaatttgttgcatgttttcaaatagctagaagagtggacttttaatgtatctaacacaagggaatggtaaatgtttgaggcgatgaatattctaattatgctattgatcactgtgcaatgtatatctgtgttgaaacatcatactgtaccccataaatatgtataattattatgtattaattacaaacaaaatagaaagtaaattgatgtatcattttacatccagcaatgtatgtaaatccatctgtaatccacaaagtttccaatttctccttatctttgccaaccctttgcactgtctgtgttttttattatagccatctgaatgggtgtgaaatagaatctcattaaattctttatttgtattgccctggtggccaaagatgttgtaagatatttttaatatttctggatacaagtccatagcagatatgttatttgcaaatattttatcttactcagcgagtgtcttttcactttcttgatggtatactttgaagcacaaagtggtttattttttcaactttgatgtggttcaatctttcattttctatctgtatttatttgcttcctttttttccttttcttattatttttggcttatgctcctagtggcatatctaaaacatcgttgcccaagttaaggttacaaaggtttactcccatcttctcttttaagacatttataattttaatgcctatgtttagatctatgatccatttaaagttaatttttgtacatggtgtgatgtagagatccaacatcaatttttgaatgtagatatatagttgtcccagcaccattttttgaaaagactattctttcctcaataaattatcttggcacacttgtcaaaaagttgtattgccttgatctaaatgtctttcattatgccagttttcacattgtcttaattactgtagctttgcagtaagtttcaaatcaggaactgtgagttcttcaaatttgtttttatttttaaagatcatttggttgttggaaatcccctacattctatgtggactttaggatcatcttttccatttctgaaaagaaaaagcattgaaattttgatagggattgcttgtatctctatattgctttcagtagtaatatcatcttaattttaagtcacccattttaagaaaatgagtgtctttccatttatttagatctactttaattcttcagtatagaagtcctgtacttccttcattaaatttattcctagttattttattcttttttgttgctattataaataaaattgtattcttaaattattttcaaattattcgctatataattgattttcaaatatttgcgtatttttatacttctaggaaagtgttcatttcatctaacataaaatttctttgcatattgttcattgtattcctttatcatcctttttatttctggaaattttgtggtaatgtcccctgtttcatttctgattctagtaacctgagtcgccttcttcttcgtcgtcatcttcttcttcttctttttcttcttcttcttcttcttcttcttcttcttgttcttcttcttcttcttcttcttcttcttcttcttcctcttcctcttctttctcttcctcctcctcctcttcctcctcttcctcttcttcttcctcctcctcctcctcttccacctcctcctccttttcttcttcttcctcctcctcctcatcctcttcctcctcctcatcttcttcttttctacttctttttttcttaaggtggaaagttaggttatatatttgaagtatttttgcatttttaatacaggtgcttacagatataaatttcattctcagcactgctttagctgaaactcataagttatttttgttttcacttacctatctatattttctaatgtcatttgtaatttttttctctgatccattggttattggagagagtatagctgggtgtgatggtgcatgactgtagtcccagctaatagagatcacttaagcccaggagtttgagttcacagtgggcaacatagcaagaccctgtcacacacacaccaaaaaaaggtaggaggaacatctgccaccaagggaccaggacatcaggaagaccggtgcactccaagcagatcttcagaaggaaggcattgagagtggacagagaggaaacactgctaggttgaaggggcaggaatctgggacctctgcatgtagctaccacacatcaggactcattttgacccccagtgacttctggggaaggagtgagtttagcaggcaagaagcgtcccactctcaccacagacctctggaattctggcagcgggagatgtcacaactttcaaggacacttgagctggcagggaaagctgcttagagaggtggaggggcaggacttgatctgatatatgacctcagcaaagtttcaggatatgaaatcaatgtacaaaagtaataacatcctcatactccaacaacatccatgctgagagtcaaatcaagagtccaattccattcacaatagccacaaaaagaatgaaatacctaggaatacagctaactggggtggtgaaagatctctctcatgagaattataaaacactgctcaaagaaatcagaaatgacacaaacaaatggaaaaacattccatgttcattgataggaagaatcaatactgttaatcaatattgttaaaatggtcatattggccaaagtacttaacagattcaatgttattcctatcaaattatcaatgacattcttcattgaattagaatattttaaaattcgtatggaaccaaaatacagactgaatagccaagacaatcctaaacagaaagaacagagctggaggcatcacattacctgacttcaaactatactacatttgcagaaaatgaaaactcgaccacttccttataccatatagaaaaatcaactcaagatatattaaatacttaaatgtaaaacctaaaaccatgaaaaccctgaaggtaacctaggaaataccattctggacatgggaccaggcaaagatttcatgatcaacatggtaaaagcaattgcaacaaaaacaaaacttgacaaatcaggttgggcatggtggcttacactagtagtctcagcagtttgggaggcctagtccggtgaattgcttgagctcaggaactggagactaggctgcataacttagtgagaccctctctctacaaataatacaagtatagccaagcttgctggcacatgcctgtagtcacagctactagagaggctgaggtggcaggattccttgagcctgggaggctgaagttgcagggagctgagatcataccactgcactccagcctgggagacagagtgagagtttttttcaaaagaaaataaaattgaccaatgggacctaattaaattaaaaagcttcttctgcaaggcaaaataaattatcaacaaagtaaacagacaacctacagaatgggagaaaatatttgcaaactgtgaatccaacaaaggtctagtatccaaaaacctatagggaacttaaatatacaagtgaaaaataaccccattaaaaattgggcaaaagacatgaaaagacacttttcaaaagaagatatatatatgaccaacaagcatatgaaacaatgctcaatatcactaatcattagagtaatgcaaataaaaaccacagtgagataccatctcacaccagtcagaatggctattactaaaaagtcaaaaaacgacagatgctgccaaggttgtggaggaaagggaaggcttatacactgctgatggaaatgtaaattagttcactcattgcagaaagcagtttgacaatttctgaaaggacttaaaacagaatgagtactcaaaggaatagaaatcacagcactattcacagtagcaaagacacagaatcaaccttaatgtccatcaacagtagactagataaagaaaatgtggtatatacacaacatggaataccatgcagccatgaaaaagaatgagatcatgtcctttgtagtaacatggttggagctgtaggccattatcctcagcaaattaacacagaaacagaaaaccaaataccacatgatatcacttatgggagctaaacatcaagtatatatggatacaatgaagggaacagcagacattggggcctacttgaaggtggtgggtgtgaggagggtgaggagtgaaaaaatacctatcggatactatgcctattacctgggtgaggaaataatctgtacaccaaacccatataacatacaatttatatatgtagtaaacattcatatgttcccctgaacctaaaatagaagttaaaaatagaaagtaaaaacaattaaataaaatagatactcaagtagtcctaaaataacaaccactaccaaagcaaaacaaaacaaaaaaaatcaaaacaaaacaaaacaaaacaaaaaaccccaaaaccaaacaacaacaacaacaacaacaacaacaacaaaacgaggaagggtgtttcctaatttacacgtatttgtatatttgtgagatttcaaaattttcttctatcatttctaatgtaatctcataatgaataaagaaaatgttttgtatcatttccatcttttaaaatttcttgattcttttcataacgtggtatacttgtatatggtttaaactggaaaatattccaagcacacttgagaagaatgtgtattctgctattgatgagtggtttgttcaatgtggctgctttaaattgttggtcaaatcttctaggtccatttggatcttctacccattcattgaatcctttattcaaagtggtgtataaatgtctccaattcttattgttgcattgtctatttctctcttcaattctgtcagattttgctttctgtcaatttggggtttctattgttatgtgcatatatttttatatttgttatatattcctaaagtgttgactctttcattattgtgacatgcctctctttatttctagcaacactgttttttcattttaatttttttgactgacattaatacagtccctccagttctctgatgattgctgtttgcatgatatcattttccatcattttagtttcaaattacatgaaactttaaatctaaagtgtgtttgctttaaaaagtatgtaggtagattgtttttaaattaaatctggcaatctgtcttttgattggatctttatcaattcacatttaattttatcttgatatggtgtgtgaacattttctgtggcaccattttaattattttaataattgtttaattttatttttgagccatattctcaggggtcactctagggcttgcaatagatatatatcttaagttatcaaaatgacaccagatttccagtaaattccagtaaaatatgaaaactttactcttgcaaatgtcattccccacttttgtgcatatttagatactatatataatgtataatgtctatatatggtaaaaatatttttgtaattatactgtatatatatttagaaagttgatgaaaagtggagagcaagtatatatagtcatagagcttgttattatcttttttatttaccaatttttatcctatttctttctgtaggcttgttatcttacatcatttcattactccaatatagctttgttacacctgcctcctttatgctgttattaccaaatatattacattactatatgttatatggccaacaatataattatgtatacatattgttttattcagttgtttctaaagtaagttaaaagagaaaaggagaagaaaggtgcaattacattgtgttttataattactgactttatgacctttattagcactctgttttttcatgtggatttgaaatactgtttgatgccacttgctttcaactcatggaactttctttcatacaccttctaaggcacatcttttagcaatgatatctctcagctttcatatatctgggaatggtttcatttcaccttcattcatctggaatgtctttatttcacctttatttttgaaagacactttttctggatttaagaatcttggttgatagttttctttcagcattttgatattatctcactgcctctggcctcattatatctgatgagcagtaagttattattctcattggagttccttgcatgtaatgatttgtttttctcttactactttcaaaattctatcttaatattttgttcttaatattttgattataatgtgtctggatggaaatatttttgtatttatcttatttggagtttgttgatatccttaaatgtgtagaatacagtttttcaacaaatttggaaagtaactattttttcaatagtttttctttcccttttgtctcttttcttcacctagttctcccattacatttggctacttaatattttcatatatttctccaagactttgttcactgtacttacaatcaaagaactgcagactatcacaagatagctggcactacagaagacttctagtacaaccaaaccaattatttttattgccttccttattcaaaaagctcaacaaatgttcatcccagcttatgcttgcatatcttcagtgaaggaagtgactaattcttaagtatttcattttgattttatgctggtctaattttaagaaagctttatattaaggaacagtctccccttgttttgattccaagtccccttagcatcataattacccttctctctaaaagcttctgttagttataatcattttcaaaggtgaatcataatcctagaagagctgacatcagagtaaaataataggtttttatctcactgtagatgcatcaattcataaagctgaagttatatcagatattgaagaggtacaaaatacactgttcctccatagttaacgtgaggtcaattaaaagttggatgtcttcacatgaatttgctttaaatcatatatcgtttaatctgtgtttgaatagaattttttaaatggcacacttatatttgctaaaaattttatattcctgggtttagctctttcagtctaaatatttgtaattttattttttattaaatattagctcactcttctggcctcataaaatgtataatcatgttgtttgtacctaattctaatatggtaataaacagaatgatcctgagatagccccttaaaaagctaagttcaggttaacgttgaagcatttataatagttgttaagtaagattattcaactacataaaaactgaggcagggcacaatggctcatgcctgtaatcccagcactttgggaggccgaggtgagtgaatcacccgaggtgaggagtttgagaccaacctgaccaacatagtgaaaccccatctctactaaaaatacaaaattagctgggcgtgctggtgcatgcctgtaatcccagctacttggtaggctgaggctggagaatcacttgaacccgggaggcagaggtaacagtgagccaagatcatgccattgcactccagcctgggcaagaagagagaaactctgtctcgaaaaaaaaaaaaaaaaagtaaaaatgtacccataccttaatattttctattttgtcctaagattattaagaaaatctcttaaattcaaagatctctaaaaatcaagatagcctgtatattacataaataattatttgaacaccaataataatgaaaattagatttatttgacataatgtgtacttagtaatcccctatgggcttccatttcttatctattttctttctaaattctcaaaaaatattatacaatagacacattttttggtataaccacagctacttttcataatacatttcagttctatgggtatatgaggtctaataacaacaataacagcagcagcagcagctaacatttattaacaattattctgtgctagatattttactggaaaattgagtatacacatgtgctagactttatgtcaagtactatccatgcattctctcacttaattttcatagcctacttatgaaatatatgtttttattatagctatttgattataataaaagtccatcaccatggttagtatattactcaagataattaacactagatgccatggcagacaaaacctaaaatcataatggttaacaaaacaaaagttgatttcttgctcattcaaacctaaactggatggggcattcttcgtatgtagtatagctagaccatctgaaacataagctagctctagggatgctaaagcaacgaaataaagagaatggtatgcttagcccagaagtgacacacttactttgagtcagaatttattaaccagtaataaattatgtcaccccaattaaatttaaggaaagctagaaaatgtagagaaacaagtagaatactttgtaagaacaaaattattgccacaagtcaccaaagatcctttgatcccttttcgccaaacattgaacacactcctaaaaaatgacaactgaaatcccatcaagtccagaatctctacgtgtgcagtatctctcaatcaggtctggataagtttttaatccagagacttatgaattaaaagacaaatcatctgccttctgccccacccattcttatacacttaaacatacaaaagtggaagagggaaagactaaccacaagtggaagtacacactctgtgaacttctcctaccttaaggtacaggtggttcctgaattaatccctgattctgctttccgtgtggagttagttctcttgccttctgaatgtgtggagaattacggaattgcctacctcagaggctacaaaagctttttcagtgcactttttagtgctgaagatgaagaaatcaagtgtatatttaagtcttgaatgctcaaaggtattttaggctaaaattctctggtaatccttctctgttaaaattatagatatctgatctattttcttctgtgagttccatatgtggttgatcacagtaaaaattcttttggagtcatatgtagttttcatatctgcttttttttcttaatttcttcccacaattcactctctagcaatttaatggaagttactataaatctggaataatatacgggaagcccatacgcttaatctaaactgtgctgtgagtcataattttcacttaagtttgcgcccttgtctaaaagacttgttaaatttattgttttactatttgttatttagaagcagacagctttccatatgtgcaaggccctaattttggaggtcttctttttcttttattttgtcttgaaaaccagctacttttctgagctctctttttactataaggtaacttgccaaacatagtcaagtacaaccaacacacagaatcaatattccgtcttccagcttcttgccttagagacataaattagtaggcacatagtttgccttccaagttatcacggggaaattctttgctactaaataacttggactgccatcatttcagcccctgatatcaattttttcatctcctataactaatcacaaagataaggccatattttaggttttatgttatgatactaatttctgtatttaatagcataattaatcctaatttccttcacagataaaccctgtaatctcaacagtttagtacagtgaagatttctttatttctcatctaagaatcaatgtgggtcaggaggaccttgcagctatattaatggaacatatggcctctaagatctgcatagcagggaaatagaacaattctcttaatttcttttactctgaaatgatcacttttacttttgctcacagtcaagtggagagactgatcacataatttttacataactgcatgggaagctgggcaatgcaggggagcacatggaatatatggtaccggtgcttataattacaaaataaattcaaacatatctgatttaaatttcaccttcttcctctctgttctcagtagtaaaagtatttaaaatattttaaaagcaatttgaaatattacatagatacaaaaacaaaatacatttttggtttgtttgcatgtttgcttttaatttaacatctggtggcaaagatttctagtcttatatgcatgagtatgccttaattgctcatctggagtaatttagttgatattattttatatcctagactaaaattcagtcattccagcaaacaatttaggagaatggtaaaaaaaaaaagcactgttaaaattgcataaagcacaagtggattgagatcagaaaggtgacaaattggatgaatttggaagaaaaatgttggaggcagaaaatgtaatgtgtttcagtggaaaccataaaatcacctttagagtattcgtttcagatataagtggatttggagcaagacaaagtatataatgaaggtaaaataactaaagactgcataaatctgatcacaggcaggttgatacaatgaccctcaaataattaaacttttgacctttttggctgaataggaagtagcagttttgttctcagaaatatcttttatgtaacagctggcactttctggaaagtatttgaatttacttctttacaactgtatctgaaatatgaatggtccttgaaatggctatagaagattggcccattctgcagctatacttattataaagggttaaaaatcactaacagaacacacacttttaaggtttcaatttcagtcttgtatgccacatcttttcagtataaatcaagaaatttgtatgttaatttctaatactgaaaatgcttcttacagcagccgatgaaataggtattcatgaagtatagcattatttaaaaatgtctgacctacagtgttatatcatttttgtagagaaaaataaaaaaaattggataagcattataaaatgaagctaggagaaataatagctttaatttaagttaaagaagataaaagcacctattattacaaactagctaattaataaaacaagaattttggataatatttatagcaaaatcaatcagcagctaaaatgtcacatacaagtaaattaccatttatttgataatataaatgagacaacataatatctatccttagtcacaagctacaagtaggtgcatggagactttgaacttcataatcttccaaaatttccactgaaaattgtaatatcatccttacaataatatgcaagctccaagacagtaggatttcatatgccctagttgaattttgaatgcctagggctgataaaaatatttatgtagtatcactaatcattaaagaaatgcaaatcaaaaccacaatgaaatgccatctcgcattagtcagaatggttattataaaaagtcaaaaaacgacagatactgacaaggttgtggagaaaagaaaaggtttatacaccgctgatgggaatgtaaattagttcacccactatgggaagcagcttggtgacttctgaaataaaacttcagaattactatttggcctagcaattccattattggacattggacatatacccaaaggaatataaattgttctatcataaagacacatgcacacatgttcattgcagcactattctcaatagcaaagacatgtaatcaacctagatgaccatcaatggtagactgtataaaaaaacgtggtacatacacaagatggaatactatgcagcccccaaaataatgagataatgttctttgcagcaagatggatggagctggaggccattattctaagtgaactaacacaggaacagaaaatgaaataccacaggatctcacttataagtgggagctaaacatcaagtacatatggatacaaagaagggagcaacagacactgggccctactggagagtggagggaggcaagagggagaggattaaaaaaatatgtattgggcactatgcttactacctgagtaaggaaataatctgtacaccaaacccctgtgacatataatttacccatgtaataaacctgcatatgtacccctgaacttaaaatgatatatatatgtatatatataattgtgtgtatatatgtgtgtgtgtgcatgtttagtaataacttatgatttagtaaaaagaaatctaagcataataaaatacctctcaatttcaaaatctgttgaaggggcaggaggaaggagttaaactatctgtccaacaatccactcattttgtttataaaatgagggcatgtaggaagaaaagaagactgtgatgtaatctaatctccatgtcaactggaactccagaaaaaatagagaaattatatttttcaggagaaagacaccttacctattgcatgcctttagcagggtggtccgtggctaaagattatttatatatatcaatatatatatataactgattccttgtctttgctatatatacatatatatatatacacacacacacacatacacacacattatatatataactatacaaattttatagttatatatatatataggttgttaggtaaattgtttgtatgtatatataactatctattgtctatcatctatctatgtagttatatatagttatataatcttttagagacagggtctcgctgtgtcactcaggctaaagtgcaatagcatgatcatagctcactgcaacctgcaaacctcaagtgttcctcctaccttggcctcccaaaactctgagattacaggcatgagccactgtgccctgccaggattgcttctgttaaataaacacagagtctgtaaggtgtgttccctggaaaatgtcaataaactacacaaccctctggaaaataaaatgaaaatattttgtaatgtaaacacttgcctccgttggaagtaaactcataatcctcactagagactttgtttttccaagtcagaagtgcatgttctccaagggaagagaggacctagaaagctacccttgatgtcccagatgtctccttgtttcatttgagtcttttgattgtatccttgatgttattagtacagtttcatactgagataagatctttgatttgtgtcattctaatttgataagccaatcatgttaaactgacttatgaagaagaaaaagaaaggcacatatgttttgtataataataaaatatcatttagactggagcatgttcaagactgaaaggcactgttatacaccaggacaacaggcactaactcagactctctggggccaaactgggacatgtagttatagtacaaatagcatgggtccctttcattagtgtatttatctaataaatattttaaaagttttgccaactttgaaagtctaggtgagaaaatggaataatatggtcccatatgggatttgtaatactcaacaatatattaattattcaggctgatcttatattaacaatataaggattagaaaatacatagaataacatgttattttcatttaaaaattaacaaatcatatattacttttaagggtagtttgattatcaccattatatttagccacacaaatatcagtatttaagaatggtatctaaaagttggaattatggtaataggtgatatgaatagcactcaaattaatctatactctgtcagaaacattaagcatcgcatatatctcaagtaagtcttatataatgtctaatgtttaggaatagctcaaggaatgaagatacaaaagtgtgcaagatatgtaattgataataccagaaccattacttactgaggtgagcttctcttggaaattttagaggtagtataaaatcttgcatattagctaaattatgtgattcttgttcttatcaactaatttaaggaccatagatgggctttggtgatcccatgaacctcctaaaattataaataaaatgcttttgtgctcatatatatatatatattttttaattgagagattaatgtttttatcacgttcttaaatttcttcatatttgggcttgtgaacaaagaagaaaaaataatcagtgctcaggagtaatagtatctaggaaataggtctactgagagatgatccatatggtggggcaatttatgctcacatttatgctctgattatgaagagatctgtagcctagttggaagtaggtacctattagcagactgaaccattttgaaaaaaaatttaatccacagtcattcactcaaattccctttaccttagaaggcaggagtaatatctagaatttattatatccaaaattaactttgtgtatgaagttttgattattcgaatattctgaccataatgttcttttataattcatacatatatattaaattttcaaagtataaatataacaaaatattgataacactaaaaatgcttttggctcttaatttagaatttttgatactcagaaggttgatttctttctttcaatgccttgagattattgagagcataaaaagtgtaaagtttaaaatacctcaaaagtgttaaatattatcaatgtttttactcctttacttccattcactcttaaccttctccaacatggttcctatctctgctccttcgctgaatttgcttttgtcaaggccaccgttgatatctatgttccagattcaataaatactatttagttttcatattccaagacttttggccaggcaaggtggctcacgcttataatcccagcactttgggaggccgaggcaggcgattgcctgagctcaggagttcaagaccagcctgggcaacatggtgaaactccatctctacaaaaaatccaaaagatagctgtgcatggtggcttatgcctgtagtcccagctacttaggaggctgaggtggaggatcgcttgatcctggggggtcgagggtgcactgagccataatcactccactgcactcaaacttaggtgacagagtgagactgtcttaaaacaaacaaacaaacaaacaaacaaacaaacaaaataaaaagaccacacacacaaaggcttttcagctggccttcaacacagttgaacagtccattctttaaaaaaaaaaaaaaacagttttattaaattagtacatgtgtaaaatggagaactgatgaaataaagccactggcaatgaggatctaacagagtttgaccaattcatatgcaaagaagagaaaatcaaatgggataaagacaccatcatgggattaaaaaagaaagatttgaatgtttaagaattaggagaagcccttgagaaaaataagaccttcaaatgattttacaaaagtgattttatgattcttctgtgaaagataaagaaaagtttatctaatcatgacaaattttatcagaataaatgttgtaaaacaaaatcaagatcacatttaaaactaaaattttatcagcaataagacaataggcatttttattcaacaaaaatgattatgaccaaagtctgaaagaaatttaataatttataaaatttaactaatttgtaataattattctgatacttgacagatttcctgaaggaggtacaatgctgacatagccatacagtaacaaagctatcagttcaatgattcttcctaaaaaaatttctcctaattcccaacttctaccccaaatgaggttcttgatatccataaagtaaccttctgaatatgtatatttagaaaatgttgaataagatatgattttttaacattgctgtaatatttttaatgggaatagagaatacatagagaaaagtgcacaaatcacaagtgtataggtggatgaattcttccaaagcatgtaaccaacacacagatcaagaaataatattatcaaaatcctagatgcctgtctgtaatttcttccagtcactactcccctatgaagataattatcattttttagctttttatacacggattacatgtacttttttgtgtctggcttcatttgctccaagatatggatattttatctagaagtctcaacatatatttcatagacttttggatttatacttgcaaatcaacatgcccaatttctaattatattatttactcttcatcaaaatatatttattaaatataattaaaaattcatataactaacctttttgaatgagatgtcttgatgtttttgatttcatgcctagatcttttggttttaattcacataaaatagatgacacatgttttctgtgttcactggaattttttaaatcaacaggataatatatattctgtgaaaataaaataaaagcaatgacaatgataatatctcatgtgttttagagttcttcaagggttttcacatgaattacattatcatgattgattttcatttaaaacatgaaaacaaaaacctgtgaggtaggcagggttaagaaaaaaatttaaaaagctccattgtgtataattttaacaatctgtcattctactaatattgtaccttggccaatgctgtgagagagattgagggaaagagagacctgccaggaaagtgctgtgacaaaaggaacaagggaagagggaaaataaggaataaacaaagagaagcaagatagtgttccccagaaagcctgaaggaagattcagagtaataaagggaggtacaaaattatttcacagagcactaaaaggcagtaacatgggggaggaaaaggagggacaataacaggaagaaaggaagggagaaacgggaccagaattatcacacatgttaaaactacaaatgggccaggcacaggggctcacacctgtaaccctagcactttgggaggccgaggcaggtggatcacctgaggttaggagttcgagcccagcctggccaacatggcgaaaccctgtctctactaaaaatacgaaaattagccaggtgtggtggtgcatgcctgtaatcccagctactcaggaggccaaggcaggaggattacttgaacccagcaggcggacattgcagtgagccaagattgcaccattgcactccagcctgggcaacagagcgagactccgtctcagaaaaaaaaaaaaagaaaagaaaaaggacaaatggatcagctatgtgtgggaagagtagcaagtagcttcatggggaacagaggcattgtcaaatgtaaactgtataatatctgtgaactggttgggatgttttagtgacagtgttatctgttttcctcttcacagttcatccaggactgttacggagctttcatcaggttatcagggacataggctctttcaaaattcctttatcatctcttactgtatctgcatgggtactatcctcaaacttttcacatgagtgaaaatagctactagagctccaaacaccatttcagtcagaagttggaggaaaagggaaatgacaaaaggacacaggccctgtatcttaaggagcttttccagaggttcttcaaataacttctgtttaatatctcattggccccacatccggctatgaaggggagggtaaagaataacgtattttgctaggtgttttgctgcctggaatgaaatttgggcccgttaccatgacagaagaaaagagtagatattggtaggcaaccaatagtccatcagagaaaaagttcagaagcttagatgagggtatgtgtttacatattaaaaaactttctcgggatatgatactttctttggtaagaaacactgatctgacttctgaagactcacaaatatttagtttccatagatctttctgagatctttggttttgtgtatttgtttctggaacatttacatagcgcttatcatttgctattgtgaagttctttatggatattaactcatttaataatcaaaacaaccataaactgagctctttcacatggacatctcatactcaagagaatcaaaacaatatttttttcctccaaatatattagttcttagtcctagtttcagtgaatggcaccacattcatttaagaagaagaaagtcaggtaaactctctgatatgtcacagctgacagaattttgaaatagagaattcatcctcacatttcccccattacttcgacctgttcacttgttcaaacctcctttatttgatgatttagaaaagacacttggatatgtgccttggtcccctgtatttacaattttcttagtttctattatttaaattttatatgtgatattctctaatttacttatcaaaaacaatttgtctccaagcagtgactcatagggtaagggctttttaatgctcattataggtgttaagtatcatctgttcctggaataaacctgtttttatttttcatttaaaaattcttcactcaactcttacacaagacaatttctattcactctttatgtgataaaatcacctcattttgctagaaacacaaataagtacttttaagctcatacattctctttacatttaaaaatttttcaatgttgccaaggataattaaaatttaagaagtcacaataccaaaacatattgtcaaaatatgacacaattttaagtaatgctgcttctattttcatttaggccctggtttttctattagagaagtatgacaaaatacaatgtgtggcactattttgcaattccagtctgtaacaacaactctaaatactttttcaacctcaaattcttctgcaagtcctcttcaagttgcatgatcactctcgtattttcctacttctaagaattttgctctatttggaaacttctctctgtttctgcctcctaacgatgcaattcatcacatgttgaaaatcacctcaaattgcatttgaaccatagaaatgtgtcatttctttcttctatatatctcacttttatcctacccatgataaaataatgagtatgttcagtgatcctgtttccactagtacttacacctttagattcccctgaaaaaaacaagaaccccccccaaaaaaaatctgtcaaatttgagatatccaaactctatcacaaatacagttaatttataaactcatgaaacgtaaagggtcagaaattaagtagacagctagttagctccttttagaaatatattttcttcgtttctcctaattatcctttttcatgtatctggctgtcattgcttgccacattttataaaaatatttccttccatgtttttagaaaagaagaattcatgacaaagggtacatatatgacaggggaacaaatctacagaaagatgaacaaaaagtttaaagctctaaaggaactgaggcttacacaagctgcaaaagtaaagaaatgggcttttctgttatatgtaatgcaagaagggaaagagaatgtgtgcacttactgatagatctttgagctcatagagaaggaaaagttatcagaagactgggaatgatctaataacgatcttactttcaataacagaaagtatatttgattaactaccctactttagacttaacactggtcctcaataattgcagaaaatattttaaggatatttggtagcacttagtaaaggaataataatcaaggaataagttgacaataaactaattatatcaaatacaatttcatttttaacaaggtcaaaattaattcaggttcaaatatccttcgcatggtaaacctgtattcagcagtatgtttgataaaatctttcattacttttagatagagatcagaaacgttgagtgaccatgaaagactgaagattaataaaatgatgccaagctgaagggaggtatctaatgtcatgatacatggttctgttttcagctccattctggtcaacgtttatataaatgagaagtaaaatataaaagaaatgcttgctaccttttccaatgagatagtaaaaaaaacaaaatcaattaataccaaacaaaaatctaagatagtgtcaacagcctggaagtaaattaagcaaatgaagtaaaatagaaataaatattgcagttgggcaacatacgcttaatcactgggatacttggtggtgattttaaaacatgcatgataagacatattatattatatttataaaatacgttttagttaaaagtaaattagttaggaatttgttatgtgatgtgaccctaagctgtattaagcatttcgttgagaaagagagaagcaatagttttaccatattcacttctgaagaactatgtcagatcaggaaaacatatcttcagatgattttggataacctggaacatgaatagtaagcagcttacctactgaattattgtgaacgtaagccctatataaataggctatagataaatccagtatagagaaaagataaagggagattcagagtccctatttcctccactatccatcttcttcattttgaaaaataatgcagaaaaaaataattttttgatcaactcagaaatacttagaatttgttatttaacccttcttctgaaaccttatgcctaagctatcagcaaatcttggcaaggctacttccaaaatatattttaaatatgcttccttctctaaattttcagctacttctctattctacagctataattgtctatttctggtcaatcacaaatgcctcttattggactctgccttcaccatggcttttataatatacattttcatttgtcaaaatgtaaatccaatcatgtttctcttttagctttaagtcctcctactgttcaagatgctaagtcctttctacgaggtatagaacatcatcaaaatatggctcctcaccacacagccaaactcatctcatgctactgttgacttggtttattacagtcctgctatactagatttaatgcagactcttgaacaaaccccaaacaaaataagctattgcatgcctcaggtccttgtgtaagatctttcttctgcctggaacactctccttcccaaaatgtgcatggctagctccttttccttcaggacttaactttaaatattgtctcctcagaaaaaccatccataacaatcttatgagaaatagtcctcctcctattattctctatctcaacatcctacttgttttatttataacatttatcacaattttgtttgctaacgtaggttaagatttgttttgttttgttttttccctagaatctaatccacaagggcaaggacttttcttttcttttttactcaatgctgagaatgttctctgacactcaataaatactcaataattattcattaaatgctgaatgaatatagccaaagagaaatagcagaaggaatgagtggagatttagaaacttcagttcaatatgatgtaaaacaaagctccattctttggagacagtccaacaaccagaaataattttaaaagaaacgtatagcttgtattttctacaggactttgccccaataacacattcaacattctcttcttttcttcctgaattctttcacatctttttgttactccaaagcttctcactcagcaacccttcacaactcttgcatctctttataaactgtttatcacgattctctgaatttagattctctgaattttttggtgtttctatcaacttatcaatttctgaatttgtcacacacacaaaaagcataaacataaacatgtggtaagaataattatatctttagtcagatacatctatctacctgttctgttgattctatatcacacacaaaaaaaaccaaaacagcaattaaagagccatccttaggtaattcagagtgaagaagctaagaaaagataatctataataggtatagaagtgggggagacatagtatattaataaatctcatctaatcataataagaatttctcagagcattattgaaaattggaatagattatctgaggagctatagaactctccacaattgacaaattgaataagtacctggttataaaagtcagatggattatggtactagatatgtattttcccaagagagataatgatttatctttaaaaattaaggagcggtagcagtggtaaccattgcctctatcttctttctagatcaagaataaacactttacactgaactctgctgtctttcaaattcaaggtgcattttcaacccttcctagtttgagtttcccaacttagcctagttagagctctaaaaaattgtaattttgttttcacattctgaatgatacaaatcagagtgctaatccagatcttaccttttccagataatactcaaagagattatactaaaactcaaacaaaaagagtcgcctttatttgtttgaatgaaaatcgttagctctagtgtctggcagcacagcctctcattaacatagtatgcaaagccttcaccttagggggaggttaacgtgtacagcaatccatgtatggcaagtaaatagggttgtcctcaaagtgggtaaactatagagtagcacttggactctgctttcaataataagtactggctaacaagaaaaaccatggagaaaggagcatggttcaaatggtttaaaatgaagttttaccagaaatagttactaaaaagtaactctaaaaagttacttaaaaaagataacccctttaagtgactggcaggtttaactgaggtttgaataattgctactatcctgcatttgatatcaatcttactttatcttaagagagtgaactagaagtgataatacccttgatacgcaggagagaatccaaaaagaatagcctggataaataaacacaggaaacatatagtataaataaaagaaatgtgacatttctcttctacacacaacttagccaagaaatgagggcacctgaatattatattatgctgcaagtgtccagtttaagaacacatgacaaaaaagataatagaaagcttatgttccctcagttcaagaatggtctaatagtctaaggtctatctttactaagattggaggcaccaatgtgtaaattaatgatgcctactcttagctacactacagtgggcacttggtagtagcctttgtagaacccagtgaaaaagagatgttgcaaacttccatgagattttagagcaggttatagtttcaaattgaggaaaaaaacaatgctagtttgtgtattgtagtaattgatactaggtggaataagtaaaagaaaggacatggggaaatttcagaatatatagttttcattttatttgaaaatctctccaaaaatgtatttgattaatttttgtttacgtttcaatacaattctattcacaaccctatttttctagtacgtggattacattatctagtagctaacatattattagtaatgattaaaaataattctatatctttatctaaagatctcattttaaacagagtataactctcccttaaataattaatatcattgtttatagccttcaaagcattcgttgcattctactttatatcatagttatgtccattgctcacccctagtaaaaattactctctctgaggactgaggttgtggtttacttatcttgatatttccgcaccagtttgattgtattcttcaatctgttgtattatcaagtcacaaacaacaaaaaaggataataaatttgattagtttattcaacaactatgtattgaatggcagctatatccatggcataatattaaacataggcacaaagttattattagtaaatatttaaattatgtctttttcaaaatatttcataatttactgattatttccctatgtagatgtgaaaacaagaaaaaaaggcattgaaagtgagaaaaacatagtagaaagcataggctaaattcttaagctcctgattaaaatctgcattttattaaacctcatgttttaggccaattagttacgataatattttcaatttataaatctaatcattttaatgaaagagacatacgtatatgagtaatatgagtttacactgcttaagtaatttgcaattctgaaaagttcatagggtcatgtaaaatttaatgatgggcaataaaatggaattttcaagagggaaattcttttttcttaacaataaaatacatagctcaagactctatatttctaagtatatttgaacaatgtctatatttatgaaagatttagaaaaaagccacaaacggggacttgccaatattttattactgattagtttgctcttactttacctaaacaccttaagtaatccagcaatttagaatttatgtgttttaagtttgagtttgaatctgaggagggatttatattttttcatgagaaaaatgtctcctattaacaaagtagctatatatatataattatatctctaaagtaaggcatattacaatctacttgcatgtactttataaacacatattgataaattatgaaattgactcaataacaattacttgaataatattttctaaaattgaggttttatccccctgcaacttggaacaatatattcattttaggatttcagaatatttcttaagtgttacttcatgtaagtttttattacaatactgaagcctaaaatgactgtctcatatgaagtatagttatgtttcttctccgccaaatgccacatgtatctctaaaacttcagggactctttttatcaaatgatggattatataacaaggcagaaaatacacacacacaaacacacgtgcttatgtatgtacatatatatctcctgaggctcagtctcagtaaactgctatcactcacccaaggtaggcagcctgaaaattctacagcctcagtacaaatcttagtctgtttcactccacattgtattcagcatagcttgcttaataactttatgcctactgctctggtcagaaatatttcagccactgcccaaatgttaattatttacaagactccaatattccggggactggataaggtgactcaaaactgccctagttggcaaaccatttctaccaacaagcttattttaagttcttaagcaattaaggcaagtgttgtcagaatcttgtatattttatttttaaaggccttaatataaagaaatgcctgcaagtgactgtaagtctctctgggctttgtaggtgaattttgtcagcaaaacccaggcttatatggagtatctaaaaaactatcttaactagaccagagagcatcagtgtgattcaatagttaatattttccttccaagtcatgctgcctaaataagttttgagaaaattcagtgctgttgatgtataggtaagtcataaaacacaaatctttgtcatttaaagcttataccaatattgaaacacattgaaatagccaatctctcttacattgaacaaataaaaattcattctaagtaagtggtaaagaatggtgcttttattgatcttattatctttttcattaaaaaaggatgaacagcttaaaagtttttgcattagcagtctctgcaaagcaatttttatgatggtatgtttcattcaatttaagaattgtaatgttagctttcttatatgaggaaggaaataatatcatgaacattttaatgcaagttttaaagtgttaataaatgctagcttgagtgaattactaagtgtatttctcttttcaactttacacttatcttgtgtgtacagctgatatccctagtgtccaatcagagacaagttttcatcctgttgtccaatgaatgatgtgcataattccttttggcactgatgagagatgaatacacacatccagcccacttcagtgaaaattgacccataatttttttttatcctgaagaaaaatacagtaataaagtttaaagatggaaaaaatcagttaaactcttgaggtgtaccattagttaacaataatcagcaaacattacattttgcctggaggacagtgagctcaagatttgcttttaggtgctcatgaattctaataatcttggctctccaaatgatagcaagaaacctaaacatgtgaattttcacatttcaatgagctcaaaagttaaaattcaaaaggacagacatactttttaattattttcttctatctctactgtccccaaatatttttcttgtgaaacgagtgtatgcatttctgataaatatttagcagttgagaatatatatttatttcccacagaaagacaaaaagtgcagatcttatgtaaaactccaatgctgtctctctagtagtattatcaagataataccagaattctaagaattaaggggaaaatgacttggcatactgaggcagactaattgtcatatataccaagtattttacctttaatagtagtaaaaaggaatatgccgtaaaaagttgtttatccaccaaaacattttaattttctttaataacccttaagaatctactattcattaatttatctatgtgatttatttttggtctgttaatatcatcagcctatagaatttccagaataatgaatttcattataatgaccacggtactggtaacccccttactttatctatctttgaagggtattccaagttctactataacaggactgtcaagaaaatcagttttatttctatagctcataactttatgttttattctttgacttgcatcttataatgttaatgtattttctttcaatgattcccttcaatcttcccacccacatacaaatatcacaatgataagcagattctgtcagctattattttatattagggcagtagaataatgttttcacaaaatatatgaaaatgattatgtgatttataagttgtaactcaaaacaatataaatagaatttggattctgctttttaaatgcaacagatactattttaaataaataaatattttttgagtgcatcctatgtgcgtatcactatgctaagtacatggtggcaaaaaaaaaaaaaaaaataaaacacaacctgccataaaatggctaatatttttagtgtaaaaatgttcatatagaatagtcaccttaaaaggaggtcgaatataaataaatttaaataaagacataaacaaacctgaataacatcagagagagactaatttcccctaatactaaaagtgatctttactaaaagagaatgaatcttcattctggatgacatcagagactatgttattttatttaccattgcaagttgaagtgaagagggaaaagataaagaggtacaatcttggaataaattattccaaaataaattgaagtagttaccaggaaggaggttttagcctgggagcccagaatttaatttaaggcaaatgaacaaaggcttttagtgcctactttaagatagcataattgtagaaagaaggcagtgtgctggaatggaggtgaagcagagaaggacatatagtgatgctttttatgtcagacctatctgtgaaaaagactttgctctcaataattgactgattgatacataggcactaagatcaaacacagttaattctaacacacaattctaataatggaatctctcacaatatgcagccatggtttgcttctgagaaaaaagctgctggtagaaataatgctccatctctgtaatcaccctctccatccttcggagctactaaatcaacaaacagagaccccactctctttccagttctagtacctgtgacaggagctatttaagtgtcttcaggccaaaatttagaactcttgataaatttatctttgtgaacagcctaacatataatgctggtagttaggtttttacctcattttgagacttcatcacccctttctgcctttgcaatgtttcccagtttcttcaaacttgacatctgccttgagccatttcctaagcctctattctacctatccagtctttagtccgagttttcttcttaagacaatacttcagcatggtgtctgggatttgatacctgatgacagattccattaaccgacttttaatcttaacctggtccaatttcaatgttgctaaatgcttcatgacagttgctcaactctttcttgccatgtggacaatgaatagagcttacagtactcactggataccagactgattctctttttctaattcctagtgctataaccattctgtctcctgtactgtcatactagcccagtccaaattcttccttagtttaacctattgtgttttaattaatataccatcacctgtgaatctcaagataaagtgtatgtttaagttttaatatgagtaataggctaaaagctctaaaagttatcaaaagattgagctcattggaaagcatcttaaagaaactgggaacatgagttaggcagatgtaaaagagtaaataatacttaatttacattaggaaaacatgaggcaaacaggtaataatggacaaaagactaaagagaatggtgaacagacaacaaaaaacaattaaacagtaagccaaaacacccataaactcctgtaatctataatcctattatgctcttttatctaggctctaggaagttttctacactatcttgtcatctgtaacatttcaccacctacaaaactttaggctgacaggtgtaagaacttactctttactctttccttcatatcttaattacaattaaatagcaatcctaacatttggttgcttatatggaagattaaataataaatgtaacttgtttactcaaagtattttgataaatattatgcatataactccacaactccacatatggtattaaaatatatagagagaacttttattgccaaataatcattttgagtgctcaggtgaaattaaaatgttcattaacagccctatccacttgtttccacattttgtctcatacatctctatgtttaagataatttcctttccattaacacatttgccaagctaattctcacttccacagttttgatcatatagttttcttagttagcattttccttcctctgttcttctgaatagtattatttaaaattttatcttttttttttttttttttttttttttactttttggctttcatttttttcaatgatccaccacagagttggtgtttaattatataaacgtattggtctctatttcatctgtattcctctattacctcatctaaaatgctatttcataaaaaaaaatctaccctctttaattatcccattgcatgttgaggtgaaaaaggcacataagagcatagaatgtgaaatttttagctaatctttagtacttatgtaaaaacaatctgtgttgatatctgtattgatacttatatctataaatttgtgtgagtacctatctacggacctttaagtatatgagcaaaactgattttttaattataaagaccatcatatttgcattatactgtgtggccgaacagtgggataaatcagtatttctataggtaaaaaagtcatcaggctgggggccgtggctcacagctgtaatctcagcaccttgggaggctgaggcaggtggatcatgaggtcaggagttcaagaccagcctggccaatacggtgaaaccctgtctctactaaaaatacaaacattagctgggtgtgatggcgcctgtagtcccagctacttgggaggctgaggcagaagaattgcttgaacccaggaggcagaagttacagtgagtggagattgcgccactgcactccagcctcggcaacagagtgagactccatcaaacaaacaaacaaaaaaacaaaacaaaaaaaaacaattgtctctcagatatttgaatattctttccatatgtcaactctcagaaactaactctccacatagatttctatccattatgagtctaaaaattacaaacatttcgtaagttttttcagagaaaataacacaacattcatacacatgggaggaattatttgcatgttaatttctgaaatttattataatgacataaaatgcttacattttaggataatagatttaaatattaagcataaaacaataacaaactataccattgaagattcttaagattttttgtccttcagtagtagcataccttttaaataatataaattattcaatgccaaaattatatatacagacatacgtatcaataaaatagaacttagagtccaggaataaatccttcaatatagtcaattgaattctgacaacagtaccaagataattcaatagagataagaaatttttctcaacaaatggtagtgggacaagtggatatctatatgtaaaataataaagtcaaacctttacctcacaccacatgaaaattagctcatgatagattataggtctaaatataagagctaatactataaacgcttagaagaaaacatagaaaaaaaatctttgaggcctcaagtgaaagaatggtttcttagatatgacacaaaaaataaaggcaacaagaaaaaaatataaatgtaagtttaccaaaataaaaagcatctgggatttaaagaataccattgagaaagtgaaaagacaacccacataatgagaaaataactcacaaattatatatgtgataaaagatttgtatcaagaatatgtaaagaattctcacaactcaataataaaaagataatctattataaaatgatcaaaggatttaaatagacagttctccatagaagatatataaagggacaataaatacacaaaaagatgctggcatcatcaactgctaggggaatgcaaattaaaaccaccatgagattactttgtatcctgtagaacagttataatcataaagacataaaataacaagtattggttgggttttggagaaattgtaactctcatgcatttatcatgtgaatgcaaaatggtacaactgctatggaaaactgttcggcagtttctcaaaaagtcaagtgtagaattaccatatcatccagtaatttcacttttaggtatacccaagaaaactaaaaacatatattcattcagcaatttgtacatggatgtttagagcagcatagttaaaaatatccataaattagaaggaactcaacgaatgaatggaaaaacaaaatgtggcatatccatacaatggaatattattgagccataaaaaataaatgaattgttgataaatgttacaacatgtttgacatgagatttgggcagtgaaaaaaagtgtttcaacatggatgactcttgaaaacattatactaagtggaagtagccagacataaaataacatatatgcatgattccgcttatattaaatgccaagaatagacaaattaatggagagagaaaatagattaatgttcccaggggctgtagagagaatttctaatgggtatggggtttcttctggggaataatgaaaattttatttaattagtgatgatcgtttcacaaatttgtgaatatactaaaaacaactggactggacacttaaaatgttttattttaatggtatgtgaattacatctcagtaaagatgtttttaaaaatggtgaagttggcaatgtagcttcagtagtgtttctcaaaattataacaaaatgtaaacaatgtgagataccaaagataattaacataatagcaagagacctgagaaaattattataatttttcaggcaatttaggattcacattttcaaaaactgtaacactttttactatttctagtggtaactcaagaatgtaaaaagaagccaagtaaatatgaattttactatgtttttactgtttgataaaactgaagctcaaaataactaaaatgcagaaaacaacatatttatcattaattactagctataacacttccagaactttcatttaaacttggtaataggatcttatgcattttctgtctttggggatccaaatataaattatttgatggcatctacagaattataataaatcaggattcaagatagactagtcagaatggaataaaaaatctacaaaatagttttttttttaaaactgaagtgctaggaagatgagaaaactatgagagaactttaaaacttaaaaataaattataaaatcaacacaaagtacatcagatttagtatttaaaatacagctaaaaagagataatgattatcaggtcaaaagaagactgtaccagaaatacttagtaatgaaaataaaatttggagagtagagacatccataaccaggactggtaaaatataaatttggactaattctcaagtttcaaaaagccttatgaaagatttgtttaggccaggcatggtggctcacatctgtaatcccagcactttgaaaggccaatgtaggaggactgcttgagcccaggatttcaagaccagcctgggcaacaaccttgtctctaaaaaaaaagtataataataaaatttaacttagctgggtgtgggagtgtgtgcctgtattaccaactactagagaggttgaagtggaaggactgcttgagtccaggaggtcaagattggagtgagccatgaatgtgttacttcactccagcctgggcaacaaacagagtgagacactatctcaaaaagaataagtaaatacataaatcaaaataaaaaaattaaaagtcttttgaaaattaggaaagagctaccaagaaagctaggacttatcaggtcaaaatttaagagaaggcaagatcccccaaaggtaagtcctcaaagatgcttttgttctgataaaatttgcagatcaggaataactttggtggctcaaggagatcaggaatcaaaaatcaaatcccatgttcaccaaagtagaaggtcctgtccatagtgagctggaaactcacacagctacagcatgatacaagtaaacatggaataaaacaggctgtaaattaaaatgatacctgaataatccataaaatctcgagatttaaattgtgtcatggtcaaatattggtggtgattcagtttctagtggtagaaaatggaaacactatctggaggaaagtaccttcattctaaggcctaaaattttcacaattgatatttcaaatacaatgagcagtacacaagacctgaggtatcaaatgaacatgaacaaagactatagagttactctgcttattatttttcaataaagaatgaacaattttgatatatctgcaggaaagaacaaaaaattaaaatttattgattaaacgtagctaacaagaaaattagtgaactggaagagtaattgaaaaaaatttcagaaagcatcaaagagaaaccaaaaacaagtgaaattcaaagaagagaaaaagaaccatagagaatacaagcttattagtaaaaagtaacaaacatcctatagcaagatttttgacatcagtgcaacctagctttgctttaactgtctcaggcaaataaatgtcttaataattcaagtggaaagtatctattttattttataatattttattataacattctacctccattaaatactttctttacttcttgattattttctattgctttgccaattgctttccatacctactctgcagcaaagacttatatttgttctttaatattcgtttacctttgttttcataatagaatctctgatttttgtctgggcacatttctgcttaaaataatgcctacatatttcagccttccttgcagctgaatgtaatgataaaaccaaaatctagccaaagatatattgtgtggcatcatttagaaaccttacttaaaacacatctgcaagttccctcacacttttattttctatctcttcctctttcttgatggctggagtgtgcatgtgatgggtggagtaagtgcagtcattttgggtcatgaggtactatttgactggaggtcatgttcagaaaagcatgagataaaaacagtcagtcactaagtactgagtgaaatagttccataatatcagtcctagactgtatacctctggagttttacctgagaggtgaacaaacatattagtatcattttagatctttattacacatagctgaatctaatttaaactgatagcaatatggtagctggaagtgggatggtacagatgaaagaaatgtaaaacatttgacaccaccttagtacaggagattgggtgaccagtgataaggactcaagatattataggctgaagagctggtgacccttgttattatggcttcaaaacattttcactttggaaggcaggctacatgctgactgagtgtgttgtgttacagaaattttcaaacaaataccgtaattgagtgtgtcttagatgttacttgtagcttttatttaagtcttttgagagaaaaaaaaatctgggttatatctagccaggctgaaataagagatggaaatagaataaaatttttgataaggcaggtactctttgaagtctgcaagttaagcttactgagattctagtgattcagggccttgtgtaggtgaaaaaaccaacatctcgttcctcaaattgaagcggttacaataggggacttcaaagtagaaataagacttatatacaaaggtgtaaatgtctgcaggaaagatgagattaagaattttgtcttccctccaacacccattgtttcagaaagttcacctatggtcactatcgttaatttggaagagaggaaaatgagtagagaacaaaaaccagtaagtgaaagatcagaagcttcaggattataaacaatgtctaaacaagatctttctacttgcttaaggatagaaactactgacatcaaataaatcagaagcatactaagtttttgaatgaaatgtattaccaaaaaaaaaaagtctgtcctaaaaatacctgtggttcttcaatctctatagcaacccacaggcccctaaatctattaagactatgaaactccaacactcaggaggaacaaattccctaatacctaattctgatgttgccataaatatgaataaacaggtaagatgttttcacagggaaaatataggagatttttccagatgtgtttactctatttcaaaagaagagagtgtttactattcctatcagactgatttggtaactgctatgggggcagaaacaactgtgtttcccttttccaaattagagttttattataggtatgctgtttctatgccactttatatgctaggtatgtataaggtgaatattttataatttagctataggttgctagactatgagttatatcttgtctaagtgaagcagactggacatctaccaatataacgattggaattaagtttagctgcaagtagtgacttattcaatataggagtacttccatctcacatgaatatctgaatgtaagaagaccagggctggtatgaaaactgcaattttctgttatccaggatacttccaagtttccactcattcatggtctaaaatgaagttccaagccacagaatgaaggaaggcagaaagaagagacaaaatccattgccaactgtcttttggggacatttctcagaatctgccaaatacttcccttcatgacatggtttgatgagctgaataaagggctgccaaatcatctatgtcctaatcccctgaaccctgtgaatgtcaccttatatattagttgggtagggcttccatagactgactggcttaaaacatagtcttttttttctcacaggtctgaaagttggaagtccaaggtaaaggttccagctgattcagcttctgatgagggctgttactggcttgccgatgacaaccttctcactatgtcctgatatagtctttcctcagtatgtgcacatggggttgggggagggggagattcttaatcctatcaggtcaggaccccatccttatgacctcatttaaccttaattacttctttagagtccccatctccaaatatagccacacaagtttagaatttcaacgtatgaattttgaagggacacattcagctcataacactttataggcaaaaagatatttgcagatgtgattaaggatgttgagatgagttgattattgtggtgtgcctgataaaataataggggtctttgtaagagggaggcaggacattagagaggatgtatgtaagagatgagatgacagaagcaagaggttagggtgatgtgaggtaggggtcacaagccacagaatataggcagcttccagaaactagactaggcaagaaaacagattctgccctttgaaaaacatcagccatgtaaacactttgatttagtcaagtaaagccaattttagtcttctggaactataaaggaatgaatttatcccattttaagccaccaaatttgtagtaatagaaaactaatatacatgccaatacttaattgctagagaagctgagaaatgcaaattaatccagacagctaaaatttggggatgctattagagaggaagagagatatgatagatattagagggcaaacatcacttactgccacaaccagaaatgatggaattttttctgactattatagtgacataagcttttaggtttgctccctttggtagaggctttgtgttctgtttttggaaaaggtacaggcaaatgtttgaaattgtccttcaatagtcattccaatcttattctataataaaggaaactcatgttttagctgggcatttggatgatcttaatgagactttatttcttagcctcttgtagctatgagcccaatttgtggggcctaccagatataagcagagtgttgcatggcagcttctaggaactttccaaaagtaaacacaatagctgtgacctcttcttctttatttcctcttctttctggcaggttagaatgaaagcataatgactggatctggtgaaactattgtggaccacaagaggacctgcaaaatagaggccatgtatgctggagcaacaggatggaaggagtgaagaactctgagaacattatgatgcagagttgttataccagcaatgcactgtctatctcttgatttttatgtgagagaacagttgttttgtttacatcgctattagggatgattactcccaattctaactattgcattctcttccttctttattatttctctcatagaactgttcatgtaaatttttactcgtgtctctacatacatatccataacatgtataacaaaattttgtctttgaaaatgtaacattagtgaagttatttaaaggcatatgtgttgtgaactattataactaagatattgggaaggaaatttgttaaatatattattcctaaatctcataagcaacttacattaagcacaggaattctagctaatgagtaagaatgcttttttatgtagacagtatattcaatattggatacttttgtactctaaaatcatagccatatataactaaaccatggtcacatgggaacatagtaaataaaaaatgtaaaaatacatttaggtcattactgctaacttataagtttatccaaaacattcctaatctaagtgttactttacaatcatatagttatatttaaaaagaaatgataaaaattatatctgatggagatgtttagcagagggtctcaaactttttggtcagaggactcctttatttgcttcaaaattatgaggcccctaaaatcttttatttatgtgtattatattctttcaatatttaccatactagaaattcaaagtgtaaaaagtttaaagtatgcattaatttatttaaaataacaataagaaacccattttattttcatgaaattacacactattataaaacagaactatatttcaaaaaaaataactgttaagagtggaactggtctatatttttaagaatagatttagtgtctggcttaataacccagagattttcatatctgtttatatattaaatctcttattgtatcatgtcatgcagcctctggaaaaactccatgatacagtaatgggagaatgagaatcaaaaaggaaaatactgttttagtattattataaaagctatattggtatggtggatcctttaaaaagatttcaggaacctaaggtggtccctgaactacactttgagaaccactattatacagaataactacaaagataaatcttacaaaactggaccaattataggaaagccagtcaaaaggcaattataggaaagccagtcaaaaggcatgaaaattctcaaggttataacttcctcctttggcttggagaagtataatcgtctgaagccttctcgcaactcgttaaagtcattctcggtccagctttgttccattgctggtgaggagctgcattcctttggagggggagaagcgctctgatttttggaattttcagcttttctgctctgttttttccccatctttgtggttttatctacctttggtctttgatgatggtgacatacagatggggttttggtgtggaggtcctttcagtttgttagctttccttctaacaatcaggaccctcagctgcaggtctgttggagtttgctggaggtccactccagaccctatttgcctgggtatcagcataggaggctgcagaacagcaaatattgctgaacagcaaatgttgctgcctgatcgttcctctggaagcttcgtctcagaggggtacccggctgtgtggagtgtcagtctccccctactgggggatgcctcccagttaggctactcgggggtcagggatccacttgaggaggcagtctgtctgttctcagatctcaaactccatgctgggagaaccactactctcttcaaagctgtcagacagggacatttaagtctgccgaggtttctgctgccttttgggggaagtttgaacacatcacaaagaagctaaaatccttgaaaaaagattagatgaatggcttactagaataaccagtgtagagaagtccttaaatgacctgatggagctgaaaaccatggcatgagaactacatgacaaatgcaaaagcttcagtagccgattcaatcaactggaagaaagggtatcagtgattgaagatcaaatgaatgaaatgaagcgagaagagaagttagagaaaaaagcgttaaatgaacaaagcctccaagaaatatgggactatgtgaaaagaccaaatctacgtctcattggtgtacctaaaagtgacaaggagaatggaaccaagttggaaaacactctgcaggatattatccaggagaacttccccagcctagaaaggcaggccaacattcaaattcaggaaatacagagaatgccacaaagatactcctcgagaagagcaactccaagacacataattgtcagattcaacaaagttgaaatgaaggaaaaaatgttgagggcagccagagagaaaggttgggttacccacaaagggaagcccatcagacaaacagtggatctctcagaagaaactctacaagccagaagagagtaggggccaatattcaacattcttaaagaaaagaattttcaacccagaatttcatatccagccaaactaagcttcataagtgaaggagaaataaaatcctttacagacaagcaaaagttgagagattttgtcaccaccaggcctgccctaaaagagctcccgaaggaagcactaaacatggaaaggaacaaccagtaccagccactgcaaaaatttgccgaattgtaaagaccatcgatgctaggaagaaactgcatcaactaatgagcaaaataaccagctaacatcataatgacaggatcaaattcacacataacaatattaaccttaaatgtaaatgggctaaatgccccaattaaaagacacagactggcaaattggataaagagtcaagacccatcagtgtgctgtattcaggagactcatctcacatgcagagacacacataggctcaaaataaagggatggaggaagatttaccaagcaaatagaaaacaaaaaaaggcaggggttgcaatcctaatctctgataaaacagactttaaaccaaaagatcaaaagagacaaagaaggccattacaaaattgttaagggatcaattcaacaagaagagctaactatcctaaatatatatgcacccaatacaggagcacccagattcataaagcaagtctttagagacctacagagagacttagactccgacacaaaaataatgtgagactttaactccccactgtcaacattaggcagatcaacgagacagaaagttaaaaaggatatccaggaattgaactcagctctgcaccaagcagacctaatagacatctacagaactctccaccccagatcaacagaatatacattcttctcagtaccacatctcacttattccaaaattgaccatatagttgcaagtaaagcactcctcagcaaatgtaaaagaacagaaattataacaaactgtctctcagaccacagtgcaatcaaactggaactcagcattcagaaactcactcaaaaccactcaactacatggaaattgaacaacctgctcctgaatgactactgggtacataacgaaatgaaggcagaaataaagatgttctttgaaaccaatgagaaaaaagacacaacataccagaatctctgggacacatttaaagcagtgtttagagggaaatttatagcaccaaatgcccacaagacaaagtaggaaagatctaaaattgacacccgaacatcacaatgaaaagaactagagaagcaagagcaaacacattcaaaagctagcagaaggcaagaaataactaagatcagagcagaattgaaggagatagagacacaaaaaaaaccttcaaaaaatcaatgaattcaggagctggttttttgaaaagatcaataaaattgatagaccactagcaagactaataaagaagaaaagagacaagaatcaaatagacacaataaaaaatgataaaggggatatcaccactaatcccacagaaatacaaactaccatcagagaatactataaacacctctacgcaaataaactagaaaatctagaagaaatggataaattcctcgacccatacaccctcccaagactaaaccaggaagaagctgaatccctgaatagaccaataacaggctctgaaattgaggcaataattaatagcctaccaaccaaaaaatgtcaaggactagatggattcacagccgaattctaccagaggtacaagaaggagctggtaccattccttctgaaactattccaatcaatagaagaagagggaatcctccctaactcattttataaggccagcatcatcctgataccaaagcctagcagagacacaacaaaaaaagagaattttagaccaatatccctgatgaacatcgatgcaaaattcctcaataaaatactagcaaaccgaatccagcaacacatcaaaaagcttatccaccatgaacaagtgtgcttcatccctgggatgcaaggctggaacaacatatgcaaatcaataaatgtaatccatcatataaacagaaccaaagacaaaaaccacatgattatctcaatagatgcagaaaaggcctttgacagaattcaacagcctttcatgtgaaaaactctcaataaattaggtattaatgggatgtatctcaaaataataagggctatctatgacaaacccacagccaatatcatactgaatgggcaaaaattggaagcattccctttgaaaactggcacaagacagggatgccctctctcaccactcctattcaacatagtgttggaagttctggccagggcaatcaggcaggagaaagaaataaagggtattcaattaggaaaagaggaagtcaaattgtccctgtctgcagatgacatgactgtatatctagaaaaccccatcgtctcagccccaaatctccttaagctgataagcaacttcagcaaagtctcaggatacaaaatcaatgtgcaaaaatcacaagcattcctatgcaccaataacagacaaacagaaagccaaatcatgagtgaactcccattcacaattgcttcaaagagagtaaaatacctaagaatccaacttacaagggatgtaaaggacctcttcaaggagaactacaaaccactgctcaacaaaataaaagaggacacaaacaaatggaagaacgttccatgctcatggataggaagaatcaatatcatgaaaatggccatattgcccaaggtaatttatagattcaatgccatccccataaagctactaatgactttcttcacagaattggaaaaaactactttcaagttcatatggaaccaaaaaatagcctgcattgccaagacaatcctaagccaaaagaacaaagccggaggcatcatgctacctgacttcaaactatactacaaggctacagtaaccaaaaacagcatggtactggtaccaaaacagagttataagccaatggaacagaacagagccctcagaaataataccacacaactacaaccatctgatctttgacaaacctgacaaaaacaagaaatggggaaaggattccctatttaatacatgatgctgggaaaactggctagccatatgtagaaagctgaaactggatgccttccttacaccttatacaaaaattaattcaagatggattaaagacttaaatgttagacctaaaaccataaaaaccctagaagaaaacctaggcaataccattcaggacataggcatgggcaaggacttcatgtctaaaacaccaaaaccaatggcaacaaaagacaaaattgacaaatgggatctaattgaactaaagagctctgcacagcaaaagaaactaccatcagagtgaacaggcaatctacagaacaggagaacatttttgcaatctactcatctgacaaagggctaataaccagaatctacaaagcactcaaacaaacttacaagaaaaaaacaaacaaccccatcaaaaagtgggcaatggatatgaacaaacacttctcgaaagaagacatttatgcagccaatagacacatgaaaaaatgctcatcatcactggccatcagagaaatgcaaataaaaaccacaatgagatatcatctcacaccagttagaatggccatcattaaaaagtcaggaaacaacaggtgccagagaggatgtggagaaataggaacactttttatatgttgatgggacggtaaaccagttcaagcattgtggaagacagtgtagtgattcctcagggatcttgaactagaaataccatttgatccagccatcccattactgggtatatacccaaaggattataaatcatgctgctataaagacacatgcacatgtatgtttattgtggcactattcacaatagcaaagacttggaaccaacccaaatgtccaacaatgatagactagattaagaaaatgtggcacatatacaccatggaatactatgcagccataaaaaaggatgagttcatgtcctttggagggacatggatgaagctggaaaccatcattctcatcaaactatcacaaggacaaaaaaccaaacaccgcatgttctcactcatagatgggaattgaacaatgagaacacttggacacaggaaggggaacatcacacactggggcctgtcatatggtggggggagcggggagggatagcattagaagatatacctaatgtaaatgatgagttaatgggtgcagcacaccaacatggcacatgtatacatatgtaacaaacctgcacgttgtgcacatgtaccctagaacttaaagtataattaaaaaaaaaaaaagaaaattctcaagtttgtaagagtgcatttggagactatcaagaggacaaagtagatgagaaaaaacattcttcatagtttatcgcagatcaagagggaaaataatatttagaaaagaataaaaatgaaactgctactctccaaattattcgatactgatacagtattatcttcactgagtggtaaataaaggtataatgttgaatgttttcattaagaactaatttaaaaattgcctaagaacttgaataaacatttcttcaaagaagacacagaaatgcctcaaaagtatataaaaatgcccaatgaaactaatcatcagaaaaatgcaaatcaaaactgcaataagatattacctcatatctgttaagatggctattataaaaaatagtaaaagacaagtgttggtaagaatatgaaaaagttgaaactcctttgcgctgtttttgaaaatgcaaaatgacgtagcagctacgaaaagcaggatggaggttcttcaaagaattaaaattagaactatgatatgattcagccatcccacttctagatatttatccaaaagaattgatatcaagatctcaaagacatgaacacttcctagttcctttctcttactctttccctttcctaggatgcattgtgtcatttgataaaccctctgttcaactctctcatttccccagtgatctctctattgactttggcaattcacacagctttttacctcagattatgtattaatctagcacccacttgctgcttttcaaaaccaattctgcaattacttggcttgaaacctttcttatccacatatatggagctaggtataataaatggtgtcaaagatgggtttctccagaaagggctatagcctcccttctaagccatcaatattgcttccttggaccttaaaggctgaactacaattatctttagcctctggtagctctagtatcttctctatagattcttctgacaaatatcttatacttctacctaagtagacactaaaaaccactacttctcagaattcctaatactcagaacaactccagcttcttatatgagacccattagttgcaggtggctgactgactaaattgtacttcattgtttatatttccctcatttccattctttataaaatcaacctctgcccagtgagatttttctagctcttccccatcccctacaagttccagcatagaacttgattgattgcaagtttgtaggccttatgctttactacagtgcctggaatattgtaaatattcagtaaatatctatttaaaataaattgcattactggtggaaccctaaaatgagagttatacaataacaaaggacaatttttagagtagatgtaagaatgtcatcacaaagctcatttcttagcattagttaagctagaacaaatcccagaaactgaataataataatattttactttccagcataaggaaacacactatttcacaaaacaatgacataaattgacccccaaaataaataaaaatacttaaacatattttttagcattccatattataaaagaaggtgaccagttccacatttgctaaatctcatagagaatcaactccttcactattttcttagtatcattttctgttgaacaagataaaaaagaagatgagtagtagcttcaatattttggcttgtaatattatggaactaattattctccctctgtccttcccccccccgccatatttacctgaatttaaagtagacataaaatactaaaagcaatcaaataagactagttcttgatgtatgaaattacagcaacctcaccgtgacttgccagctctgttctgcaacactctagtcaaagccagctacatagactgtgatgtaaatgcactcctgtgctacgcaatgcaatagtcctgagtaaggtgaatccttctctttcctctcttatataggacaggtgacaaattatctcatctttctaatagtaaaaggaaaattacatctcaccaaagaatatacatagatggtaagtaagcatacgaaatgttcaacatcatacgtaattaagggaattataaattaaagcaacaatgaggtaccactaccaacctattagaatgaccaaaatccaaaacactgacaataccaaaagctgatgaggtcttgtgtagcaacaggaactcttattcattgctgatgggaatgcaaaatgctacagctgtttgtatgacattctcgtcatacaatccagcaattgtattccttggtatttacccaaatgaataaaaaacatgcccacacaaaaacttgcatacaatatttgtaggagctttattcataattgccaagacttggaagcaaacaagacgtccttcaacaggtgaacgcatgatctttcatacaatggaatattattcagtgctaaaaataaaatgtgtgctcaaagccacatgaaaaaggcataaaggagacttaaacacatatcaccaagtgaaaagaagccaatctgaaaaggttacatactatatgatttcaactatacgacatttcagaaaaggcaaaactgtggagacagtgaaaagatcagtggttgccaggggtaaggtaagaaggattggcagagtacaaagaatttttaggagagtgaaacaattctgtatactacaatagtttatacatacaattatacatttgacaaaacccataaagtgtacaacaccaacaatgaaccgcaatggaaactacggactttaggtgataatgatgtgtcagtatgggtccatctatttaataaatttaccactgtggtgtaggatgccaattgtggggtatagggaaactctctgtacttcccactcaactttgttatgaaactaatactgctctaacaaataaagtttatgaattaaaaagaagagaactgatgatgtggcataaaatataaaacagaggtacctgaaggcaatatttctatatttatgttatcaaaaaagtaagtaaattttttgttcacaataaaaacgtttttattttgtaaataaaacatatttgaatttttaaaaagatgtataaacctttagaaagcaataattatctaaaattgtattaactatgaacactattaatatcttgctgactataccttaatgtattttttcacatctatgtggtgtgtgtgtgtgtgtgtattttttttttttttgagacagtcttgctcttttgcccaggctggagtgcagtggtgtgatctttgctcactgcaacctccgcctctgggattcaagtgattctcattcctcagcctcccaagtagctgggatttcaggagtatacaatcatgctcagctaatttttgtatttttagtagagatgggggtctcacaatgtttgccaggctggtcttgaactcctggcctcaattaatctatccaccttggcctccctaagtgctgagattacagacgtgagccaccatggctggcctatgtggtataattaaaaagttatcttgttgctatttttgagtccttattaaaattataatagatttaaatacaaacagctcatcagatttaaaaatatatatttaacctttagaataatacatctaataataattaatggaaagggttcacagggagaattgtatatgagaacatttaattttatttgatcttacaaaatggcactcaacatagcatgtatatagttccatgagtcttatttataggaaaaattaatctttggaagcaaagcaaaagtaaataaaaatattctagaattcaagcaaatcagcagttataaaacaaatcttactttagtagagctgaatgccaggttattttatgtcaggtgttttctggaggtatacaaagccatagagtacaagatgtgaacattcagtatgttagaagtggttccgagtaagagatgcctttcagagaggttgtatatggttaccctatagatagctttcctcctttgctgataaccagggagaatcaggcaccctctccagaagattaagacagagggtgtgaaattccaattttcatgcctcaaggagaaagggtattgctcaagttctaagaaaaagattagatcattatcctaggaagtggactgtcaaaaaagatagaaattcacaacatatagactgattcttttctttccacatggttgaagcagtaaaagtttctggccatcactttcttacttcacagatgctttctctccttccttacaacataggaactaaatcagcacaaggaagcttccgatgtatgtggcaaggagtggggatggcggggggaggaagggaggggagctaggctgcctctaacataaatattttgggaaatgcccccatctatttccttttggctcccatgggtgtgagtatctctcacactatattccttctaaattcatgtttgaaatataggaagtagatgaaagaagactatttatgccaacaaagtataggtaataaaggaattaccacacagtccagcctaggttacttactataagtttataaggaatttgaagtcaaagccccggtggggtattagtgtgtttgctattactccctgaacatatattttgcttagaacagcagtaacctccaagggaaaggatcaacgataccaaagccgattttaaatatccttaggcatcctagcaaaatctttcatattagtattcagattttcctaaaatctatcataatagtatacaagttttccttcaattggatttaattgaactcccacagttctgtatttatgccagcctaatctgtaccactcacaaccacgctttaatacctgtaagccatggaaaagtaatgtccctagtaagtgtctaggaagtgttccacatcctccatttcttctattctgacccagctgcttttgtcaaattcactcctcacggcttctgacttctggttctctatctcatttacagttagttcttgctccataaacactggatgtttatttgaatatctagttttgcatcgtggtatttcctaagtgaatgtagcttgaactcactcctctgtctcttcgcactttaggttccatagttatgggaattattaaaccctttaagtcaagcacgttttattcccaaacaggagaagattcagatactgattacttcatctaattactgaaccttgaattctattcttggctaatcctttgtattgttttgctcatggcatgttttgttgttgctattgttttgttttttatgaactttcagtattaaatgttcatgttttctcacctccacccctttccctactccttaaccctttcactgttcctttagatttatcaattatcactatagtttcttacaaaccaaactccaaggcacaagaaatcaggtagctcacttagttgatattattatttttaccactcaaaataatacaagataaaagaataataagtgaataaaaataatacataatgaataaaagaataatatgtaattattatataaataataaaataagaataatgaaagataataataagagaataatatatcaactaagtgagctgaagaggaaactacaaatgaagccagcagaagattgaaggacaattttatataaagaaactattcatcaaaaaataaaacttacaattaaaaataattttaattactttaagaaattgagatgaagacaacttctataatattctatgaatggtggttataaaaaataaaaatgcacaacacaatgtacatatttatcaactatgaaagaatagttcttaaaaagtaacattaataattacacatttagcagaattattcaaaatacaagggagatttcaaacattctttataataaatttatcttgaaaaaacttcataatattcaaaatacttgcaaaaccttgacaatggtacattttatataactttatacatactaaaaaatctttggaaaatgaatattttatttgatttcatgcacatatatatttgcttgccacaacaaaatatatacacaaaatatatatttatacacaaacacattggttgtcaatatattcaaattagttataattacacaacaaattggttatcagtatactgatatcatactctctaatcatactccgaaatcatactctgtataaagtatgtaaaaaagcaggtggtatgctctgaaatccagtgattttatattctacacagagggtcaaaacataatttagatgaactttataattttataatacacactatcatctggagcaaattaatactgttggcactgagtgctgatgagggacaagttttaagtagaatatgtttgccttttgtatcctatgtttttattcaatgaataactttcacacgatttaaggagttgagaacattactatgctatatctggaacacaggtgttcatttgccttgaaataagactaatgacagtctggaccttttgtattgccttctaacaatgctaatgtaatagaaatatttgtagtttaggctactcaagcagagagccacacatgaaggagcttatcacaaactaagtgctttagaaattatagaatgttcactccagttaattctactataatgctaagtattcatttctaccattaattagtgtccaaatcaaaataaaattataaagataaaaaagcacaaattctagagtcagaagacctggagtccgatcctacctattaattatgtagcttttggtaagttaattaacctctatgtctcttagttttcatattggtcaaaatgagataaaaaatatctatctatggtgctacagagaataagttacataccacttgcaaaatgtctagcacagtgcctgggatatagtaggcattcaatcaacataaataaatttctttcaatttccactgggtcctcaaagcaatttataatatagcataaaaccaatgaatgaatgttgtattatagagttcccactctttaataaactaaatatttatgttttcaatcactgagaagtggtttttacgttattattactacttgtaaaaactaaataaaaaattatatatataaagcataaattattaaatggttgtggtatactatactatagatgcaccacaaaaatatatttgtattacattactatataacttttttcaatcaaaaaatataaagcaggatattaacaatgtaatgaaggacatttaatagagactgaagaaataatagcgctacctaaatcataactttaatatcttaaatacatttcaaataaaaataataaactaattatacttacatgtttccaatatgcaagctttccttttatattagtttcaggtttgaaaaagagatccttaaggagcttatcttcataccctttggttatgtaaatccattttgcttcatatcctctaataattttttcctgctgtttttttttgtggaaaaacacagggctgaatataaggggaggggaaaactatttgttagttttttgccattaaaaaacatgaaaattagtcatgagttcacttacatcttagaaaacatagtgttaaattgaatgtaataatatatttattttcatagtagtgttatataatgctacttagtaactaagatttgttcatcaacattcatcagaggataaatgaatgctgagaaatttcagctgatatgaatctacaaacaattctgtacttacatctggctaagcattttaataaataatgggaaggagaacatgtctaaattatctatagaaacataaggtaaacagtgtgaagttattttttttccaaacctagtgaagaaggaactttttaaatgaggtaacagttattactatatcacaaaaattatatttgtacttcattacaaactaggaaatatactctagagcagtatgtctaacataatataagccagaaataattttaagtttttgattagccacactaaaaaaaaagtttaaaaaacaggtaagcttaattttaatactatgctttatttaacccaatagatcaaaaatattacccaataaatggcatctacaagctaacatcatactcaatggtcaaaaactacatgttttccctctaagattaaaaacaaagaaaggatgtaatctttcatcaaacctactcaatattgtactacaatgcctactggtctaataaggcaataaaaagaaaaccatagaccaatctcacctttgaaacaggcacaaaaattctaaatattagtgaaaagaatctagtaatgtaagcaaagaataataacactatgatcatgtattgtaaaactcactacgtcaacaaattagtggaggaaaaaagtgtgattatataagtacacacaggaaagtcattggataaaatttagcagcctattttatagaaaaatctttgtaaaacaggatcaaaagaaaccacatcaatatcacggaggtgatttaccaaaaatcagtaacatccattctgagtgataaaataatcgtttgaagtaaaatgataaatgaggtagatggttaccattattaccattattattcaataggagaaataaaactaggaataactgaggaaagcaatcttctcacttctaagatgttttaagcagactccacctatttactccttcattcaaaatatttgtattaatgacatacaaattagttaaggtaaaatatactaagataatacaatttataataatttaaataaggccgtttactttctcatgctgaccagtctaggctagtggagtagccctgctccataaagtcattcgattttgttttaccatatccaaaatcactgccatcagctacatgatgaatgcactctagcccatggaataaggaaacgtgaaaacaaagggggagcaataacaatttaagcacataaaatcgaagttgtactcattacttctgctcactttccaatataacaacaacaaaaaattgtagtctgatgaatatacttagtcacgagagagtgtgaatacaatctctagttttcagtcaattgccaaaagaaaagaaaagaatggatgttaaagggaaaagtagtcttctgcaaatgctcaatatgtgccctgtgaagagaaaaaaaaaagtttctaccatgatgaagcttatattctctactatgtagagacagatagtatataaataaaatacaaaatatataataagtaaattgctttttacatagtctggtctgggataatattgctaagaagagacaagatatagcgggcatcacagaaaaaaaattccagtcagagcaaataccaagtgcaaagaaccaggcagaagtatgcttcatgagataagaccacatttggcatgtctgaaaaacagaaagaaggtcactgagatggaaagtcattgcagagctttgagcagaagagtggctttgaaaaggatcatgttggggagatgattttctggaatagagatgtgagaaattctgtggaatctcttcccagtgaaacaatatctagtggaaattatttttttaagttatatatctctggaaattgtccaaagggcatacagcaaaataaacatctattcaagaaaatctattacatctcagtgttaacagtgaatctttgccatttaaaccacaattttctctcttctttcctcccttcctccctcaaccccagttcagtatgacagaagttcgaccctgaataagtacagccaagaacataggatccctctactactgggtcccagttgagggctatggtattttcacaagaaatgcataaatttatctcacatcccgatcctacctccatgtttcagagatattatgtcaggaaagaatagttgagaggtctggggctttcttcatccctccagctcccactgataggcagaagctctaatcaaggtgcaacggggagagaatactggagccctggtagcccttactccagatcacttgtaagatagcgattctgagacaggtgaggcaagttgagaagactagagactgctgtcacagctgagcactctatttgtgaatgtcactctgaaaaaagtgagccactgcctcctccttctgatctaggacagtggcacagtgattttgcctaaggataaatgtagcctatatgaacatagaacctgaagtgctctcctcatcctctcaaagtgaactgactttatgaaacagagtgtggagaatttcaaatctaaaggcactgttaaagacagtagagattatgatgttaagcaattaagaggaggatggtagctccatgagactaaaaaggtaaactgaagatcaggttgaagttttccagagaaaaacaggaaaagagctaagaagaatatcgggattagagcaaacagcaaaaactggcctcaaagattaccctggaaggggccccaacataaaatgaatcagacagtgggtcaatttatgttccagagcattgttaaagacaatagaacaatcaaccagcaattagtggaggttgacactgggtttgatactaaaaaagttcagacagcctaacagggaaatcagagaagacagtcaaagaaagcttataccactgtcctaccaagagcaacatagctggccaaatagctgactatagctggtgcacgctctgaggagcaatatcagaggcttgcacaatgcagggaaaatagacttcactaaaatagtccagccaaattattaaacaaataaacaaatcacaacaagaaactctgggtggggctacagtatcccggattgttacgatacattacctaaaatgtctaattttaaacaaaatgttattaggcaaagaaacacaaaaatgtaaattatatacaaaatagggcagacaacagaaaccaacatagaaagggcccagacaacaggcgaaacaaagacttcaaagcagatgttataaatatgttgaaagaaaatcaagcttaagtaagtaaatacacttaaaagaaatcaaatacatttaaaggcatgacaacaatgccttttcaaataaagactatcagtgaagacataaaaataatttaaaaaaaaccaaaaattttgcaactgagaagtacaataactgaaacaaaaaaattttactatggtggctcaacagattatgctgaaaaacagaaataaaatgaagacaagtgaacagacccacaaaaagttgagggatacaattaagtccaccagtacaaataatgggagtacaagaaaataatagagacagagagaaaaaggcagaaaataaatattataataatggctaaaaattctaaaacttgattttgaaaaattaatctacacatccaagaagtccaatgaatgtaaagaggtccacgtccagacacatcatagtaaaattattgaaatctaaagacagaaaatctcgaaaatgtcttcttgagctcacgaaaaatgatgagtcatgtccaaaggaaccccaataaaattaactatggctctcttatgagaaacaatggaagccagaaggcaatagtatgacattgtcaaagttctgagagaagaaaaagaagaaagaaattcaattaacaatcttaaatccagaaaatatgatctttcaaaactgaaggtgaaataacaatgtttccagatcaatacaagctaaaataatttacttctagcagcatgctttttacgagctaataaaggaagttctctttaggctgaagtcaagagacctccatgctttttaagattaaaaaaagcagaatgctggcaaaggtaattatgtaattattaatgggtataaatgcatattttttctcttaactaattgaaaaagtaattatataaacatatatatataaatcccctctctctttctctatctctctctctatatatatacacacaactatatatataattgtatcattttatgtgtatattgttatatatatacacatatatataattgtattgttggatctataacatatagaaacatatctgacaataagagcacaaggaggcaggtgagagcaagttggaatagtgaaactacctcaaatggtagctcaaatccacaaaaataaagagaactaaaaatgataaatagaaatataatataacaaactctatgaatatatccattcatcttttagtttctttaaaaagcttacagttttataatgtaacaattatagtcacaaactgtcggatttgtaacatgtatagatgtaatatgtctaatttaatagtacaaaaagtggggaaagggaataatgctatatagaagtaatgtctccaaatctcactagacttaagttagtataaatatgaagtagacaagataagttaaagtgtatattgtaaggcctaataaaagcaccaagatcatgcctgtaatcccagcactttgggaggccgaggtgggtagatcatgaggtcaggagatcgagagcatcctggctaacacagtgaaaccccatctctactaaaaatacaaaaaattagccaggcgtggtggcaggcacctgtagtcccagctactcaggaggctgaggcaggagaatggcatgaaccaggaggcggagctttcagtgagcagagacggagccactgaactctagcttgggcaacagagcgagactccgtcttaaaaaaaaaaaaaaaatgcaccaagaaaatcactaaaaacatacaattaaaaatcaataaagaaatgtaaatgttaagctataaaatattcactaacaataaaagctgtaaaagaagagaggaacaaaaaagatataagacatatctgtgaataatgttaagatttaagtttattttaaaataaattccccttttattcttaatattttatacaattatatgattaattttacatggctcctattttaaatataatctttaattttattttcattttctttctaaaatatactatcttgtcgaatgatttattttttataatgtctgaaagaaagtaaactcatagaattgaagcggtacaaatcatttccacaacctacagatattaaaacctaatttttatctcagaagaagtatttattcactctttcatgaattgctcaatcattcattcattcaaaaaacactgttctagactctaaggacctattgattaaaaatccaaagtctaatgatgtttagattaggaaaacttctcaatggaagattatttttctcttatgatgaattataaggacaaaacatttaaatttaacttttaaaaacatcaattatttaatctcaacatttctttaatatttccatctcatcttatttttactggagactccctaaatgacattctaacaggaagtggctttttaatgaactactggctggaggaattcaggaattatctggttgccttagcaattaaaactctcattacaaaatagaaaataactcaagagttcaaaataaaatggggtgtttgtaaaactttgctttgccttcaataagtaagtggcttcattaatccattaagatcctggctggacagtgtgagacagtccagatctcaagatcaaggtaacctagccagaagacaggggtcttggatctttcatgaaataactcagatttactctaattttccaagaataaaggctaaaaaacaggagaattttaaagttatgttatatattacagtttagcttcagggtcatgaatctatactgagaaaaatacccatagctttcttcagattcccaaaggaatctgaaccctcccaccaaaaagtcaaatgttggaacaggtgttaaaacaactaagaatgttctaaaagagaagaaaaacaagacttgatgacaaaaaccaaatattaaacgcttaaaatgcataatgtaaaatagaaaatcaatacaaagaactaaaacaatataaatgaggacattattcaattaaaataagtccaaaatatacattctttctttttaaaaatcaaaatatattgattttaaaaacctgaaaacaaaaaaccccactacagcttaaaacaataaaacagaagaattctccaatatagacgtttttccacagcagagtacccaatattagagaaatgtgttggtgtagagagaataccaaaagaataaaaaataaaaatccatacactgccctatacctggagctcttgcccttgcccactgaaattaaggtaatagagtttcactgtgttcttttgtaactttggaaatatgaggtcatgtattaaagaatactatcatggcttgaaatttgaaggctagaaaaccaatataagggtctattaacagttctctgaaatgacaacatacaggcaatcagatataaggctcacccccactgaacctgtcaaagggtgagataataacttcagcaatttcagaaaaaaaattgagatttctttctatggtattaaataaaaaacaattggattaattattattttacaattcaatacacaggtattattaactaaaaaatattagataatttttaagttttcctcaaagtttgttgctaattacctgggttcagtagaaaaatacaaggaagtgagcatcaaaattcaaaggaaatgttgatcacagtaatttttacataagaaagaagatacatatgtttagaatgctttaaaagtatctacaaaatgctatctgcaaagagctttaaatttacatattaatgaaaaaatttaagccattatgtattaagattttatgataataggtaatataccattaataaggtataaattgcagaagcatgaagagccaaacttataaagacccataattcaaacgattattaatttaaaagagtaaatctgccctgttatgtacttagtcttcagctctatttgtcctaaaaaggaaatgattagttataatgtagtgccaccttttagttcttttctactgtaaaacaaagaaaggtatattaaattatttaaaaagaatcatcacaataatcatcacaatcagtaaaggaaaagtcactatcattttcagaacatttgtatatcaaaatattttaaatagaagttatccagaactgatgataaaaggtgattttccaggtaactttggcaatggttgaaagtaaaaatatagatagatggaaaagatgtgtatattttatcacaattggaaatattaactttcaacatagcctttaagagctacctccaaccaccttcattcctgtggctcatttcattaaataaagacttgacttaatgacaagagtctcatgtaaaaagtatgaagaaaagataagcaaagtatgaagaaaagataaggccttattatttgtattaacagtagtacaattattagcagaaataatagaaaaacaaatattgtcttgataagattaataatataccagcttagtgaggtggctcatgcctgtaatcccagaactttcggaggccgaggtgggcaaatcacttgaggtcaggagttccaggccagcctggccaaggtggtgaaaccttgtctctagtaatactacacaaattagccaggcatggtgatgcacacctgtaatcccagctactcaggaggctgaggcaggagaatcacttaaactcaggaggcagaagttgcagtgagctgagatcgcaccaccgcactccagtctgggtgacagagcaagtttgtctcaaaacaatagtaataatacaccatataactagcaattactagtatcagtaatacaataataaaaatataattctatatatccattgacctggcaaatcaaattctagaaactgtttataaagacattataatggatatatagacatatgtaaatttacagggttttgtccctatctttttataatttagagaaaatagaaaccataataatgtccaccaagaagggagaatttacctaaataaaacataaccatttaaaagaatacatttagctattaaaaattgttatggaataatatctaatactatagaaaatggaaccaaccctattagaaaatagcaggcataacatacccttttttgtaaaataaaaatacactcacatgtatatgtacacatttttaaaattgtatacacacacacacacaattatcaatcattactacactctcgcttttacagaccattgcacaggcacctacccatacatttggttccacatttttcccttgttcaaacggacataaacttttgcccttgttttttgcaaaaaaagaagtttgttaaatgtattttttttgtaacttgcttttctaacttaatacatttctgaaatcactcaaattaaattttagaactaacccattactttttaacaactgcataatattttatactgtctttgtatccagttttcaacaaaggacacacataagtttttcaagagttttgccaccagaaataagacagtatctctcttgctctctttctctctcggtctcttcccagccttctccccaaccccactacctcccacacacacattttatttttgtagtataagtttcaagaacggttattgctggcgtaagagtgtattagtcaggattctctagaaaaatagaaccagtagaaaaaaaatatagagatatatatatagagagagagcaagagagatttattttaaggaattggctcacacaattgtggaagctggcaagtctgaaatctgtagggcaggcctgcagagaaaagttgatgttgcaatctcaattccaactctgcagtctcaaaattcaggcagggtttctatgtcgcagtgttgaggaagaaatgcttcttcaagaaatcttggtctttgtatttgagacctttaattgattagatgaggctcacccacattatggagggtaatatgcttcactcaaagtctacaaatttaaatgttaatcacatctaaaattctaccgttataacaacatctgggcaggtgtttgaccaagtaactgagcaccgtagcctagctatgttgacacataaaattaaacattacaaatagtataacactttaaaaattaattttagtaaaaattgtcattttattttttaaaatggtgatagcaattgtcaccagcaatataattccctttctcttaaatccttataagaactattatcccactttaaattttttttcaaattagggaaatatatctaattgctgatataatttgcatactcttgaatattaatgaggttaaagatcttttgatatgttggttggtagtttatatttcttcttctgtaagttgtctattcacatcctttgtccatttttttctgactcatttttctttgctcgactactttatatacaagctatttatatgtgaacattttctgatttgtatagacatattcttttgaaagtagttaaatacattttctccatatataggtcacttacagtctcccccacaacaacgttacaaaaatatacaacttaattgtcttctaatgtcctatatgtaatgttttaactcatctgaaatatatttttgtttatgggtgtacagtaagaaaacaaatattttgtttagaaagataaacaattttaccactatcaattattaaataaatcatcctttccccaccaaattaaaataatactcctatcctactttgagattcccttatatacacagctctttttaggggcccttgttattctgttcatctgatttctctatccctgtgccaataaaatcatatatcgataaagtggcctaaaagtaatttttaatatttggaaaggcatatttcttcagatgtttcttggatattacaaagcatttaattttccttctctggaactttaaaagcatatttcccagtatctctacaaaaacaagattgtaattgaaatcacttatgtttaaacataaacttagaaaggatggttatttgtattatactgaattctcacacagaaatatggtatttatttatatatgttcaggttttattatttgataaaaattattattttcttcacataggatatttattttttgtatgttgttttttttttttgacatggagtcctgctgtgtcgccaagctggagtacagtggcgtgatctcggctcactgcaacctccgcctcctgggttcaagtgattctcctgcctcagcctcctgagtagctggaattacaggtgcatgcaaccatgcctagctcgtttttgtatttttagtagagacaggatttcactatgttggccaggatggtcttgatctcttgaccttgtgatccgcccacctcggccttccaaagtgctgagattacaggtgtgagccacagtgctggcctctatgttgtttcttaaatattttccggttttattaacaaggggaaatataaaattttccatttatatgcaattggaattttgttagtatgaagaaaaacatcaatttttatatatgcatattttgtatccagccaccagccaaattttttaaatctactaatctctttgatttaccattcatattaatacattatataataatctaatttctttcttattttctaaacatgtggccagatttatcttatgtatggccttaacttgaaactccaaaacaatgttaaaaactttaaattttaaaataaatgataatatttaataaatagctcagtcttttaaaattatttttattagaaagagtgttaattttattaagttacttttcgggcactcaataacatgattacattttctccattaattaattgtattaataagtttcccacttattatccctcgattcgtggactaaactttacttggtcaaatttattaaacctctcatatattgcagaacattatgattgattaacatttaacatttgtgtctacctgtgttcctgatgctgggcagtaacatttttattaccctgtcatgtattagaattaaaattgtaccaaccttataaaatgaataggtatttaaaaaacttttcctatgtgcaggaataatttaaacaatattatagtcttgttcattaaagattatgtggaactcagaaataaaactacttgagaatagtgtctttgtcaatgttcattcattattttattgtttgcttattggtctacagagatattatactcaccttgagtccattttgatggtttgtatttgctagatatcattcttattttggcagataagtgccatccaacttttccatgtcatggcaaacaaagaaaatgatattatttgtttattactgaaaacaaaccaagtaacttgtggctggaagggacctgccaaaaaggtgcagaggattacggctgccctaggcttgcgctgactgctgaaccataaccccttatgggcaagactatgtggcacagtaagctagtgagaagtttttctctagactttaatatttcatagttttgtaggctagtcatctatataattttaatcttattagtaattttggttacagatcttctcattacttttctgtttttttaattatactttaagttttagggtgcatgtgcacaacgtgcaggttagttacatatgtatacatgtgccatgttggtgtgctgcacccagtaacttgtcatttaacattacatatatctccaaatgctatccctcccccctccccccaccccacaacaggccccagtgtgtgatgttccccttcctgtgtccatgtgttctcagtgttcaattcccacctatgagtgagaacatgcagtttttggttttttgtccttgcgacagtttgctgagaatgatggtttccagcttcatccatgtccctacaaaggacatgaactcatcattttttatggctgcatagtattccatggtgtatatgtgtcacggtttcttaatccagtctatcattgttggacatttgacttggttccaagtctttgctattgtgaatagtgccgcaataaacatacatgtgcatgtgtctttatagcagcatgatttataatcctttgggtatatacccagtaatgggatggctgcgtcaaatggtatttctagttctagatccctgaggaatcgccacactgacttccacaatggttgaactagtgtacagtcccatcaacagtgtaaaagtgttcctatttctccacatcctctcaggcacctgttgtttcctgactttttaatgatcgctattctaattggtgtgagatgttatctcatagttttgattcacatttctctgatggccagtgatgatgagcattttttcatgtgtcttttggctgcataaatgtcttcttttgagaagtgtctgttcatatccttcgcccactttttgatggggttgtttttttcttataaatttgttggagttccatggtactggtaccaaaacagagatatagaccaatggaacagaacagagccctcagaaataatgccgcatatctacaatcatctaatctttgacaactctgacaaaaacaagaaatggggaaaggtttccctatttaataaatggtgctgggaaaactggctagccatacgtagaaagctgaaactggatgccttccttacaccttatacaaaaattaattcaagatggattaaagacttaaatgttagacataaaaccataaaagccctagaagaaaacctaggcaataccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacatgcaacctacagaatgggagaaaaattttgcaatctactcatctgacaaagagctaatatccagaatctacaatgaacttctcgttacttttctaaaatatttttttctggcctgggcctatttcattagtcttttgagagaataaacatttagcccccactcatttgtgggagctaaaaattaaaagcattatttcctaactctagtttttttgttcaacttctgtgttaattttccattccaacttttatttacttatttttaaatttttaatttttgtaggtacataggaggtgtatatagttatggggtacatgagatattttgatacaggcctataatgcataacaatgtcatcaggattaatggggtatccatcacctcaagcatttatcctttctttgttttacaaacaatccacacatattctttcagttattttataatgtacaattaattattcttaactatagtcactctggtgtgctattaaatactagatcttattcattacatctaactgtatttttatgcccattaactgtccccattccacccaccctactacccttcccagcttctggtaaccatcattctatctctacttccatgaattcaactgttttaattttcagctcctataaatgagtgagaataagcaaagtttgtctttctgtgtctgccttatttcacttaacataatgacttccaattccagccatgttgttgcaaatgacaggatctcattctttttctgtggctgaatagtatttcattgtgtatatgtaccacattttctttattcattcattcatttgttgatggacacttaggttactttcaaatcttggctatggtgaatattgccacaataaacataggagcacagatatatcttcaacagactgattgcctttactttgggtatgtccttagcagtgggaatgctggatcatatggtagtttttgtagatatttgaggaacatccaagctgttgtccatagtggttgtcctaatctacattcctaccaacaatgccaatgtcaaattatactacagagatatagtaaccaaaacaacatagtactgtcataaaaacagacatctacagatgtctctatatctgtgccagcatttgtttttgcctgtctctgataatagccattttaaatagggtgagatggtatctcaatgtagctttgatttatgtttttctgatgataaattatattgagcacattttcatatatatgttttccatgtatatgtcttcttttgagaagtgttcattcagaacttttgcccattttctaatcaaattattagattttttcctatagagttgtttgagctccttatatattgtagctattaattcattgtcacatggatattttgcaaatatattatcaatttctgcaggttgtctcttcattttattgtttcctttgctgtgcagaagctctttaactttatgtgatcccatttgtctaattttgtttggttgcctgtgcttgtggagtattactcaaagcttgttgcacagtccaatgtcctggagaatttccccaacgttttcttatagtagtttcatagtttgaggtattagcgttaagctgcaaatccattttgatgtgatttttctatatggtcagagatggtggtccaatatcattgctctgactgcagatacccaattttcccaacaccacttactgaagagactgtctttctccaatgcatgttcttggcacctttatcaaaaatcagttcactgtagatatatagatttggttctgagttctctattctattccattgttctatatgtctgtttttagaacagtcctatgttgttttggttactatatctctgtagtataatttgaagtcaggtaatatgattcctcctgttttgttcttcttggtcaagctgactttggctattctgggtcatttgtggttccataaaaattttaggattgttttctctatttctgtgaagaatgtcattgatattttggtagggattgcattgaatctatagattgctttgagtagtatggacattttaaaaatattaattattctaatccaggaacatatgtatttccattttttttgtatcctcttcaatttctttcatcaatgttttaagttttcattgtagagattgctcacttctttggttaagttaattcctaggtatctaattttatttctagctattgttaatgggattaatttcttgatttatttttcagattgttcactgttggcatacagaaatgctactggtttttctatgttgattttgtatcctgcaactatactgaatttattcatctgttctcaatttttttggtgggatttttgggtgttttcaaatataagattataccatctgcaaacaaagataatttgacttattcctttccaatttgaatgccctttatttctttcttttgcctgattgctctagctaggacttcaagtactatgttgaataacagtgatgaaagtggacatccttgttgtgttccagatcttagagaaaagccagttttttcctattcagtctgaatctagctgtaggtctttagtacacagcttttattttgttgaggtatgttcattctatatctagtttatttaggtttttatcataaagggatattggattgtgtcaaatgctttttcagtatcaattaaaataattatataatttttgtccttcaattctgttaatataatgcaccacattgattgatttatgtacgttgaaccatccttgcattcctgggataaattccacttggtggtgatgaatgctctttttaatgtgttgttgattttggtttgctgttattttgttgaggatttttgcatcaatgtttatcagggattctggaatgtagttttctgtttttgacctgtctttttctgattcttttatcaggataatactggccttgtagaatgagattggaagtattccttactcctctatttttgggaacagtttgaataggattggtgttagttcttctttaattgtttagtaaaactcatcagtgaagccatcaggtcctgatgttttctttgctaggagacttcctattacagcttcgatcttattacttgtttttgctctgtttaggttttggatcgtttcacggttcaatcttagtaagttgtatgtgtataaggatttattcattttttctaggttttccaatttatttgcatatagtttctcatcgtatcaactaataatctttcggatttctgtggtattgcttgtgatgtctctactatcatctctgattttgctgatttgggtcttctctctttttttcttggataatctggctaagggtttgttgattatatttatcttttaaccaccaatttttcatttcattggtcttttgtattattcacctcatttcaatttcatttatttctgctctgatctttattacgatcttgtcttctactaattttgggttccatttgcttttgcttttctagttctttaagatgcattgttaggttgtttaaagattttttaatatatctgatattggtgcttatagctataaatttacctcttagtagtgctctcactgtattttataatatttggtaggttctgcttccattatcattcgtttaaagaaatttttaaatttccttcataatctgctcattgacccactggtcattcaggagcatattgtttaatttccatgtgtttgtatagtttccaaaattcctctggttgatttctagttttattccattgtcatcagaggagacacttgatataatttcaattattaaaaaaattttaagacttgttttgttgtctaatatatggtctatccctgagaatgatctatgtgctgagaagaagcatgtgtattcagcagccactggatgaaatgctctgtaaatatctattaggtctatttggtctataatgtagtctaagtccagtgtttctttgttgattgtttttgtctgagtgatctctccaatactgaaagtggggtgctgaggtctccagctattttggttttgtggtctagctccctctttttctctaataatatttgctttatatatttgggtgctccagtgttgggtgcatatatatttaaaattgttatatccccttgctgaattgacctctgtaccattatataataaccttctttgcctccgtttatagtttttgtattgaaatgtatcatgtctggtataagtattcctgatcctttttagtttgcattggcatggaatatctttttccattccttattttcagtccatgtgtgtctttataggtgaagtgtatttcttactggtaaccaatcattgagtcttgttttttcatccattcagccactctatgcttttgattggagaggttagtctatttacattcaatgttattgttgataggtaagattttactcttgccattttgttatttgttttctagttgatttgtgatcttctcttctttctttcctgtcttccttttagtggtatgttttaatttcttggtttttgtgtgtgtatctgctgtattttttttatttgaagataccatgacccttgcaaatgatattctataactcattattttaaactgatgacttaataatgattgtataaacaaaaaaagagaattgtaataaaaattcgacactggacttcatccttctgctttttaactttttgttgcttctatttacatcttagtatgctgtctatgtcttgaaaagttgttgtagttattatttttgaatagttatcttctaggttgtttttactcaagatatgactagtttagacaccacaattacagtgttaaaatattctgtgtttttctgtgtacttactattaccactgagttttgtattatcagatgatttcttattgctcattaacttccttttctttctggttgaagtactccttttagcagttctggtaggcaagtctggtattgatgaaatccctcagtttttgtttgtatggaaaattatatcttcttcctatatgaaggatatttttactggacatactattctaggatacagctttttttccttcagcactttaaatatatcctgccattctctcctggcctaaaagttttccactgcaaagtctgttgccagatatattggagctccatgtatgtgaattgtttcttttctcttgctgctttcaggaatttttctttatctttgacttttaggtgtttgattattaaataccttgaggttggcttctttgggttaaatctctttggtgtacaatagctttcttgtacttagatattgacatctttctctaggtttgggaagttctctgtttttatctcatttttttgtctcctctgtatgttttgtgatggcatgtcttaaagctcactaattcttacttctacttcattaattcttctggtaagagaccgatttactcttcagtatctcaattgcatttttcaactccagagtttttgcttcattctttttaattattcaatatgtttgctaaattgatctcataggattctggactccatctctatgttatcttgaatatctttgagttccctcaagaaggctattttaaatcatctgtctgaaagttcacatatgtctctctcaacaggattagtccctggttcattatttaggttgtttggtgaggtcatgttttcctggatagtcttgatgcttgtgaatgtttatcagtgtctggccactgaagaattgggtatttattggactctttgcagtctgaggttgtttgtatgtgtgcttcttgggaaggtttttcagatatttaaaggaatttgggtgttgtgatctaagtttttgatctctgtagtcatatatacattagggggcaacccaagcccagtaatgctgtggctcttaaagattcatacaggtacttccacgaaattcttcttggatagttctggaagaattatctggattgcaaagcaaaaacgcttgttctcttcctactttcccctggataaacagtctctctctgtgatgagctacatatagttgaggaagggtggcataagcatccctgtggccaccaccactggaactgtgctaggtcagatctaaagccagcacagaactggatctcaaccaagtctttcagtaaccactgccttgctattttctatgttcactcgagcctgcagagctttaaaatcagcagttggtgaagccagccaggcttgttttcttttcttcagtgtggcaagttccccttggtcccaggtaggtcaagagatgccatccaagagccagcaccttgagtcagttactttaggaatctacctgtcacccaagccacaaaacaaagtccttccctacttccctcctctacccacaagcagagaagtctctccctgtaactatcaccaccccagttatgtggtgagtgagtattacctggttacctctgatgtttattcaaggacccagggctctttagttagcttgtggtaaatgctgccaggcctaggactctcccttcagtgaagtgagctcccctctggaccagagagggtacagcaatgccatctcagagccaagaccaaagcctggaatctgagacccttggtgctctactctgtttgggccaagctggtacctaatctgcaagatgaagtcaccttttctctccctccatttttcctcgagaagaaggagtccctagctatagccaccacagctggaaatgtgcagggtcacatctgaagccagtatgtctctcagtctcaaccaaggcccaccatgagtactgcctgggtaccactgctgattattcagtacctaagggatctttagctaggagataatgaatccttccaggactgggtctttctcttcaagacagtggattctcttctggcccagggtatgtctagaaatgttgtccaagagctaggtcctggaataggggcctcaggactctgcctcatgcccacttctactgtgggtgaacatgtatcaaagttgcccccccaccaaaaaaaagtcctccttacttatctctctcttctcttcaaacagaaggcagaagtctctcttggagttgcaagctatgttgtctagtgttgggtgaggggtgatgcaaaccctcccttggctgcttctctggcatctcatttggttatgctcccctgtcaactccactgactctgagccagcccagcaccaggacttgcccacagattgcagactttgtggtctagactgcctttcaagttaatgtaggcctccccagagcactttagccccgggtaaggtggtgaggcttgttagaacttaggctctgaccactgggatgagcaacttccctatggctatggctgatctcaatgcacattccatgagcactggctgagttccaccaagtgccactttccactgtgacagggcagcactaaatttcaatgcaaagttccacaattactgtgttctcactctctcccaagtgcagattctctttccacgccatgtggccactgccagagtgtgggggaagggtgatgttggcaattaaggactggctttcctaccctcttgagtggctccttcattgatatgaagataaaaccaaatatagtgatcactcacttgatttttggttcttataaatgtgattttttttgtgccgatagttcttcaatttggtgcttctgcaaggaggatgatcagtagaggtttctattcttctacggtgcgttacctctttcaatcagtatttctacttttaagaggtattgttgtttgtttttaaataaaaatctctaaaggcccacaagagaaagcaggaaagatctaaaattgacaccctaacatcacaattaaaagaactagagaagcaagagcaaacacattcaaaagatagcagaaggcaagaaataactaagatcagagcagaactgaaggagataaagacacaaaaaacccttcaaagaatcaatgaatcctggagctggttttttgaaaagatcaacaaaattgatagaccaccagcaagactaatacagaagaaaagaaagaagaatcaaatagacacaataaaatatgataatggagatattaccaccacagaaatacaaactaccatcaaagaatactataaacatctctactcaaataaactagatatctagaagaaatggataaattcctggacacatacaccctcccaagactaaaccaggaggaagctgaatccctgaatagaccaataacaggctctgaaattgaggtaataattaatagcctacagaccaaaaaaagtccaggaccagacagattcacagccgaattctactagacgtacaaggaggagctggtaccattccttctgaaaatattccaatcaatagaaaaagagggaatcctccctaactcatcctatgaggccagcatcatcctgataccaaagcctggcagagacacaacaaaaaaagagaattttagaccaatatccctgatgaacatcaatgcaaaattcctcgataaaatactggcaaaccgaatccagcagcacatcaaaaagcttatccaccatgatcaagtgggcttcaaccctgggattcaaggctggttcaacatatgcaaatcaataaatgtaatccagcatataaacagaaccaaagacaaaaaccacatgattatctcaacagatgcagaaaaggcctttgacaaaattcaacaacccttcatgctaagaactctcaataaattaggtattgatgagatgtatctcaaaataataaagagctatttatgacaaacccacagccaatatcatactgaatgggcaaaaactggaagcattccctttgaaaactggcacaagacagggatgccctctctcaccactcctatttaacatagtgttggaagttctggccaaagcaatcgggcaggagaaagaaataaagggtattcaattaggaaaagaggaagtcaaattgttcctgtttgcagatgaaatgactgtatatttagaaaaccccattgtctcagcacaaaatctccttaagctgataagcaacttcagcaaagtctcaggatacaaaatcaatgtgcaaatatcacaaacgttcttatgcaccaataacagacagagagccaaatcatgagtgaactcccattcacaactgcatcaaagagaataaaatacctaggaatccaacttacaagggatgtgaaggacctcttcaaggagaactacaaacgactgatcaatgaaataaaagaggacacaaacaaatggaagaacattccattctcacggataggatgaatcaatattgtgaaaatggccatattgcccaaggtaatttatagattcaatgccatccccatcaaactaccaatgactttcttggaaaaaactactttaaagttcatatggaaccaaaaatgagcccgcattgccaagtcaatgctaagccaaaagaacaaagctggaggcgtcgtgctacctgacttcaaactacactataaggctacagtaaccaaaagagcatggtactggtaccaaaacagagatatagaccaatggaacagaacagagccctcagaaataataccacacatctacaaccatctgatctttgacaaacctgacaaaaacaagaaatggggaaagattccctatttaataaatggtgctggggaaactggctagccatatgtagaaagctgaaactggatgccttccttataccttatacaaaaattaattcaagatggattaaagacttaaatgttagacctaaaaccataaaaaccctagaagaaaacctaggcaataccattcaggacatagacatgggcaaggacttcatgtctaaaacatcaaaagcaatggcaacaaaagccaaaattgacaaatgggatctaattaaactaaagaacttctgcacagcaaaagaaactaccatcagaatgaacaggcaacctacagaatgggagaaaaattttgcaatctactcatctgacaatgggctaatatccagaatctacaaagaacttaaacaaatttacaagaaaaaaacaaacaatcccatcaaaaagtgggcaaatatgaacagacacttctcaaaagaagacatttatgcagccaacggacacatgaaaaaatgctcatcatcactggccatcagagaaatgcaaatcaaaaacacaatgagataccacctcacaccagttagaatggcaatcattaaaaagtcaggaaacaacaggtgctggagaggatgtggagaaataggaacacttttatactgttggtggaactgtaaacaagttcaaccattgtggaagacggtgtagcgattcctcagggatctagaactagaaataccatttgacccagccatcccattactgggtatatacccaaaggattataaatcatgctgctataaagacacatgcacatgtatgtttattgcggcactattcacaatagcaaagacttggaaccaacccaaatgtccaacaatgatagactggattaagaaaatgtggcacatatacaccatggaatactatgcagccataaaaaatgatgagttcatgtcctttgtaggcacctggatgaagctggaaaccatcattctcagcaaactattgcaaggacgaaaaaccaaacaccgcatgttctcactcataggtgggaattgaacaatgagaacacttggacacaaaaagggaacatcacgtactggggcctgtcgtggggtggggggaagggggagggatagcattgggagatatatctaatgtaaatgacgagttaatgggtgcagcacaccagcatggcacatgtatacatatgtaacaaacctgcacattgtgcacatgtaccctagaacttaaagtataataataaaaaaaagacaaagcacataatcctaccaaaaaaaatctctacacttccttataagtatttcagctgtattttgtcttatatgaaatgacactcaatgctttttttaactttatatttgaatttttatttgattcaagtattatttatgagagtattttttgattcccaggaaattttgacatttttattactcatttctaacattattggagtaagagtatctgatcttcaaaaattatttcttaaaatatagaggtcttctgtaatggctgagtgagggacttggcaactcctctttccaaagagtaattgtaaaactgaacaaaatttcccaaaattaccattttaagactagaaattcactaaaggcatataaccaaatgaaaagtctttattgatgaaatgataataaatataaataagaacagtggggagtttgtagcattttagcctggtgctgctcctgctaccaatagccccccataacccctaccacttctacctacatggtgcaaaggtactactatggcatagcagactgagagcagattgaagtgacatcagacagtaacttcaattcacaggaagaaaacatgagtaatagaaattataaatacatacgttaatttcaaagagtctataagtatatattccctcctcttaatatctttaaaagcaataactataacactcttttcttgggtttaaattaccatatatagatgtaatatagagcaacagtagggcaaaggaaggtagagggatttaagttttactggagcaaagttctatattttactgaaataaaggtactattaatttgaagtaaaatgtgataagatacatactgtagtacatagagcaaccactgagaaaataacaaaaaacacagtaaaaagcaagaaagaaatcaaatggtacagtagaaaatacctgtttaatataaaagaatgtggtaaaggagaaatacagggaaatacatgtgatatataaaaacccaaaggaaaaatggtggatgtaagtccagctatataaataataattttaaatgagaatggattaaatattccaattaaaagacaaatgttttcagattaacttaaaaatagcaaaacgtaagtttctaactacaatctgtctacaaaagaaactttaaaattcagagatgcgaatcagccaaaagtaaaataatgcaaaaataccacaataagagtgactataagaagctggagtgggtattctaatattagacaaaatagactttaagataaaatatgttactgaaacaaagacaaaaattttacagtgttggaaatgtcacttcatcaggtacacacaacaattctaagtatgtatgtacccaacaaaaatgagactaaaatatatgatgtaaaaagtggcacaattgagggaagaattacacaattcaccagtaagagttgtggactttaatgccacactctaaataatagacagaatgacaacacaataaatcaacaaacatatagcaaattataggaactctatcaactaactttacttaactgatgtttatggaacaattcacccaatagaatgaaatttcttctcaatcacatgaaacattctccaggatatatctcataacaaggctataaataagtctcaataaatttaaaataattgaaatcaacaaagtatgttcagtaatcatggtaaaattaaataagaaatcaacaacagaagaaaattttggaaattcaaatatatctggaaataaatttattatttctccataaccatggggacaggaataaatcaccaaagcaattataaattatttgagttgaatgaaaacacaacatataaaacattatgagatgtagctaaagcagtgcttagatgaaaacatagctgtaaatgcctatatcagaaaataagaaatgtctcaaatcaaaatccaaacttcctcttgaaaagtgtgaggtggagtgtggaaggagggagggtaaaggaatctcatagcaagcaagattgaaggaataaatatgagagaggaaatcagtgaaataaaaaactagaaaaatagtagagaaaattaataaaatcattgattctttgaaaatatcaacaaaatggcaaacctctaggtaagctaagtaaaacaaaagaaggcatatattacgaaaataaaaaagagaccacattactaatgaccttacagaaattaaaaatatcaaaagaaaatatgagaaatagtattatgccaacaaattggaaaatgtagatgaaatggatgaattccttaaaagacactaattaccaaaactaacttaagaagaaatagaaaacctagatagatctgtaacaagtaaagaaattgaattcacaatttaaaatgttcccatagataaaatccaaggcacagatggcttcactggtgaattttactaaacatttaagatagaaataataccaatcttttacatactcctccagaaatagagaaagaaacacatcccaattaattctgtaagaccacagtgttccgccatcattccagatggtggctacacagaaagtttcttagcacagcagtgagcatcattccaaggtacctctctggaaccctactaagcagcttaacggcaatttcaagaataaagtattgttcaagaatccataaagaagaaatagatctaattatatatatattagaaatagcaaaaaatcatcagggactttgattttgttgttggaattattccctaatgtgagcattaatgagttttatctaccttcttatccaccattcaaaatttttctattactttggttattccagtcaatttctcagaggcaaattgggaagactgttcttagtaattattttgctaactgtaaatgcaaaatttccttagcattcttcattccttccactctcttcactatcattcagtagaaattattaaggctaaagggaaaaccactttgattcattttatactgcaactcaaaccataaacagtttaagtagaaaacttttagagtcttatttgctgaacctcataacggttctttatttatatcttcaagcactgaattaagtttattattttactgctgtttgttaaaaacatgttaagtattttacaagtataatatttttgtctatttcttgcattcatgattgcttttgttttcaactttcggttcctaaggggcaggagacatgcctttacaatgatctaaataaaaatcatatatacctaacagacaatatatctagtataattacagggggaaaagcatctcctctttaaatttttttaaattcactcctattttatttgcaacactttttaaaattaaacaatcaacctaaattgctactgcagattttacataaccaacatctttctatatactataaaaatagatatgaacagacacttctcaaaagaagacatttatgcggccaaaatacatatgaaaaaaagctcatcatcactggtcattagagaaatgcaaatcaaaaccacaatgagataccatctcatgccagttagaatggcaatctttaaaaagtcaggaagcaacagatgctggtgaggctgtggagaaataggaacacttttacaccattggtgggagtgtaaattagttcaaccattgtggaagacagtgtggtgattcctcaagggttgagaaccggaaataccatttgacccagcaatcccattatggagtataaacccaaaggattagaaatcattctactataaagacaaatgcacaggtatgtttattgcagcactgttcacaatagcaaagacttggaaccaacccaaatgtccatcaatgatagactggataaagaaaatgtggcacatatacaacatggaatactattcagccataaaaaaggatgagttcatgtcctttgcaggcacatggatgaagctggaaactatcattctcaggaaactaacacaagagcagaagacaaaacactgcatgttctcactcatatgttggagttgaacaatgagaacacaggacacagggaggggaacatcacacaccggggcctgtcagggggtgggagggtagggaagggatagcattaggagaaatacctaatgtagatgatgggttggtgggtgcagcaaaccaccatggcacgtgtatacctgtataacaaacctgcatgttctgcacatgtatcccagaacttaaagtataattttaaaaaaaaaggaagaagaaaagaaataaatatcctggctcttttgcttcctttaaaaaaacaaacaaacaaaaaaaaaaaacaaaaaaacaaggccctgacttcatttcatggtaatgtgacctggatgtatgattacaagtatggggtagaggtcagtacagataagcataaagacctttagcatttttcattttaaagacgatcatgtttatagccaaatcacagctcataattatcccaggtcacaaaaagtctattttcagctattccttctgagtaaactggggccaaaatgcccagactgtctccaaatatccttcaatccattaccagacttacatacttactttttggtgtcccatgggcagggtctgacccagagttcagctaggcatgtcaagttgaatgtctgttgtctcaatatgagaaacaaaaggagaaaaactgcaagtggaactcttcaggagagtgaaatggcctttgtttaaacaaaaatcctctcttatggctgctttcaagaaagcagccagcgaagactgtattttgaaacaagtggattgagaaactacatttttggactcagaacatgttgcaagttatacttgtaatgggagtatttttcattttaaagatgatcatgtttatactcaaatcacatttcataactcccaggactacatgggctccaggatgtaactgggttacatatgaaattcaattatctgtgatatatctgttcctctccaagcaccttcccttcctctccaatacagcccccagtccacttatcatagaaaataggagagtggctgggcgtggtggctcatgcctgtaatatgtcactttgggaggccaacacttgaggccaggagtttgagaccagaccgaacaacataacaagaccctgtctctacaaaaaataaagaaataaaacacaaacacaaaaaatgtatttatgtgtatatatatatatatacacatatatgtatgtgtgtgtgtatatatatatacatatatgtatgtgtgtgtgtatatatatatatacatgtgtgtgtgtatatatatacacacatacataaatgtaaaatgttaggctgtaaatgatgaaaatatgatggctttggggaaataaaatgtataatttgacttcaaacttttcagtggaaagaaggaagggagaaaggaaggaaggaaggaaggagggagggagggagggaaggaaaaagcgagaagctaggaagggaagtagtgaggactggccgctatccatgcaattgcatacaccaaaatttttagtgtcatccatcatatgcttctttttctcaccataacaaccactacccatttgctcaccaaattctctaatcctctgtattgtacccataaatacctttatctgatccctacatctatattttattccaggcacttatgactcacctaaactattttagtaacctaggattgatggctttagtcttccctcattaaaacttttattccacataactgtagagtaacatcccatggcatctcttctgtgcttaaacacttgtaatggcttgccactacttataacaaaggataacatttcttgatataaatactgactatataaaaataaaaatattaatgtcttattataacccatagataaaattatagtatatgacaaaatagcatgaaagttgaaaaggagatataatgaaaatagagttctaaaatttttatatggtcaagaagaagagtaaaggtactaattaaatgaagatatattaaagtaaataagcatattttatttgctaggattactgattcttcaaaattggaaatatagagtgtatcttccaaaacagtagagggggaaaacatacaacaataaaaactaaattccaaagaaggcaggaaatatgagggagaaaatttacagaacaggagagaaaagcaaaaagcaaaaataacacaatgtatttaataccccaaacatcaggaataacatttaatgtaaatagtccaaatatgatagttaatataaaaattgtcagactgggtttaaaaaatcaaactctgttatttatgagctagatagacagataaagataaatatacagaaatattataaccaaatggatagaaaataaatatgcaaaaactaaatacaaaacaagccagtgtaaatacatctgataaagtaaactttaagccataaagattactagatgaattgagagtcatttcataaagataaaaggttcaattgactgattgacataatgatttttaatttttatgcaactaataacatagttcaaaatatgcaaaacaaaatttgacctaactataatgaaataataataatacatctacaatcacagtgagagatgtaagttcacttctcccagtgactgagaaaactagtaatcccaaaattaataaggaatagaatagttgaacaccacctaaccagtgacctaatagaaacacaaaaaatatcttagccaataactatagaggacactttttttaagcacacgtgaaaagcgtgggccatatgcaaatctcaatgaaattcaaagtcaaaggactgaaatcatataggacaggatttcctactgcaaggaaattaagcttgtttcccctgccctaagatatattcacaccaaataagttattatcatatcaatgtgaaatgtccttccctacctcaataactttacacatcctacagtttgactagaattaaaccctttacaactaatcccactcttctggcaccacatcccttccaatataaaaacatacatacattccatacttgatgaaatttttaaatttttgaaaaaattcatgtaatataaggtctatgaagtctttcttgacaacctcacccaatcagaattaattgtatacccacaaagttggctgaatatttgtctactgtaatatttatcatagtagataaaatactgtgtttgtttgtctgtataattgaactattatcttcttatgattaggaatcataatttgcgtctttttacattctcaacacctaaaacacctaaagcacttaagacacagcaggcaactaatatgctaacatcatggaactaggttttctttggctgccaagatattcttgttgtctattctgatttatatctccaatagtaaattttaaaaaatatacttcagtttcttaatagtacatgatagattatcaattcaaaatacaaataagctgatgattctaaaaataagcatggatagatggcaatgttgcatctataaaacacggtttgagctaatattttacacaaaagtataactatggctttttcaagaaaaaaaaatcagtttgcctgtattgccacaaaaacagtagctagaaaatatggacagatatattgtttgaattgtttctaaaaattttaaaatttctaaatgttttgaacacaccaatgtagacattagcttattcaataattatttattaagatctggtatttttaagatgcagataatttaactcaatactttttatttctaaatatgtattagatacgtattttgtttgataaaaaatgttctgatttttacaacaattttatgtcacttttatccaaaattatgagttatataaaactaagaaaaaaacacaaacaatattattttggtaaaatattgggctcattttgttgcttcatgaaaaattttcctagtccacttttgttttccactattaaaagataactggagtatcaactgaaaagcagtttcataatttaatcctggagagattaaactgagttaccacttcttcccctaaagaattctcattatttttaaaggtgctgaataatattattctgaataatattccatttatacacacacacacacacacacacacatattacacaaacatatataacaatttatctgtttattccttgatggacatttgcattgattctgtatcttggctattgtgaataatgttgcaatgaacgtgagagtgcaggtatctttacaagttggtgatttcatttcctttgaattcgaaagactggggttgaattgttgcatcatatggtagtactattttaagttactttaggaacctccatatttttcccacagtagctgtaccagtctctattcacactcatagtatcgccagtacttccactttactaaaaatactgcttctcaaattattaattatcccatcaaatgagataatgaaatccacatactactcaggaattgttaaagcttcaattttagcatattctcctcctaatagtgtttacctactttcccaaagcagagttaatcacaccacacccagtccacttcaaccaaggaaatactacattgtaatgtgactttctgactttgcaaattaggtggccaaaccattcttcgagtaggtagccaaagcctatgtaaaggtaacagatataaggctgactgttaaagtagcttaaatttcagtgtcatatattatatacaatttcacatgaattttgtatttttaaagggtacttattcctggaatggccacaaatgcttgcttaaaagagtcaggggtatattcatctgaacccataaagaagcagacagaggcgatcatgctgttacatcttgaatcattagggcatgcgtcaaggccatgccacttatttttgcagctcctgaaacttgctgatggatgtactattcttgccttaagtgcaggaagacccacagattattggaatgagcccacccatctttttatgactccagtcttccagtaagtctaatgaggacaagaagatagcaataaagctgtcttgtatgtgtatctatgtagaagcccattcattttgaaagaaagcaaacacacaaaatattctgctcctagtaccacttctgaaaaatggaaaactgctttctaataagactaatataaacatctattttttattctgagtttcaaatgagtcaaaatattttgcaaagtattagtgcaattaaaattatttgaagtgaacttcaaataaaataaagaaacaattcagtccaattctgacaacttcagcagagtcattattcaactgggtaagatgaacgggagacactattttatggataatatttaattatgaaaattgtttacccagtcataaaatgttattgattctttaatagtattttaataaagatagtttttggttgacaaatagtagaagaaagcacatctgtgttccaagatagcattgaaagaagtaaggtaaattttgaagatgcaaaatttaaatagtattgccttgaatctgtactttgtcgtaacagatggtcaacaatccctaccatatgcaaagctagacaatattttaaatcattgtatatatccaggaaattcactgtatgaaacatttttcacgcaaatgttggcatacatttattatttaaaatataattttctttaagaaacttgtgctactggtatcttcaatatacctaacttttaaggtaggaattaacctaatcttcattatacataagtaatataatcattgttgaacacactcagcattcagaattacataatttactataacaaattataataatcttttatatattatatattacaactttttatctcataattccaaaatgaagtctcaaaacccaggtagctaaggtaactactcttggcatattagatgtattactaaaaagttgcatataatgctttcacattaacaaattatattaagtacattataaatgttttatacttaaatctttaaggtgagtaattttaaatgagactaatcatttcctgattcatataagttgtgataatgctattttgagtattataataatttatattcctttaagaactagtgaagcattaacgatgtacatttaaaatgcataaatagatgttggtgtttaaagttttgacctcagaatcaactatgatccatttattctttacctatttgggcacctttcagttagtagctcttgttttttctcttttctccttaacaaagtgcccttaaatttgaaagacaaattagctaacttcctagtcctgacctttggtctaatttcctagattataatcagtgtcccttcatttgacaaggagtcttatttgcaaccatatttggcataatcccaggatatccacatatcaaatactccccaagtaatcaacaatgcagatttctaagttagttatcatatagaaacctaatctagaacaaatttctgtagtccagtttaacatgaaacatttctttattttcaatagattttatatttcaaggaaactagattaatatttttctatcaacttaaaaattagaaaaaaaatgttttttttttctcgctttcttggacacatcttcaagcaatccttaaattcagaggactgtaacagtctgtaaaaaaaaaaaaaaaaaaagcagcaaaaaaaaccatttaccaaattatctccattgtatcttctgtagcagtcagggttaacaaactttttctatataaagctaattagtaaatatgtaggcgctggagtgtacatatgttctattgcatatttttcttttttttctaacaatccttttaagttataaaaaccattattccttctgcacaggctatatcagatttttcctgcggactatagtttcccaaccttatatctatattttatcctaattcatacatgtatgtgtacacacacacacacacacacatttttctcccatatggccttagaaatttttgaggaaaaatgaaaaataaatgcacatacacacatatacatatacaattttaaattaaatttaaaatatttttacctacagaaatattatagagaccccagatcaatcttgcttattatgataatatgatctatgcatacaaaaatagattaatgtacatttagtagaggtatacaacacctgaaaatccttccattttgggtacctctactaatgttgttatcactagcgtatgaatgacttaagaaaacaaattccattttccattttcctaagagctaaggccacagtcatatgacttagcttaaccaattcggtgctttttccctggatttttacttgtcagggacaatccaaatgcacaaggacaacaaaagggtattcatgacagctgcaacagaataatggggagacaagtagccaatagtaacagtaaactaggaatgctctctggtggagttggctctgccatgcttctcactgctgttccttttccaaagccagttactctgtcttcctgaatttttcgtgagcttcctgaaaaacctctaacaaattctattattgtctaagtcatttacagttagcttccgctgtttgcaagtaagaactctagatactacacaatctaatcttctaaattttatgtgagaaggatttaaaaaattacttgctttaatcaattatgaaagaaataactcattaactactcatcaacaaaataatcagaaaaacatcacaagtatactaggcctacaatccaaatttgaaaagaattttgtaaaatattccaccactaaaatataatgaattactaatttttttcttaattatatttgtattaagtatttaaatgtagtattttctcttctttttatctagttttaaaaataaatcctcaattttctctatcatatctatgaagtaattatatttacctcacagaactgctgtgaggatcaaatgagttaataaagacaagtgtacatttaaaatttccagcaaagtatacagttatatgccatataatgatgttccagtcaatgacaaactgcatatacactggtggtccccatgaaattatactaccgtacttttactctcttttctatatttagatacacaaatatttatcattatcttacaattgcctataaaatttagtatagtaatatgctgtacagatttgtggcctaggctacaaatacgctataccacctaagtttgtctaagtgtagtaggctatataacctaagtttgtcaaagtactctctatgggttcacacaatgacaaaatcacctaacaacatgtttctcagaatgcatccttgtcattaagcaatgcatgactgtatttcagcaaaaataatctattaggaataaaataattatgttatttataatgtaaaatcatatacaatgttagtgtaccattatatatgttccatgatatgccactatatatgtgaaaatagtaattctattaaaatataaactccacaaaggcagtgaatttaaatgttttgtctgctgttgtgtcttcaggacccagaaagggcctaacttatggtaggcactcaataaatacttgtagaatgaactgatcgataaaaattaataattatatcatgcctataaggcaggtagtgcacatttgtatataatttcataactttgctatgaaaattttattaagaaataatatttcccaagatctagcaagtgctagcagaataatacaaattattttattttattttatttggttatgatccatgaaatatgggcctgagtcctgtgtctataacttacaagttttgaaacctcaggcaagttatttgggattgtttataggatcaaatgaggtaaattacataaaatgtctggcacacagtgccaagccagaacttgaataaattatctgatgattctaatccactgtcaactttgaataacaccaaaaaattcacagtaagtaggatagttgattagacctaaatagttaatattgttttataataaataaaatagtctttataagagttccctatgattggtcagccaaggcggctcatacttgtaatcccagcactttaggaggacaaggcaggcagattgcttgagcccaggagttggagaccagcctgggcaacattgcgaaactccatctctataaaaaatacaaaaatgagccaggcatggcaacgcgtgcctgtggtcccagccactcaggaggctgaggtagaagaatcgcttgagcccaggaaggtggaggttgcagtgagcttagataacaccactgcagtccatcctggactacaggtaagactctgcatcaaaagaaaagaattgcctacgaacaagaaaaattaaaaagcaaatttaatttggtacacttaatctctaaaattttctaggcaacaagaacattctaaaaaaactccatatgaaataaataaatttttctctttttatctactcttttgctttggtcaaccatgaaagattctaactcatgataaataaaaacattttaaggtatttttcaaacccaattaatttgatgtttgataacataggttgctaccctgacaatcatagtagagaataatgattttatgtcaaaatgctaatcatttcagaagagctttccaatatcaacccaatgtccataaaataaagtgaaagtgtcagaaatattaaaaatttaatttaaaaggcatgtattattgataaaaacatgttttggatacagttttaactgttagtctgagggggatttccttatatgtgacttgaggcctttctcttgctgtctctatcattctctctgcttttgtcttttgtcagtttaactataacatgccattgagacgaccttttggggttgaatctttttgaggacttttaagctttctgtatgtgggtctatatgttttgcaagacttaagatgttttcagctattatttcattaaataggttttcttcatctttgtccatctcttctccttctgggtctttcaaaatgtgagaatttggtcactttaaatttctcattcaacaagtcatgaattgcttttctgatatctttgtattgtttaactgtgttcctttatatctcattgagttcctttaaaatcattaaaaaaatttttcagccatttcaaatatattttttcctttggaatctgtttatagagatttattgtttctttggaggcattatgtttcctgctttttcatgtttcttgtgtccttacattgacatctgtacatctggtgttaacagttgctttttccaaattttgtagggaagtactttttgttatagatgcatctacagtgttggttggataggatgctttgactttgaatctggtgggtgtagtggagtagtctcagtataatttatttgaccataattagcatcagaagtatctgtgagttcttcagtgcctgaggctgcagttgctggtagaggctgtagcaagactttgctggtgacagagacaccagtcaggccagtcctcagtcaccagttgtggcagtggtgggctagacatgctggtccttaggcctccacatggcatacatgggtggcagtagttatggttgtggttaggccagtccttgggcctcaaggatgttgtaattataaaagaaacagataaagagatgcatagggtgtgttgtgggggaagaagcatggagctttccttgaggaaccttcacttgttcagttattcagtgaaaattctgtttttaaagtactcgtgagataacgttagatccatctagataatctctcctaaggtcaactgattagtaagtcattttaattacatctgcataatatcatttgtcctgcaacataacatgaccatgcgagtaacaccagggaacaaaagccatgtgggtcacctaggaattctgtctaccacatgtgagaagagattaaataagatcaaatctttgttaccttgaaaccatgccaagtgaggacacaattggcttataataggcacacattttagtcaacatggttccaggcaaaagggaggaatgcccatggtgttattttcctcttttagtcggttaatataagtgattttctaatgttaaattaaccttgtattcctggaataaattatatggttataaggtattattttttctatatcattggatctaattttctaatattgtattcatgatttttacatctgtattcatgacactgacctgaaattttctttcttgtaacgtctttgtaagattttgatattaaggttttgttgatctctcaaaataatatgtaaagtgttttcttttactctctgggaaatttacgtaagatggcattatattttccttacatgtatagaatcatgcatcagtaaattcatccaggctcaatgtctctttgtgaaaagcacttcaagaatgtgttcaattttttaatgtatgtacaactatttagtatttttatttcttcctttgtcagcttgaaaattgtgtttcttcacagaattttttcatatcacataaaaaattgtaatttttgatataaagttgttcttattctctttcatatctgtagacttacagcaatgtgcctttttaaattctttacgttggtaattactctttgctttatcagtcttgctggagtactaccaatttctctccacaaataatgaattcttaaatatattaattttttcatgtgcattttctcatgtttattgtatatttgtattccatttcattcatttctgatactacttttcttattcccctttactctgtttgggtataacttctgctatttttctatcttcatgagacagatgcttagattcttgatattctagcctctctcttttgttcatacatgcatttgtagctgctaggcaatagttattattttgtcttttgctttcaaatattctgtggcaaaaactgccactcaattccaattctctttttaatccttaaaacagtagccaaatttcatacaggtgacaaagtgatcagataaaagaccctatttcttagctgccagtgtacccatacaactaaattctggccaaggaaatgtaggaaaggggaattctggctaacgaaatgtaggaaaagagaaatgcagtatatccggtaagggtgattaaaattgctgttataatcaggagatgtgcccctttctgccattcagtattgcctgtcttccagcataaaatcagatgtaaagattggaactctggcagccattttgaccataaatgaccttgaagataaaacacacaaattagaaaggtagattgaaaagttagaggaaggttggatccttgattttgtgcagtatcacaggcctggacttcttgaaccacagactcttctcacataaaaaacaaaacttctgcctagtttaagccaagatattggggatccctcttacatagaactgaattgaataagtaaaacatacaaatatattatttcttctttttttaattatcaaatttactaaagcttcaggaaattgtaatatatagtgatgattatgggcctccttatcttgctccccattggataagataacgtactattttgctattattttccaatatgtatattaatgtattttaatcatatttactggaaaatgcagtctaagtatcttagacttttctcgcttctgctaaaacctagtttattatagccctagcatttagatggttcctacattaacattacctgcaaaaagaaatttgcaaccatacaatcagacaatcagagttaaacatttttcctggaaaataagctgaaatttgtctttctaaaactttcactcactatacctgattcttttatctattttacttacagaaaatattcaacaatttgaggtcaactatttgaattgccttaaatttactcttctgatacttatatatccaagttcccctaatcatacctctcatgatatgactacaggatatttcatttctctccaccttatatgttttaagaaataaatatttatttaataaatatcacctaaaatgtgaaagtcacagaaatttagtttgccagaaatagttattgaatgatgctttcttttttttttttttttttttttttttagatggagtcttgctctgtcaccaggctggagtgcagtggcgcgatctcggctcactacaacctccgcctcctgggttcaagcaattctcctgcctcagcctcctgagtagctgggacaacaggtatgcaccaccatgctcagctaatttttgtatttttagtagagacggggtttcaccatgttggccagaatgctctcgatctcttgacctcgtgatctgcccacctcagcctgaatgatgcttttaacatgtaaacactactttttaaaggcactgtgggataatagttatggcagtgacatagttttctaatttctccagattccttcatagaaacaaacataacaactagaaggcaaatttttttaaatatctacaacagtactatgtgacaaggtatcctcgggaaatctaaaatgtgaatgaatggggaaaaatcatagacaattgtaagcccactgctgtgttagcaattattcaggaggaaacagacaaaagtaatgaggcatttgatggatagaaacaaaacaaatagaacagaagctaaatccggggtgggggggatgggcattagtgtgtgaatacaataaataaaaagtctatggtaagatctaaaggatctgaagcattccgggactctaaacccccaaaactaaccagccaaaactctcttacaggtcaaagcccaaagtgaggagaatttcctgggaaaataatagtaattgagtggcagagaaaaacagtgaaaagagagagcaaaatatccacattaacagggaggtaatagaaaccacagtcagagacagcagaaagagaaccacgatactgtggatgctacacaaacacaataggagtagttttaaatactaaaataagaaaagctttttcttaaagttcagaaaaactaattttatagaaacagcaatgcagaaaaatcactatctcgttctttacagaattataataagaagaaagtaaagagcataacaatatcattgtagacaatggaagcaggccagaaagtgaaccttataaaaaataaaaataaaattacacctattatttcaaaatgaacaaaaagatagcaagaaaattatataagacatgtaagagaaaatttagaaatgcagtgatagaaatgagaaaaaaatcagtatttaaaaactaattttatatataaagactaaaccagaaggattataattataaatgaaaacaacaaaaaatttcctaagtgaaatagactaaaataaggaatatttttaaaattaaaaagaaaatcagtagaaaaagaactaccatcactatgataaatgaatatgagtaactattcaacaaactatttcaacaatatatctccagtctaatcattaaaaaaatcctgcaacaaatcttgaattgtattaaatacattgttgatagtagtgtgtagtagtgactatgaaactattttgtgtatattgtaggattaagctaatgagtaaaattaataatgttggcaaccaaaattcaaagggaaatataatgttgaatgaaagcagtgaataaccctctgtgttggattaacatttggggtgttaacatgaaattatgatggaaagaataatccatattctgtctgctaaaatgagctaggaataatgacaccccaatagcaatgaatacatctagtttctagatcttactttccaaataccattccttactgaaaggactagagctgtttggaaaagctgacttcaggggtgttgttagaaaagtaaaaggagcatggaatttggaatgtgttaataccggaacctgatatttatttacatgcggtttcatctcttcataactgaccacaaatgaccaacacaaaatggctttctaatattgattcatatattagcctccccaccaagtttaaactcttaatgtttcatctgtaaaacagaaaatacagaaagactcaaaagctctgttttattaaataatataatggattaatgtacctaacatggtgctttacatatattgcacattcaataaattttgtttcctatattttttccattctttttccttttttacaacccatcaagacaaccaataatcctccccatgatctcagtatagctgcctttacgtaggtttaggaggctatcaatctaattacaacatttcattctaagaataaaagtatactttccttatattgtatcacccgtactagaaatactaccactctaaaagataatagcattaatcataataattttataaattttggccatatatatttcaagtacttaaagttaaaaatttcaaagtacaaaatatttgggtgtgaggagacatttctcatgcctagaaatagagacacaagaagactaatcactcggaccctaggttgtgggaatctatagttgcctctcaggggagctcttcatatttcctaattcttactttcacctttccatgcatgaatccagatctgatttcagctcccactgtctctccatttgttgatgtattaatcaattcagaaagtatttttgagcacctaacatgtgtcaggcattctgttacatattaaagatacagagtggaaaacagagatacagtctcatagagtttatagtaaatctggagatataggtaactatagagacgactataatacggtatggtaagagcttgtgataataaaagtatgtgaaacacatcaaagaggcaatatcccaaacatttgtcctaaacaaatagaaagccactggaggactttaacttggtgaataaaatgattaaatttgtatttttgaaagattactgtctgcatgctggaagggagcaagaaatccaaggaaaatttcccatggggccaaataacacagagagcactaaatataacaacaacaatgataattaaatttttaaggctgggcgcggtagttcacgcttgtaatcccagcactttggggggccgaggtgtgcggatcacgaggtcaggagattgagaccatcctggctaacacggtggaaccccgtctctactaaaaatataaaaaattagccgggcgtggcggcgggtgcctgtagtcccagctactggggaggctgaggcaggagaatggcgtgaacccggaagtcagaggttgcagcgagccgagatcgcgccactgcactgcagcctgggcgacagagcgagactccttctcaaaaaaaaaaaaaaaaaaaaaaaaaaaaaaaaaaaaaaatgtaatatctacttttgtcaggtgctaagagcattatattgatcatctcaattcccacaaatagaaataagtactttttttatcccctgttctttacaattttacagataaagaaattcaagcccagcatagataagtaatgtaactaatggaacagagctttaaagagagagaaaatacaaatcatcttgtcttgaaccctgccatatattattactgaaatctcttcctgcaaaactctctattcatacatgcttagtttttaaagattgttcccatgaacaaagtttttatctcatgttacatgagcgtcagtgagaaccttcattctaccagagaaaaaaatccctgggaaataacctaaaaacaagaccctttaattagatctgtatttaatataaaaagcacattaaattccaatgcaaaataaagacagaattaatattttaaataagtatgcacttttcagcaactgcctgattgattcttttgcacctcctttactcaggtaatttgacttgtctccaatgtgagattatgttctctcatattttgacctcagtgtggaaaattatgtggaaccacttcctcagaagtcggaggcactgtatttatggtcagtttcactacttattcctcatacttgtttctctttatcaggactattgccacctatgatttagcatatattggcttgtgctggaaggcattacatctcattgtgtctatcttaccacagaatgttgaatctcatttcagtgaaacttcctaatcttgctttatcaacaaatgtctgttttcttattccagatctacgtcaatcctatctatatttcagggccaaatttcatttctatcttctgaactttaccaattagaataagctatatgaatattttcatttagtttttcatatgtttgacatttggtatgaccaatactataaattgatgacagagtatcctatcatatctctgcaagtacaatgttgagaaattctagcaaaaaggtttccatttatttgcaaagcttagctactgcaaaggaatgcaaggaacaagaaaagaggaaaagacaactaaataaaggacaatatagattgacgtggtagcagatgtgacagcaaaattgtattcgcatctaaataaaatataaaatcttccatgtatgttccatgttttatattctattgtatcccattatataatccatggcttacatttgtatttatatggtaagttgaaaagaaaaaataaaatatcaaatgttgattatgttaaatattatattactatagagtctgtggtatttttcttaaagttaggttaaacagactataccattttaatgatagagaatacaaaaatgcaaattattggagaattgacttcttatcatttatttcttcaccttcttatttcaatattcaaatggtaaagaaaacaaaacatacctcaaattttttctaactaagaaaccacgtatccatctttgaacaatcaaaactggtgaattatgagccagaattgcattaatttttgaagtaatatgtttaatattattaatttcctcttcataggttgttccctgtataaagaaaatataattaataatttttatctttcatgaaagtattttcaaaagatattttaaatttggtaatctattggtttaaataaactaacaaaatgttcacaaggtcttacaggcattatagttaaattatgatatggttggatgtttgtgccctccaaatcttatgttgaaatgcaatccccaatgttagagataggggcttgtgggaggtattggatcatgggggctgttccctcctgaatggcttagtgtcatccctttgatgatgagtgaacttcttgctcatatagttcacatgagatctggttgtgggaccaccccttctgtctcctgctccctctctcaccatgtgacttgcctgcctcccattcaccttccaccatgattgtaggtttcctgaggcccttaccagaaacagatgccagcaccatacttcctatataccctatagaaacatgagccaaaataaacctcttttctttataaattacccagcctcaggtatttctttatagcaatgaaactgagtaataaaaataataaatacatttttattattagagtaaaagaacaataattagtagcatcaagtaatttcaattctctacacaaaacataagattcttgatgataactttttccattaaagattattttcccaatctgataatatatgtataaaattttaaccataatcattctgctctctaaatggtagtggcacaaacaggtgtccaatgaaactgcaaatactctgtcagcccccataaataaaattgatatactttgattcataaaataatgtatagtagttaaaaattttgttgtagcttaactagaatgttggacacttttattggaacacagcaaattatcttggaaaagatcctgtattggctttgagaaagatctcctttcctgaaaatttttagatttgagatcgtaggctcagtatatttcattgacaacttgactggttagaaataaggtcactgtttatgttttgaatgtaagataatgcattaaaaatactgacaattgcattgttcatgaagcacctcttctgaaaattatcaaccctattacacttaaaacatacaccttttctgcatatacactcaataaaaaagtttacaggaaacaaaaaaaaaatcacaacaccttgcagattagtgccgcttccgatttatactttcaaacactcattgctaattataaacttatttccttggctctgtctttattctattcccaacattagctactgaaaacctttgacactattcgatactcttccagtccattccctggagcttcctaaacactctgcttcttttttcacagagaaactagagccatcaagtctgaactccatcaattaactcccctccattctctgtaaatttaactatattcctatctatactgagtagaagtgccttctactcaaacttaaaacaagaagtaactctttttttgtctaagattggcactctattatgagtctcatatctgttttctaaggctctccctctgctagcactatctgttcatatataaagatgatataactttacctatccttaaatcctaactctcaatcctttatatctaactttcattaagagcccaaaatctagaaacagaattccatgtttgtttctcccactttctttttttttgttttgtttttctatctctcattccactggcttctatccctatcatccaagggcacttttttagagttaacattggacattccctccttgaaacacttgccttagattctgtactacacttctttcagttttcctctaaatcttgtttacttctgcactttaaaaaaaactatatataccatgtttatcacttcattgttacattgaaagaattttctccatgttgctttttaatctctacacatcctccaaatgaccacttctaagttcatagcttgaacactcacttttgtgctacagactctcagatttctatgtttaggcctgacctacgtaacaatatagtcaaactgatatctaactaaatacaactttcccaaatatgaattttctttcccaacctgctttctcatatacactaccttagtaaatggtaccagtgcccacagttgcctaaaccagaaaccctggaaccatcctaggttctctctttttttatgcttcctggcatgcaaatgttactagatgcagtacattcaacatcccaaatatcagtcttacctctctttttcttctattttctgccattgcttttcctatgtctttaacaccacttccgtaacttactaaaattctcctaacttatatcttcattaattcctgttcccccactttctccaaaccataaaatgcactattgctagattgagcattccaaaatgtaaatcttatcatatgacattctagattaatatatttattggcttgccaatgaaagacaaattacaaatgtcttggtttgccacacaaagtccttcttgatctagtcccatcctagctccttaatctcatctcaatttatcctacatagaattacctgataatcaaacttaaatgctttttgccatctgtatttcttgaactgcctttttcaatgatttgtctcacaattttagtctttgggagactcagttccttcccccaagaagactttcttgatgttgatctgcattcagtgtctttatacaatattatcctgtgtcgtgtgaaataattcatttgtcactctcgacaatgttgagttttacctgacccctgtgttcttggaaaacagtgaaagttaagaaatctcctcagtcctttgtttcaggaaatggcttactgaaaagaagcaccctgctctttatgactgacttaaataatactcttggatgcctttcttgtttgtttataacaagacctgacacagaccttacaaattcccattcttcccttctttaacaattagctgaaaggttttgtccccaccaatcaattggaataaaatatttgttagcccaactttagttgagattatttccttcccctgggcccctgaactttggcccaccatcagccccagccagcacacagtctccctttaacagcccctcttaagaataggtttttctcagggtaaaacagtctgtgctctaaggtcagaccataccacttttcttcattccacttccccacattcatttatttatagtcttgtttattcctccttataaatgagaaattcttttgcctaaccattatgacttttgcagatcttatggtcagaacattctccacattgtaataatcccactctgcctattgcaatagttcctttccctcacgtgcaatcagctttttgaataaggtctctatttattaatcctgatgtttttagctgacaaattattctttaatgcaatcattggtgtatcttctccatataagctcaccaaatttaacaactcttcatcctacatatctggactaactgagatatctggtctataactggcatttgattatcaattgactgttaaaatactaagtaatcattatcgttggcctccaagcgtgacttaacaatgtcaatcaatttattcttgtaactcaattattttgcatggctacaaagacatcacactctttttctcccttttaaacttttcttagtctgttttgctggttcattttcttctgcaaacatttaaacatttgatttaacttagattttcattctttttcatctttcttggctaactcttctcaagtgaaaaccttccttgtaatatcttactgcctcacatacctagattatccacatagctgtaatctcctgtcagacattctttcttaaattacaggcatataaaataaacttccaattccatttatttactttgatgtcaaaactataaataattatctccctaacttgaatcaatccacactcatattatattatctatatagtcataaaaacgattcttcgtcgtgtcaaccaagtaataaacccatattcctctttctctcgcacctttttccattcaataaatcactaaattctatcaaatagcccttcaatctgttccttatacactatacctgaactattataatagactcctaattcccctatattcaatttccctccactccaaaattacagaatacaggatgatttttctagaataaaaatcaggtcatataaatgcctgaaatgtttccccaagatcttgcaagataaagtcctgtctccttagtattacatataacaccctttgctattttaatcccgtttttgtctccagcatcatttgacatgcccaaacatatcctctaaactccaagaacacgaaactacttgttgtcacttgcatgtgccaagctctatcaatacctctgtgcctttgcaaatgctttccactctgcctcacaggctcttcactcatgccaacacctctatttgcctagtaatttcttacattcaaaaaattcatcagaaatataaatacttctgcattttttcctgtgattagagaattgaacttcaaagatttttaaagaaaatatatgtactttgctcacagaatttttcccagtactcagattcatggtgttttatccattatttcctgattattgcttctcctttatttgctttaattttctctaccgtaattccatcctatttataaatattacatgaatgtctacattgtttctcataactttatgtatttattctcattttggtgaagccactctgtcaaaggtcagtttctcatattgaattttttatttagcttatcaactatttcagttatgtggctgagtctaagttcttttctgaagctcctaactgctctcacacgagtcctatcatataccatttgatatttattgtaaccctgactgtacttgaatctctccatgaaacctattctgtagtaatggatcctgtcacttgttctatcgtcaccctgaaaacatagagggttttgcagaatttcctctagttcctgtgattttataatatttttcaggaagaatagcttaaagtcaggctgccttagtttcttcttttgattcagttatgtcttagtccatctgggtagctacaacaaaatacatagtctgggtagcttataaacaacagaaacttatttctatcagttctggaggctgggaagtccaagataaagctactggcagttttagtgttggattaaggcccatttcctggtccataaatggtaccttcccactgtgtcctcacgtaatggaaaggggacggatctctctggggcctctttacaaagaacacgaatcctatttatgagggttctaccctcatgacctaatcacctccaaaagtctccacctccaaataccatcatattggagattagattttagcatgtaaattttagactggccacatttagaccatagcagtctcaccttcatcgtatccgacaaaaagtctttgctatgtctagaattatccagagctaataatattttgtaagaatattatcttttactagtttctagtatagatgtgatttccacaaatctatatgtttgttaattacatttgtgctcatgatgccacctgtggcttaggattaaaggggttgagtgtaatgatgtaaaagtgcataagtggtggcaaggggatgggggtagaagtgttggagaagcagaaagaatacaggagggaatttagatgattagaaccaagtagccctggtcagaagcagttctcatcagtagagaaacattaagctcatattgcagtttacatcagagtcctgcttctcactgagtcatgaaaaattccttctcattaaagaaataaacagaatattcatcagctctgggtagtatgagtgtcccttccagagaacaagtaaactccagacaatacttaagctttctgatgtcataaaacaatgatcttgaaaagtaacaataaagaccctgcaaaattttacaaatgccataaaccatttgatgtctgaagatgaaggaatcctctttgtaaaataataataataataataatgcattccctccattaaagaagtgacggctctgaagaaaaactacatttgtttaaatcttagttctaccacttgctagctgtgtattatagggtaaataacctatctgtatcatgttttcatcatttgtaaaatggagataacgatggtacaactcactgggttgttgtgaggttttaagcatgcaaacaatgttatctttcaacagttttatagcaatacttaaaatgatatagtgttttagggtttataagggacttctacatacattattatatttgatacttacaaaattttatctaaaaagagacgtgtactaattaatttatccaaactaatataatgtaaaattatgaaatcaacaaattaactataaaagataatcactacaaatgttttcaatccaatcaaaggaattatagtaaaggcttagcaaagaacaaaagatgcttaggcaaaaaactatcaacaatcaataaaatgattggtagaataatagaaattctatactacgtgcctgaaatgaaacgggctattactaatcctggaacgaaatagagtgagacatgcaaaagaatattaaggacttttataattatgactcatatggatgacagtgttttgcatgtcaacagtaagagttgtttaaaaactaattctaaaactatatgctagtcacattgtataaaatgatgcaaaacaatttcccaattaatttgacattctaaatgcatattgtacttatataatttttatcttccctacttccacgtttttagttctacgatctagtccataaagtttatctttttctattttatttgtgaatattttccataagaatatttgatctcatagaagtaaaatgtagaacagaggatactagaggctgggaagggtagagggaaagaagagataggaaaagatttgtcaaaagacagaaaattacatgtacataggaggaataagttctagtgtttatatcactgcaaaatgactatagttaataataacatattatatagttttagatagctagaaggaagatagtgaatgttcccaacacaaagaaatgataaatgtttgagatgatgaatatgctaactatgctgattggatcactatacactatatattttgaaacaccatgaatgccataaatatgtacaattatatcagttaattttttttaaaaatccaaatttggcacacattttctcagcatatttgaaaagtgtaaaacataccaatcccataagtgtttatttcaaataaagaaaaatcatatcatttttacctttttatttattcttttaatattatgttcactttaatagtcccacaaaatggtaaaaaatctgtgtgaaacttcccacactagcatggaatcttttgcattatttaaatcagtatttataaggatcacttggtaaacactgaggtacaagatggctgtgttttattaactgtaaacccagggcatagaacaaaactgtaacatagtacatagtagttatataacaaaagtgagtactctaagtgtgctaggcagtgaaaatataatttttctattgttgaaataattttatataagtagcattattctatggacattcacacagattgctgcatgtgtatcaataatctgttaatatttctggttgagtactataccatggtagggatgtgtcaattcatttaaccattcactcattgaaggacatctaggtattttccagttcggggccattaccaataaaactgctttaaacactcatgtacaagcttttatgtgaacataagccttcatttctctgggataaattctcagtattgcaattgctgaatcatatgattattccatgtttagttttttcagaaaatgtcaaaatcttttccagagtggctgtactattttattttcctaccagttttgctgcatacatgccagaatttattgtcactctttttttttaattttagccattctgaatagtatgtagtaatatctcattgtggtttcaatttccatttccctaacagctaatgatattgaatattttttcacgtgattactttgccatctgtatataccctttggtgaaattcctcttctggattttgttcaatttttaattagattgtttcatatgtttttgacgtgtgtgtgtatgtgtgtctgtgtgtgtgtgttttaaggcttgagagttgtatacattttctatatactagtcttttttcagatacagggtgctataggctgaatcgtttcccctcaaattcatatactgaattactaacccccaataactcagaatgtgactgtatttggagatagagttctaagaggtaaataagttaaaataagaccatatgggtgggctctaatacaatatgactggtgttcttttaagaaatttggacacaaacactttcacagaggaaacaccatgtaaagacagggagaagaagagcatctacaagccaatgagagagtcttcagaagaaatcaactttgctgatgcctcaatcttggatttctagcctccagaattgtaaataaataaatacatttctctttaagctacctagtggtactttgttatggcagccctagcaaacaaatacatagagtttgcaaatacttgccccaaatctgtagcttatcttttcattctcctaacagggtctttcatagagcaaaatttttgaaaaaaaatttgattacatgcattttatcatttattccttttacaaagtatgcttttgatgtcaggtctaagaattctgtctagtcctagatgcccaaaagtattacttttctaaaattctgtaactttacatcttacacaactgcttgacctattttgagttaatttttgtataaagtatgaaacttagactgaggagttttgatgttattggtcttttggctatggatacccaattgctccaggaccatttattgaaaagacttttttacttcatcaaattacatttgtacctttgccaaaattcatttggacatattgcatgaacctatttttaggttttattttctgttctattgatctatgtgcccatgtgttatcaataccaccacagtcttgattacgatagctacacgtgtctaaaaataaggtaactgatgcatcccacttttttcttgtttttctaagttcttttaacaattctagtttgtttatatttccatataaaattcagtataatcttgactacatctacaatcttatggaattttgataagaattgcattgaagctgtatataaatttcggtagaattgagatctttatttttattttttaaatcagtgttatgtagttttcagcgcagcagtactgtgcatgtattgttagatttatatattaagtatttcatttctttgaatgatgataaattgtatttcaaattttggcttccatgtgttcattgctagtatatagaaatataatttttgtatgtttatctggcatactgagacaatgctaaccttacttattagttctaatatattctttgtagattcttgaggattttttacataggtgatcatttgatctgcaaatagagttgtatttcctcttttccaatttcttttccttttgtttccttttctcaccttgttgtactggctattttctggcactatgttgaaaagagaagtgacagtggacatccatgctttattcccaataatgtgggaaaagtgttctttcaccattaagcataatgttagttgtaggtattttcttgatgtttttcctcaagttgaggaagttgccttctaaacatatttttctgaaagtttttgtcacaaatagatgttgaaatttgtcaaatttttttctgcatgaattggtatgacatctcttctttagtcttttaataaggtggattgcatttattggtttagaatgttgaaccatccttgaatccctatacttggtcccacttgatcatagtatatatttttatatactgctgaattgtattcgctaatatttttaaagatttctatgcttatgctcttaaggaatattgatctgtggttttcctttcttgtgctgtctttcattttggtatccagataattttagcttcataatataaattaggaggtgttccttttttatttttattttttggaatatattgtacagaattggtgttacttttacatgtttgggataattctccagtgaagcaatctagtcttgtatgtttctcttttgtgaattttaaaactatgaaatcaatttccttaatagttatacaattattcaaattatctatttcatggtgggtgagtttttgtagtttgtgtttttttttctgtagaagtgtttcatttcatccagactgtctagtttacgtgtgtagaatatttagtattattattctgttaacatttgcaaggcctgtgatctccctggtttcatgcatgatgttgataatttgtctctcccttttcctttgtcagtcttgacaggtttgtcaattttattcactttttcaaagaaccagatgcttgttttcctaattttctcaacttctttggtttttcagtttcactaatattcactccttatcattttgttccttctgctggctttgggttaattttgctcttctttttctagttcttgagtgggaagcatagatcattgatatgatattttccctcttttccaatttagtgctataaattttcctctaagcattgccttagctgtgtcccacaacttttaaaactttgtatttgtatttttattcagttaaccatttctttatttcttttacaccatcctcttttgggctaaggacatgaatagacaattctcaaaagaagatatacaaatggccgacaaacatatgaaaaaaatgcttaacatcactaattgtcaggaaaacacaaatcaaaaccacaaggtgatatcaccttactcctgcaagaatggccataataaaaaaataataataatagacgctggcgtggatgtggtgaaaagggaacacttttacactattggtgaaaatgtaaactattacaaccactatggaaaacagtgtggagattatttaaataactaaaagtagatctaccattagatacagcaatcccactcctggttatctatccagaggaaaagaagtcattatacaaaaaagatacttgcacttgcacacagatgtttagagcagcacaatttggaattgcaaaaatatggaaccagcccaaatgcccatcaatcaacaagaggataaagaaaatgtggtatacatataccatggaatacgactcagccataaaaaggaatgaaataatggcatttgcagcaacctggatgaaattggagaccattattctaagtgaagtaactcaggaatggaaaaccaaatatcgtatgttctcactcacagtgggagctaagctatgaggactcaaaggcataagaaggtgataggttcataggtgcagcaaaccaccgtgacacatgtttaactatgtaacaaacctgcacatcctgcacatgtaccccagaacttaaaataaaaataaaaattaaaaaatacgacactctaaacttccacatatttttttttaaagaatgatacaatggactttggggacttggggaaagaagtggttgggctgggggtgagagataaaagactgcatactggatattgtgtacattgctctggtgatgggagcaccaaaatctcagaaatcaccactaaagaacttattcatgtaaccaaacagcacctgttccacaaaaacctattcaaatgataaaatacactaaaaccactgaattgtacaattaaaaacataaaataaacacacacacacacacacgaaagaattcctccttgactaatggatttattagaaatgtgtaatagtttccaagtgtttggagattttcctcttatctttctgtcatcagatagcacaccctgtatgatttaaattctattaaatttattgatatttgttttagggatagttgctgatatttgatttaaggatatatatagtctgtatagaatttcatggacacttgaaaagaatgtatattttgctgttgttgggtggtgttctataaatgtcaattacatactattggttaatagggtgctcgtattttctatatatatcctaatttcatatctagttgttctaatttcctgtctagttgatagagagaagtattgacatctccaactatatttgtagatttgcctatctctcatttcagttttctgtccatatattttgttgctttattgtttaatgcatccccatttagaatggctatgccttattagtagattgaaacttttatcatgatataacatctctctccacctctgataattccctttgtgctgaaatttcctttatcagatattcatacagctactcaatcctacttttaactaatttttgtatgatacatatttttccatcattttattttcaatttgcctataacattctatttgaaattagtttattgttaacaacgcatagctgaataaagttttgaagcccaatttgccaatctctttcttataactggcatatttagaccatttactgtaaattttaatgtaattatagacaggttaatgcttaggactaccattttattttttgttttctgttagattcctgtttttttctttcattgttttcttctcttgatttcctatgggttacttaaacatttttggaattccatttagatttatctatagtgaggttttctccctcagttttcctgacatataattagcatacacaaaaagcctaaacataattatgtatggacatatgtattacttgtgttactatgtccataatcaaggtaataaatatatccatcacctctaaaagttcttttggttgtcttgtgtcatttttattttcttttgtttgtttgtggtaagaacacttaacatgagatctactcacttaataaacttttaagtttacaatacattattgcaagctttaggctctatgttgtaccacaatttgtaggaacttcctcatcttgcataactgggtatttgtaaaccttgaacaacacttcccacggtgtcctccctatcccctggtaaacatgatttgattatctactgctgtaaatttgactatgttagatgcttcacataggagaaatcatccggtatttgtccttccatgactgacctgtttcaccttgcagagtatctttcaggtccatccatattgtcacaaatggtaggatttccttctttttttaaggctaaacaatattcaattgtgtatgtatagtttatttctgtattcatctctccgtgaacgtgcaggctgtttctgtctcttggccattatgaataatgttacaatcaacatggaatactgtttaagatcctgattttaattgtttcttatatagacccagaagtagaaatgctggatcatatgatagctctatttgtactttgttgagaaacctccataatgtttccataatagctgtaccattttacgttgccaccaacagtgtacaaaggtttcaatttctccaacacttttttttaagagacagggtcttgctctgtcacccaggctggtgtgccactggcaaaattgtagctcattgcagcctcaaactcctggactcaagcaattctctcaccttagcctcccaaatagctgagactacaagtgcacgccacacctggttaatttcttaaattttttgtagagacagggtcttgttatgttgtccaggttagtcttgaactcctggcctcaagtgatccttctgcctcagcctcccaaaacactggaattacaggctgctttgttgtgttttaataatagccatcctaggaagtatgcaatggtatctcctcattctttgattttcatttctcatatgattagtagtgttatcttttcatatatcttttttatgtattcatttttatgtattctttggagaaatgtctattcaagtctgttaaccattccttattcgggttattttttgtttgtttgtctttgctattaaggtataagagttccttatataatttagaaatttacccctcattaaataaatgatttgccaatattttctcctagtctataagttgccatttcactctgttgattgtttcccttgctgtgtagcagctttttagtttgatgtagtcttaatggactgtttttgcttttgttgattgtgtttttagtgggatattggagaaaccattgccaagaccgatgtcaagaaggttttcccctttttccttctagaagttttatagattcagatcttacctttaagattttaattcttttttgagtatagtgtaagacaaaggtccaatttcattctttttgatatggatatccagttttctcaacatcatctattgaagagaatatcttttctctgctgtgtattcttggcacccttgctgaaaattagttgaacatatatccatgggtttatttctaggttctgtattccgttctattgttctatatgtctacttgtatgccagtactacactgttttaattactatagatttgtaacgtattttgaaaccagtaagtgtgatgcctccagctttatttggtttttgtgtttgttttgcttaagattgttttggctattcaggatcttttgtggtgccatattaattttaggatttttttccatttctgtaaaaaagtacttaggtattttgataggaattgatcaaatctgcattgctttgggtgggatagacattttaacaatactaattttttagtccatgaacccaggataccttccaacttatttatgtctactttagtttttccattagtgttttatagttttcagtgtacaagttttcacctccttggataggtttattcctatgtattttattctttctggtgctattttaaatgagattgctttcttaatttccttttcagattttttattattaatgtataaaaatgtaactgagttatgtgtaactttactaaattcgtttattaattctaacagtattcttgtagcatgttttaaggttttcaacatataagaccatgccacctgcaagtagagataattttacttcttccatcctaactttcatggcatttatttatttgtttagtcccattgctttggcttggacttccaatactatgttgaatagaggcatctttaccttgttccatatcttaggaaaaaaaacttaaaagtttttcactgttgagtatgatgttaactgtgggctttttatatatagtccttatattgcattgagggaaactctttccatacataattgttgagagcttttttaatcataaaaggtgttgaatttttgtcaaatgtttttctgcatctatggagataattgtgtgatttttattattcattctgttaatgtggtgcatcacattgattgatttgcataggttgaaccatccatggctcccagagacaaatctctctcagccacagtgtgtgatcctttcaatgtactgttggattcagtttcttaataccttggtgaaaattgctgtatccatgttcatcacagatattgacctgtagttttcttgtgttgtttttgcctggctttggtagcagtgtaatgctggacttataacatgagtttagaagtgttcgctcttctttttggggggcagaatttaaaaataattggtattaatgctttaaaattcatatataaagccatctgaccctggacttttctcattagagaggaatttgattacataatcaacctccttatttgttataggtatgttcaagcattctattttttcttgatttattcttgggaggttgtatgtttctgggaatttatttatcatttcttctaagttgtccactttgttggagtatgttttaaatgagtctcaaaatcttttttatatctgtggcattaattgtaatgtctcttctttcatttctgagtttaagtcttctttttttctgtgttattattgctgagtttgtctatcttgtttgtctttttaaaaagccaactgaattttgttgaatttctttgctattccgtatttcatttatttttgccctgatctttgtttctttatttctgccaattttaggtttagtttgttaatttttctagttccttcaggtgtacagttggttgagatcattttttcttttttaaaatagatttcactataaacctcccttatcatactgcttttactttatcctataagttttggtaggttgtgttttcacaaattttagtaagttcattttcacttgtatcagtgttttataatttcttttgatttctcttttgactcaatagttgtttaatttccttgcatttgtgaattttcccaatttccttttgttaatgatatctagttttattccattgtgcttagaaaatattcttggaataaattcaatcattttaaatttcttaatacttatatgtgactatgtcatttattctaaagaaggttctgtgtgtgcttgaaaggaatgtatattatattactgctggattctgtgtacatgtctgttaggtatatttggcccccagtgttattcaagtctgctgttccctatcaatttactttctggatgatctatcaattgttgaaagtggggtattgaagttttgtattattgtgtttctgttttctcctaataactgctaacgttgcttcatatattacataatttaatgttgagtgcaaatatatttatatttgttatagcttcttgttggattaacccttttatcattatttgatgacctcctttgtcttttgtaagttttttaattaaagcctacttttttaataaatgtagacactcctggtatcctttggttatgattagcaagaaatatgtttttccatttctttcccttcaccaatatgtgaggatttaaatccaaggaaaatctcttgcagacagcatatagttgggtctcggttttttaaaaatccattcaggccaggcacagtggctcacgcctgtaatcccagcactttgggaggccgaggcaggtggaccacgaggtcaagagattgagaccatcctggccagcatcctggccgtctctactaaaaatacaaaaaatcagctgggcgtggtagcgggcacctatagttccagctacttgggaggctgaggcaggagaatggcatgaacccaggaggtggagcttgcagtgagccgagatcacgccactgcactccagactgggcaagagtgagagtccatctcaaaaaaaaaaaaaaaaaatccattcactccctccttatcttttaactggtgagtttaatccatttacacttaaaataattattaatagtaaggctaatgattaccattttattgttttgttttgtagttctcttgttcttcttctcttgtagtctttctctgtggcttgataatttttatactgctatgctttgatgctattttatcttttgtgtatctaccataggttttttctttgttatcatgaggtttgtatcaaacctcttaataaagtctattttaagctgctataaattattgtcaaacacatgtacatttctgcacttttactgtcccctcccatattttgtcactgatatcatacttttcatattgtatattcagtaacaaattttgtttagacttaatattttgtttcaattgaaacaataaaaaataataataataaaataaattttgtttcaattcaaaaaacttccttcagcacttcttgtaaggtaggcctagtggtgatgaactccttcaatttttgtttatctgtaaatgtctttatctctcttttattttttgaataagcattttgctaggcatagtatttttggttgtcacgttttgggttttttattgttgtttatatggtgttctgaatataccatctcattttcttccagcccacaaggtttctgatgtatcttgatgtaaatttctttcatttctatctacgtgcagatttttgggctgcctaagtataggtatccatttctttctccagatttgtgacgtgttcagtcattattttatacactttcttccctcttttctctctgtctctcttaactttgtaagatatccataatgcgttatattgttttacttgatggtgtctcatcagtcccatagagtttcttcacactttttttttcttttcttttcgtctctctgactggacactttcaaatgacctgtctttaatttcactaattctttcttctgcttgactgagtctactgttgaaactctctattgaatttttcagttaattcattataacactgaactctacaatcccccttccgcccttcccctcttccttccttcctgtttttgacaggagtttcactcttgttgcccaggctgcactgcaatggtgcgatctcagctcactgtaacctctgcctcccaggttcaagcaattctcctgcctcagcctcccaagcagctgagattacaggcacctgccatcatgcctggctatttttttttttttttttgtatttttagtagagacagagttttaccatgttaaccaggctggccttgaacttctgaccttgggtgatccacctgccttggcctctgaaagtgctgggattacaggcatgagtcactgcacccagcctacaacttcattttggttaatgttttctatttcttgttggttaatagtttctatttctttaacatcccattttttatgtattgtttttctgatttcatttagttatttgtcaatgttcttttgtagttcactaagattctttcagaatattattttgaattctttgtgaggcagttagcagatttccatttctttaggtttggttgctagagagagctttattagtttcctttagtttcctttgatggtagaatgtttcccttattcttcattgtccttaaatacttacgttggtgcttgtgcattttaagaagcagttacatctaaaacaatcttctcatcttcataggctggctttaggaattaaaggtcttcaccagtcagtgcaccctgggattctggggctctgactggtgtctatggctggtgaagcctgctgaccagcgtctactggctctgaagtcagatgaggccgatggggtccaaggtcaggtgaggccagctggtctgctggggccaaatggaagaagatgttgttaggtgaagatgatgacaggtctacagtcagtcaaggccaatggtaggggctatggggctactgccaatatctgtttgcccaccactaacagctctaccctccccctttttttgttgttgttgttcctagttgtcccgtgatgatttagctgtgctaattctcccatattctgactgaggcaagatagaagtgcacttctcaggcaacaccctgaaatgctgaggaaaatgaacattcatctcagactctccttcccccactggataaatgggaggccaaaaagatccttctcactgtgatgctctgctagcttggggaaagggtgacacaagtaaagtaaaattgttccttttatccttttaacattcttccccagattttgcactctactgggtgctgtaacctctcccctgggttctggaattctcacaaaggcattattatccatgaatagttactaaattggtgcttctgagggagggctagaactgagaatctcctattcttccatcttgctgacatcacactcctctctatatattgtttttgtatatctctttgtacagctttcttagtagatgctttaacataccacagtcaactaatgtcacaaccatgtaatgtcactaatttaccagatcaggtgaagtatggaaaccttatccctcttaacatccctttacactcctgtttataattcttaagtatacattctatatatatttagaacaacctgagacagtgttataatttttgcttacacagtatttataatactcaagagaaagaaagtgtatttcgtttacccatatttttgcttaccatgttctttcttccttcctgatattccacagccttcttttatcattttctttctatgtagagcgcttcctttagctattattttaggggaggtatgctagtaatagattctcttagttttcctctatctgagtatatattaattccttcttcattcctgaggaatattttcattgtcatagaattatgatttgatagtgttattttctttctgagcttgaaaaatattttgcaacttgcttatattctttacagtttttggtgcaaaattttgtcactctcattgtttttcacctataggtaaagtgttgtctttcttgttttccagatttttttctttgccttcagttttaagaagtttaattaagatattttttggcattggatttctttgggctgatttggggttttctcagcttcttaaatctgcatttatgtctattgcaacatttgggaagtttttagccattatttcttaatcaggcaccttttcagtgctgcactctgttttctcgagactctgatgacatgaaagttatatcttttattataattccatggatacctgaagctatgttcatttctcagtattttttttttctgttgtttatgtaggggttatagctcctgtgtggtcttaattggcacagctttaggggtagccttgttatcacccagcaatggtaaaagtcttgatctccattagtgtcagaggagtctgacaccacctcagcagggaggggcaggaatgttgtactacaatgggttagtaagggcttataactggccaacagaaatgaaatccctggttccttacttggcctcctttgacatcaccctacagggtgttgggttgcttcacttgagtctcaaaaaggtagaggtctaaactccccacccagactttgctgcatgggcgaatgtgagaccacagatttttctgtactttgactgcagtagagtggttattttctaaaagttatcagtcttgctatgttgatcctttcctgttcatttagatagagagagcaggcttctgttactttttttaatatgtatttttttgtttgcaccctttgtcccttctgtgttgctgaactttgtcagcttcaggttttggatatatgaaggtgtaggggttctttcagctgctaagtatgtctatgccaattatgtaggctggcactggggaaatgactggcctagcctcccagcctacatctttctcctgtgctggatgcttcctgccctcaaacattggactccaagttcttcagttttgagacccagactggatctccttgctcctcaagcttgcagacagcctattgtgggaccttgtgatcatgtaagttaatacttaataaactcctctttatatatatatctatctatcctattagttctgtccctctggggaaccctgactaataaagaagaagaaaaacaaaccaggaaaatgaagaatttaccactgtgtcattccttgcgtttcaactgttctatcgagtctgcctcttctctttacctttttagtctcctgatgtttgttttgtgtataatttttaagatattaatatgtttattacatataatatcttaaggaattatatgttttacattatatgttttaaggaacatatattttaatgttttagggaattaatatgtttattacagatcatacaatttaattatataatacatagtaattactactatataatgtccaggatatttaattgtacttagctagaggaatatctactctatcttcttagaaatgcaagccctatgtgcttatttttccacacataatttgttgacataaaaatgttatgttttccttccactataatattttctatcgatttattcttatatttatcaaagtatttatggtatatgtttttgcataatactattgtgcacattaatggtcagaactaaaatatcattattgtggcagttactttttatatcaatgaaagagttcctatctatgccatttaatgctttatatactgaattctacattgtttgaaactaatgttaagtatttgctttgttctacttaatatatatttgcttagcattttatgttcatctgttcaccattactttggtttttggaatcaatcttgccaataaacaactttatttcagtttttacattcatttataatacacttacaatttacttacatttacattcaggtaacatccataaatgtaaacatgtaattttcataagccataatcttacttttgacacttttatggtttttttcatatagactgtttaactgtatattcttttttatcttttgtattttttgaaagcaaaaacacgttaaattttacaaaaattatttaatctatattactctattgagtgaattataaatttacttttaaatagtttttggtaattatacatatgatttttatattttgtttgacatttacattaaaagaacaaatggatgctaaatgctcaagctaaaaatctctaccttaaaatatcaaccttgtactgcattatcaatttgtttttctctgtgtgacagaaatattagttgccttacaagaatcttccttcttttttattaatagaatattggttttgtttaggaagtaaatgtgtccacttaaaaatactcatcaaaccagattccattctacctagtggtagtcatgtgaggcagttccagtcatagaagtctatcaagtaagacatttgcaggagctattatttcctaatataaaatgaacggacttcactggcatgtgatttttgttctcatcaatcccttttttctgccctaagcacattcttggatgtgaagttcattgcctatgagaggtagggggactgttcacttgctaaaggtggcagagcaggaagctagaataaacttggtccttcatgatttccttgagcaactacaaggaaggacttcctatatcctaactttctgtaacatgatgaaaataaaatccttgtttagatggatttctattacatgtaaacaaaacgcaatactggctgatagcactggtttcttgcccatatcactctgatctttaaaaagttacatatatacaacaatcaaaatataaatatatatccttctatgatatgattttagataactaagcacttcaaatttgtaaagttactttgatttcgtatagcaaagaagaacccatgcttcctcgtttttttctgactcaaaaaataaaggttagaaatcattttatgtcacaattaaggataaaatccttctggatatttttattgtgttataaggcacaagctttaattacactattagatttgtctcttttcaaatgagcatatgcttctttaatttctatattcaagctctccttgaatgtagaataccaattatataaaataattgtgtgaactcttacaaggctcattatttttctgttttcataatattcttatactcattaataagtgcaatgttctaaaacatatatttcaaacattactaaataattatctccatcggttcatatttattccttctcaagagttatttttgttgctgtaaattaaataaaatacaaaacatttcaatgatcaaagaataatcaaaagaactttgcttagtggaagtaatgaacacaaatttataggtggcctcaaaaattgttattcaaacagatttctttaaatcttcacaactcataaaaatcatgtcagcatttggtatgcctatatctctttaagtcttactccatttgtgttaccgtccattcatacttcttcacaatgattttctccaattatttcttcatttatgacattttcagtctctttctctttctaatcaaaactcatttatcctcagtttataaatatggtaaattatatatttggtaagttaaagtgaggcaagtaccacttcactttaataaatctttcataaattctatttcctatagttaaagctttatttttcttctgtccaaaatattctcagtaaaggttctatacttggcagttatatataacccaccacaatttcatgtccaacaactgcaagctattgaaattctaaagatgcgacatcctctttaccataaaaaattcttccaatatgtttttttcttttctatttaattttttttttactcttacctgctgagatcaattatcctttatcttcattggttacactgctttctacccacaaaatgagacagtgccccaaggttgtgtccttagttttcagcctttattgatccctgtatttacctgagagaactaggctttaactatgaccccaagcaaatactcctgaatttacaatcaagtccagaacactatttctgaatttttgtttttcatttccaatgtctagttattatttcttctttaatatcctgcctcaaagaagtatgaccaaacttatcttttcaccaaaagtctttaagtgctgccatttctgttaaataagttcttttctgtcccagttatccagcttcaaaatagtagaggagtatttccacacttattcttctcctctttccacactcagtgtgaaaagtacactcaaatctctgcactgtctgtcatttgtgatgcaatgttgactgcagacttgttgaaatcccacctcatgactcatttgctgtccaatattgggtaagttcctaaacctcactatgcttcattttctcctgtaaaataagactaacatttttccacatccaaggaaacaatgaggaataaatattcttcaaaaaggccttccccatccaccctagctaatgtagcccaaatctctacccctttcagtctgtgttaatgccttactttcttttctttagcaactaacactagctgacattttatggttgtttagttttatttttgtttccagatttgtctattctctgtgcctttcccttggacttaatgaggacaagaattttgtcagtattatttaccactgaatctccaagtcccagacagtccttttcatatattaggtactcagtatatacttggtgaaagaatgaagaaataaaatgtataaagcgcctaccacaatggcattcactgaatatgtgtctgtcctctacactgtgttctttcttctttattactggtatctgcctatatcaatcctaatcacatcattttgaacctacagtaattgatccccttgccctcatttggcttctatcctccattaatctgctagcaaaatgttgggttgatcaccttttaaaaaccttgtcaataccatttattcatagagcacttactatgagggacctaccctaattttcctactcaaataatttcaattaatcttcattatattcatcaagtctaagctctttagtaggtcatccaagttctttctcaatgcccactgcccaactttccattacttccttaaatgaatctgtcacttcgattatccttaaaagggtcatgcctgttgccacctttcattatgccatactacgcaactgaagtacctaagtgaaattctttatttagggcccaggttaagatatcagacttaaatactaccttgttttttatatttttaactattagtacaaaattattaccaaaatcctaaatttttaaaactattacaaaatcactaatatgtccctaattaaaaaaattatatgcagtaataaaattcttccaactttgtaattttcagtttttccacgcataatcactgttcaatgtttatatattcttttagatatactcactgttcaaaattatgttctattcttcctcaaaatttctacacacatatatgtgacttcacatatctttagaacatattacaaacatttcctgcaacttattgttactatatcttgtacctaatttaaccccctcttttgaactcttaaatgatttgttctaatatttattcatgtgttataaagaacgtttccttatgtttttgtaaatccacttaattagtctgtatccgttaacttggtatcaacttttcacaatcacttcttctaacattttataaatcaatagataatgatggttttatcttgtcaaataaccaaatcaattgtgtaagaattaaatattttatcttctaataataatctaagtcatcctttaacgctcttaaaaaacattaagtatttctcaatggagtctttcatataccaaattctgaataaattagagatttactttcaatttaaaaaacaaaaatttgtttctctacaatttgatcatttcaggctttgtttaatgtagttggcatgcaaacttttatcaagtttcagatagaaagacattacaaatatattcattggtttatattattttatataaatgatgcaaaaatattaaaaagtttatataatttagatatagaactcagaagctaaaatttcccttttatacatttaattaaaatgaaaccctaaagaagccaattacctttctcaaagctgggcagaaattaaagaaaagtcgatggttacatgctttgaatctttcaggaagatgccagttctgaattatttcttcatcagaaatcacatgatgatccagcgctttgagaggccatatactgttaacaagaacatgtctatatccttttttaaggcttactggacaatcaaacatagtgagggcaatgagggttggacaggcagataatacacatatattctttaactttgcaaacccattgtcatgaagatagagtagttttaggttcttcaatccattccaaaatttggtatttggtagactctttatctgaaatattattaaaaatcttttaaattccaaaattacttttttcgaatagcacagaaaatggtaaaatattacacatataaaattcaatattccccaaatagcaagtttctaattaataagcaaacagagtatttataattatccaatgatggccagttgaaaaccataatacactgggtatctgagataatttattattattcgcatagtaaaatgcataaccatacttttttgttcaaagaaaatttctttgtaataggttgactctttaaacttttctaaaatactttccttacctaaggaaaattaaggaatcatgaggcattcttaatccaggctatagatttaagaagtgaaacataccagattacacactatttatgtattttcatttacatcaaagtgtccgtatttatatacatcttacatgcttttaatttattgttaaatttttgtttatattttagacaaaagaccatgttgaagaaatactgtggataggtaacataagtacttattataagactgaaatttcgtttatatgcaaatatctgaaatggctattgcttacctgatttccatggagatcaagtttgattaattttatacaactttgaagtggatgaatatctgtaataaaattgtttgagaagatgcatactctaagagagatgcaagactgcaaattttccatagactttaaatgaaggccattgaacttcacaaaaacaaaatctttttgaccttctcttatgttttcattatagtgactccattcttcatgactggttagctcttctgtgactgttccatgaaacatctaggaaagataagaaagtgctttgatttttttttccactttcaaaaatttacctgaaaacaaacaaaattttgccaagagatagcgcaagtaaaaagtgttattaaagttaaaatttaaaaaaactcattcttatagaactttctatcccaaaataacttaaatatctaacatttcaataacagccaatcagaatgttatcactgccctcaccagtgaacgaactaattagcaagaggaagacaaacttccattttcatagaatatttgaaaaattcagtgaagaaactgagataaaatcatcccttctagacaagacaactaacaacaaacaaatgaaaccatactttatataactcgtatgataatttttgttaaaatatactgttaaagaaatacactgaataataaacaagtcaggagagtgataatctttgttaaagaggctaaacaatgcagccagataaaataaaggtgctatacaggccttcaaatgttatcaacaatatttgtgtcttacagagaaaatttgttgtcaaaatatttacattcaattcaattaggaaattaggctcagaattctaatagctttaaattttgactacttaaatttatctaaaatatttggataaatggtttttaatataattttacacagtatttctcatatatgtgaattttcacttattaagagtaatttcagctttcataaaaggtagtcagtgataggtgagaagagaatgtatgagctgaagtggtctatttggaagtatgttttaagatcaacattccccaatggaagaatcgatttctacgatgtgcagataaactaaatcagtgtgattcaaatgagaataaatgtgaaaatccagatacactcttgtactctttcaagacactggttactttatatatcacaaccaaggcctaaaactagaatcctccagctctaagtgtcaatgaattaattagaaggcagattcatgggccccatctcatatctactgtatcagaatttctgggctaagggcataggaataatgttaacaggtgatcgacgaacaccttatgaaagattagcctcaactacaagtaaaccagtcttaaaaatatagagtcagatatggaatacacagatataaataaacctttacaaattaaactcatgaagctctattggtgctgggatgtaggataatatacacatcatttggacttccaaaatagaaaagatataagtctttcctcatttaaagaaagcttaaatttaaggttcctccaagtctttagaaaaataactcattttttaaagtactgaataacattccatcgcatggatgcactatggtttggtttatttatccattcacctattgaaaatgtcttggctgtttccaactttacacaattatgaataaaagtgctataaaaatttatgtgcaggtttttgtgtggatatgttttcaacttacttggataaataccaaggagtttgtttgctgaatcacataatatatttcattttgtaaaaaactgctactgtcttccaatgtggttgtaccatttggactcccaccagcaatgaatgagagattttattgctccacaacctcaccagtacataatgttgtcaatgttttgattttggtcatattaataggtgaataatggtatctcattgctttaatttgcaattccctaataatatatgatgttgagcatctttcatacatgtggcttattagccacatgtatatcttccttggtgagttatctgttcagatcttttgtccattatattttgattgtggtattgtgttattgttgagtttgagtactttgtattacttcagataccaatcctttgtcagatatgtgttttccaaagtttttttttcccattctgtggcttgccttttcattttcttaattttcatttcatttttagctcataaatgcataaaaagtccttgaaagggccgggcgcagtggctcacgcctgtaatcccagcactttgggaggctgaggcgggcggattaccaggtcaggagatcaagaccatcctggctaatacggtgaaaccccgtctctactaaaaatacaaaaaattagccggacgtggtggcgggcgcctgtggtcccagctactcgggaggctgaggcaggagaatggtgtgaacccaggagcgtgcactccagcctgggcgacagagcaagactacgtctcaaaaaaaaaagtccttgaaaaaccaacaccgatcaacatggaacctcagagatctcatttcttcacataatgctaaaggtggctttatactgttaatcatggcattagtacacaaattatatatatgtacacaaaattatatatataattatatttaatatatagctatataaatatatataaatatttttatttcaaaggatttatttctcacattgattattccatctcttaacagtctattttgaaatttctttatgaagatattatcttcttcctggcatttattttcagggattctcaacagtgctattaatcaaatatagttagtaatgtctatagattcatccaccaggaataattgtttattttaaaccttctgcattaatgctatctatatgccatttgaacatgccaatgaactactaatggtattattccaaagtggagttttttctattttccttactgatctcagatatattagagaattttccaaaatgagaggttctacacttgtgtgagacattcaaattttagctattagatgaataaccttgttagtagctttgtgacattaacaaatactgttgtaatgaacctgataaaataacattgtcccctcccaccaaaattcttaaatatgttcaaatatttttctacataaaatttgtaatatataataagggaattggtatgattggcactattgcctcacttgaaaacttcttgtaaataagacatagagtttgaggaagaaatgaaatattggttcacacaaatccaaatttgggataatgctcatgatattacttaattcaatgccttttttttccattttgtacaacagtttacttttcagtttcaatcaaaaagatgtctattagaaaaaaaattgtaagaattaagtactagtgtaattaaggatatattaaattcaaatttgagatctttttgatgttacttaatgcagtgtcttttcctccattttgttcaactgcctactttttagctttaatcaatgactattataagcaagaaaaaaaatcactaatcatcagggaaatgtaaattaaaaccttactcctgcaagaatggccataattaaaaagtcaaaaaacaatagatgctgtcgtggatgtggtgaaaagggaatactgctggtgggaatgtaaactagtataaccactatggaaaacagtatggaaattccttaaggaactaaaggtagaactaccatttgatccaaaaatcccactactgggtatctatccaaaggaaaataattcattatataaaaaagacacatgaacatacatgtttatagcagcacaactcacaattgcaaagatatggtacaaacctaagtacccatcaactaattagtggattaaaaaaatgtgagagagatatatagatatatatatataggtatatgtttacacacacacacacacacacacacacacaccatggaataccactcagccacaaaaaggaacaaaacaatgtcttctgcagcaacttggatgtagcccagaaggctattattcaaagtgaagtaactcaggaatggaaaaccaaatatcataagttctcacatataagtgtgagctaagctgtgaggatgcaaaggcctaagaatgatataatgtactttgaggactcaagggtgaaggttgggagggtcacgaggtatagaagactacatactgggtacagtgcacactgcttgggtgacaggtacactcaaatctcagaaatcatcactaaagaacctatccatgtaacaaaatagcacctgtaccccaacaactattgaaataaaaattaaaaaacaacaaaaaaagtcaaaaaataacagatgctggtgatgtggagaaaaaggaacgcttatacattgttggtgggagtgtaaattagttcaaccattgtggaagacagtgtggcaatttcccaaagacctaaaaacagaaacaacatttgacccagcaatcccattactgggtatatacctaaagcaataaaaattgttctattataaagacacatatacgtatgttcactgcaccactattcacaatagcaaacacatggaatcaacctaaatgcccataaatggtagactggataaagaaaatgtggtacatttacaccatggaatactatacaaccataaaaagaatgagatcatgtcctttacaggaacatggataaagctggaggatattatcctcagcaaaaaaatgcagggatagaaaaccaaatactgcattttctcccttatatgtggaagctaaattatgaaaacacatggacacataaaggggaacaacacactggggcctactagagggaggagagtgggaggagggagaggattaagaaaaataactaatgggcactaggcttaacacctgggtgactaaatcaattgtacaacaaattaccctgaaacaagattacctatgtatcaaacctgtacatctatccctgaacttaaagcaaaaatttaaaaaatccaaactattaagaaccctggcttcttagttaatgaaatgtgctaacctgctatcttaggatgttacacttctctctcagtgtaaccttctttggcaaattattgtctagtcattatttagactctgattctatccacacatccccaatttagtgattacatatttatatatgttattatttaatggccctgttttccactaaattatatgtaccctgtgaacagaaaacttgttttatggttaggtagtttttcaaatttttccataggacctgaactagaactgagtcaggtttcaataaatgtctctttcatacacatgtctgtcttttcctttcctcagagaaacagcaaactatggggaaggaacctgtaaaagacttctaagtacaaatgacaaagtctctcccatttcggtagaaatctattgtaaattcctttatttttaattctccacagccaataatcacttgcaaaacaacaaaaaaggtttatttttcaattatttatgtagtgtaacaaatcactccaaaatttattggcttaaaataaccatcattttgttactctgaagattctgtgtgttgactcagttgaagtaagcagttctccaactgacagtggctgaagcatcagttagttcactcctccagtgaactgctggaaggttaggttcagctggaatgctgagatgaaccagtctttctttccatactgtctcaggacctctctatgttgacctgtcctctccatgtcatctatccatgtgtgtctgaaatagggtagccagactttctacatgcttaagggctcccaaagcataaaagcagaacctgtccaaacttcctaaggcttaggttcaactgaagcgtctcctcagccacattctactggttacgacaagttcattttatttttcaagcaccctataaactaagtacagaaaaaggaaatgaaatgtaagttgttctgagattggtgatctcaagtaaattatgtatgctgtgcctcagtttccttatctgtaaaaagaagataataataacagcccatagaatttttatgaggacgaaataagtcaacctaaagggtttagaacagtgtttggcacttaatgatatggttgggctgtgtccccacccaaatctcatcttaattgtagctcccataatttccacttgctgtgggagagacccagtgggagataattgaatgatggtggcagttttctccataccgttcttgtggtagtgaataagtctcatgagagctgatggttttataaggggaaacccctttttctttgttctcattctctcttgtctgctgccatgtaagatgtgacttccaccttctaccacgattctgaggcctccccagccacatggaactgtgagtccactgagcctctttttctttataaattacccggtgttgagtgtgtctttatcagcagcatgaaaacagactaatacagtaagcactacaaaattaattgaatgcctagttccattaacaattcaagataaaatatatgcttcaaaaagtgtatcaagggacctgcagtttccagtatggcatgtaaggagcttggagtagtcactccatcctaacaacacattagaaagctgaacaaactaaaaatcaacaacttttcttagctacacaaagtaaggtcatagggtaaactgctgaccacaaaattggagcaacagacaggcagtacagaaactcatcaggaacagacacacagatgtcagggatgttggaaatatcagactgggaattgaaaacaactaggattaatatgctaatggctctaatagaaaaagtaggcaacatacaagaacaaatggataatgtaggtagagagatagatattctaagaaagaataaaaaagaaatggtagagaccaaaaacattataacagaaatgaagaatacctttgaagggctcattagtagatgggacatgactgataaaagaatctctgactttgaggatatgtcaacaaaaacattcaaaactaaaaaccaaagagaaaaaaaaagactgaaaaaaaacataacattccagaagtgtgggacttctaaatgtgtaacatacgtgtaataaaaatgccaaaaaaggaaaaatagaaaggaataaaagcagtatttaaaacaataatgaatgacaatttactctaacatcggacactaagccacagattcaagaaacagagaacatcatgtaggataaatgtaagaaaataaaaaaaaaacaacctcacacctagataattaatatacaaacttcagaaaatcaaaggtaaaaaaaaaatcttggaaaaagccaaagaatttttaaaaaatcttacttataaaggatcacagataataacgacatttgatttatcagaaaccatgcaggcagaagatagtggagtgaaatatttgaagtgttaagagaaaaaaaactcactgacctagaatttataaggggaaacccctttcacttggttctcattctctcttgtctgccgccatgtaagatatgccttccaccttctgtcatgatgctgaggcctccccagccacatggaactgtgagtccactaaacctctttttctttataaattacccagtgttgagtgtgtctttatcagcagcatgaaaacagactaatacagtaagctctacaaaattaattgaatgcctagttccattaacaattcgagataaaatatatgcttcaaaaactatatcaaggacactgtatggtgcaaaattattctttaaaagtgaaaaagaaataaattctgttagataaatattgaagtaatttgttgttggtaggcctgccttgtaagaaatgttaaaagaagttctgagagaagagaaatgatataggtcagatactcatatctatgttaagaaagagtgttgggaaaggaacaagtgaggataaaataaaaatctcttatttttcttattcttagttgaataatttgtccaaaataataatagcaactagttttattttaattcatccaacaacaacagaatatacattcttttcaagctcacatggagcattcactcaccaagacagaccacattctgggccataaaacatgccttatcaaattcaaaagaacagaagccatgcaacatcttctctcagaccacagtggaattaaactagatatcaataacaggcaaacagctggaaaattccaaaatacttgggagatttataaacacacttctaagtaacacataggtcaataaaaatttaaagatattttgaactaataaaaataaaatgtaaaatttagcaaaatttgtgggatatagtacaagcagtgcttaaaaggaaattcatagcactgaatacatatattagaaaagagcaaagatctaaaatgaatcatataagctgccatttctagaacttgaaaaagagcagcaaatttaatccaaagtaaatatgagaaaatttttctcatatttttcaagaaaattgtaattcttaattatattctcaaatattctgggaggaggggcatattttatcatcatctcattccagaagagtccataaagatctatagtctctataaaaaataaatactctactcagattatatgtaggttcttctacaatgtaaagcatctaaccattaacctgtagttcacatgtttagtgaagagtggggaggtctttccatatactcactgtggttacttttaccatgcaataataaatctcactccaaaatgtatcctttccttatctgttaggacattcagagttaatttttttccaacttttattttagaatcagggagtacatgtgcaggtttgttacaaaagtatattgcataatgctgcaatttggagtatgaatgaatttgtcacccaagaagtaagcatagcacccaacaggtagtttcttttcagcccttacctgtcatcctctctcccaattcttgtattcctctcaaataccaaatcttatccgaaatatgtgtctaaaaacatatttttcagttcctctttactgatttttgtttcatatgtattcaatattttaaaatcttctcaactggtttctttttagttgatgtgatatgaacactaaaataatttagtcttataagcagtcttccccatacactatattaatttacattcattttctctattaatattcacctctgccaacaatatgtatttgccagtatataaacaaccttaatatttttaaaaattacaaaacagaacataataatactggttattgctattaaaaggaaagattaacatgagtaataaattacagaaaaaactagtattctatattcagaatataacgtatgtgtcagttatttatattattcagctacatattctgtcgaactttccaatcattatggaaaagtggggatttttcatattttgttttaactaccacatgcagcatttcaattttgtttctcattatttatttatgttgtacatctgaaaactggaataactcaaatgaccaggccccagagcatgtcccctgaatcatatcattgcagctatgggcccatatgattctactgcctaccaagggaagctaaaaaccactacaattgatatatcctcctctaccaagttggaagccctttaccacttgttgcaaatttaaaatatgcacatagaggaggaatctagtcactttcattcattttagactttgataattttataactattttgtgaaatgtatatacacatttgtaaattatcaagttcaaataataatataatgttcaaaggcaaattaagtatagcaacacgttacagaacgtatcaagtctccaaccacagtttcaaagaaattctgcagttaaaaataaatcagtaccattatcagcaaacctttccttagtttgtatcaactaaagtaccaatttaaaaattatcctacattttaattgcactatataaaccatgtctataaaataaaatgcacatcagttatatctcatcttcacacccaactttgatggcaaacacattaagtgtaactatacaaggttataactcatgaatatttaaattaaatattaagaagtaaaaactatttattttgtatatttatttcttttccaaatgtgatacataataaatattgggaaaaaagttttcaaagaaagtctttgctgagtgtactaattacctttagacttaacacttattcactgaagctttcagatacttggaagacagatcatcattattttaagtaatatattaaaatattagatttgatggtctacatgaaagtaatttattttataagcatgaactataatattagatggaaatctgaatactagactccagaattatcacaacagctgttatctgcatataaaatcaaatcataaaaaaagaataaaaagtcttagtttttagaaaatctaattgtaaggattctaatcagtaacattttatacatattgtgattacaaactatttttagtttagaatgtctgcaacatattaagtgcatctctattaacaaaataaagaaattatattttttaaatactttttatttggataacagatttgttaagtaacgactgttttaataaagaattgccatgggccggtgcagtgactcatgcctgcataatcccagaactttgagaggccaaggcaagagaatgcttgagtccaggagtgagctatgatctgccattgcactccagcatgggtgaaaggttgtctctaaaaataaaaatcctgtctctaaaaatataaaagaattgccataattttatatcacagaaaaaatatattttaaaagttaagaaggggagagtctagtagaacagtcagactagtacatgtgtcctggaaaatgaacacagaatatagtgcatttataacttaatataaataaccttggtagcacaaaacattatattttcatggcatattctatatgttttcaaatgacatgaaaagtcattcagaacaaggaatcagaattcatttgtaattataactttttttctttaaatatattggctttttgaattttagaaggttatatacttctgttcagaaaaaaagcttttgtgagacctcatttttcaatttttatttttattccaacttggagactgcaaaagcataagcctgaaaaaactaaaaggtggtgagccagaagatggatattaaacagccaaaattaataaaaacattcacagaaaataatctgcacagaaatcacaacctcttaataaagaaattagcacgacaaatatttcttctagcccaaaacattccttggttagctttcatagaacagattttggatctcctaaaattaagccattaatacctttttcttaagtgtcataaatattgtattacattaattaaaatttaattcttgactctactaatttatattcttcaaccacttgccctctccctatccctttcccctccccgaaacctcatcctggtatttggacaaagtagattatgattacactactggggaactccatttggaaaaaaaatctacaaaaatactaagggaggaagtataataaaagttcaggggtgggagaatgtttctctgcactacagaaagttgaggggtgtgagggttcctccaacagggcatagtgagaaaaaaaatatttaagaaataaattgagaacaggctagctgagtaaataaatcgaaataaaacaaactgcaaaaagacaatttttgctttcgttgcatgtcaggaagggtaacaggaggaaacagtggttaaacagagccatgaagcacaaggactggaaacaagtacagccctagcttggcctgaccacagcatgcactacgagctccacagtatataatccaggaccctattcatttggcttcaacttcctcatataaagaaggggggaaaattaaaacattcttctctataatttccacacaacagtcatagttatatgcctgtagtaataaaaaaacagtgtaactggcattaactgtaaatgggttggaagacattttaatggggggatgaaaatgttctaaacctgtacctcaataaagttgctttaaaaaatctatctcattcttccttatggcagctcttcagatactctctactctcctcctggaaataaaaagcccaaatgcctccacagaatataatttttcaatttattatagtctagtatgttcaacatctttttaaaaatgtggaatccaaaactaaacagattatttcctgtgtgtttgatttgtgcagaattaatgggcttacagcttggctggattgatatattttactctggtaaaatgacattctgataaatacctggaaaaactctgtggcgaattctctagtataataatactctggtagcttaagatgttaaacagtcatatcacactgttttattatagtgaatatgaacttaaataaaatccctaaactttttttgcctccaacaatcaactgccacggaaatttactcctactcatatatatagtattttttaattttttttttactaaaaattaatattaatgaaaatttgagaaaagaaagaaaacagaagccatagctgataatatggtatatttatttccagcaaattttgattgcatgatatagtcatattgagaaaaaataatatccaatttctatggccatccttcccagatccaagaaatactctaatattctgtatgataccgtcctagatccaataaatactctatttaatattctgtatgatagaatctaacacatcactctgtttgtctcctcacaattgttaccactggattttttatttggttacttcttccttctttatttcaccttattagaatatacagaccccaaacatataggctctgctgaccttcactcccttgggacctcacttagttccacagttaaaattaattctatcttcttgctgacaattcccaaaattgtatctctagcccagacctctctcctgaattctagactcgtatgtataatgcatacagacacatacacacacaaacttccattacatattcactgcatacacatgtctctttattccacatgtccaaaatcaaattctggaccctattaccccaaaaaccttcctcagtcggaaacttacccatcttaattgatggccaatccatcccaaggcagtcattttgactcctctttttctcttacagtccacacccattaattccatcagcacattttattgtttttgtcttaaaaatatatccagaatctgaccaacttctcaccattcccactgctaccatcctggtcaagccttcaccagctctcacctgcaatattgcagtaacctccaaagaagtctccctgcttctatcattgcctcatcccccattataatctattctcctatctccgagtgatctctttaaacataagccaagtcacttcaaaaccctgcaatggctttgtttccctcaagagtaaaaaccaaaattcttcctatggccctttgttctctctctgaccttctctcgctactttctcctttggttactttcactcaagtctctgtattttctaaatgttcttcaataagatactgtttttttaattaatgaagttttaaatgtaaaactatgaaagagtaatctaatctgccattttatccaaatgtttccactattagaacacgattgtataacaagtctgagaagaaaaactaagtaaatttatgacaagagtttatggtgccctgaatgtctacgtacctaatgaagacgttgatacagagaaatcgtctcaaaaaatcaaacggtatggtgaaataccacaagttctgggtttgggattgaaatatatttcttaaatcttttattacttactaattgtgataccttgactaactcactattctctgattcagttttcttctgtgtaaagatgaagtggtctgtaaaaccaagaaacctcgtgttctataacaggaacacctttatatagctacccaaaaaaacacctaaaaaggctgacttattcctaagagtgttattgaacattctagattaatctgcatatacaaaagaatgccagagaagaaaccaaaataccaaaaatatttggagcctggttgcggactgaattttatacaactttcaaagacactatttgagaggctgtcgtgtgtagcctactaagaaaaaacagaggggtggggtggctcactctctaggaaccacaaacttaaggttcctagaaagagcagagattttaaatattcagactgtgtatgtatcatgacccagggttgggggcagatggcccggggtggcgggggaaaggagagatggcggagatcttctatcaggctatcctggggaactgctccaggctgaaacaaaccaccagttaggacgaaccgcctttgatgtgaaagctgggaagctagaatgtagtttcgccttatccttagcgggtcggttctaacaattttgtcacccaaactgaaccactcaccgggtcaactgggctgcaagcccttatgagttggagacaagtggcccagccccaacacagtcagacaaatcgctgggcggccatctgctcctgagaccgttgctagagaaacaagacaacatccaagttctccacatcatggttttccgggcgccagccaaggcgctccgggggcgtggttacgtgggcgac

SEQ ID NO: 395 - DNA, 66859 bp, Homo sapiens
cgcaggcggaagggcgcggaggaggtgacgcgataggccagcgccggcgtcgcggcagccgcttcagaggaagctcggcggctgtggccgcggcgaacaggccggacgcctcgtcgctggcggggcttcccttggagctgacgaaggcggggtccgcggtccaggctgctgccgcgacggggccggcggcggggcagctgccaggaacgagggtagcaggtaagcggggacgcgggcagacgagtgacggactcagcgatcgcctggcggggctggctggggccattcccgcgccggtgcgccacctcagcgcccggtccggaggcctcgagccgccctcccccgcccgagctggaggccgccgtccgtctcggccacagcctccctttccgggggaggcgagcgagctcgtcccgaggggccgctgccctgcgctctcgctccagccgggctgtgcgtcgcaggcaccgggaagctggcgccccccagctcctcctgaagccgggaaagctctgagaggaggagccgctgtcacaggcctccagctccggccgccgtggaagtccggggtttttatttgcttagaccgctctgcctccttccggccttcgtttctttcctcgcgctccccgggacccttttccagagagcccggttgggcatgagcgcggtgggagacgtcttttcccttcggtctgctctgagcggtatcagcctccgctctacgccctgtggccactctgtcggggtggagggatgcggagaggatgtgggagttttggacttagagcgagaatagccgaggtgaaatcctaccctgctctctggtagtgtttttcatctcatgctagatagacatttcgacctttttcaccgcaggtaaagtgggactttcttctaccaatgtaaattataatgtttggagaattaaatgaagaaagcagacgttagttatgaaatgttttgagaatctggttaaatttaatttaagaatatccaggacacttcatgataggttcctacttatgttttttttttgcattttgcccggaataactaagcttggtatggaaaaggttgcctagagatgccaggcgctcgtgtggtcagagcctaactgcagtctctgttttgggtgggcagcatcaggaagaaaccagactctctcctagccatccacatgtctcacgcttattgatggcatattattggtatatgagggatggcttatatcagttttgatctttactcaagatagctttttcccagtgcatcttttctaggagaaaagcttggtatgtagaggagggtgctggggaggggggcttcatttacacctgggctcacaatttttttttggaggggggacagggtctcactctgacacccagcctggagtgcagtggcgcgatcttttcagctcactgcaacctcctcctcccaggttcaagcgattctcctgcctcagcctccagagtagctgggattacaggtgcccgccatcgcgcccggctaatttttgtatttttagtagacatggggtttcaccatgttggccaggctggtctcgacctcctgacctcaagtgatctacctgcttccgcctctcaaaagtgctgggatcagccgggcgcggtggttgacgcctgtaatcccagcactttgggaggccgaggcgggcagatcacctgaggtcgggagttcgagatcagcctaaccaacatggtgaaaccccatctctactaaaaatacaaaattagccaggcgtggtggcgcatgcctgtaatcccagctactcggaaggctgaggcaggagactagcttgaacccgggaggcgaggttgtggtgagctgagatagtgccattacactccagcctgggcaacaagagcaaaactccgtctcaaaaaaaaaaaaaaaaaaaaaaaaaggtgctgggattacaggagtgagtcactgcgcctgggctatattactttctaaatcagcctttttttttttttttggtaggccattatgtgaatccttcaaaaatcatagaaaaattgaaatttaacaatattttgcttttattctagcttgtcataaacccagtgctctatacacaggcctgcctttctgcctccttcatcctggcatgcatggccatttactttgtgttattagccagcttcctatggagctcagtttgagaacggggttctgtgcttctctagttgccaaacatctgattgaagtagatcaccttggcatttgcgatattaagcatgtctttgcgaatttttagttcctttttcttttcttggttagattgtactctgtcactgatttaaagaatttggtagacgctcagaaagggtcaactggtaaggtggtcacagtgctttacatgtatttttcttacctattatggtgaaacccttgtgactttttttgggcgtgggtaatattttcaaaattaaggtaaataggccatcaggctgcgttgaactttctcttttagggaaatatattcattctccaattattctttggtagccttcttattgctttagcaattcctactctattattagtagagccggaaatggaccctacatcacagattctccaaatatactaaattattttttctctaaaatgatcatgtttatagcatgttgattttctttttttttcttttgagacagagtttcactcttgtgcaggctggagggcaacagcttgatctctgctcactgcaacttccgcctcccgggttcaagtgattgtcctgtctcagcctcccaagtagctgggattacaagcgcccaccaccacgcccggctaatttttgtatttttagtagagatggggtttcaccatgttggccaggctggtcttgaactcctgacctcaagtgatctctccgtctcagcctcccaaagcgcggggattacaggtgtgagccactgtatccggtcagcagcatgttgattttctacaaccagatgacaaaggatatcctaaagtcagtgatttaaaaagtcatgttggcttggtgcggtggctcatgcctgtaatcccagcactttgggaggccgaggcgggtggatcacgagtcaggagttagagaacagcctggccaacatggtgaaactccgtctgtactgaaaatacaaaaaaattagctgggcatggtggcgggcgcctataatcccagctactcgggaggctgaggcaggagaatcgtttgaacccatgaggtagaggttgcagtgagccgaggttgcaccattgcattccagctttggcaacagggtgagactctgtctcagaaaaaaaaacaaaaaacaagtgatggtaacacataggttgtctaatacattcagagtctagagagacctggtatgtatctgagaaaccaaatagctgaatctctaaaattttatttttgtgtctggaataccttaattctgaagttttagttgttgttgaatttcacattctgacaggagacaagtagaggtacatgtgaagggttagtatgaacccagggttacagtttcaatctaaactgatactgcagagttaacattgaaacaaagcagctctagggagctggcaaaaattgaaggttagaagtcacttgctggctcttgaggcagtcttctgactctgaaactacttgagactaaaattttcaagaattttttaacttaattttgtaaagatataatttacggcctggtgcagtggctcatgcctgtaatcccagcacttagggaggccgaggtgggttgatcacctgaggtcaggagtttgagaccagccaacataatgagaccccatctctactaaaaatacaaaaattagctgggcatggtggcacacactcgtactcctagctactcaggaggctgaggcaggagaatctcttgaacctgggaggtggaggttgcagtgagtcgagatcaggtcactgcactccagcctgggtgacacagtgagactccatctccaaaaaaaaaaaaaaaaatacagtcaaatacatagaccttaagggtttttattttttaaagcatatgtacacaaaatggaagacagaaaaatagcaaaacattttggaagctggaatgcagattgatttaagcagtctgcccgccttggcctcccaaagtgctgggattacaggcgtgagccaccacacttggccgatataactttttcgtagtgaagcttcagttaacctgtacggtggctgcgctgtgaactttcacccaaatattgggctccttaaggggctgtttaggcttggggctgtcctagggtcggtgagtatctagtaagagtgtaaaccttctatttcccttgtgtgcgtgttttatctttgaaggaatgttgatatttggtcagtatgaacatacagcagcatggctgggaatacaggggcagaaatgtaaaggaaacgcatgtgaagtttgcttttaattactggaccgttgtattcaagaaccttcaatggcagtatcttgtctttgctccagggtcagattccctaaagaagaagggatctcctacttggagagtacaaattgggcttccagcagtctggcttctatacttagggaaaggctggaggtcttagtattcgttatgtaaacactcattcttgttcatttaactcaactattttcagtaagatgacctcattctcaactggaccagttgaaaagctttccagtccaggaattctttgtttttacataggattgttttaagctgctacgtgtggttagtggctaccatattggatagcggagctgcactatccagtgtggtagccactagccacatgtagcagcctaaatctaaataattaaaattaaaggtttagttcctcacttgcactagacatgtttcaagtgctcaatggccacatttgcccagaggctaccgtattgggcagagcagatatagaatatttctgtcattgcagaaattttattgggctgtgctgttctagtctagagaagaagactccaggtgtctgcaaggatgggtaggggacagttggctggttttgtggcatgtgggaggatatttaaatcatttgaccaatccttttatttttagcgtcatattcatattcacatccctctgtagaacaattcctgacctgttttgaggtattgttctttagattgctttcctccctgcaagcttgagatttaactttttttttttttttttttttggagacggagtctcgctctgttgcccaggctggagtgcagtggcgtgaacttggctcactgcaacctccacctcccaggttcaagcaattgtcctgcctcagcctcccaagtagctgagattacaggcacatgccaccatgcccggctaatgtttgtattttagtagagacggggtttctccatgttggtcaggctggtcttgaactcctgacctcaggtgattcgcctgcctcggcctcccaaagtgctgggattacaggcgtgagccaccgcgcccggccccagccgagacttaacgtctttagatctttaagtcaatccacattccaactttcaaaatgtttttgctgttgttcggtgttccattttgtgtacatatgctttaaaaaaacaaaagcccttcaggtttatgtatttcactgtaggtaaattatatctttaaaaaattaagttaaaaaattcttggcagccgggcgtggtggctcacgcctgtaatcccagcactttgggagtctgaggcgggtggattgcgaggtcaggagatcaagaccatcctggctaacacggtgaaaccccatctctactaaaaatacaaaaaattagccgggtgtggtggcgggcgcctgaagtcccagctactcgggaggctgaggcaggagaatccttgaacctgggaggcggagcttgcagtgagctgagatgtgccactgcactatagcctgggtgacatagtgagactccatctcaaaaaacaaaacaaaacaaaaaacataatttaattttaattagttatttaggaatgggtcttgctgtgttgcccaggttggtctcaaattcttgacctcaaaggatccttctgcctcagcctcttgagtagctgggattatagacatgcaccatggtgcctggctggttttttcttttaaaaaattaatttattggctcacacctgtaatcttaggtactcagaaggctaagtcaggaggattacttgattgagcctgggagtttggggcttcagtgagccatggctgacagaatgagaccttttttttttaaaaaaaaaaaaagataaaggacaatttttttattcttaatgaagttttaagagggaatgatggtaaaatgtgtctgcttaatctgcagtctttatccagaagtaaagtgcttcatcagaatttaaacatgtataagaatctccactaaaaaaatgtttgagctttacccaggcttcttgaacaatttttatatatcgccttttttgttccaccttggtttttgtcctttccattgtactaaaatttctcctgcaaatgtcaagagaattcagtgaacacttttaatccttatcttgctcgacttctcaacaacctttaactgaccatttccctctttttagaaacctgttctagctttgctgataccacctttacctgatttttgaccttatctccctggtcattttttttcactttcctttgcttagtctttctttatttcttaaatcctggagttccagctgggcacacctgtaatcccagcactttgggaggctgagttgggtggatcacctgaggtcagaggtcgagaccagcctgaccaacatggagaaacccggtctctactaaaaatacaaaattggctgggcgtggtggcgcatgcctgtaatcccagccacttgggagcctgaggcaggagaattgcttgaacccgggaggcggaggttgcagtgagctgagatcgtgccattgtactccagcctgggcaacaagagtgggaaaaaaaaaaaaattcctagagttccttgggctattgccctagggtacattctctcattctcttctaccttttacaaattctttctaggtgatcttatcattttctatagctttggttactctaagctgaaaactggaattcacatgatgtcctcttttcagaattcttgaactgtatatctagctgtatatatccacttggacttctaatggtcatctcaaattgaacatgtgaaagactaaaggcatagtcagtataaccttcccctaatcgatctccgtctgtgtttcgtatcagtgataccactatctacctagtagctgatactggaacatttacccccaacagataggcttttgacaaatgacaagtcctgtcatttctgtgtcctgaagattgattcactttgctacatcctcccagtttttctcttaatccaagaagctgtcccactgtatctgcattgatttacctgtaacagattcctaatgggtttcttctgctgtggccttctccttgccattctgcacattgcaggtagaatgatttttttcaagaatatgaatcagatctttgtctttcagtggcttcacaccaaccttatgttaagtgtcagcatcgtgaatttagctcttctgttcctcatctaccccttccgtgcctctaagtgttactgaagttctttccattccttgaaatactgaattccctctctttcctaggaactcttgctcatcatttgtctcagctgaaaaataatttcttcagagaaaaaataatttcttcagagaggtgtttcctgacccttttgccagatatttccattgtaccctgaatttgactttttttaatttttattttatttttttatttttttgagacagggtcttgctctgtcacccaaactagagtacagtggtgtgatcatagctcagtgaaactttgacctcccatgcccaagcgatccttccacctcaccctcctgagtagatgggaacacaggcatgtaccaccacttttggctattttttttggagacaggatctccctgtgttgcccaggcaggtgatcttgaaatcctgggctcaagcgatactccacctctgcctcccaaagtgctgggattacaggcataagccaccatgcctggccaatattggcagtataccatagtaagcgtttatttgaattacatgtttatttcatattaagaagtttgtttatatagaagtgatttttccactgataaagtaaaatatgatattctaaactagaggttcccaaactttctctgtttacaccctccttaatatattttttacatgtccctaagcttaacagtttgatttattaaataattaggttcagacagcttaagaagtatttatgggccaggcgctgtggctcacgcctgtaattccagcaggcggatcatgaggtcaagagatcgagactatccttgctaacacagtgaaaccccttctctactaaaaatacaaaaaaaattagccgggcctggtggcgggcgtctatagtcccagctaggctgaggcaggagaatggcgtgaacccgggaggcggagcttgcagtgagccgagattgcgccactgcactccagcctgggcgacagagcgagattctgtctcaaaaaaaaaaaaaaaaagaaaagaaaaaagtatttatgttctttcaacctaattgacatctaagaaatacacaaattggaagacaaagtcagatagatgtgatggctcgtgtctataatctcagctctttcggtgggcggatcacttgagtccaggagtttaagaccagtctgggcaacatagaccgtatttctacaaaaaaaaaaaaaaaaattgccaggcgtggtggtgtgtgtctgctgtagtcccagctactcaggaggctgagggaggattgctggagcctggaaagttggggcgagctctgattgcaccagtgcactccagcctgggtgacagagtgagacactctcaaaaaaataagaaagagaaagacaaaattacattttgatttcattcttaaataaccacagttatttaccgtatatacttgttgggcactacaaaacccaaaccgtggaatcatattggactctgccacccacattgcttactttttaattaaaacaaatttgcttttggctgggcatggaggctcatgcctataatcccagcactttgggaggttgaggtgggaagatcgtttgaggccaggagttcaagaccagtctgggcaacatagtgagaccccatcttactaccttattttattttttttaatttttaattttaaatatttatttagagatggagtctcactgtgtcacccaggctggagtgcagtggcatgatcttggctcactgcagcctccactccctggttgaagcgattcttctgcctcaggctcctgagaagctggccattactggtgcccaccaccacacacggctaagttttgtatttttagtaagagacagggtttcaccatgttggccaggctggtctggaactcctgacctcaggtgatctgccctgctcgaccttcaaaagtgctgtgcttacaggtgtgcgccaccgtgcccggccactatctcgctattttaaaaaataaataacatttgtttacatctttgttttctccactcattttttgctctaaattgatatttgcacagtatttttttttaaatcacagcaaccaatagatactcagctttgcaaagattatgatatcatcaaaaggaacatagtgtgatctattttgaagctgaactgtcttgaactagtagtttataaggtgtttgacaagtatagaagattactttttccctgtaatttagaatttcctgttgtgctctcgtgagttctctacagaatcccaggttgccttgggcacagtttgggaactgtgatcctaaacttttgatagtttggtgtatatgcttttagacatttttctccaaacattcaagcatatgcatatatttttccttttaacaaaagtgggctggtacatattggtcagcaacttcattttttccattcagcagtgtatcatggtaaaggtggtggattgaatatatacgtttaattttatgccagcctgaaaatttcattaaaacaatggaggacttaaaaaccctctagataacaaagaacaggaacaatgagaataacaacaatatcgtgaaagctggaaagcagaaaagactaatggcaactaattcgccaacttgagaaagctgtatcctaaaccaacagtggagagagccttcaaatagtcatgttatgttaccaaaccctttaaaagtctcaagattagctgtgtcctgtactgtggaggtggaggtgggacagaaaatatgaggagttgtttgaaagtctgtttcagaaaagtttccactcctgacctccctttcttctccccgtagacataaatagggtaactagagacttactatctggagtagaaaacgattattatctggactgagggataccatgcatagttaaggataaggtactgtgccttatagtggaaatctatatgctgaaggtagaaacctctagctttttttcctgacatagttctcagaatcttgcccctttctgctgtttcccattcaccaaaagcagcctctttcaagtctttgaggtattgttttggtataaacaacatgtctttaaattacctttttatttttatattttatgagatggagtcttcctgtcacccaggccagagtacggtggcatgatctccgctcactgcaatctccgtctctcgggttcaagtgactctcctgcctcagcctcccgagtagctgagattataggtgcccgccaccatgtctggctcatttttgtatttttagtagagacaaggtttcaccacgttggccaggctggtctcgaactcctgacctcaaatgatccgcttgcctcggcctcccaaagtgctggtagtacaggcatgagccaccatgcccggcctaaattacctttttataatgtaacttgtgattacttagtttatgctttatctgttgacttgaagatgaagattgttcttttttacatctgttccccacgtctgtgtacttgcatacttcttatcttccctccaagataccactgtatcttcccactatagggatgctataaggggcagtattaccattccaggtgagataattcttcattgttgtgtttattgcatgatacttagtatccttggaccccagcggtaaatgtcaataccaacctgaatgtattacagcaaccaagaatttcccacacatttccaaatgttaggttgaggtggtatggagtatctggttgagaagcactgggttagatcagtgtttagcttattactattatgtaaatggtagtcatagttaagccatgtagtataccaaggtttacaaccactgttttccctttcttgtacatttttctgttgtccctgaaattaattgtctttatcttttgtttagtgttctctgtacctactactaactgcaaactctcttctggttgtctgtttctcctttatttgctttcatacactttagaaattctatcaggatcacattcttggagccttttgactgacttttgaccgctcccttctggattggtggccctccaggcttaaggcacattgtcattctgcatctatttttactgttatctttagtattctttttgcctgactcttgtttttggatctcatttcctgcatcctgtgtattcttgacttactcccatatttgccagagtaccttctcctgtgactctctgagaaggatgcatgggaggtaaatattttgataacttacatctctgtaaaccttttttgttagttgttatgttagtttcagtctgtcattttgtggtactttctgggagattgctcaaaattttaaatgttttaatgttttacttttaacttcgaaataacttcaaatttaccgaaaaaaattgcaaaatattacagtttttctatatgcttcacctagctttgctccgaagttttgtttcagttttttttgtttgtttgaagacatggtctcactctgttgcccaggctggagtgcagtggcgtgatctcggctcactgcaacttctgcctcctgggttcaagtgattctcctgcctcagcctcccgagtagctgggattacaggttcatgccaccgtgcctggctaatttttgtatttttggtagagacagggtttctctatgttggccaggctggtcttgaactcctgaccttagttgatccacccacctcagcctcccaaagtgctgggatcacaggcatgagccactgtgcccaaccttacttcagtttttttaaggagacagagtcttgctatgttgcccaggctgatcttgaactcttgggctcaaacaatccttctgtctccgcctcccacgtaggtgggtctacaggtgtgcaccactgtacctggcctctccaatgttatagaactgcagcacattgtcaaggccaggcaattaacgttgagagaatactgctaactgatctgcacaccttattccaattttgtcagttgtcacatgacttttctttttctgaactgagactcaatccaggattataccttgtttaattgtcgtctccttaatctcagtctttcattctaggacagtctgtctttgtctttcaggactttgactgatgtgattgaagagtattagccagttattcttttttttttttttttttttgagacggagttttgcttttgtaccccaggctggagtgcaatggcgtgatttcggctcactgtcacctgcgcctcctgggttcaagcaattctcctgcctcagtctcccgagtagctggattacaggtatgtgccaccgtgcccggctaatgtttgtatttttagtagagacagggtttcaccgtgttggccagactggtctcgaactcgcgacctcaggtgatctgcccacctcggcctcccaaagtgttgggattacaggcatgagccaccgcgcctggcccttttccttttttattttttttttgagataggacatcactctgttgcccaggctagagtgccatggtgcaatctcagctcactgcaaccacaaactcctgggctcagttgatccacccacctcagccttctgagtagctgggaccacaggcacatgccaccacacttggctaatttttatatttctttgtagagatggggtttcatcatgttgcccagagtggtctcaaactcctgggctcaaacagtccacccatctcagcctcccaaagtgtgagattgtaggctgagccacagttccctgctggttgtttttaatattttgctattataaacaatgctgcaatgaatagccttgtacatgtgtatatttgtattattgtaggcatgtcttcaggtaaattccttaaagtggggttgctggattaaaaggtaaatacttttgtagttattaaatgttaccagattaccctccaaaaagattggatcaatttgtagtcctcctaacaaagtgtggaaaggcccttcttccccaccaagagaatgtgttataatttttgccaattgtcttataaatgaatttggacatctttcttaagcttaaggaacatttaaaaagctttatttgtaaattgtctccttatgtatttttcctattttccattaggctttttttcagttatctcttaatttaagaggtctatatattagggatattaggcctttatgatacatgttgcaaatatttttttctaatttatcagctgtcttttcattttgttcatttattattttttttaacttccaagcttaattgagtttttaatttctgctattatttttaattttcaagacccctttcttgtttttggccattcctttagaaaaagaataacaccctgttcttttttttcaatggatgtaatatttgcttttgcttctttgagatagtattagttttttttttttttttttgagacagtcttggtctgtcacccaggctggagtgcagtggctcaattttggctcactgcagccttcagaactcccaggttcaagcaattctcgtgtctcagcctcccgagtagctgggattacaagcacgtgccaccacacctggctaatttttttgtatttttagtagggttggggttttaccttgttggccaggttggtctcgaactcctgacctcaagtgatccgcctgtcttggcctcccaaagtgctgggattataggtgtgagccaccacactcagccccctctttttttttaattgtggtaaaatatacataacataaaatttactattttgaccatttttaggtgtacagttcattggcattaaagtacattcgcattgctgtgcaaccatcaccaccattcatctccaggaacctttttatcttcccaaactgaaattctgtacccattaagcaataactcccttttctccccctccctgttggtttataaaagttgactttatatagtttttgcttttatctgtttgttttggtctgtttttatccctagacatctggtgattcttggtcatcctttattttttattttatttttttgagacagagtcttgctctgtcgcccaggctagactgcagtggtgcgatctcagttcaccacaacctctgcctcccaggttcaggcaattcctgtgcctcagcctcccaagtagctgggattacaggcatgcaccaccatgcccagctaatttttgtatttttaatagagatggggttttgccatgttggccaggctggtctcgaactcctgacctcaagtgctctgcccaccttggcctcccgaagtattgggattacaggcgtgagccaccatgcccagcccgtctagttgtttttaataatgaccactaagaaactgcttgggaactcttaacacatggtggaatgtgtcaactttggggtacactgtgggccattttgtggggtaatatctgtatctttatggattttttttttttttttggtggactagttatagtctccagaaaagaatcttcagtctgcttgtatgggtgagacagactgctagcattctgggagatgagtggcaaagtgtgttcggagtctcatatgcagtatataattccatcttcaaattatgcctggagtccctgtgtctgcagactttccattttactcttttttgcattttacatttcactattttatctaaaggataaacttccaatcttgggtgggggagggtcacttacctgccatgtggagttaagtagggatctggagtctaactgcttcttaaactttaggccaccctattgagtcattgttcagacttattttgttgtgacatccccaaatatcactatctgttggttttttctccgtgaatgatctgttttcccccagggactagtcgccttcttgtgggtatagagcttcttgccagtcttatggaagctgagtggggaagggcctggaggggaattcacggtgtaaactcatttatcctcctggtatacccctgtgctcagctgtacatgatatactggactatcctgggtcatcctcctcagaaagtgaaactttcatcatctgccacggtaggagatggtatctaggagtttcactgcttcttattcagactttgagccagcgtttccttttcaacaccacccatactcctgactttcataggtatatgttgcctctgcttctgagcctttctgctttctgaggtcctatagctgctgcttttttttttggagacagagcttcactcttgtctcccaggctggagtgcagtggcgcaatcttggctcactgcaacctccacctcccaggttcaagcaattcttctgcctcagcctcccaagtagctgagattacaggcactcatcatcatgcctggctaattatttttgtatttttagtagagacggggtttcaccatgttggccagtctggtctcgaactcctgacctcaggtaatccatctgcttcggcttcccaaagtgctgggattacaggcatgggccaccacacctggccctgtgttctcatgtgtaaaatgaaggacggggaagggagaggagaccaaataccacttaagactgattccatattgacttaattataatttgctcatagcaaaataattagtttcatacagcagatttttaaaagagcaggtacttttgttctgtatagtcatgcaccagtagatatttagtaaatacatgtgaggtcagcatctcaagagggaagccacgctcctctgttaccagtcaaagactctgggtagccatgcaaggacaggactttatcaaatgctctcacccagtgatggttctggatctcaagtgaatataagaaaaaagaaccaacacaagcatacacacatatactgcaggaacacactctagaagtagatggaaatgaatgacagtcaaatccaaacaataacttcccctcaggatttaataaaatctaatattagcgaaggctctttagtctagaaagaaaggcaccagtcactgcaggtagagtggaagaaagactatgaaacagaagccaatattctaatttcagcttgacaacagtttactcagaagtgctgtattacctttctgtgtataagttttctctggggaaaaaaatggaggactgaacacatgtttacctcagttccctctccaaatcacactgaggttacagaaatcagtttttttttgttttttttttttttgagatggagtttcgctcttgtcacccaggctggagtgcagtggcgcgatttttggctcagtgcaacctccacctcccaggttcaagcaattctcctgcctcagcctcaccaggagctggtgtcaggtgtgaggattacaagcaatccttgcaccttggcttcccagagtgctgggattgcaggtgtgagccactgcgcctggtcgaaaatgattcttaagtttatttttctcagaggcaggtgtacagcaaatggctttttgttagactactcatgtcctccctcctctccagttttcattgtgatgaaaaccttggtcagataagatttcattgtgtccaatagtctaaattgaagtatatgtactctttttttttctcaattttctgccttagttactgtgaatatgtcttcatgaccttatttttagatagaaatataacttacttctcttctttacagctgcatccagatctcattatgcatcagaaaaatgaaaaaacagaggaaaattctatggaggaaaggaatccacttagccttttctgagaaatggaatactgggtttggaggctttaagaagttttattttcaccaacacttgtgcattctgaaagctaagctgggaaggccagttacttggaatagacagttgagacatttccagggtagaaagaaagctcttcaaatccagaaaacgtggatcaaggatgaacccctttgtgctaagaccaagttcaatgtggctactcaaaatgttagtactttgtcctctaaagtgaaaagaaaggacgctaaacacttcatttcctcctcaaagactctcctgagactccaagcagagaagctgttgtcatcagcaaagaattctgaccatgaatactgcagagagaaaaatctcttgaaggcagttactgactttccatcaaatagtgctttaggtcaggccaatggtcacagacctaggacagacccacaaccttctgactttcccatgaagttcaatggggagagccaaagtccaggtgagagtggcacgattgtggtcaccttgaacaaccataagagaaagggcttttgttacggctgctgccaagggccggagcaccacaggaatgggggacccttgattccaaaaaagttccaacttaaccaacatagaaggataaaattatctcctcttatgatgtatgagaaattatccatgattagatttcggtacaggattctcagatcccagcacttcagaaccaaaagcaaggtttgcaagctaagaaaagcccagcgaagctgggtacagaaagtcactggggaccatcaagagacccgtagggagaacggtgagggtggcagttgcagcccatttccttccccagaacctaaagacccttcttgtcggcatcagccgtactttccagatatggacagcagtgctgtggtgaaggggacgaactctcatgtgcctgattgccacactaaaggaagctctttcttgggcaaggagcttagtttagacgaagcattccctgaccaacagaatggcagtgccacaaacgcctgggaccagtcatcctgttcttctcctaagtgggagtgtacagagctgattcatgacatccccttaccagaacatcgttctaataccatgttcatttcagaaactgaaagagaaattatgactctgggtcaggaaaatcagacaagttctgtcagtgatgacagagtaaaactgtcagtgtctggagcagatacatctgtgagtagcgtagatgggcctgtgtcccaaaaggctgttcaaaatgagaactcataccagatggaggaggatggatctctcaagcagagcattcttagttctgagttgctggaccacccttactgtaaaagtccactggaggctcccttggtgtgcagtggactcaaactagaaaatcaagtaggaggtggaaagaacagtcagaaagcctctccagtggatgatgaacagctgtcagtctgtctttctggtatgcacttttcctttattctccctcaaactccaagctcacatttgctgtgcattatccttgctaataagagtcctatttttttctcccactcatgaatatttctttaaaccagttagtctgcttgaagccttttatattgctgcattatgtagatgttccatcatttaatccttgtagacacttgcattgattccatttttttcataagctaatagtgcgatgaaattatgtctttacatttatacatttgtttctgtaagctaaattctcattattagaattgatggtgaaggaatattcacacttaaaattttaagataattaagttaccctccaaaaagttgaaccagtttacatttgttaagctttggcagtcttacagatcacagagttttgttttaatttgcatttttgagttttaagtttgaacatctgtttctgtgtttattggccacttttttgtatgtgcatggttttcctttgcctatttttcttttttttgagatggagtcttactctgtcgccaggctggagtgcaatggtgagatcttggctcaccacaacctccacctcctgggttcaagtgattctcctgtctcaaccccccgagtagttgggattacaggcacccgccaccatgcctggctaatttttgtatttttagtagagatggggtttcaccatgttggccaggctggtctcgacctcctgacctcacgtgatccacccaccttggcctcccaaaatgctgggattacaggcgtgagacaccgtgccctgcccctttgcctatttttcaactggattgtttctgtttttttttttttaatataggagacgctcaatgtaccaggcactgtgctggttcctaagaatgtagcaatgaacagaatatatgaccttcagggaacttggtgtcattctagtcataaaaatgtttaattgctgattataaatgtcataagaatggtccctcacgaaaggtaaaagccttcagtaccccaaaattgtttgatatttttgcttaataggagttttcagttcttacatagtaaaacttatctgtctttttttattttttattttttggagatggagtcttgctctgtcacccaggctggagtgcagtgacgcaatctcggctcactgcaacctctgcttcccggttcaagcagttctcctgcctcagcctcccaagtagctgagactacaggcacacgctaccatgcccggctaattttttgtattttagtagagacagtgtttcaccatgttgcccaggctggtctcgaactcctgagctcaggcaatctgcccgcctcggccagtctgcctaaagtgctaggattacaggcatgagccactgcgcctggcctaaagcttacctatatttgactttgaggcttctagtttttacgtcatgctttaagaagccttctcttgtcaaaaatctatcccataaggtaaactggtgtaaacatttctttggaagacaatatgatagtataaattatggcccattcaggcaatagtttgctagcagctgtttaagaatatagatctatattttgatactgaaagatgtctatataaagtgaaaacaggccaggtgctgtggctcacgcctgtaatcccaacactttgggaggccgaggtgggcggatcacctgaggtcaggagttcaagacgaggctgatcaacatggtgaaaccccatctctactaaaaatacaaaaatcagccaggtgttgtggtgcgtgtctgtgatcccagctacttaggaggctgaggcagggagaatcgcttgaacctgggaggcggaggttgcagtgagcttaggttatgccaccgtgctccagcctgggcgacagagcgagactctctcacaaaaaaaaaagaaagaaaaaaagtgaaaacagtaagttgcaaaatggtatgaaaccattttgttaaaagatatatatgacatatgtaggatgagtgtgagtatatatgtgtgcatatgcatttgtataggacatctggacagatattattaccattggctttggggagctagttaggaggtttatttcttggtagttgaaacagttctgagcactttctctttccaaccattaagtataataaattcttctggctgggcacggtggctcatgcctgttatcccagcactttgggaggccgaggcgggcggatcatgaggtcaggagatcgagaccatcctggctaacatggtgaaaccccgtccctactaaaaatttaaaaaattagccgggcgtggtggcaggcgcctgtagtccccactacttgggaggccaagacaggagaatggtgtgaacgggggaggcggagcttgcattgagctgagatcgtgccactgcactccagcctgggcgacagagcaagactctgtctcaaaaaaaataaaaataaataaattagtaaataaattcttcctcatagaaagacacaaagtacagagtcctagcaaattaaaaaaaaaaacaacaccaaaaaacctcttgtctatactgtcctagagtaaagccagatttccctactgaggttagcagacccatgatacttacacctgaaaagaattagcatttacccacaaatgccagttaacctttatagatgtaacactttcaagtacggttgataaattgaatatgcacgtagtaaaacctgtagcatgacctgaggaagtaggaattcttacagaattcatgtgtagtgacaatataattcactattttaataggccaaaggggaaaaaaatggtatctcagcaagtgctgaaaaacctgttagtaaaattgtttccttttgggtttaaatctcttagaaaactagtaataaaggaagcttccttgaattactaaagaatatcaatcagaagccaatagcagtttcaggtttaagagaatgaagtaagctcatggactctcttcttcctcctaccaaatccatagaaattatgaaaaaatattaaaaacacatgtgtcttcatactcacaaatgaggagacagttttggtagatcagaaactgagaatcagctcccactgggcaaaaagtagagggaaggtccaggcgggcagaaggaagattagtacagggaagtggtgtgatactgagtgctcatatttctggagatggtggaagtggagaggaaaggggacacccatggtaaggactgagtagttggggaatctctccctgcctgtgccacatgtcagcaaagaacaaatctgttatcaagccaaaattctaaggacaagagacaggatactcacccacacacgtacaccttgtaacacttggcaagagtgaggaacatccattttcagaacagctgctggggttcttagtgtccttattcccactgaaaatagttcaaggcagagcagcagctactgcccattatagccctttgccctcaattctcagcaagttacctaagtagagatgaactaacagtctatcaccatcctctgagaaaagccaacacaatgaaatagacaaattcagcaaataacagaactaaacctcagtattgattaatggggcaatgagtacaatagataatcctttaagggacttctacaacattagccactattgagttctgtggggtgctgaatgctggcttgtctctaatatgactgcacattatgctcctttcagttgatttacatgtttaagagtcagttatacttaggggagatttacttgttgcagtttcataattttattcagtattacataaaatgatgaaatatgagtgtaagaagaaagctcctcctttgaaaaacaaggtgaatactttgcaatgacagtagcgggttgctgcaaaaaaatgaatgctgatgcgctcatgcaggacagctgcaaaagatttgagggcgtgcgtgaaagtctaggactctgcactgagattactttgcaagttctttaagttcttgcttcgctttaaagttctaacctctatgtcatgagtatgccaggagataatggaagggaaactgaagaaattaggaatgttttctagaactgaaaagaaaggtctgagtctaaagttgaaaggctttgcaagtgccaatcaggattaaaacacacaaatacatacacaaactcacactaaatttagtgtagtaaaattatagcacatccaagagaaataacttggatggttacttcttttggagggaaaagggatagattcctgtgccgcaaaacattccagatggattaaaagtttggctaattaaaaccaaatacacagaaatgtgtacacgaatgcttgtaacagcattgttcataatatccagaaagtgaaaacaacctaaatgttcaacacctgatgaatggataaataaaatttggtatatctatacaatggaatattattctataaaaggaataaacaccgatatatacttaaatgtggatgcaccttggaagcatgctaagtgaaaagccagacacaaaaggccttataacatatgatttcgttcatttgaaatgtccagaataggcaaatacatagagatataaagtagattaatagttgccaggagctgggaagaaggggaatgagaggtgactgttaatgggtatagagtttctttgtggggtaatggaggtgttctggaattaggtagtagtgatagttacacaatctgaatatattaaaaaacagtgaattgtgttctttaatggggcaaattttgtggtgtgtgaatcacatctcaataaagctgttaaaaagaaacaaatataggccggccatggtggctcacatctgtaatcccagcactttaggaggctgaggcagaaggatcgcttgagggcaggagtttgagaccagcctgggcaacatagcgatataaatacatagagggatgtatatagatttagcgagactctattgctacaaaaaataaaattatctgcatgtggtggtgcatgcctgtagtcccagctcctcagatggatgaggtgggaggactgcttgaagccaggagtttgaggttgaagtgagctatggtagctcgactgcattccacgctgggtgacagcaagaccttgtctctctcttttttttgagacggagtctcactctttctcccaggctggagtgcagtggcgtgatctttgcttactgcaacctctgccttctgggttcaagcgattctcctgcctcagcctccggagtagctgggactataggcatgtgccaccacgcccggctaattttttgtatttttagtagagacggggtttcactgtgttagccaggatggtctcaatctcctgacctcatgatccacctgcctcagcctcccaaagtgctgggattacaggcgtgagtcaccgcgcccggccgaccttgactcttaaaaaaagaaaaaaaaaatacaggaaatcattctttttaagtttttggtttctttgtttgtgacagagtctccctctgtctcccaggctagagtgcagaggcgtgatctcagctcactgcaaactccgcctcccgggttcaagcgattctcgtgcctcagcctctggagtagccaggaccacagaggtgcgccactatatgcctggctaattttttgtatttttagtagagatggggtttcaccatgttggccaggctggtcttgaactcctcacctcaagtgatccgcccggcttagcctcccaaagtgctgggattacaggcatgagccactgtgcctgacctaaagattatttttaattgacaaaattctatatatttatggggtacaatgtgatgttttgatatatgtttactttgtgaagtaaatcaagataatcagcatatccatcactcacttcgtcgtgagaacatttaaaatcaattctcatctattttcaagacacagtacattattattaactatagtcaccagactgtacaatagatctctaggaccacttcctcctgtctaacggaagctttatgacccttgaccaacatcttccaattctctgccccacccccagcccctggtaactaccgttgattctctacgtctatgagtttgactttagattccacatgtaagtgagatcatgcagtatatttttttgtgtctggcatatttcacatattatgctccagattcatccatgttgcagatgacaggatgttttaaggctgaattgtattccattgtgtatatatactacattttctttctccattcatccactcatgggcattgaggttgatgccatgtcttggctattgtggatagtgccgcagtgagtatggggtgcaggtacctcttcaacacactgattttattgtctttgaaatacactcagaaatggaattgctggatcatatggtagttctatttttaattttttgaggaacctgtatactgttttccttcatggctgtgctaattcacattcccaccaacagtgtacagggttcccctttctccacattcaagtcctttgcctgctttttaaattgggttatgttcttgctattcgttgtttgagcaggagaccatttttataatcttatattgataagacatttttgcccataataggaagctcagaagcaatgaaaatataccaaattgactctacagacatttaaatcttgtgtgcatgtgtgtgtgtatagcaaaagttagatgaaaatttaaaaatttagatatgcatgcccttttacccagaaatttaacttgtagtaggtgtgtccaagggaaacagtagaactaggatagatcaagagttttaattgttacattatttagaggtaaaaataaatggccatcagtagggaattggttacaatacagtatgcattttttcaggcaaaagagaactgtccatgatatagtgaatggaaaaaagcagcttcaagaagagtaagtttaggccgggcgcggtggctcatgcctgtaatcccagcactttgggaggccgaggtgggtggatcacctgaggtcaggagttcaagactagcctgaccaatatggtgaaactccgtctctactaaaaatacaaaaattagccaggcatggtggcatgcgcctgtagtcccagctacttgggaggctgagacaggagaattgcttgtacttgtgagttggaggttgcagtgagttgagatcgcaccactgcactccagcctgggtgacagagtgagactctgtctcaaaaaaaaaaaaaaaaaatttagtgtgtttaagaaatacatgttcaaagggcttgaaagtccagaaggaattatgggctcactgccatttatttaaaaatatttatggtcgtgtatgagaaaaaataactacttaaaaggttgtttccacatataaagtaaatgtttataaaaatgtccaactctttttttctagatattaatgtggtttttttttttttttttttttctggagacagagttttgatcttgttgcccaggctggagtgcagtggcgtgatctcggctcacggtggcctccacttcctgggttcaagcaattttcctgcctcagcctcccgattagttgggatgacaggtgcccgccaccacgcccggctaattttgtatttttagtagagacagggtttctccatgttggtcaggcttgtctcaaactcccaaactcaggtgatccgcccgccttatcctcccaaagtgctgggattacaaatgtgagctactgcccccggcctaatgtgttatttttaatttagtgctttggaaaaaagttaaggtagatccttacctcattctttacaccaaaatgaattccagctgttaataaaatatttagttgcgagttctttttttttttttaaatttattcccatgggtctgggaaccaatgaaattagttggtagttctaatactgtttattgagtgatttgctcttttccctgtggttcagaaatgcaacctaccacagagtctctttggatttgatctctattccatgctggctctatttgccttaattagcgtagttttatcatttgacaggacctggcgctccttattcacctctctcctttaattcttttcaaaaatttctaggaatttctcacatttttgtcccaaggtaaattttggatttattttgtaatcttttaaaaaagtatggtttttacttgttgttgcattatatttatagattaatttagggacagttgctttcattgcaaaagacttcctgtcccttagtcatatttcgcatcttttcacttaggttttgcgcattgcttatgtttgttcttagatactgtataccttccttactgctgatgggcccgttctgaggtatgcactgtgttttgttggagaaccatgtgcttgcatttcttacgtgcacagcacggggaacctcattccacatccagggtggaatgtgacccaggtcagttgcatcaaacgaaaactgtccagtgccgttagtttaacatgatggctacttttaacttctttttttttttttttttttgagacggagtcttactctgtcacccaggctggagtgcagtggcataatctcagctcgctgcaagctccgcctcccatgttcacgccattctcctgcctcccgagtagctgggactacaggcgcccgccaccatgcccggctaattttttgtattttttagtagagacagggttccaccatgttagccaggatggtctcgatctcctgacctcgtgatccacccgcttcggcttcccaaagtgctgggattacaggcgtaagccaccgcgcccggccttactttaacttcttttttttaaaaagttcttttttattttttcagttatttttgaggcagggtctcgttctgttgcccaagttggagtgccgtggtgggatcttggctcactgcagtctttgcctcccaggctcaacccatcctcccacctcaccctcccgagtagctgggactacaggcatgtgccaacatgcttggctaatttttgtattttttgtagagaagcggtctcactttgttgcccagactggtcttgaacttctgagcttaagcaatccttctgtctcagcctcccaaagtgttaggattacaggcatgagccaccgtgcctggccgggtactttaaattctaaaatgacacctcaggttttgttttttatattactaccttttgtacttgcagagtgctctgtaatttgaactccagtttttgtttgttgtttattcctaacattttatcctttgtttcttgggtcactttgaaattttagtactttgggagtaaaataaattgtgtataccaattgcatttttccttttttagttgatcagtttagtgaaagcaagtgggtaaagaatggtggatttaactgtcattttataaaatctgtttctgagtaaaataaattgtatataccaagtgcatttttccttttttaattgattagtttaatgaaagcaagtggataaagaatggtggatttaactgtcattttataaaatctgtttctggatagttcttggcccacagatattaaaaaggaaaggtgaagaaccaagttgtttttgtagagaaaagataacagatatttcttgctttgtaagtggcatgacatgatagttaacagcccagtttctgtagtcacggtacctacaatcaggatcttagttctaccatatgctagttaagtgcccttggggaggtaacaacctctcaaagcttctaatgtctccatttgattgactggttgattgattgattgattgagatgaggtctcgctctgttgcccagactggagtgcagtggcataatctcggctcactacagcctctgcctcccaggttcaagcgattttcctgcctcagtctcccaagtagctgagattacaggcacgctaacatgcccggctaatttttgtagttttagcatagacagggtttcaccatgttggccaggctggtcttgaattcttgacctcaggtgatccacccgccttccaaagtgctgggattacaggcatgagccaccgcacctggcccagtgtctctatttgtaaagtagggatactatcttaacacccagggaggctataagaactaaatgagacaggctagtgcttgtcttatgagtattttttaactgttgttttacttctggtcccagtgagataatggtgtgtgtaagtgagacactgtcatctagggttctccttgaagatcgtaccttgaagggcatttctaccgaataagaaatccatgtttatcatctgaaaatgaaaataaagatacagataagaggaaaatgtgtaataatttagaatctccatcattctaccaccagaaataacattgttaacaagagcaccatgatactagtttgaaattcacatccatatcccattgtgggggacactgccttcttatttgaggagcctcaatcaaagttgtggggcctaaagtttaatttttattgttgttaggggtattattttacaacgaaaaataattctcaatgcagtttctcaaatggtgggattccttatcttccactgggcccattcccccatgtagacacaaggttatgattaggtaactgtaagatgtgaaatagtaaacactagaggcaagtatatggtctgttcctagattagaagccccaaatctttatctgataccctgatgaagttggagcatgggactatcttcctgtctactgtatttgcccaaagcctagagcagaatggacgtgagaaaggacctcttttctgtttactgtaccctgacctttgctcctatgttaagccttgaaaattgagaggtactctggtgggagattaacaggaggaaaaataaattgttcacttctttgtctgtctctcccctcataaaagacaaaacacttcattcccaagacactcttatcatcttttctatcctgtttatatcaatgcatggcagaggccattcttggagttacaaagggagctggttaagatatgtggctaacaatcctcatttttcctgtcttaactcagcagacttaaccgtcagactgatggttagctaatttgttgctctgcccattcagcattggtgaacaacctaagtcatgtctgtacttctgtgagcgtctaagccttgcctcagcttttttgtatttacttagaaataatgtcctgggtggccaggcgcggtggctcacacctgtaatctcagtactttgggaagacaaggcaggtggatcacctgaggtcaggagttcgagaccagcctggccaacatggtgaaaccccgtctctacaaaaaaaaaaaatacaaaaattagctgggcgtggtggcgggcgcctgtaatcccagctactcacgaggctgaggtaggagaatcacttgaacccaggaggggtgggttgcagtgagccgaaatcgcaccattgcactccagcctgggtgaaaagagcaaggctttgtcttaaaaaaaaagaaaaaagaaaagaaagaacgtcctgggtttatttcctggggcttttctaggttcagtggatcattcagggatatatataagcacatatacatgttacttacatttacctgaagactgtcctatggtgtggccaaaaagccacctttaaattttatttctcatcttgggaggctggagcgaaaggatcacttgaggccagaagttcaagaccagcctgagcaacatagcaagaccctcatcttaaaaaaaaaaaattaaaaaattagctgggtgtggtttcacttgcctatagtcccagctaactatccaagcaggaggatggcttgagcccaggagtttgaggctgtagtgagctatgattgtgttactatgccccagctgggatgatagaaagagaccccatctccaaaaaattctatttactgtcttaaaatgtgcttcactagctgggtgtggtggctcacgcctgtaatcccagcactttctgaggccgaggcgggcggatcacaaggtcaggagatcaagaccaccctggctaacacggtgaaacccctcgatgatagttccattcgattctatgcgatgattccattccattccattggaagatgattccattcgagaccattcgatgattgcattcaattcattcgatgacgattccattcaattccgttcaatgattccattagattccatttgatgatgattccattcgtctctactaaaaatacaaaaaaattagccgggcgtggtggcaggcgcctgtagtcacagctatttgggaggatgaggcaggagaatggcgtgaacccgggaggtggagcttgtagtgagcagagatcgtgccactgcactccagcctgggcaacagagcgagacgccatctcaaaaaaaaaaaaaaaaaagtgcctcactagctgttatccagttgagctcacctcacagcgttatttggtgtcatgagtataataacttatcaagatgtatgatattgtcccttgctgatactaaagtacatacctttaccaaataatagagtcacagtgatctcatcagttaatgctaattgtgattttaaaataataattctttcagttaccaaaaggataggcacatttgactatgtgattaagccctttagaagtcacgctttaagagaaggttaagctgtgggaagctgttagtatttccttctagctatccattccttctctaacaatgcttcagtaacttaaaaatctaatgtgaaatgattcctcacagtatgtctctctagattgcattggttagagcctaatatattttattttttacaaaagacataactttaaaaatatagtatcaatattatatagtaatataggttaaccactgtatgtgttaagtgctgtgtataggttaagtgtttggagaatgactctactgaaaatggcttgtttttccatcttaacttttctttcttcctttatttaaggattcctagatgaggttatgaagaagtatggcagtttggttccactcagtgaaaaagaagtccttggaagattaaaagatgtctttaatgaagacttttctaataggtatataaatgatgctaaagttaagcccttgaaaataaaatttttggcatatatgacttttctcttgatttacagaagaaaagatatttagcagtaaattgagaagtactcatgttttttttaccttttgtttcaaaatctttctctttcagaaaaccatttatcaatagggaaataacaaactatcgggccagacatcaaaaatgtaacttccgtatcttctataataaacacatgctggatatggacgacctggcgactctggatggtcagaactggctgaatgaccaggttagtatattgtagtttttcagtgtggagaagttgcagaggatgttagtcaataaaatataatctctagtttggcttctcagttgtcttttggaataaggattcttcattctttactggttacttgccccaggatccaaacggtttgattactattggcagtaataatatattatttattctgattgggatgtactgaattgtatagggttagtagcctggttttatttatttattttgtttttctttctccaacttaactggcagagatagtaagctggttttatgttgactttttataggtcattaatatgtatggtgagctgataatggatgcagtcccagacaaagtaagtgaaaacttcctcttctgcaggagagagtgttcttgtgtattaaaatgagtagtttttttgtttttacatttgatgtaattatctgacattccttaaattttttaaaagaagagttcaattttttcttgatcatgtactgggcttgatcgtaagttccatcaaatcacttctttttgttctttttgagatggagttttgctcttgttgcccaggctggagtgcagtggcgtgatctcggctcattgcaacctccacctcccgggttcaagcgattctcctgtctcagcctcccgactagctgggattataggcatgtgccaccatgcctggctaatttttgtatttttagtagagacagggtttcatcatattggtcaggctggtctcgaactcctgacctcaggtgatccacctctgccttggtctcccaaagtgctgggattacaggtgtgagccacagcgcctggccccatcaaatcacttcagcataagaaaatcactgtgcaattgttttcctatttatttgtgttagggtaggtatgtttgttgatatctggagagggcctttttttggtggggagatgtgcaaaagggactggctaagctttttacatttatgtatttattttacttttttttttttttgagaccgagtcttgctctgtcatccagactggagtgtagtggcgtggtcttggctcactgcaacctccacctcctgggttcaagcaattctcctgccttagcctcccaagtagctgggattacaggtgtgtgccaccatgcctggctaatttttgtatttttaggagagacaggtcttaccatgttgggcaggctggtctcgaactcctgacctctggtgatccgcccacctccccctcccaaagtgctgggattaaagatgtgagccaccatgccaggccagctttttacatttaacttaaaatcttgctctctttaaaaatgtaaaaaaaaactcatctttcatttttccttagataaatctttgatactcagttcaaatacagattgaaccctcataaactctaaattctcttaagagttttgttacatatcaaaactatttttttacttaatgtatttttctgagtacacaaatgcctgatgggtgcaaaaatttccaagtgctgtataaaacttaccaatctaataaagtaacataaatactaaaaagtcagattctgataccgtttatgaatatagaaaatgttttatgactttccacttaaattataaatctgttatacatttataaattggaatcatgaggctaatctgctagatgctctattgtcaaattctcttaatcatcagaaagtttaaacaatatagattatctttaacataaaagtattaatttcaagggtttcatttaccaccattgtacatttaattctaaacattcatggagtcaaaaggacacttaactaaggcagtggttctcaaagcatggtccccatactagcagcatcagtatcccctgagaacttactagaaatgcacattctgagactccatcccacacctactgaatcagaaactggaggtgggggaccaccgatttgtgttttgacaagctctctagatgattctgatggacaccaattttgagaatcactgctctagagacagctactataagctctttcttatttatttgtttttattaaaattataaaacataaccttctttttagagacactaaaaagacactccaggctggaatgcagtggcacagtcatagctcactgtagccttgaactcctgggctcaagcaatcttctcgccttagcctcccaggtagctgggactagaggcatgtgccactgtgctactatacccagctagtttatttttatttttggtagagccaggagtcttgctatgttgcccaggctagcttgagctctgggcttagctaaagtaatcctctcacctctgcctctcaaaattgctgggattagaagtgtgagccactatgtctggcagctctttcagtctgtatgttaagctgcatggttatcaaaagaatgtgcctcagaaccgtctgaaaggtttataaaaccagattactgggccctgccttcagagtttctgctttaataggtctgggatgaggcctgataatttggatttctaacaagttcctagatgatgctgacactactggtcaggtgaccacactctgagaaccacagtgctaagggaacagttttatcacctcaagttactgaatgagcactttaagatcacaatatgtttaccctctaagatgagctgatataccacttacttataagtcagaaattcaaagccaaggacgcaggacctgatactctgtacagccagggtaattctgtggtactagaaataatcatgccaaggcctttttatggttactgtaacaacaggagtctctaaatccacatccttcacatggagttagttttgtaatccatctcccttgagttcaaggtaattgttacctcattttttcatagcctctttcagctttttcacctgatttagagagatttgtcaggttgcttctctacttgattggattcaggtagtctatttactgccccattccaaagctgactatagaccacagctgtaaggtcattccaataaaactttggaacagcattttctgtaaaccatgtaatgtattttctatattttgatcattattatcattattattattttttgagacggagttttgctctggtgcccatgctggagtgcagtgatgtgatctcagctcactacaacctctgcctcccaggttcaagagattctcctacctcagcctcctgagtagctgggattgcagatgggtgccaccacgcccggctaatttttgtatttttaggagagacagtgtctcaccatgttggccaggctggcctcgaactcctgaccccagatgatccacttgcctcctcaatcattgtttttatgaagaaatttttccttcctttttgtctgctttacattcaaacattttaaaatttcctcttttgaagttaaatctgggcacagcctaatataatctggttgcttgtgtttgttgtctgttctaggttcacttcttcaacagcttttttcatagacagctggtaaccaaaggatataatggagtaaaaagatggactaaaaaggtattctctttatttcttttttattccaaatttgaaacgcagatgataaaccactttgtgtggaaggataagtactttaatgccaatacgatgttaagtagaaacagactttttaatgtgacaagttttaaatttgtttcttttaaatcttattgtttgaaagaccttaattgcctactggtcccaattatagtggtagaacagtgggatgataaagaaggagctgccatcatttggtgttatctggtaggcttgtcagcagacagcagaagctttcaacaattttttgctggtgctgggcacggtgcctcgcacctgttgtcccagctacttgggatgctgagaccagaggatcacttgagcacaagcatttgaggccagcttgggcaacatagccagatcctgtctcttaaaatgttaactgatccatcaggagaaataacttttatatcacaatctattcataaaatcttatacatacatgtaattgaaataatttccaaaaaccatgtacctaatttactatgtatgatgtactctagtcagagagtggtaagtgctatttgctatggaaacatcagaacacagtatgagaatacaaggtaactgggatagggtagcaggaggaagatgggctagttcttttagataggcttgtcagcaaaggcctctttgaagagatcccatttcactgaaaactgtgaagatcagaggagcattcccagtagatggaagagtgaatgttaaaggccctgaagcagaagtgagtttggtatattggagtattacacacatgagatcagggaaggaggcagggatcaagtcatgtggcgccatataggccctggtaaagagtttggatcatgagggcaatttgaagacattagagagtttaggccaggtgcggtggctcacgcctgtaatcccagcactttgggaggctgaggtgggcggatcactgaaggtcaggagtttgagatcagcctggccaatgtggcgaaaccctatctctactgaaaatgcaaaaattagccgggctgtgatggtgggcgcctgtaaccccagctacttgggaggctgaggtgggagaatcgcttgaacatgggaggtggaggttgcagtgagccgagattgcactattgcactccagccttggtgacagagcgagactccatgtcaaaagaaaattaaataaaaaataaaaatgaagacattagagggtttaagcagcaggcaaggagtgtgtatgagtgtgtgtgtaaatgatagataggattgtccttagcaacattgattcattcattcatcatttatttattgatttattttttgagatggagtctttcaggcgctatcttcgctcactgcaacctctgcctcctgggttcaagcgattctcctgcttcagcctcctgtgcagctgggattacagtcacctgccaccgtacccggctaattcttgtatttttaatagagacgggatttcactatgttggccaggctggtctctaactcctgacctcaggcaggtgatctgcccgcctcagcctcccaaagtgttgggattacagggtaagccaccgtgcccggcattaaacatttattgagtacctgttatgtgcctatatggaaaaacttttttcctttgctgtcacaccacaacagtagtcagcacagaagacttctgtgaccaaagcaagcaagcaagcagttctgcagcgaccactggctggatgccctctaattcaattccgacctgtctacctggagacagtgccacgtcccatagtttgagggctcatgcctcaagagtgccccccacccacttcagacaccagttgcaagtccaggcttctgaaacttctgaccaacagacttcaagtgagggttcccatgccgccctccttgaatttgattaatttgccggagcggttcacagaattctgggaagttcttacctacatttagcagtttattatataggatattacaaaggattcagatgaagagatgcatgggaagagatgtaggggagtgggcacagggattctctaggacctccacaggcacatcaccctccaggaacctccacatatttagtatccagaagctctcccagtgcagtcagtttttatggaggcttcattacataggcgattgactaaaccagtgaccattggttaacctttagcttctcttctctccctggtggttggggggttgggtggggctgaaagtcacaatcctctaattctgccttgctcttatcctaaagccacctagcagctgccagccatcagttaatcatcaacatacaaaaagacatcactttgggcctgggtcatgtccccgtaatcccagcactttggaagtctgaggcaggcagatcacttgaggtcaggagttcaagatcagcctggccaacatggtggaaccctgtctctactgaaaatacaaaaattagctgggtatggtggcatgtgcctgtagtcccagctacttgggaggctgagacaggagaatcgtttgaacccaggaggtggaggttgctgtgagccgagattgcaccactgcactccagcctgggtgacagagcaagactttctaaaaaaaaagaaaaaaagacatcagaaattccaaggactttagggagttgtatgccaggaaatgaggtcaaagaccaaatttattattttacagtatcatagtgccagacattatagtaaatcaagaaataaagaggtaagtaaaacaatattagagacagtttttgctttcacaaagtctgcagtctagtggtggagacagcacctaccacagtttgtatttatatttttggtggtgtaattatttgtttagtgggtacaaaagaaaagtactacaggagtgtattggaatgcaggtttggttaacctagcctgagggtaagggaatgtttctcataggaagtaatatttaagcagaaatatcaaagatgaatacaagttaactaggtaaatggagaataggggtatgtgaaacataggcagaaggaataagtatctggtagaagaatgggaaaaggctagtgtagctgaaatgcagagagttaagaagacagtggcatgaagtgtacctgatccacagatcagggccttgaggtttgtattttggattttatcctaaatgtaataggaaaccattgaatggtttttagtgacattatccactttgtagtctttgttctaacagtactgaagaagatggatgggtatgggagcaaagttgatgtgggcagaacaggagaccatttcagattcatggtactttgaagtagaatgatagcaggagagatggaagatgagtgtgatgtaggaagtaaaattaacaggatttggtgataagttggttatggagatgaaggacaaggaagtgtgaaagatgacttccaagtatgtgacttgtatgactggacggcctatggttgtatttacattagaaaaatgtaggacaactagtagaggattgttcaaatttaaaatgtacagtcatataattggatgctacttaagcaggaaaagctgtgtagataatgaacgatgggccgggcacagtggctcacatcagtaatcccagcactttgaggggccgaggcaggcggatcacgaggtcaggagatagagaccatcctggctaacacggtgaaaccccatctctattaaaaatacaaaaaaattagccgggcgtggtgacggatgcctgtagtcccacttactcaggagactgaacccaggaggcggagcttgcagtgagccaagatcgcaccactgcactccagcctgggcgacagagagactccgtctcaaaaaaaaaaaaaaaagataatggaagatgcttatattccatttggggtgggaaaaattacaagcagtgtgggcaaaaaatatacattcatggaaaagtatctgaatgataaacatgagagtgaaagaataaagtcaaatatgtgagttgtttcattaaataataaactaaattattccttcctctagatcaggggtgtccaatcttttggcttccctgagcctcactggaagaagaagagttgtcttgggccacacataaaatacaccaacactaacaatagctgatgagctaaaacaaaaaaaattgcaaaaaagatctcataaaagaaagtctacaaatttgtgttcggctgcattcagagccgtcctgggctgcatgctgcccgtgggctgtggactggacaagcttgctgtagatcctctgagattgggttaagtaaaaaaaaaaaaaacccaggtttatgctgaatataagaagtatacataaaataatatgaaaaagaaaggttgaaaatgaagtgacatttaaagaggctgggcgctgtgtctcacatctgcagtctgaacactttgggaggcctaaaattactgtagatgggaggattgcttgagcccaagagtttcaaatcagcctaggcaaccaagcgagaccccgtttctataaaaaatttaaaaaacttagctggccatggtggcagcctgtggtcccagttatccagaaggctgcggtgggaggatcacttgagcctgggaggtcgaggctgcagtgaaccctgatcacgccactgcactcctgcctgggtgacagactgagaccttgtctcaatttaaaacaaataaaaaaggcaactacaggaaagttaaacaacctgttcctgaataactcctgggtaaataaagaaattaaggcagaaatcaagaagttctttgaaaccaatgagaacagagagacaatgtaccagaatctctgggacacagctaaagcagtgttaagagggaagtttatagcactaaatgcccacatcgaaaagctggaaagatctcagatcaacatcctgacatcacaattaaaagaactagagaagcggctgggcgtggtgactcatgcctgtaatcccagcactttgggaggctgaggcgggtagatcacctgaggtcaggagtttgagatgagcctgaccaacatggagaaaccccatctctactaaaaatacaaaattggctgggtgtggtggcacatgcctgtaatcccagctacttgggaggccgaggtaggagaatcacttgaacccgggaggtggaggttgtggtgagctgagattgcgccattgcactccagcctgggcaagaagagtgaaactctgtctcaaaacaaacaaacaaaaacaacaacaaggaaatagagaagcaagagcaaacaaatccaaaagctagcagaaaacaagaaataactaagatcagagcagaactgaaggagatagaaacacaaaaaaacccttcaaaaaatcagtgaatccaggagctggattttttgaaaaaattaacaaaaaatacctctagctaaactaaagaagaaaagagagaagaatcaaatagacacaataaaaaatgataaaggggatatcaccattgaccccacagaaatatacaaattactatcagagaatactataaagacctctacacaaataaactagaaaatctagaagaaacggataaattcctggacacatacaccttcccaagactaaatcaggaagaagtggaatgtctgaatagaccaataacaaattctgaaattgaggcagtaattaatagcctaccaaccacaaaaagcccaggaccagatggattcacagccaaattctaccagaggtacaaagaggagctgataccattccttctgaaactatttcataacaattgaaaaggaggaactcctccctagctcattttatgaggccggcatcatcctgataccaaaacctggcagagacacaaaaaaagaaaatttcaggccaatatccctgatgaacatcggtgcgaaaaattctcaataaaatgctggcaaaccaaatccagcagcacatcaaaaagcttatccaccatgatcaagttggcttcatccctgggatgcaaggctgattcaacatatgcaaatcagtaaacataatccgtcatataaacagaaccagtgacgaaaaccacatgattatttcagtagatgcagaaaagaccttcgataaaattcagcatcccttcatttaaaaactctcaataaactaggtattcatcaaacatatctcaataataagagctatttatgacaaacccatagccaatatcagtgggcaaaagctggaaacattccctttgaaaactggcacaagacaaggatgccctctcccatcacttctattcaacataatattggaagttctggccagggcaatcaggcaagagaaagaaatacagggtattcagatagaaagagaggaagtcaaattgtctcttgcagatggcatgattctatatttagaaaatgccatcgtctcagccccaaaaccccttacgttgataagaaactttagcaaagtctcaggatacaaaatcaatgtgcagaaatcacaagcattcctatacgccagcaatggacaagcagagagccaaatcatgaatgaacccccattcacaattgctacaaagagaataaaatacctaggaatacagtttataagggatgtgaaggacctcttcaaggagaactacaaaccactgctcaaggaagtaagagaggacacaaacaaatggaaaaatattccatcctcgtggataggaagaaccagtatcttgaaaatggccatactgcccaaagtaatctttttttttttttttttttttttttttttgagatggagtctcgctccattgcccaggctggaatgcagtggcatgatcgtggctcactgcaacctccacttcccgggttcaagcaattctcctgcctcagcctcccgagtaggtgggactacaggcatgcaccaccatgcccagctaattttttgtatttttagtagacacagggtttcgccgtgttagccaggatggtctcgatgtcctgacctcgtgatccgcctgcctcggccttccagagtgctgggattatagatgtgagccaccactcctggctgcccaaagtaattaatagatttaatgctattcccatcaaactaccattggcattcttcacagaattagaaaaaactactttaaaattcatatggaaacaaaaaagagcctgtatagccaagacaatcctaagcaaaaagaacaaagctgtaggcatcacatacctaacttcaaactatactacaaggctacagtagccaaaacaacgtggtattggtaccaaaacaggcatatagaccaatggaacagaacagagacctcagaaataacaccacacatacacaaccatctcatcattgacaaacccgacaaaagcaatggggaaaggattccctatttaataaatgatgctgggaaaactggctagccatatgcagaaaactgaaactggaccccttccttacaccttatacaaaaattaactcaagatgaattaaagacttaattgtaaaacacaaaatcgtaaaaaccctagaagaaaacctaggcagtaccattcaggacataggcgtgggcaaagacttcatgacaaaaacaccaaaagcaattgcagcaaaagccaacatggattctaattaaactaaagagtttctgctcagcaaaagaaactatcatcagagtgaacaggcaacctatagaattggataaaatttttgcagtctacccacctgacaaagatctaatatccagaatctacaaggaacttaagcagatttacaagaaaaataaaccatcagaaagtgggcaaaggatatgaacagacacttcgcaaaagaagacatttatgtctgtagtctcagctactcgagaggctgagacaggagaattgcttgacctgggaagtggaagttgcagtgagccaagattgcgccactgcactccagcctgggcgacagagtgagactttgtctcaaaaaaaaaaaaaaaaggacatttatgtagccaaaaaacatatgaaaaaacctcatcagttgggcgcggtggctcacgcctgtaatcccagcactttgggaagctgaggcagttgtggtggtgggggcctgtaatcccagctactcgggaggctgaggcaggagaatcgcttgaacctgagaggcagaggttgcgtgagctgagattgtgccattgcactccagccttagcaacaagagcaagactccgtctcaaaaaaaaacaaaacaaaaacagctaatcactgatcattagagaaatgcaaatcaaaaccacaatgagataccatctcatgcgagtcagaaatgacaattattaaaaagtcaagaaacaatagaagctggcaaggctgtggagacataggaatgcttttacactgttggtgggaacgtaagttagttcaaccattgtggaagacagagtggcaattcctcaaggatctagaaccagaaatatcatttgacccagcagtcctattactgggtatatacccaaaggaatataaatcattctctatagagacatatgcgtgtgtatatttattgcagtactcatagcaaagacatggaaccaacccaaatgcctatcagtgatagactacataaagagaatgtggtacatacgcaccatggaatactatgcagccatttaaagaatgagatcatgtcctttgaagggacaaggatgaagctggaagccatcatcctcagcaaactaacagaggaacagaaaaccaaacactgcatgttctcactcataagtgggagttgtacaataagaacacatggacatagggaggggaacaacatacaccggggcctgtcagggggttgggggcaaagagagggagagcattaggacaaatacctaatgcatgcagggcttaagacctagatgacagcggggtgcggtggttcatgcctgtaatccagcctgggtgacagagcaagactctgtctcaattaaaaagaaaaaaacaaaactagatgacggattgataagtgcagcaaaccaccacggcacatgtatacctatgtaacaaacctgcctgttctgcacatgtatcccggaactttaaaattttttgaaaattcaagttttcattaaaagaaaaaataaaaggtactaggcagctgggcgtggtggtgtgtgcctgtagtctctgctactccggaggctgaggtgggaggattgcttgagcccaggagtttgagactgcggtgagcagtggtcacaccactgtaccccagcctgggtgacagaccttgcctctaaaaataataatttgtttgaaaattgtagaaatttaaaggtactagacaaattgaaacaaaaacagaaaggaatattaatcatattaatagcagttgaaatagaatttaaggtgagaagcaaattgtgtaattatcagatttcaatataaaggagatataatgaccaatctttatgcaccaaagcacacagttgctaaatatgtgtaatacaattaaaacagaaacaagaggaccttggtaaaatagtgatagtggcagacttttctcataagtggataaatctagtagacaataaagacatatacaaaaattacagtcaatataattgatttaatagatgtttatgctccttaagagaatatacatttattgctatggttcaggaatatttgtaaaaattgaacatgtacttagccacaaagaaaattattttttattagccgggcaaggtggcatttgggagcccgaggcaggtgaatcatggggtcaggagttcaagaccagcctggccaagatagtgaaacctcttttctactaaaaatccaagaaaattagctgggtgtggtggtgtgcgcctgtaatcccagctattcgggaggctgaggcagagaatttcttaaacccaggaggcggaggttgcagtgagctgagatcatgccactgcactccagcctgggtgacagagtgagactccatctcaaaaaaaaaaaacaaaaaaaactagtaagaccctgaactcagtagaagactcagtgatgaaaaggtttataagaaaggcttttttttttttttttttttttgatggagtgttgctcttttgcccaggctggagtgcagtggcacaatcttggcttgctgcaacctctgcctcctgggttcaagcgattctcctgcctcagcctcccaagtagctgggattacaggtacacaccaccacacctggctaatttttgtatttttagtagagacaggttttgccacattggctaggctggtctcgaactcctggcctcaagtgatctgcctgcctcagcctcccaaagtgctgggattacaggcatgagccactgtgcctggccaagaaaggctcttaaacatataaaaagttgcataacttcacagtaaaagaaaagcaaatgaaaaccacactgagtgacagataaatgcagtaagttaatcttgattggatcctggactggaagagatgcaatattttgggtaaattaggggaaattttagtatagactaatatattcaggggtcagtgatctttttctgaaagagccagataataaatactttggattttgcagaccttatggtctttgatttatctactgacctgttacagcacagaagcagatgtagataatacccaagtaatgagtgtggctgtgtttcaattaaacttaataaaaactggcagtgggccatacttggtcattcatgcattagatgatattagtaaactgatgttaaatatcttgtgtgttcagagatagtgagattgtggttatataggagaaaacatctaaagtaggtaggggtaaaatattgtgattgatgtctccctccaaaaaaattgtacaagtatatgcaaaaaaataaaaagccaggcaaagtggtaggtgcttatagttccagctactccggaggctgaggcaggagcattacttgagcccagaggtttgctttaaaaaaaaaaaaaaaaaaaaaaatatatatatatatatatatatatatgtctacacacacatacatatgtgtgtggggaggggttttataagaattggttaagctgagaggaggaggagcaagatggcagaatagtacccttcaaccatcgtcctcctgcaggaacaccaaattgaacaactatccatgcaacaaaataccttcataagaaccagaaatcaggtgagtgatcctagtacctggttttaacagcatctcaaggaaagaggcatcgaagagggtaggaaagacactcttgcattgcctacaccaccccttccctatcccctggcagtgtgcggagatagaatctgtgtgcttgcaggaggaagagcaaaatgattgtgggactttgcattgaaactccagtgctgtcatatcacaatggaatacaacacagggcagaattctgccagcacccatggagggagcattcagactagccccagccagaggagaatcttccgccccagcggtaggaacctgagttgcagctagttccaccaccagttgagtaaagtggacttgggtcctgaataaatttgaaaggcagtcaggccacaggactgcattcttttggcacgtcctggcactgtgctggggtcagagcctgtggatttggggtgcacacaactcagacaccagctctggtagtgaagggattgccactcccacaacttgaagcagtggagcttggggaggtgctctttccatttggggaacggagaggaaagagtacagaatattgtgtcttgcaacttgagcactagctgagccacagtaaaataaagcaccagtcattcctgaagcctccaattctaggccctagaccctggatggtatttatagccccaccctgggccagaagggaacctactggccctgaagggaagggcccagtcttggaagaatttaccacctactgagtaaagagcccttggaccttgaataaatatcagcggtcgccaggcaggagttgccacatgccttgggcaagacccagtactatgctgtgttcagttgtgacccagtccagtgccagctgtggtagccatgggagtgcttgcaccacccctccctcaactccaggcagcccatcatggagagagagactatttgggggaaagtgaaggaagagaatgagagatcgcctaataatctaggaaattcctctccatcttacccaagcacaccaaggtgagacctccaggagcctgcaagggtcacagtcttactgggcttggggctccctgtagtgcagatacggctgcagtgaccaaagacttagattacaacactcaatttcctttgaatacctggaaagccttctcaagaaggacagataaaaacaagtccaaactgtgaagatagaataaatacctaactcttgattgcccagacgtcgatgaacacctgcaggcatcaagaacatccaggaaggctgggcaccttgggtcacgcctataatctcagcactttgggaggctgaggcaggcagatcacctgaggtcaggagttccagaccagcctggccaacatggtaaaaccctttctctactaaaaatacaaaaaaattagctgggcgtggtggcgggcacctgtaatcccagctattcaggaggctgaggcaggagaattgcttaaacttgagaggtggaggttgcagtgagccgagatcatgccattgcactcaagcctgggtgacaagaatgaaactgtctcaaaaaacaaacaaacaaaaaaaacatgcaggaaaacatgacttcaccaaactaaaggcaccaatgaccaatctcatagtgacagagatatgcaacctctcagacaattgaaaatagctgttttgaggaagcccagagaatttcaaaataacacagagaaggaatttagaatcctgtcagagaaatttaagaaagagattgacttttttttttttttttaaagacagagtttccctcttgttgcccaggctggagtgcaatggtgtgatctcagctcactgcaacctccatctcccaggttcaggcaattctcctgcctcagcctcctgagtaactgggattacaggcatgtgccactatgcctggctaattttgtatttttagtagagacagggtttcaccatgatggtcggactggtctcaaactcctgaccttgtgatctgcctgcctcagcctcccaaagtgctgggatttgagtgaccacacccagctgagattgacatatttttttaaaaaaataagcagaggctgggcacagcgactcacacctgtaatcccagcattttgggaggcctaggtgggtagatcacttgaggcaaggagtttgagacaaacctggccaacatggcaaacccccatctctactaaaaatacaaaaattagccgggcgtggtgacacaggtctgtaatcccaggtatgcagaacgctgaagcacaagaatcgcttgaacctgggagacagaaattgcagtgagccaagatcatgccattgcactccagcctgggcaacagagcgaactctgtctcaaaacaaacaaaccccaacaaaacacaaaaaacaaattctggagctgaaaaattcagttgacaaactagaaaatacatcagaatctctcaacagcaaaattgatcaagcagaagaaagaattagtaagcttaaggacagactgtatgtaaatacacagaggagaaaaaagaatgaagcaaacctacaagatctagaagtcacagggcaaatctgagagttattggtcttaaagaggaggtagagagagagagagagggtagaaacttcactcagatagtaacagaactttccaaacccagagaaaggtatcaatattcaggtacaagaaggtcctagaacaccaagaagatttaacacaaataagattacctcaaggcatttaatagtcaaactcccaaaggttgaggataaagaaagaatcctaaaagcagcaagagaaaaggaacaaataacatatgaaggagctccaatacatctggcagcagacatctcagtggaaactttacaggccaggagggagtggcatgtcaagtgctgaaggaaaaaaacgtttatcctagaatatcatacccagcgaaaatatacttcaaacatgaaggagaaatactttcccagacaaacaaaagctgtgagggattttgtcaatatcagacctgacctataagagatgctaaggggagctctttaatctgaaaggaaaggacatgagtgagcaataagaaatcatccaaaggtacaaaactcactggtatcagtaagtacacaagaacagaatggcttgacacactaattgccgtgtgtaagccatattttgagtaggaagactacaaagcctatcaaaaattataattacaattttttaagcgataatataaaaagataaatagaaacaatggccgggcacggtggctcacacctgtaatcccagcactttgggaggctgaggcaggtggatcacgaggtcagatcgagaccatcctggctaacacggtgaaactctgtctctactaaaaatacaaaaaaattagccgggcgcggtggcgggcgcctgtagtcccagctactcgggaggctgaggcaggagaatggcgtgaacctgggaggcggagcttgcagtgagccctgattgtgccactgcactccaagctgggcgacagaacgagactctgtcaaaaaaaaaaaaaagtagaaacaacaaaaagtcaaagagggggatggagtttggagttaaactgtagagttctgttttcgttttctcttgactttttttttttttggtaacgagttatcagtttgaaatagttgtttataagatgttgtttgcaagcctcatgaggcttttattttgaggtaaccatgtaacctcaaaacaaaaaatctacaacaggtatacaaaaaatgaaaagcaagaaataaaactatactaccagagaaaatcatttcaacgcaaagaaggaagggaggaagggaagaccataaaacaagtagaaagcagataacaaaatggcagtaggaagtccttacgtatcaataataacattgaatgtaaatggactaaagtctctaatcaaaagacacagattggctgaatggaaagaaaaataagacccaaccatatgctgcctacaagaaactcacttcacctataaagatatacacagactgaaagggctggaaaaaccagaactcctctttttccatacaaacagaagccaaaaaaagagagcagagtagctatacttaatgtcaggtaaaataggtattaagataaaaattattaaaaagagacaaggtcattatataatgataaaaaggtcagacaatataaaaattatgtatgtgtgtatctatctatctatctatctgtctccacacatacctaacactggagcacccagatatataaagcaaatattatctgagctaaagagagataccatcacaaagaaggcaagaaaacaaacaaaaacggaaaagagccagagagagagagagactcaacaatgcaataatagctagagacctcaacaccccactttcatcattggactcaaaatcaacaaagggccaggtgcagtggcttacgcctgtaatcctattagtttgggagactgaagtgggtggattacttgaggtcaggagttcaagactggcctggccaacttggtgaagccctgtctccactaaaaatacaaaaattagccaggggtggtggcaggcacctgtagtcctagctattcgggaggctcaggcagaagaatcgcttgaaccctagcagcggaggttttgttgagccaagattgcaccactgcactccagcctgggctacagagtgagactccatctcaaaacaaacaaatgaacaaagaaacgtgaccaaccaggggcggtggctcacgcctgtaatcccagcattttgggaggctgaggtgggctgatcacatgaggtcaggtgttcaagaccagcctgaccaacatggagaaaccccgtgtctactaaaaatacaaaattagctgggtgtggtggagcatgcctgcaataccagctacttgggaggctgaggcaggaaaatcacttgaacccaggaggcggaggttgcagtgagccgagattgtgccattccactgcagcctgggcaacaagagcaaaacttcatctcaaaaaaaaaaaagggagggatcaagattttttttttcttagtatacttttcttttccaatttcattgctttggcaccattatagaaagtcaactgatcatatatgtgtaggtctacttctggattttctgttctcttacaatgatgcctattttttatgttaacactacacagtattactgtgtcttcatagtgtgtctcaaaatcactgtgagtctggcagctttatcctttttccagattgttttggcaattctgagtcctttgcattttcatataaactttaaaattagtttgtcaaactctgttgtttagtaagcatgctggaatgattgggattgtgtttatacattagtttggggagaatggacatctaataatagtaagcctttcagtgtatgaacatggtatatatctttgcatttattttttctcagtattatctgtaatttttagtgtatacatcttacatatacattcttgttaaatgtatccttaagtatttcatgtttctgaattggctatgaacagaattttaaaaaatattatcttctagttgtttgtatatagaaatacagttgatttctgtattttgactttgtatcctctgaccttaccaaagtcatttattacttctaggagcttttttgtatattctgtgaaattttcatagacacttataagtagtgacagttttatttcattctttgcaatctgtatgccattttttccttgccttactgcactggctaagactggctgcagtgttgaatagaagtaatgagagaggacatctttccctagttctcagtcttggaaagcattcagtttttcactactgtgtatggtgtcagctgtaggctttcctattattcctattttcctgagagtttttaatcataagtaaatactgaatttcatcaaatgcttttcctgcatctaagcagatgaacctatggtttttcttctttattctgcgaatgggacccaaactgaaggagcagcacctttcctgagacatggcagtctcacatggtagctctgaaagtttcaatctgatcgtgacataacttcacttctgcttattacatccttttgattaaagcaaatcacatgacaggactacacttctctctttgggagggcagagaagtcacatggcaatgggcaagtctgtataatcttctcacagggagggcaacaaataattggggtcagtgatacaatctgtcatgcacattgttcttaattatgtgtacaggttaaatatcccttattcaaaatgcttgggactagaagtgttttgaactttggactctttcagattttgtaatatttgcatatatataatgagatattttgggggtagaaccaaagtctaaacacagaattcacttatgtttcatattcaccttagatgcatgccctaaaggtaatttacaatattcttagtaattttgtatatgcaacagtttatgtacattgacccatcagaaagtaaaaatgtcactacctcagccacccctgtggacagtctgtggcatcatgtcagcactcaaaaagttccagattttggaggatttcaggtttttgggttagagttactcagcctgtataaagctctatgtatgtctatgttagtgtgttagaagaagaaaatgatttggaaagataggtgaagtgtatctttttctgtattttctaatttttatacaaaaatctgttttacaatgtagaaaacattactttttgagaagaatatacatctggttttatttactactgtattctaaatatgattccttgttttagatactcggaattaaaaaaaaaaggatactcagaatttttaatctggaaaggaacattgtttattattttcactatttccttctacccacctcactcccccaggtttatggatgcagaaactgaaaagcttaagtgattttgctccaaggtcatgaagacttaacagaagattcatttagagcaggacactatttgagtatcagaaagcgagaaggaaatcttgggaaattagtttcagagaatataaggtagtttaaaatgttttaacccaagtaatcaccaaattatgctaaaaaatacctgagaagggaaattgattcactcttttacaaatgtatgtggagcacttactactttatcacccactctacaactggaattttgagtggaatagcaagcatttctagattgtaaagggatatatattatgatataaaatatgtgttaggattgtaaaggatgcataaggtattatcaaagatgtttttctcaattttgacatttgagagacccaagcaagtaatcataataataactaaggtatttggctacttataatgtgctaaacagagttgtatgcattttacacatattcttttattactcttaaaaacttcataaggtaggtactattttctatccattttattagttgcggaaatcaaggtgcaaagaagctaaggaaattaccagtcatgtgactaatacgtggaagagccacaatttgaacttgagcagacttgcttcagagcccatgatcttaactgctgcttatatcatgtctgttgaacgagtctaacttgagcagacttgcttcggagcccatgatcttaactgctgcttacaccatgtctgtagatgcagtttcagggtctcactccgtcgcccaggctggaatgcagaggtgtgatcatggctcactgcagcctcgacctcctgggctcagtgatcctgctgcttcagcctcccaagtagctgggactgcaggcatgcaccaccacacctggctgattttttatttatttatttttcttgagacaaggtctggctctgtcacccaggctggagtgcagtggtgcaatctctgctcagtgcaacctccgcctcccaggctcaagccatcctttgaacctcagcctaccaagtaactgcgactaccagtgcacaccaccacgcccggttagtttttgtatttttttgtagatacagtgtttcgccatgtcacccaggctggtcctgaactcttgagctcaaaccatctgttggcctctcaaagtgctgggattacaggcgtgagccactgagcccggcctgattttttatttttttgtagagacagagtctcattatgttgcccaggctggtctcaaactcctgggctcaagcagtttttccgcctcagcctcccaatgtactgggattacaggtgtgagccaccgtgcctggccccttataccattttctaatactatgattcctttctaaacaagagttgaatccaggttaaatatgtatatgagaaaatgaggtaaacaaggagccaagtcttcaggcacttgacacacaggtttagtagattaactggaaaactgtactttgtatatctttatttttgtattattgttgtgtattatagcttaatagttacaagcatgggcttagagtaagacctgggttcaaattctggttcattgcttcctacttttttgcccttgtgcaggtcaaaggtcagcaaatggaagctgctggtttttggtggtttggatagcctgtggtgatggctgcatttctttctcttttcttgatcaggtggatttgtttaaaaagagtcttctgttgattcctattcacctggaagtccactggtctctcattactgtgacactctctaatcgaattatttcattttatgattcccaaggcattcattttaagttttgtgtagaggtaagttaatatactgcctattttttcatttattttgtaattggccaaatagcatcttagctctagatagaacagcagcagtcaaaaccatataggaacagtttatgtcatgaaaatcctccaaagtgttagctgagaaaaggactagaagaggaatctctggctgaggagaggatctgtctaggatccagatccccctctgagatactccacttggattttctctgcttttcccttaaaactacatcttgaatgtggttagaaattgtttttctttgatcatcttagagctaaaattggcctgtatctgcaaaataactcctgtagaataaactataacctaatggaatcaattgacaaaatattagtgttcagctaataaacagatggtgggatacaaaatcaagaaaaatgagtaggtttccggattttcctgcactaccaagaaccagtaagaaaatgtaactgggaataagattccatttataaaagaaacaaaacataaataacccaggaatatgccctaggaagaaatgtggaaattctttattatgaaaactcctaaagctttaagtacttaaaagaaatctgtacaaaactgtaaaagtatttgaatgaaatatggaaaatgttatgttcacagagtggggaaggacttcttaacatggaaccaaagaaaagacataaggaacaattggataaatttaaccacctaataatttaaaacttctgtatatcataaagttaaaggacaagcaacagacttggagaaaatatgtatgatgcaaataacagacaataactatccagaatacatggaaaactcctacaaatgaataaggggaggataaaaggacataatagaaatggacaaaggctaatttagtaaattttaggaaaaatgcaaatgaccatttaaaaacacagagaggtgttcagccttaccagaaattatagaaatgcaaatgaaaactacatcagttaaattttttgcccattatgttagaaaaagtgatgctattcaagtgtctatgtaagtgtaaggaaataggcattctcatattttctggttagagtgtataaattgatacagccgcttggggatagttgcagttctcatcagttctaagtgctttgtaaattaaaaagatacaaattctgttgcatatcagttccatttcttgttatctactgcataaaaatgcttgtatatgcacacaagaatgaggcatgtgcgaggatgttcatggcagcattatttataatagtgcaaaataaaacaacccaaatttagctctagcaagagaatagctaaatacactatggtacggtatacccatactattaaactgaccatagtagttaaattgaatatagtagaccttcaagtcctcaaatggaaagatgtccaaggcatagagctttaaaaagccaattgtggaatgatacggtatagtacacaaatacatgcaggtgtatgtgtagacacatatatacatacatatttgtaagtaaaaaggtgggaccttaccattttttatatcaatgattattacctttgggtaagtgtagaaaagcaggactaatagttaaagaggatttggcctcattttgcgtttttttttttacaaggagaatattttcttgtattatttgtttaattaacatttaatttaaaaattaagtataatgcaaactatgaggaaaatcaagttttcgaaatccacattttcatttccaagaaatccaggaaaaaaaataccccaaaaacaagaagcctcgtgggcccagagttctcacaataccagatgtgagcgtcttttccagttcccttcccctaattccttgcctttctctcaaccaacatattcccatacctgccagagcctgtctatattgtctctttcctagacagacctgcaaaggtataaccaaaagtgcagccatatcagtgcctttaagactcagattctgacaggcagaggagagcagaggtgttgggaaaactgtttcaagtaggaactatttactgtgcctcttgctttgtgccaggcactgatgctagggagtcaggtaggggccagagaaacattcgccttcatggagtgaatgatggttaaacaggattttgtttgtaaaacatgcagttgggtttaagtcgattttgaatcattagggcctggttctgcacagtaataaaaattcatcttctgaatttttgcccaagccctcctgcagagttcttaccttttcagcaaaattacaattggcctaataattttgcacatttgcaaaaagaccctaagaacagactccttttaggtgatagctagaagtcatttagagccaaatacagttcagtcatctggccaggtggggtcaagctgtttttagttttaagaggatgtaggggttgtagaagtggctcttaactaaggggcctgtatttccaaagaattgacaaaaagtgttttaaacagtcaccacataaatgtgtagattccatgacagcagagactacaagagctttattcactagtgtccccagcacttgaacccttagagatgctcagtacattttgagtgccggtgaccatttttaaggacaaatcctttttgcctgtattttacttaagaatgtacatatactggccgggcagggtggctcacgcctgtgatcccagcactttgggaggctgaggcgggcggatcagaaggtcaagagatagagaccagcctggccaacatggtgaaaccccgtctctattaaaaatacaaaaattagctgggcatggtggtgcacgcctgtagtcccagctactcgggaggctgaggcaggagaatcgcttgaacctgggaggtggaggttgcagcgagccgagatcgcaccactacactctagcctgggtaacagagcaagactccgtctcaaaaaaaaaaaaaaaagaatttatatatactgcttattctgagaacttgaagttacttctttagagggagcagtgcaacatgctgtcatactttgttggatattaagtatttgctttcatcatgttttttcttctgaagaggtggcttccagtccacctttttttttttttttttgagtcagagtctcactctgtcccctgggttggagtgcagtggcccagtcttggctcatggcaacctccgcctcctgggttcaagcgattctcatgtctcagcctctggagtagctgggattacaggtgtgcaccaccacacctggctaatttttgtatttttagtagaaatggggtttcaccatgttggtcaggctgatcttgaactcctgacctcacctcatgtgatccacctgcctcagccacccaaagtgctgggattacaggtgtgagccaccgcgtctggccctggtccacttttgttggggggtggggtgggttattcacataacctctgacttcactcttgatgtggagagagacgcacagaggttgagagcactggggacattttgaaactccagcaggcttcatcttggtagatagttcaacagtggacttgagcatatttagtattcagaaggaattttagtattactttccagaagctgaatgttaaccttttctgcagccctcaaaaataaggagtgtatcagaatatctaaggctggaatatttttcatttagttttagttattaatgatgtctgccatgggttcctttcctctgttgagcatgggcaatgatgaagactttctttttgacttgccagtatgtaagtttcaaatgcagcaagctgacttactgctgggaagggctggctaaccatctcataaaacgttctgattacacaaatgccagcgtccacagtcttgatgcataccttgaatacagaaggtctgactcccccttaacaatatgaaatgaagagtctgaaataaagtcccggctttagccgggagcggtggtgtacacctatagtcccagctacttggaaggctgaggtaggaggatctctgaagcctaggagttcaaggctgcagtgagctatgatcacgccattgtactccagcctgggtgacagagcaagatcctctctttaaaaaaaaaaaaaaaaaaaattgttccagcttcttaatgcatattctgcccagttatggggccacagcctcctcctttccttctgtctgctatgggcatgttccatttttcaccaactgatggaacacagcatctgtgttgtggtttctttttaaccagaatataagaaagtatttgctgactgaagccagagaaaaaaatagacctgaatttcttcagggttggcagactgctgttacgaaggtaagtatgtgataacaatgaaacccaggcatgtccaggggatggaattatctaagggtgggtgcctttaagagcatttgaagactagtgacagagataccaaggagagcctggaggctccagggaggcagctgagaatgaacttcagttgactattcatcatcgctgctcagttgcccagtgcttcccgggagcaaatcacttcagtcatttcctccctgaggaagttgctaatgatgtgtttgctcttctggggaaaaaaaaaatcttttttgggtggcacttgcctcttgcatcatggctcttatttccagatgacccatatagacccagagaaatgctgaaatgactatttggatccactgagggggagaaagtgcattgagctacttggcaggcatgtggggaagatagtagcccaagcgcttcagtcccaccactgtctggatgcagcaccatgcttggcccatgacattcaaactgtggggcagagtgcccaggcacagccgctcattcctgtcgtaaataccagtgtcttcattgatggtgggctgtgttgtttccagtgtttttgtgtattggatctcatttgatccttataacctgtgaggtaggcaggtcatttagggataagcatcgtctttattttgtaaatgagaaaactgaagcccaggtgtgattttccccaaaggacatcaaaactattgatacagagtcaggtccttgaacacaggtctgtctggatcattgacaggatgttataggcaggatcttgaaacaaacctttaacccaaacccaaagagacaagatttattagttcacccttgaaccgaaccaaatgctaaattttaaaattaagcttaagttttgtgttttgaataacctagtataccagttcaaaccagaactagtaaatttcctgaatttacccaactaaaaaatctgggtattctaaatttagtcaggatcttctgtattaccgctttgagcagaatacagtaaccagttcttttaaaaacatactgttggccgggcacagtggctcacacctgtaatcccagcactttgggaggcaaaggtgcgtggattgcgtgagtctaggagttcaagaccagcctgggcaacatggtgagacctcatctctacaaataataaaattagccaggcgtagtcccagctacttgggatgctgaggtgggaggattgcttgaactcaggagactgagatcgtgccactgcactccagcctgggcgacagagtgagaccctgtcgcgaaaaacccaaaacaaaaaccatactgtttaccttcacgatttctttcaaagaataggacagggtcgtgtgatgtgagatcagaagtgaagactgctcagcggagttgtcgccatcctagcatccagaggctgggcctttgttctcccaggcacagttccattttgactccactgtcaatgaattgatagcagagctcagtatccaaatgcatgttttaaaacaggtttttacatttgatttcccatttctcatatttaggtaaaacattgtcctataaattggggttgccacctgatagctctttttatgtggccaggtgcctccataaaattagatgcttgagatatcagatataccagctgtcctggagagagaaaagtttcctatcttttgcgcatttttccataaaggagtttttcttatctgaagagaagtaatggatcttgttttaatgactattttgtttttcccttcagtgtattccacaacagaaaaacgacagtgactgtggagtctttgtgctccaggtaaagaaacacttgcttttcggaacttacaatgtgtgaattgagtctgttgggttgagaggggagagatggcagttcctgtatgtgtatatgatgctaggtacgagcaacggagtactttccctcccctttattgctgaggagcagtagtttctgcatgttcagatgttatcattaggaagaaccaccttccagggatcaagagtgaagtgtgggtgtcatccatgtctcactggaggttattagtaagccacattggagactgacttgaatttgtccatatcataaccattggcatttgcataaaaaaaaaaaaaaaaaaacattggcaagcaatctgcaggtctttgacacagtgattagattttaaataaggtccacgttgagaaactgccatcttgtgctgtagatctccttagagatcgaaaagggctatggaaaaaaattcagttatacatatatttatgttggaaattacagaatatgatgcatgaatttagagatttgcaaagatcttggaagaccggttcgtttgtatacctcatgcatgtttggggttttataaacaaattcaagttcccattaagggccatgatgggtctagctgcactccagcaggttgcactttgggaggaattgaggccttttcatcagttgctgcttttcacagtattgggtcaggagggagaggagatcccaagccatgcactagcttggtcagtcacctataatttgggtaaatgcttaaaacagtgtatttttacagtagtttaaacagacatgaaaatgctgccttagatcggggtcccaaacccctgggccacggacagatactgtccacattaggttctcttaggagtgtgaaccctgttgtgaactgcagatgcgagggatctaggttgctcaccccttatgagaatctaactaatgcctgataattcatcctgaaaccaaccccctctcccccaagtctgtggaaaaattgccttacacgtaaccagtccctggtgccaaaaaggttggggtcttctgccttagacactattaggtctgcatttagtaaaacagaatgggctggtccacaactccaagtgccactgaagtgtttctgggacctttttttttgcagtactgcaagtgcctcgccttagagcagcctttccagttttcacaagaagacatgccccgagtgcggaagaggatttacaaggagctatgtgagtgccggctcatggactgaaactcagcagggactctgggaagtctgaccaagttggagcagatggtttgttacttgaatctccaaacacttagttgaatttttacagatatttcagatcagtggtgttgggccactattgttacctcaaatttattttttgcccttattcatttctccagctaccatgtactattgtttaatgttcagtttggtttcatttttaattttatggttctgtgcgtcccccatatttaatatttattattcaaacgcatgcatatagacagagcatgcagtgaagagtattaaaaaaaaaagcttagtagatttggtgcagcttttgaaacttagttagacgtgaactgaatacaggtttcaaatttactcccagaacctaaaaatgcaagatgtttttgatacaacataactctgagaatagtaagtgttccctggggcattaagggtagctgggggtggttttgacaaatccagtcctgttttactttaccagcggcaactttcaccaacttccctctccaagtgagtcttagagagtgcagtccattccttttgaagggtgagatggaagtggtcgtaaactgactggtgtcttctgtttctggaggcacacttgtaagcacagtggctgctttgggaggagtaaggtgtgagaaaaagcaaccttggaggccagtaacaatgacagatttcaatcgtggttttaggaattataatacgtggcatacatctcataaaggcttttgctgggatattgaattccctgaatttttctgttttcgacctgttaaaaaaatcttaacatccatcaaactagtggtcaaacaaatgagaatgcagctgttctcagagtaatttttaagttgtcatttccctgtgttgcctcccaattggaagaagttaaggtttaccaaatgcatttctatttcaagggtatctgaaacgtaaacattcaaaactgaaggctgactgacttgagatgttttgcaggtggctggagagaagagggaaggtaatagagacaacttagtcccatgggagcgcagcaaccgtgtcaggttctttctcctgtcccattagtgacctcagtaacatgcagggtacgtctggcttctgcatggccagtgctgacactagcacagctgttcttctccttctgttgaacctcatcttctgaagaaaggccaagtggcccttgtccatacacttagctgcattaggatgaatatcacgcgtctcacatctttaatccagcctttcgtgacatgttggaaagatacatgtgaaacctacccagttaccctttctgaattgggaggaaaaccaaccaatgtatgtatgagaaactcagaagtctgaatagaaaaacaaagtaaatggcagaagattctcgagtttatgcccgcgtaggtttggagtgttgaaaaagctaaaatgtttagtttcacttggccctgaggtatggttgagaaggctgactgccagcagttgaggattgagtccgaccatgtttacatgcagggttcccaacaccagtggtgacactgggaagcagccccagcactttcctctcctgagtcctccagacccaaaatccttaatgtcaaaccaggtcagtgtttcttactgtgtttcaagtcgttaaaaagactgagagtagaggcactttatgctgctataggtggggttctgtcagcgttaggaaaaaatgacagtttagggtaaggaagatctcataatgagtttttcaaacataattatgcaaacatgagatttttcaaaacatgccagaaatttgcctctgattttttttttttttttttttttttttttgtgggggtgtggtataccaaagtagccagtcactgggctgtcagttcaaaatgtcttgtacttcagagtgaggaagtgtttcagttcctcagtgacagaacctggcatgcagaagagacagaattgttcctgtaagaaaatcaacgccgagagagagctgcccaaatccagtgactcttccacttccagtctcatgcttcatagggcaccttgaggtgtgctgcccagtgtggcttagactaaatgttgagtttgggttttttgtttttttttttttttgagtcagagtctcactgtccctcaggctggagtgcaatggcgcaatcttgcctcactgcaacctccacctcccaggttcaagcgattctcctgcctcagcctcccaagtagctgggattacaggtgtgtgccaccacgccccaccgatttttgtacttttagtagagacaggatttcaccatgttggccaggctggtcttgaactcctgacctcaagtgatctgcccgcctgggcctcccaaagtgctgggattacaggcgggagccaccgtgcctggccaatgttaagtattttaaaagtcattttaaaatatttgtcattgatgaaacttggtttcagcacacgtaattgctttccctctcttcttgtgattaggtgtaaacctctatttaactcaagtcctagattagaatgtcctttgtcctgatgtttgcagtaattgcttccttggttaataaagatatttttgaaatatactctggactgttggtgaaagaggcaggcatggctttactggtactagtttggcactgaactgtttgggtgcccatgaggtaggcagaccttatgctttttttttttgagacggagtcttgctctgttgcccaggctggagtgcagtgatgtgatctcggctcactgcaacccctgcctcccaggttcaagtgattctcctgcctcagcttccccaatagctgggactacaggtgtgcgccaccactcccagctaatttttgtatttttagtagagacagggttttgccatgttggtcaggctggtctcggaactcctgacctcaggtgatccacccgcctctgcctcacaaagtgctgggattacaggcatgagctaccgtgcctggcctaaaccttacgcttttgaggttgagtgcaggccttgtgataactaagcgctacttttgacgagccttcaacaagctgcccagtcctctcctcagcagacgcatcaggttgtagttgcatctttacagtggtctttccttttattaaatctatagcagtgaatatagatttgattcaacttttagttacgttctctcaagaatcctaatcaactttcagttagcctcttaagaaagggaaaaaaaggtgctgccagtcatccccaaattatgtttttggctgtgcattctattttctacatagcactgaatctgagtaacagtcatcctggatttatagttggaacagaacagtaacagacctaactgggactcagccagcactagcctcatcttagctgccccttttctctgctttgcagtttactgcttccctgggctagccataacggggttctgggcaggtcagactcttcagcaagacagtgtattaatagtgtgaattagatacactgatgacctgctctgcctagttaagaaactgaattaatcagcagttacaaagcacatactttgttacgtgctaggctttgcctcctggcctctagataattaagacggcccagggaataccagcagagaagtgctaattgtatttgggtgttacaaaagcagacctagacgagctgttcacttaactggtacctgttggtcagaaaaagaatttatttagagattatgatcatgtaaaattacagtactcaacccttctagcaaagtatttttttgaaaaataaactaaatgcctttataa

SEQ ID NO: 396 - DNA, 92792 bp, Homo sapiens
cgtcttcctcccccagggttgtggccacgcgcagcggcggcggttgttccgcttcccctccggcccgggccgtcgccattgccgaaggctccctcccctcccctccctggcgtgcgcaggactccgccgccgctgggcctagcggtagcagcggctgctccagcgcggcgtctcttcccgccccgcttccccttccctcccctcccctccccgcaccgcgcgctagcccggggcggctccgcagcccgccgggagctctgaccgaggcgcctcgctggggcggggaccttgccttgcccggggtaagtgcacacaggccggccggcgcgggacgcaggccgggtctcttcctcctccttccttctccgtggcctggcgggcgggagcggcccgggacggccgacctgccccgcgcggggccggggagccgccacctgcgtgctgggagccgcagctcctggggcggtggctcattgtctgctccccagggccgttttcttcgctggctttagccagaaatgggaagctcgctgggctgcggaggtctgactcttcctggacccagccctgctctgaacctcgcggcaccacggtctctgccgactctcggtcttccctcccctcgcgtttcaccctcttcctttgctccgttttcttaatgctggaccagactctccggttttgttccttgatttttcctctcactgattctcagcccctgcttgctcgctctctgttcacccgtttcactgctcaggaatattgtcgcgagtagcttgactgttttctcagctccagcctgtaacctcttttccacattccacattggtaaaaacgtagagcgtcccgggcgcttgagggccaccgcttacgaactgatctttcggagcttctcctcgctcctgtttgagcttcagcctaggggtgaaatttgcttctttagataacttaggtgaagttaagattggtttttcaccatgtttggctctcttggaaacacacgcacgcacaaacacaaaacgttgccactcaaccttttaactaattctttaaagataagtcatccaagaacagaagcgtgtcatcgtcagtgggtgtgaggttgtacccatccttgtatcttaattttagtagtactctccctgggcagtgtgagcgtgatttgttgtcccttgataaataacgaactccggttgatatcattatctcacttctgcgttacaggcgatgtgtcctttctttgttttcttttttaacctttataaaaagacaaaatggttaggcctaaaattaaactacgaagagctgtgttttggatcaaggttgtgcacgtcacgttttttcccctgctgtgttcgactcttccgctcttataagtaggcaggatattgaaatgtacaagaatttgctctggggattttgtttttgtagggttgtccaatagaataacactcagtaaagttacattgggatgaaggcagtgaatagtaatttttaaagcaggttaaaacttgtcaactttgccagaaggtctgtggcttctgtaaagcccactcatgctcgtgtatatatgaagagcctttttcatgttctgttaggagtatggatttcaggcaactttttcactgtgtcatcctcggctattaaatctttcgagctacttattagccaagcacattgattgacacttattacggaaagtgaacctgtaatagatgtaggtcttaaaccaactttccgatttggtaacaggttgacctaaattcagtgtattttgtgttttcactaagtagcccattgttacctttccctccagcaaggctctgaaaaaagtggctccaatactcagcttcaatactgtcatcatttcttaaatagtagtatcagttgtccttaacttaatggatgttttattggcctgagggattaaggtgtagaaaggttggagttttgttggagtttgaaacttggtctgtagatgttggcttctctgccagtttcttctaatcagcagatatttttatgaaggaagagttcctgggtatttcacttcccttagggccttggtttatggtttactctcattcagagagagatactattctggactccgtgctatttaatactaaccttgcaaacccaaattcaaaattaagtttatagttcgagtatacaggcgatagggctctctgatctttatgatagacaggttcccaagtagatgcggttaacaattaatatttcttttttttttttttttttgagacggagtttcagttgcccaggctggagtgcaatggtgcgatcaccgcaacctccgcctcctgggttcaagcgattctcctgtctcagcctgctgagtagctgggattacaggcacgcgccaccacgcgcggctaattttgtatttttagtagagatggggtttcaccgtgttggttaggctggtctcgaactcccgacctcaggtcatctgcccgcctcagcctcccaaaatgctgggataggcgtgagccacggcacaccaccaacagtttctatttcaattatactttttaagagagactagaacttgttcaggtagctaaagataaactttcaattatacttttctaatatttaagaacttcaagtagccaaggataaaatgagtaggaattgttagattcttccttttatccatcaaaatcgattattattataataatatttgagtatatttcttttggctttctgacttttacacttttggttaaaatttgaaactgggtcttcttcgccgggcgcggtggctcacgcctgtaatcccagcactttgggaggccgaggcgggcggatcacgaggtcaggagatcaagaccatcctggctaacacagtgaaaccccgtctctactaaaaatacaacaaaaaattagccgggcttggtggcaggcgcctgtagtcccagctactcgggaggctgaggccggagaatggcgtgatgaacccgggaggcggagcttgcagtgagtcgagatcgcgccactgcactcccgcctgggctacagagcgagactccgtctcattaaaaaagaaaaagaaaaagaaactgggtcaacttcaagactttaagtcgtaaaggtttccatcagtttggtataagagttgagtttccagactaatcagagggagggtgttaattgcaaattgtgtgtccaagctcttcctagtatcctttttgtgccttaacagagcagaataggaaaggaaaaaaatccctcattgcccccaaaaaataaaatactggttgttttcttctgtgatcagagttgagtttcatcacttcttcccttctagggtcacctgcctggttaagggtagtcagtctgaacattcattcaggatttcagtgttccagcctactatctctgagtttctttagtacttactccatgtatcccatgtggttaggagctagagtcctgcgtttgaattcttgctgttctactttaccctgggcaagatatacattcttttcaagacttgcttttctcacctgtaagatggggataataataataataccaatttcacagggatatttagatcaaatgagggaatgcaggtaaaggattctgtaattataggtcttaataaacgttagttaatagtctgttcttacatgctgtagagtcgatactcctaaacttagaattaaaactgccttctaggccgggtgcggtggctcacacctgtaatcacaacacattaggaggctgaggtgggccgatcacttgaggtcaggagttcaagaccagcctggccaacatggtgaaacctatattctctactattctttagtagagaatttagtattctctactaaaaataaaaatattagctgggcgtggtggcgggcgcctgtaatcccagctactcaggaggctgaggcaggagaactgcttgaacccaggaggcagaggctgcagtgagctgagattgcgccactgcacttcagcctgggtgacagagtgagactccgtctcaaaaacaaacaaacaaacaaacaaaaaactgccttctaaaagaacgaagtttctgagaccgtaactaaaaataaaaattacttttggatgaataaaatgtaatttttcaggagaaaaaatatgtaatagtttcaccactgaaataaaacatagggtttttgaacacaaatttctcagatttaaaaatatgcatatttcctgtataaaagttgaaaagtgggcagtggctggtggtgcctgtagtcctagctacttgggaggctgaggatcctttgagtccaggaatttgaggtcagccaggacaatacagggggaccccatctcttaaatcagacaaaaataaaagtagaaaaaaatattaaataagaaatttggaaagtggtaaaaacttttaagacaaaattaccttagtctcagctggcagaaccattgtaacaaactggaacagtggttttgttccttattttaaatttaaattctaaaagcagtacatatttattataaaaggttcaaacaagtcaattaaatatttaaagagtgaaaattctttgggagactgaggcaggaggatcacctgagctcaagagttggaggtatagtgagctatgattgcaccattgcattccagcctgggtgacagagcaagaccctgtcttataaaattcttaaaaagtgaaaattactttctctttttagtcccattccttagaagtacctacccgctgttaatagttttacttactgagttagaaataagtagtaccttttgtgtgtcggatactttttatgttgattttaaaataaaaaatctgatcattaagtattgttttccatatcatgacatatagtggcacctctactttttaagtcattagatattatgctgtatggtagtactttaattatttgtgatcatttatgttatttctaactttgagcaactaaaactagagccttaatgaacttatacgtatgtctttgtgcacatgcatatgtagataagtatttccattaaaacgacttgtaagtgtgcatttaaatttcttttttcttttttttttgaattgcattccaaaaagacttgtaatgtatatttccttattgagttgtagaagctcttcacatgtaatagatattaatctattgccttctgtttaagatcttcctcattccacctttacaaaaaacattcttatgtgttttcttctggtacttttaataattattgtgtttcaatcttttttttttttttgtgacagagtctcactctgtcactcaggctggagtgcagtgttggatctcagctcactgcaacttccgcctcccgggttcaagtgattcccctgcctcagcctcccgagtagctgggattacaggcaccataccatcgcacccaactgattttttttttttttttttttttgtagagacggggttttgctatgttggccaggctggtctcaaactcctgacctcaggtgatctgcctgccttggcttcccgaagtgttgggattacaggcgtgagccaccgtgcccagcccattgtgtttcaatcttaatctttctggaattttttcatgcctggtggggataaaagagttttaaaatagttttgctacagaaataaaatacaggtataaaaatatttggccgggtgcagtggcttacgcctgtaatcccagcactttgggaggcctaggtgggtggatcacctgatgtcagcagttggaaacagcctaaccaacgtggtgaaaccttgtgtctactgaaaacacaaaaaattagctgggtgtggtggtgcacacctgtagttccagctactccggaggctgaggcaggagaattgtctgagcccgggaggcggaggttgcaatgacctgagatcaagccactgcactccagcctgggcaacagaacgagactccatctctaagtaaaaaaaaaaaaagaagaagtagtaactagatttttctgttcattggtatttttattatcttactggacttcagtaaacgtctttattttgttttccaggttcattgttttatctgagaataatagtaacttcagtcacttttctatggttacaatatttaaccttttttttttttctttttctttcttttttaaagacggggtttcaccgtattagccaggatggtctcgatctcctgacctcgtgatccgcctgcctcagcctcccaaagtgttggacaggcatgagccaccgtgcccagcccttaaccctgttttaggtctttattacattggcctgaagttccaagacttggttaaacaagagacgtgtcgttgtcttgaaatgactctggtattaatatttttacagttagggatgatggcagctgttggatttagagaaagattattattttattctgtttctgctttacaaaaaataggaatggcttctgaattttatgagatgctattgtaacatttagatgatgatatggttttcttcttttaactattgctgaggatatgtaatagtaaatttgctattaatcaaaggtatcacaaggtatatatcgtgaataaccaaaatcccactcatattagtcctgcgtacggaatttattgaaaggttagaggagaatctcatataaatttagattaataagaataggccgggcacagtggctcatgcctgttatcccagcactttgggaggccgaggcaggtggatcagctgaggtttggagtttgagaccagcctgaccaacatggagaaacctgtgtctactaaaaatagaaaattagccaggtgtggtggcaggtgcctgtagtcccagctactcgggaggctgaggcaggagaatcgcttgaacccgggaggcggaggttgcagtgagccgagatcgtgccattgcactccagcctgggcaacaaaagtgaaactctgtctcattaaaaaaaaaaaaaaaaaggataggcctttatgataacttctgtagttaacttctataacctattcaggaatccttattcatgagtcacttttgataattcgtatttcctagatcatttcttttagattttcaaatctgttactatataggtgtgtataatcttttgtcattaagatctgtggtattcatttccttttttttattagtgatttcactatttttctgaatttgccaaatgtttgtctacttagtggttttttttactaaccagctttgagatttacttattgtattggtttttttttgtttgttttctgaatgcctgatttctacttttctctttattttgctctcctgctttttttttttgttgttaacaatgttaacattaagttaatgttaatgttattaattcttaatgaattcttagttcctttaatgtgttttcgatgagcggtaatcgctcctcggatagacctcattggctacgataccgccactgtgcaaagctagttcattttaatgtcttttaataataaaaacctttaatgttcttaatttgcttttgaatgcagcgttggctgcacattctaatttacatggacaatgttcttctgctcagtattttccaaatagctggtggttctagttttgatttcctctttgactcaggaggtatttaggataattctattcactcatattttctttcattgttgtcagcttctataatcttttaaaatatcttttaaacttattgagtgtttcttgtgacttaaaacataatccattttggaaaatgttctatgaaaacttagaacattttctgttggtaatatacagagttttatacataacctattgattaaatttaatgactaagattatttgtatgaattaccagtttttataaatagttcttactaaatataggacttagtctttattagtcctagtaagaactatagtcgttattaataattcttattaatgtaaaaatcttcctaatctgccaaagacaaagaggtagcattgtttctgagaagcttgttctcacgttgggacctttagatttttatttcttctgcctgaatgtcactgaggccatatttgaaagagatctttcatgatcacctctgcctacccccactccgcatctaacttcctgcccttcagtgtgtttattttcctttatagcacttccatctgaagtttctttttcatttatttggttttctttaatatactattctgttttacagagctttgaacaaataggtatgaaataagtatgtgttggttgagtgtcactctcttatttctaatgatttttagaaatttttattcattttaattaatagactttgcagcattttaggttcacagcaaaactgagcctaaggtacagagttcccatataccccatgctcctcatgcccctcttctccaagcctcctgctcatcaacatcctgcatcactgtggtatatttggcacagtcagtgaaccagcattcacacatcatcactgcccaaagcccacagtttacgttagggtttgctcgtatggtattgtacattcagtgggttttgacaaatgtataacaacatgtctccaccagtatcataccgactggtttccgcaccttaaaactctctgctccacctgttcctcccacttttactgcaacccctggcaaccgctgatccttttactacctccatcgcaatgccttttccagaatgtcccgtagttggaattatatagcgtgtagccttttcaacttggcttctttcacttagcagtatgcatctgaggttcttccgtgtcttttcatggcttgatagctcatttcattttagcactgaataatattccattgtctggatgtacattcacctattgaaggaccaggtttggtgattatgaataaagctgctgtaaacattgatgtgtggagttttttattgtggtgtaaaatacatgtaacagaacttaccatcttaaccattttgaagtatacagttcagtggtactaaatacatttatagtgtgcaattatcaccaccatccatctccgaaactttccatcctgcaaaactgaaattctatacccattgaaccataactcctcattctcctttctgtctgcatgattttggctactcttatgtaccttatgtaagtggaatcatattttgtgtttttgtgacttatttcacttatcctcaagcttcatctgtgttgtagcatgtcagaagttcttttcttttttttttgggtgaatagtattcccatgtgtgtatttaccttattctgcttgtccatttattcatcagtagacacttggattgcttccgtaatttaggtactgagattaatgctactacgaacatgggtgtacaaatacctctttgagaccttgttttcagttatttcgggtacatacccagaatggaattgctgggtcatatgataattctgtgtttcattttttgaggaactaccgtattgctttccacagcgcctgtatcacttcacgtttccaccagcagcgcacagcagttcagtttctctacatcctttttaacacaaccgttgttgtttttaatagtagccatcctaatgggtattaggtggtatcatgttagttttgatttgcatttctctagcagttagtgatgttgagcattttttcatgtacttattgaccatttgtatatcttctttgaaaaaatgtctattcaagtgctcatgtgtaggttttcgggtggacataagttttcagctgatttgggtgaataccaaggagcatgatggctggagtgtatggtaagaatgtatttcattttgtaagaaactgttcaactttcttccaaagtggctgtaccattttgcattcccaccagcaatggatgtgggggttcctgttgcttcacatcttttccagcatgtcatgttatcattgttttggattttacccattccaataggtagtagtgtttcattgttttctgttttttttttgagatagagtcttgctctgttgcctgggctggaatgtagtggcacgatgagaactcactgcagcctcgagctcctaggctgaagcgatcttctcacctcagcctccagagtagccaggactacagatacgctaccttacctggctatttcttttttttttttttgaaacagagtttcgctcttgtcgcccaggctgtggtgcaatggcatgatctgggctcactgcaacctccgcctcctgggttcaagtaattctcatgccttagcctcccaaatagctgggattataggcgcctgccaccacgcctggctaattttttgtattttttttgtagagatgggatttcaccatattggccaggttggtctcgaactcctgagctcaggtgatccatccacctctgcctcccaaagtgctgggattacaggcgtgagccaccgtgcctggcctatacctggctaatttttaaaatctttttgtagagacggttcactctgttgcgcaggctggtagatacttcttttgcagatattttttttctaagtctgtggtttaagttctcattctcccaactctgatgatttctgtcatgttttgattcagtattatttggtacgtgtgtaaattctacactgctcaagatcttcattatgaattgtacctcatccatgaaaatgattgtcctgtacgatcatgatttaacatttttgcatcttatattttgcttgtcttaaattcctgttgtactttgttttttgttcaataaattattcaacattatctttccttgctgttttttgttgtgtctttttaaaattgcgtgtagtttatttttgctttattccaaagtgaatgcttaaaacatattaatgcttaaagcattaaaaatgaatgcttaaaacctaaaataaagtttaaaaaaaaaaaaaaccaaaacatgtttattataataaatgctttctggtatgtttctgttattttatttaatgctttctgttttttaatgattaattgttgctttttttaattgttgtaaaatacatgtaacataaaattaccatcttaaacgttcttaagtgtacagttctttggcattaagtactcacgttgtggtacaactttccctaccatctgtcttcagaatttttttcatcttccccaactgaaactcggtactcattaaacattaactcctcattccctacctccagcccccagtagcctatctctaatctgttttctgtctcaatgaacttgcctcttctggatatttcttataactggaatcgtgcaatgtttgtccttttgtgtctcgctcattatttcatgtagcgcagtattttcagggtttatccattttgtagcatatagtataggttgagcatcgctaatctgaaaatccaaaatccgaaatgctccaaattccagcactttctgagtgctgacatgacatcacaagtggaaaattccatatgtaagtacttaatgcaaaccatgtttcgtgcacaaaattatttaaaatattggccaagcatagtggctcactcctgtaatcctagcactttgggagggcaaggtgggtagattgcttgaggccaggaattcaagaccagcctggccaacatgctaaaaccccgtctctactaaaaatagaaaaattagccagcgtggtggcacgcacctgtaatcccagctactcgggaggctgaggcatgagaatctcttgagcccagagggcggaggttgcagtgagcccagatcacaccactgcagtccagcctgggtgacagagcaagactgtccccccaaaaaacacacaaatttatttatatacatatatatatatatatatataattcaggctatatataaaaggcatttatgaaacacaaatgaatttcttttttttttttttttttttgagaccgtttcactcttgttgcccaggttggagtacaatggcgcagtctcagctcactgcaacctcctcctcccaggttcaagtgattctcctgcctcagtctcctgagtagctgggattacaggcgcatgccaccactctcagctaatttttgtattttgagtagagataggatttcaccatgttggccaggctggtcttgaactcttgacctcaggtgttctgcctgcctcggcctcccaaagtgctgggattacaggtgtgagccaccacacccagccacaagtgaatttcatatttagatttgggtctcatccccaacatatctcattatgtgtatgcaaatattccagtattagaactctgagacagttctagccccaagcattttgcattttggataagggatactcaacctgtagtacttaattcctttttaagggtgagtaatactccattctatgtattataccacttttgtttatctgttcacctatcaatgttttctttttttgctttgtaaattgtatttggtttgcttttatctcagatatttggaatgtatacatcctgtttttaaagtatattagcttaagtgaattcaagtctaaatctaaattgaaaaaaaattttctgatctgtaagcctgaaaaagaaaattgttttgactcttcctatatctgaagattataagatttttttctcttaaccctttctcactttatcctcctttcacctccgtggtgagcttgggacacagaatattgttaatgtattttttgtatatttcatgtttctaattccatcttcttttggtaattttgttttatttatttgtttgtttgtttgtttgtttgagacagagtttcactctgttgcccaggctggagtgcaatggcgcaatctcagctcactgcaagcacctcttccctggttcaagcaattttcctgacctcagcctcccgaatagctgggattacaggcgtgtaccaccacgcctggctaatttttatatttttagtagagacagggttttgtcgtgttggtctcaaactcctggcctcaagtgatccgtctgccttggcctcccaaagggctggtagtaaaagcatgagccaccacgtctggcctatttatttttgagacaaggtctcgctcttgtcccaagctcaccatggaggtgaaaagagggtaacgtgagaatgggttaagagaaaaaaaaattttttttttttttgagacggagtctccctgtgtcacccaggctggagtgcagtggtgccgatggctcactgcaacttccgcctcccgagttcaggcctgaatagctgggattacaggcacccaccaccacgcctggctaatttttgtatttttagtagagacgaggtttcatcatgtgggccaggatggtctcgatctcctgacctcgtgatccgcccgcctcagcctcccaaagtgctgggattgcaggtgtgagccaccgcgccgggcctgagaaaaaaatcttataatcttcagatataagaaggttgcccagtttggagtgcagtggtgcaacctcagcttgctgcagtctttcaggcagtcctcccatctcagccgcctgagtagctgggactacaggcacatgccaccacacccgcctaatttctgggctcacgtgatcctatcttcctgccccagcctccctaagtgctgggattgcaggtgagagccaccacacctggcctaattatttcttttatctcgctaattacatttagtattaacacaagttattgaaaccttgtttatgtgaattcattgctcattgccagctttctgttttacatttaaattcattagtcatgtataccatctagtgtacattttcagctagtattttcactaggagtacctggaagccacatttaatgatttagattgctaacttccctcagaaattctgttgatgttgttctatcgccttgcattaatcattttgtttttttcctgtgcctggatggtggtaggaattttcctttttctttttttaaaaatattttgacagattctgtcttgtacatgttcactaatgttgcctgaaacattagttccttatgatctttgtacttggtgctttttaaaaaatttccaataatacttttggtgattacttttgtttcaattgttctgtttccttccttgaaaacacatgtaattattaggttggctcaccatttctgtcccctatgtgaactgctcaaaagtttgcccttttttaccactcgtttgatttttctttttcacttctaatgttggctttatttctgctattgcaatcttaatttcttagtatccttttaaaatttatctcacttttcttaaattatcttatctcatcctggtttcttctctccatatactcctgttttgtgtcatttgctaaattgtgactggaagttcctgaagtaatttaccttgtaagttaggttctgcttttgtgtgaagggtaatcttccttgtggttttcttttgctattaggatcagtgctggatttcttactgcctacttaccattgaacagtaactgttatgtcctgtctcatgtgcatttgtcagagatgtgtgtgtgttttccttgcctctccaggggactggagttctgatgaaaccgcttctcagatgtatttctgagggataaatacacagctcccggcctgatttccagtgatgaacagacattcctcttcatatggtattctgggctagggtagtaggatcttaccctaccctgtttctgtctttgtgagtctgaactgatgatgtatgagagtggccctcatttctagcatgtgctgctgttacaggttttctgattctgatcttacacccacaacataacactctccttgttacttcactaaacctcccaggaagcagtgtgtccattcgggttttcctgcccttacacagccccgctggaaccttacctgcacacgggcgcagacacacacttcctggtttgctttctggaatttgcgcctggtaatctccctgaatgtatgttgagagatcacagaagataaggaactgtggctgccacaaaaactgcctctgtgtagcaaggagtggctgaccaattcttgattctgctttgattcttcaaagccgactctgagtctccaaataaagcgatggctagtagggagagacaagatatcttcatagttcttttaggcagatgattgaactttgttttatgaggcagagcatggctgggtcacgagtctttttgcagtacagttgaccttaaagctaattgaaatccttcaaagatctcatataaattgtattggtggagatttgggacagactacgttggagatttctgatttgatagcattatttactagagtaaacctgttccaattttttgaaacttaggtaatcacttaagtagtaacatcagtcttgaccttcatcttttaataaaagattttacctcagattgatagattttcactttggtagtaggagaatggtatcttgttccattttgcatctgtttgataaatctagtgaggctgaaaatttttcctatgtctatggaccctccctccccatttttccattttgaattgctatttggggttcatggccaaaattaggaaaaactagacttcagagtgtttacgcatttcttcttccgacttttttttttttttttttgagatggagtttggctcttgctgcccaggctggagtgcagtggcacaatctcggccctctgtaacctctacttcccgggttcaagtgactctcctgccttagcctcctgagtagctgggattataggtatgtgccaccacgcctggctaattttgtatttttagtagagatggggtttctccacgttggtcaggctggtctcgaattcctgacctcaggtgatccgcctgcctcagcctcccaaagtgttgggattacaggcgtgagccactgcacccagacttcttctttttttttttgagacggagtctcgctttgttgccagcctggagtacagcggcatgatcttggctcactgcaacctccgcctcctgggttcaggcgattctgctgcctcagcctccttagtagctggggttacaggcgagcaccaccatgcctggctaatctttgtattttcaatagagacggggtttcactgtgttggtctggctggtgttgaactcttgacctcatgatccgtctgccttggcctcccaaagtgcagggattacaggtgtgagccaccgcacccggccccttccaactttttaagtaatctttcttgttgctgacttgttgtctccctgttccctaccgtcaggcagttttgaagcattttctgagcctcgccacttgacttcctttacgctttgtcattgtttcagttttttaatgtggtgattgagtgaaagccaaggggaagaagaaaaagagaaaaaagggtcacatttgaattacaaaatgcctttacactccctgtgtcctctgtatatagataccttcctctctttctttgcctgacaaattccttttcatccttcaaaaagcaattctgggttttttttgcctaattactctcatctaaacaggagctccgggtccccctttccagtgcgttccactgggccctgtcagcagcttaactcatttcagagtagttgttatttgtgagctccaaactgagacttaactcttttaggcacttaataaatatttgaatgaatgaataaattaggagtattagtaacaaaatgcttgggctgggcgtggtggctcatgcctgtaatcccagcactttgggaggccgagctgggaggatcacaaggtcaggagttcaagaccagcctgcccaatatggtgaaaccttgtccgtactaaaaatacaaaaattagctgggcgtgatggcacgcgcctgtagtcccagctactcgggaggctgaggcagaagaatcgcttgaacccgggaggaggagattgtagtgagctgagattgtgccactgcactctagcctgggtgacagagcaagattccatctcaaaaaagaaagaaagaaacaaaatgcttattccttggtgctgcaatgaaatagcactcagcataaatttaactttctcagcaaggcagttttacttgctgcataaagggtgctcctcgcagatggaacaatggtgagagcacacctgaacaagggaggggaaggggttcttattcctgacacaggtagcccctattgttgtgtcattcccctgttggctagggttggactgcactgtctaagctaattccgattggctattttaaagagaccagggggtatgagccagagtggcaggctgagtagtttagtgggaaggacggttaggaacaggtaactcaaggtgacttaggtcagagcaggtgaccaggggtgactcaggtcaaagcaggtgactgggatgagtcaggacagagcaggtgactgggggaacagatgtgaactactgatgaaaactggtggaaaaggttgtttagtgaaactacgctgaagttaaactttaaaatggagggcaatactggttctttgaagagaaatctagaactcactgtatccaacaggagagatttacaaagagtttctgttattttttccatccacgtcatttccctgcttagtaacttctagtgtgaaaatatcaaaagcaggtatctctgagaagtggacttaggcttattcttcttttcttttagaccttattctggtttgaggtttttgtgatcatcatgtactacttttattatataagaataaaaaaaaattaaccccaaacccctcaaatttccaggcgcttcctgttgcccagaccctgcaccattctggccccactcagcctagttttatttcccactgcttgccagctgtgccctgtgatctccttgctgtctcatgagctacgtggtacttatgttcctgttgcctggaatcccgtcttctggtcaggaagatgatctgcgataaataccgagaatactcgcgttagatactgaatagtgagagtttagactcacgacctggggtgtcatcttgaacatacggtgcttaagggatgaggtttctgggtcagttttattggttgtgatgaacaagataaatggagcatttgtcttagcttctagaatagtgaccttaaaagagatagaacagtgaatgtatcttcaaacttgcctgggtctccactagcctaaagaagaaaaaaccctttaattctgatgctgtcacagatgaaatcctttcattcactgatttattcattcaagaaataatgactcatcacctactctgggctaaacacagtgtccagtgtgatggtgatgtaatggtcaacaagatagatactcactgggtccttgcctgtggagtttatacgtagttagagaagacagacattaaaagaagaaatccagtgtgatgaatgttgagataaaaggaaataaaccaatacttgtggcagtgaagaggtatcagaggtttcctgagagaatgacatttaagctagtacttgaagtaggtgtttgccaggtggaggtggtgggcagaaagtagagtcatcagttcattctggtttgtccacggctttcctggttttagcacgacacgtcccgtgtccggggaggtcatgtgcgaaagcttcagatggcaattaaagaaacagtaagaatagaaaaaacttaaagcctgaagagggaaagactaaagtgagatgagtctagaaagttagacaggagcctgatgatgcacgcactgttgggctttacctaagaaccatgagaaggttttaagtgggaggatgaagtgatagtatttttattttattttattttagtttattttattttgagaaagtgtctcgctctactgcccagggtggagtgtaccctggcatgatctcagctcacagcagcctccacttcctggttcgggcgattctcatgcctcagcctcctgagtagctgggacagcaggcactcatgatcacgcctggctaaattttatatttttttagtagagacacagtttcaccatgttgcccaggctggtcttgaactcctgacctcaagtgatctgcccacctcagtgtgccaaagtgctggcattacaggcatgagccaccacacccgtccaaggatgttaatttcttaaaaagggaaaaacttacacatttttattctcgtatttttctgtcactggatagaaacattactagcagagtaaataatccagatgcctgtcttcagcctttttgtcagacatgaagagtaagcatagaaggtaggaggcatggctgtgaggtcgttgaagtgatcttttcctgaacacagcaaatactataaatggtttttgtcaccattgaagtagtcccattgagagactgcctgattatcccagtgatgcttccactcttcagattatttctagaactcttctttttgcattgccctgggagcctctggcatattcttcagagtttcttcttcaccagaggcaaacttttcatccttgcctgtgcctctgtttcaggtcagtttctcttgctctctgcatctatgtttggcccaattggtttctttcttttccttaaaaattccttaaattttaaaaaaacagatattcatatacagtaaaattcaccctttaaggtatacagttaagtggttttttttgtttttttttttttttttttttttttttttttttttttttgagatagagtcttgctctgtcacccaggctggaggctggagtacagtggcgtgatctcggcccactgcaacctctgcctcccaggttcaagcaattcttctgcctcagcctccagagtagttgggactacaggcacgcaccaccacgcccagctaatttttgtatttttagtagagatggggtttcaccatactggccaggctggtcttgaactcctgagctcgtgatctgcccgcctcagcctcccaaagtgccgggattacaggcgtgagtcactgtgcccagccagttaagtgggttttttaagtgtgctcacaaagttatacagccgtccccactatctaattacagaatatttgcaccacctcagagagaaatactgcactgaatagcagtgactccttatttcatctccccgccggccccaaataccactaatctattttttgtctcatgaatggaatgatacaatatgtggtcttttgtgactggtttctttcatttaacacagtgttttcaaggtccatccatgctgtggcatctctcagcacttcattccttttacagtcaaatggtattccattgtatgggtgaaagagacagggtcttctatattgtccaggctagtcttgaactcctgggctcaagtgatcctcctgcctcagcctcttaagtagctgggatggtgcacacctgggttattttcagttttttgtttgtttgtttgttttgagacagcgtcttgcactgtcgcccaggctggagcacactggcgcgatctcagctcactacaacctccgtctcccgggttcaagcaattctcctgcctcagcctcctgagtagctgggattgtaggtgcccaccaccacacccagctaatttctgtatttttagtagagacagtatttctccatgttggccaggctggtctcgaactcctgagctcaggtgaaccgccggcctcagcctcccaaagtgctgggattacaggtgtgagccaccaagcctggactctgagtatgatttcttacctcattgttcatatttctacagtgataagtaggcatcatccatgtgcagccgcattatgggcctgtaaccatgaccggtctgtgagtttgagcagtttgaatgcataaggatgcattcttatgctatccaaattatttgtgctttgctggtgaagattctgaaacaaggtgtgtcattagaaagtgtttacttgtttataacggccttaaactactgaaggtgtataggatatttatgagtcgtgattcaaagtgtgagtttaaacgtttgttggtgcctccgtgttaaaagcattatgttagatagtgtcagataggtacagagatgtatggaaagtgttacctgccagccagtttataatcttgtagaaaaaagaaaagttagggctgagcacagtggctcaagcctgtaatcccagcactttgggaggctgaggcggatggagatcaggagttcaagaccagcctgaccaacatggagaaaccctgtctctactaaaaatacaaaattagccgggtgtggttgtgcatacctgtaatcccggctactcggtaaggctgaggcaggagaaccgctttttttttttttttttaatttatttttttattgataattcttgggtgtttctcacagagggggatttggcagggtcatgggacaatagtggagggaaggtcagcagataaacaagtgaacaaaggtctctggttttcctaggcagaggaccctgcggccttccgcagtgtttgtgtccctgattacttgagattagggattggtgatgactcttaacgagcatgctgccttcaagcatctgtttaacaaagcacatcttgcaccgcccttaatccatttaaccctgagtggacacagcacatgtttcagagagcacagggttgggggtaaggtcacagatcaacaggatcccaaggcagaagaatttttcttagtgcagaacaaaatgaaaagtctcccatgtctacttctttctacacagacacggcaaccatccgatttctcaatcttttccccacctttcccgcctttctattccacaaagccgccattgtcatcctggcccgttctcaatgagctgttgggcacacctcccagacggggtggtggccgggcagaggggctcctcacttcccagtaggggcggccgggcagaggcgcccctcacctcccggacggggcggctggccgggcggggggctgacccccacctccctcccggatggggcggctggccgggcggggggctgacccccccccacctccctcccggacggggtggctgccggacggagacgctcctcacttcccagatggggtggctgccgggcggagaggctcctcacttctcagacggggcagctgccgggcggaggggctcctcacttctcagacggggtggttgccaggcagagggtctcctcacttctcagacggggcggccgggcagagacgctcctcacctcccagacggggtcttggccgggcagaggcgctcctcacatcccagatggggcggcggggcagaggcgtcccccacatctcagacgatgggcgcccgggcagagacgctcctcacttcctagatgggatggtggccgggcgcagacgctcctcactttccagactgggcagccaggcagaggggctcctcacatcccagacgatgggcggccaggcagagacactcctcacttcccagacggggtggcggccgggcagaggctgcaatctcggcactttgggaggccaaggcaggcggctgggaggtggaggttgtagtgagccgagatcacgccactgcactccagcctgggcaccattgagcactgagtgaacgagactccgtctgcaatcccggcacctcgggaggccgaggctggcggatcactcgcggttaggggctggagaccggcccggccaacacagcgaaacctcgtctccaccaaaaccagtcaggcgtggcggcgcatgcctgcaatcgcaggcactcggcaggctgaggcaggagaatcagacagggaggttgcagtgagctgagatggcagcagtacagtccagcttcggctccgcatgagagggagaccgtggggagagggagagggagagggagagaggagaaccgctttaaccggggaggcggaggttgcagtgagccgagatcgtgccattgcactccagcctgggcaacgagagtgaaactccgtctcaaaaaaaaaaaaaagaagaaaagttagaagccaggtgactgaatttcaaggaagtgtgcaagtaccatatggatggatgggactgtatcattctgggtccaatcaggagagagaagccatacagtaatttgaacatgaaaaaacataattgactgactataacagggtaattgagtaatgagggattagccagtaaaaaaatagagctctaaagaacattggaatagcaaaagtaagaagcagctacttcccctagggctgagatagaccccccaccccctgcctgggaaagagctattccttttcccagagctgagatccagaccttattggagagagcgtggttgtaaatcactgaatggcagagatgtttctgccatttaatggttctttgttggccatagttgttggacatctgccctttagggtgccaaggagaattattaactctgatacaaaactgctcaaaaagagtatgtggggtggctccctgttgcagtagactcagtgctgctggccaccttcccctattggagtctgatgctggaggagctgcctgcccatcaggagtcttgtgacaactggaaccaggaagcaaaactccttttcttctgtgatgtctctccagcgccctatatcgacaaagcttagcatcgtgtcccggcaaaggaaaaatgcttgaaggcctcagatccgttttcggaatggacagaaatgatgaatttggaatggagaggcactagatcagtaactggcaggagaatggtattaactgctgcgggagctcagagacggagcagaggtcacatgacagtaaaagaagtatttgagaaagagcttagaagatgagtagatttttaaattgaagattgcttacgttttcatggcaaaatagtatctgcattttagaaaaaatagaatatagacaagtattattgtctattttctatagaaagaaaggaaaggcactcagatcactgtctacaaagagatccagtgttaattgcttgataaaaggtgtctggccaggctctgtcacccaggctggagtgcagtggtgtggcacgatcacggctcactgcaagctctgcctcctgggttcatgccattctcctgcctcagcctccagagtagctgggaccacaggcgcccaccaccacgcccggctatttttttttttttttgtatttttagtagagatggggtttcaccgtgttagccaggatggtcttgatctcctgacctcaggtgatccacctgcctccgaaagtgctgggattacaggcgtgagccaccgcgcccggcctgctgctgcttttgtatctttgcagaaaacaattggcttttaggtgtaataatgctaaactttataaacagacactgggaaaaacttcctacttttggtatttcaactgtgaagtttatttgcataacttctttatgataagtttgtcaaataaacattttagcgctcttcaagtgacctttaggaagagattttctgatggaacatcgtatcttagaagtccattttttcttgccaggcgcagtggctcacacctataatcccagcactttgggagaccaagacgggcagatcacttgaggtcaggagttcaagaccagcctggccaacatggtgtgaagccgcatctctactaaaaatacaaaaaattagccaggcatggtggcgggtgtctgtaatcccagctactcgggaggctgaggcaggagaatcacttgaacctgggaggcggaggttgcagtgagccgagattgtgccactgcactccagcctgggtgacagagcgagactctgtctcaaaaaaaaataaataaataaatacagatagaagtcaactttaaagctaatacccaatttctaatttaatttaatttaattttttaaaatagcgtcttgccacgttgcccaggctggtctctaactagtgggctcaggcagtcctcccgcctcaccctcccaaaatgttgggattacagctgtgagtcactgcaccgaccccaaattttcttttcttttctttctttttttttttttttttttgagacggagtcttgctctattgcccaggctggagtgcagtggtgcgatctcggctcactgcaaattccgcctcccgggttcacgccattctcctgcctcagcctcctgagtagctgggacactacaggcacccgccaccacgcccagctaattttttgtatttttagtagagacgaggtttcaccgtgttagccaggatggtctcgatcttctgacctcgtgatccacctgcctcggcctcccaaagtgctgggattacaggcatgagccaccgtgcccggccttttttttttttttttttttttgagacagggtctcgctctgtcacccagactggagtgcagtggcgtgatctcagctcactgcaacctttgcctcccgagttcaagcgattctcttgcctcagcctcctgagtagctgggattacaggcacacaccaccatgctcatctaatttttttgcatttttagtagagacggggttttgccatgttggccaggctgggctcgaactcctggcctcaagcaatcccccacctccgcctcctgagtaactgggattacaggtgcgagccaccgcatccagcctgccaaattttctaaagtagttttgccagtttatactcctgccagctgtatataagaattctctttgtgccatattcctgataacacttgatttgaatcagccttcttgttttttgccaatgtagaaggtgtaaaatggtatctgctagaggccttaatttacatttcattaatgtctgaggttggacatattcttatgtatgtgttcattatttgtcatcacttgtgagaatagataatacaggtattactccattatattggtggttaaataaagggactaaaaggaagagtgatttggctttcagtatgcaacttgataagtggcagtagtttatttgcctagactggctaacattgtttatttgaaaaacacattttgagtttctgtgatgtatataacactttgctaggtgctccttgagaataaaaagagctataaaattagtatcttctttttttttttttttagacggagtcttgctctgttgcccaggctggagtgcagtggcatgatctcggctcactgcaagctccacctcccggggtcaagcgattctacctcagtctcctgagtagctgggattacaagtgagcaccaccatgcccacctagtttttgtacttttagtagagatgaggtttcaccatgctggccaggttggtctcgaactcctgatctcatgatccgcccgcctcgacctcccaaagtgctgggattacagacatgagccaccatgcctggcctcttttttaaatttttatttttatattttcttctcaaaacttagtaccttctcacaaagagtagagttcagtagaggaaatatgatacatcatggtagctgacaatagaggcataacctataaataatagagctaataacccggtcataatctggttaatgagtgtttgctaactgtgtaatacatataatacaaaaagttaccattatagataccataatctctaaagatgtaagaacagaaccagtgccaatttacattcaattctgttccgtattttggtcttcatttaattgtaaatgcaaataaggtgcatatgtcgtctacaaagcaaaaaagtacaaggattttcttaagtgatcagtggatggctatcttactacaagcagtattgttcattcttcataagctggtgattttatataatttacggagttccaaaagcgaatataccaaaaatatatattcagagaaatctaggttttaacttggtcccatctctcccaaagtaactattttttaaaattttggttcctccgccaaccccacccccgacccatgcggtaactatggatggtgatggatgtcttaatttgattgtgataattattgcacaggatatatgtatatcagatcatcatgttgaatatatgcaattttgtcaattatacctcagtaaagctgggaaaaaattatggttcttccatttaaaaaaaaaatagaaacaagtacaccccgtgtgtgtgtgtgtgtgtgtgtgtgtgtgtgtgtgtgtgtgtgtattgatacaccttccccccatctcttttggtaaatgatagcatcccatatatatttttttcttccaactggttttcacttcatatattatggagattactccatggcagtatatggagctattttctcatttgtttttatagcttcaaaattatttagtgtagaatgttctgtagttagttgagccattcccctatttatggctgtttgagttacttccagtcttttgctgttactgataatgctacagtgacagcctagtgcatatatctttttgtatttttgtgagtatatcctttggatagatttttagaaacgggatatatgggtcaaaaggtatatatgtagtcggtactcctaaacactgtgttatattgctttcctatgacttgaaaattgtagattattaaacctatcctcacagaattttaggaggaaaaaatcaattaatgccctgactataatagaaaaaaagaaaaggcgagcaatttataatgaaatacatgttttttgtttgtttgtttgtttgtttgagacggagtcttgctctgtcacccaggctggagtgcagtggcatgatcttggctcactgcaacctccgcctcccgggttcacgccattctcctacctcagcctcccgagtagctgggactacaggtgaccgccaccacgcccagctaattttttctgtgtgtgcttttagtagagacggggtttcatcatgttagccaggatggtctcgatctcctgacctcgtgatccgcccgcttcggcctcccagagtgctgggattacaggcgtgagccaccgtgcccggctgaaatacatgtttttatttgtaaatacttgatcacaactatactaaaagccattatgcagtgaccagagacttgtgtctatacataggggtgaccacagtgcggtctcatcatatggactctgctgttggtgactcaaccagcatgagcacagtattgctagtgacatgatttccaaaattgtgaataaacttcttggtgaagtctgagccaaagtacaagctcctcttggttcacatagtggttgcatatctggaaaattcagtgtatgctaaaactggaaaaatattttcatatgtgaaatagaattttgtcctcagttcagatcattataagttttaaaatgataaatcaacacgtggtgggacactgaggagttgtgagcacattgcaaaacatcggatacctgtggtccctgctcattgaatgccagcagaactgcttttcattcctaatcatgtttattttttactctctttgttttgattaattttgccgagatattttactagttttgcccaagacactatttttggctttattgatagtcctttttgtatattagttttctgttcagtaatttctgatttatcttgattatttccttcctacattctttggatttattttactgttttttatacttcttaggttggatgcttaactcgttaatttttagttctcctttattttatttatatatgtatgtatgtatttatttatttatttatttgaaacaaggtctcactctgttgccaaggctggagtgcagtggcaaccccaacctcctgggctcaagtgatcttcctgcctcagcctcccaagtagctgagattacaagtgcaagccaccatggccagctaattctttatttttatttatttttatttttgagatggagtcttgctctgtccctcaggctggaatacggggtgaaatctcggctcactgcaacctcctcctcatgagttcaagcgattctcctgcctcagcctcttgagtaactgggattacagacgcgtctcatcatgcccagctaatttttgtatttttagtggagacagggtttcaccatgttgcccaggatggcctcgaactcccagacctcaagtgatccaccgcgcccagccccccagagtgctgggattacaggtgtgagccaccgtgcccggcctacttttatttttttacagggtcttgctctgttacccaggctggaagttctccttttttgatgtaaacattcagagctagctgggcactgtagtgcacacctataatcccagcaatttgggaggccaaggaggatggatcagttgagcccaggagttcaagaccagcctgggcaacatagggaggccctttctctacagaaaatacaaaaattagctgggcgtgatggtgcacgcctgtggtgccaaccactcggaggctgaggtgggaggattacttgagcccaggaggttgctgcagtgagccgttattgcaccactgcactcctgcttgggtgacagtgagtctcaaaaaaataatataaataaaaattcagagctgtaagggcttcgtatcctagttttttgttgtgctgctggtgaaatatacataacataaaatgtattatttaagcatttttaggtgtataatttggtggcattaagtatattcaatgttgtacaaccatcaccaccatccttttccagagcattttcatcatcccaagcagcaattccgcatcccggccaggcgtggtggctcacgcctgtaatcccagcgctttgggaggccaaggcgggcggatcacgaggtcaggagatcgagactgtcctggctaacacggtgaaaccccgtctctcctaaaaaaaaaaatacaaaaaattagctgggcgtggtggtaggcgcctgcagttccagctactggggaagctgaggcaggagaattgcttgaacctgggaggcagggcttgcagtgagctgagatcatgccactgcactccagcctgggcgacagagcgagactctgtctcaaaaaagaaaaagaaaaagaaaaagaaattccgcatccattaagccgtaactctgcatgttgcactttgccccgtctctaatgacctttattctactttctgtctatgaatttgactaaggtatctcacttgagtgaaattaatacagtgtttgttaggccggacatggcagctcacacctgtcatcccagcactttgagagtccacagtgggaggatagcttgagctaaggagttcaagaccagcctgagcaacatagtgagaccttgtctctgctaaaaagtttaaaagttagctggggatggtagtatgcacctgtagttccagctacttaggaggctgaggtgggaggatcactggagcccaggaggtttagaccgcagtgaggtctgatcatgccattgtaatccagcctgagtgacagagtgagaccctatctccattaaaagtatatatatacagtatttgtccttttgtgtttggcttattttacttagcatattattttcagagttcatttttattaataatatatatcagaatttcattcctgagccagtatggtggcatgtacctgtagtctcagcacagctacttgggaggatcaggtgggaggattgcttgagttcaggagctgaagggctgcagtgctgccctctgatcatgcctgtgagtagccactgtgctccagcctgggcaacacggcaagaccccatctcttaaaaaaagaattgtttgtgtgtatatatgccacattttgtttattcaatcctgcaagttttttatatatagtattttattttattgtattgtattgtattttaaagacagagtccagctctgtctcctacgctggagtgcagtggcaccatctcggctcactgtaatctccgcctcccgggttcaagcaattctcctgcctcagcttcccgagtagctgggattgcaggcgcatgccaccacgcccgactaatttttgcatttttaatagaatcagggcttcactatgttgaccaggctggtctcaaactcctgacctcaagtgatctgcccaccttggcctcccaaagtgctgggattacaggcatgagccaccatgcctggcctgagttttttatatatagtctttaaatctccattcagttctaaatatttttcaattttcattatgtctttttttaactggggtttgttggaggtgttttcaaatttctaaacatgtatttctttcctagttatctttttgttattttaaacttaattgactttaagagtgtgtagtgattctggtcttttaaaaaaaacaattgtctcaatgtttctgtttacctcattcttaaaaaatagttttgttgagtttgcagtttatgttggcagcttcttgtctcaacacactgatgatactccactgtcttcttgctttcattgttgatatcaagaagtaagctgaccattcaattactgcttctgtgaaatttgtctttttttctcctttggccaattttaggaattctttgtctttgatattattaatatcactacgatgtgtctacttgtagataattttctatcctgcttttgattcattagacttctacttacagatttgtgttctttatcagttctggaaatttctcagctattaatttgttcagtggaccagtccttcattctaccaccttctggaactccaagtagttgtatgttagaccatctaatctactcatctcctctttcatattttctttttctgttttttttgagacagagtcttgctctgttgcccaggctggagtacaatggtgcagtctcagctcactgtacctctgcctcccaggttcaagcaattcttccgcctcagcctcctgagtagctgggattacaggtgcttgccaccacgcctggctaattttgtatttttagtagagatggggtttctccatgttggtcaggctggtctcgaactcccgacctcagatgatccacccgcctaagcctcccaaagtgctgggattacaggcgtgagctaccatgcccggcctcctctttcatattttctatctcattgtctgcaatgagttcattagttcattgttcattaattctgtctaacactatgtctatgctgctttttacttcaaatgttgagttttagctttcatttattttttcttattgaaagttctgtatggtgttttcatattcgctctattctgcttttattttcaagctgcttctatgtgtcctttgacacagcattccatatctgtgtttttcagagatttttcctcctcttgccatcaccattttcaaaatgctaaaggttctcttgttcctttctgtccagagggatttattcctgattggttgttatgtgcattatagcctttttcaggcctagccttatgtgggagggacgcctgttaatttttcaacattaggcagactgggttttactacctgtcccctgtggcagccatcaaagtggaagcatgaggtctctggggtttagtcagaatccctcgagaataagtagattagtaaattgcttactctttttgagttcctggttttgctttggtttgggctctatggaatcatccctcttattttactagcccatccatgcatttaaaaagacttgatacgttatccagacctttatcttagagtttgaagcgaagttttagtttccttcttttttaccagcctccagattgtgttttctgcatctcttttctcgctttccctcttttctttctggatttgctactagtgggactgatgttatggccattgtcaccgtcaccacatgagaacactcttgcttcagagttgtgaaccttctgtttagagtgtgtgttgtcatcttcaggtgatttggaaatgttttcattcatgcttctgctctcaaagacatctgaggctcttttgtgtttttgacggggcaggtggggagggaagggccactggtgttgggctcttgcagcttattgagagattgttgaaagtctgggtgattaattagtgttactgcattcataatgtactgaaaaattaaggctcacttgttatttatataaaaagtaaataaaaatgctttttaaatcattgtgtttttcagtaatagatggtttacacttggagtactgtagttgatcccagcagataatagtaagtttagtaatctccactatttgggctgaccggttccagataccactccgctgttcgtttctgctgtatatttagccacccctagtctccttcagcagacaattgaggaattgtttgtgtttgagtcgtgtcacagttaaacagtgggcctcttagaagagtacagtgtgttttgggcacactttttgtttcgcctacttgtttttcactgaaaagtagcaaaaagtgtttgaacagatttagagagaggcactacttaccgtttgctcttttttttgtaaaacatttgttactaatggttaagcaaaacataaggtaaatcagtattttaccatgaattatttttatacctaatattgtttttggctaacatataagatgaacataaggaaccttatcacagtctcatttggtacttttcaggcatttgacactgtcagaagtagcaattcacacacaaaaaatactgttttatggaaaagagaactgaaggtcatgaatcagctgtgaggggaaaagtataaatctttctaaatatatttttgttaatatggggtagttgatgttgtctagtgctgtttgattaagaaaacaagttcaggccgggcacagtggctcatgcttgtaatcccagcactttgggaggccgaggtgggtggatcacctgaggttaggagtttgagaccagcctgaccaatatagtgaaaccccatctctactcaaaaatacaaaaattagccagacgtggtggtatccgcctcccagctacttgggaggctgagacaggagaattgcttgaatccaggaggcagaggttgcagtgagccaagatcacgccactgcactccagcctgggcgacagaatctcaaaaaaaagcaaaacaaaacaacaaattcaattagccgggcgtggtggcgcactcctgtaatcccagctactcgggaggctgaggcaggagaatccaggaggtagaggttacagtgagccgagatcacgccactgcactccagcctggggacagaacgagactccgtctcaaaaaaaaacaacaacaaaaaaaatctgtggacacagtatggtaccataaatcagtaaacattgcctaatacatgcacagtacctgcctttgaattgcttgaggtcttaggtaggaaaagcagataaaataactaagggtttatagttgtaattcattgccgaagaatggcccagtatattagcataagtaagaaaaaagagcctgagattcagagttgttaggaaacttgagttctagtcttagttctgttagtaattagatttatgtgcctttaggctaaccacttacttttgggtaagttggttttttttcacatataaaacaaggcagatggactagatgacttaatcctttacaatcttaataccgtgtgaatttgttttcctgtgtaactcgagtttagaggatgtgagggatctttttgggcaaggactgacctcaggaaggaaatcattttcactaagccttgaaagatttggttgggtagataaaaggaaaaagaaaagctaagaatgcagaaatagatacataaaaattatttaggccaggaaagtctttggtgtatttgaggaatatgaggcataggattgacatggtgcagtcacgtgagatgaaattgactcagcagttcagagttcagtggccctaatgccagagtttagtcctcagtctgtaggttatgggcagctagtcaggacgatgtgtagccagggagagtcatagcacttgttacctttagtcaacttctgcatgataattaaggtatatttaaccaattctgacttctttctcccaacaaaaaaactgaacacagagaaaccctctagggagctagttattaggtggtgcaaaagtaattgcagtttttgtcattacttgtaatagaaactacttttgcaccaacctaatagaatttcttccactcaacaacaactgaaaacatagagactgagagaaatccagagatgatgtggtaaatccccagctaagcagctggtagaggcatcagtattgtatccaaggccatgcttatatttattgagatctagtcactcgtggtatattagaattgtggcggcatggttgtcatcttgaataatttcattagggacatctctgactcaagtttactattaaattagggttttgttcaggcaagtattgcttaaagggtacgtcatgttaattggaatttccttgagacagctcattcagcatgatagtgtgtagtcactaaaaagttccgaaaaacacaacgctgtggttcctctttagttctattagactgagtatgtacagaacataagttactgcatagtatactaacattgaacagtagaaaaaatatttatttatttattttttttgagacggaatctcactctgtggcccaggctggagtgcagtggtacgatctcggctcactgcaagctccgcctcccgggttcaagcaattctcctgcctcagcctcccgagtagctgggactacaggcgcccaccaccacaaccggctaatttttgtatttttagtagagacggggtttcaccatgttggccaggatggtctcgatctcttgaccttgtgatctgcccgcctcagcttcccaaagtgctgagattacaggcgtgagccaccgaaggataaccaaaatgtaaggaaaggctgtgttctgaaagttgctgtgtaatgtcatttgcttagaatttagcattgcttctcatgaatgaaaatgtctctctggctcagccgtgaaaaagccttctgacctttctgatactgtaatgaaaagcagtatggtaaataccattgcatgcatttgggttttcaacatgttaaggattgaagaggtttctgtaccctagcttggaaatctagctgttgcttatttgttctgttaaaatgtgttctgtcgagtataagatgaaataaatatgagtcttctgccacctccgtaaaacatcaaagcatttggggtatgtaggtgaagggtaaagatggagtacgctttaaagcagcagttctcaaagtgtggtctgcaataccgtgggggagtctgatgtcaaaacctttttccgaatattcttaacacattatttgctttcacactgtgttgacgtacggattgatggggcaaaagcagaagtgggtcaaattgctcgttactttaacccataccaaggccatggccaagtgcttgcagtaaagtgccagtttcacgtaataatatacttaatggaacaataaagttattgatcaagtattctatatagcaaaatgggaagtactcataaggtacttctgcgtaccaaagtatgaaccgttgtcttggagataaccacttctgcaagagagctaaactagccctctgtttcatgcaacacctttttttatttggaagaacaactgacccacaaattccggttgttcagacttcgtattttgcggacatttcctcaaaaatagtgacagaatttgttgctactgacacaatttaggctttcaatcaaaaatcagagttttagaaaacttgtatccactatgttgattttagcagtttctcagcgcttgacttactctgatgacatagatggtgatattaatgaatgtggttttatttttactgcataacgagatgtgtcaacattgggagtatcttcaaaacccagggaaccaatattttccaaaaaccaattcatgacattgtaaaacttctgcatgggtaacagattcattcaaaattcaagagagtcaattggtttaatgtaatagggtacaagaagattcattgctgtgatttcagattccacaatgaaccttttaggaaggtcaggtttagtgtaataccaaagaagaaaatccacaattatgtgaaagctgttaaaatgctcctccgttttcaggtgggtatctgcgtaagacaagatttttttcgtaaatttcagctaaaacaactcagcacaacagattgaatgcagaagcagatctgatcatctggctgtcttctaccacaccagacatgaaaaagacttgcagaaatgtcaaagaatatcagtcttctcactcaacttattttgttttggaaaatagtcatttttcataaaaatgtatgacatgtaatgggtttgttgttatttttaaatgaattatttaaacaacttggttttttttgttttgttttgtatttttgaggcagattctcactctgtcacccaggctggagtgcagtggcatgatcttggctcactgcaacttccgcctcccaggttcaagctattctcctgcctcagccgcccgagtagctgggactacagacacgcgccaccacgcccagctaatttttaaatttttagtatagacggggtttcagcatgttggccaggctggtctcgaactcctgacctcaagtaatcccccgaccttggcctcccaaagtgctgagattacaggcgcgagccaacatgcccagccaaaaacttgttttaatttctcatacagtaagtatatataaacataaccctcatcaacaaaaactctttggactcttcattaatgttgacaagtgtaaagggtcttgtggccaaaatgttttgagaacggctactttgaaggagctgagtagctttaatatgcctgtgttgagagcagataccaataaagggaatgcctgacctaacttaaaacaagtacgtgttggtctttctccaggttatgaactcttacagaggactcaggtcgtcttttattttctctaatgtctagcacagagtcttataaatagtaatgatgataacaattgcagcagcttttaatctttgttagctcatttaatctttattctgtgagtagatagtgagatataatttgcataaccaaaaattcaccattttaaagtgtacaattgagtggttttagtgtattcacagggctgtgcagccatctccactgtcttcataccggaacatttgcgtcccccagagaaacttgatacccattaggagccccatctcatttccctcactccttagcaaccactcactaatcagccgtgtttatgaactaaattcctctctgtctctgtggatgcccctgttccggacatttcatatgaaacggaatcctacaatatgtggccttttatggcttttttcacttagtgttcgagggtcatccatgttgcagcgtgtatcggtacttctttttgcggccaaacaatattccatcttatggatacaccacgttttgtgtatccgttcatcagttgatggatatttgggttgtgtctatcttttggctgttatgaatgcttctgtgaacattcatacaaagtttttgcgtgaacatgtttttcagttctcttggctatatacctgggagtggaattgcggggtcgcatagtagctctatatttaatttttgaggaacttactaactccctttttaatagagtttttattaggggataattttagatttacagatgaattgcacagatagtagatttcctgtatacctatcacccggcttcctctaatgttaacatcttacataaccgtgatacgtatgtcaaaacaaagcagccaacattggtacctcactgttaaccaaattctaggatttatttggattctactagttgtttcaccagtgccccttttctgttccaggatccaatccagggtgtcacgttgcgtttatggttgtgtctcctctgatctgttacagtttctcagtcttgtttttcgtgtccttgacagtttggaggaatgtagtggtcaggagttttgtagcatatccctcaactggggtttgtctggtgtttttctcgtgattaggctggggctgtgggtttgggggaagaataccacagaggtgaagtgtgcgtcccatcacattagattaggggataagtaatattgtcatgacttgtcgctggtgatgttaactgtggtcacttggttaataaggcatgtttgccaggttttttcactgcaaagttatttttcccttgccatacactgttctttggaagtgagtcactaagtcctgccttcactcaagaggagacaaggattaagctgaaactcctagagggagacatatttacctattttatttgcaattcttctgtaagaaagatttgttccttttctcccatttatttacttattcatttatttatgtcagtatggaataacatacttatttgatactttgggtcgtaatctaatagtatactaatttgctcaaatcatcccagcattggcctatggaaaatctttcctgtgtccctttggcatttcctcatccttttaaagtgctcccttgccttctgacactacagcgtgctctgggctcatcttccattttccctttcccatgcctagagtcagccattccttcaaggagtcatgagacgtggtgaagtgtaagtcggtggtggaaacaggattccatgcaaagcagtctgattctggaacatatgctgttaaccaaaaaactggataacatgcagctgatttattattattattgaaggtgcattggcagtttctactcacattccatctatgtgggagccttgaggaaagaatttatagcactttacactaattattgtgccctgtttttgttgttgttgttttttgttttgtttttgagatgatgtctcactctgttacccacgctggagtacaatggcatgatctcagctctgcaacctctgcctcccgggctcaagtgattcctctgcctcagcctcccgagtagctgggactacaggcgtgcgccaccacacctgactaatttttgtatttttcgtagagacagggttttaccatgttgcccaagttggtctcgaactcatgaccccaagcaatccgcccaccttggcctcctaaagtgtggcgtgagccaccgcgcccagccgcaatgttgttactaagctttgtctttcttctgtctgtagcaagacagggcccctcttgtaatgcacactggtagtagcccatacttaggaatagccagctgcatgctgcttgcatcctaccccaaaacaaaacaaatcccgcatgatgtcatgagctggttaggaagaatcattttagggcatgttgtcagcactgccttagatcctgccctcatttcttccttagaccagacagccttttgcacacaaagatagagatctttttcactcccttttcccagcccttctctagctagttaccccctctcttagtctgttttcatgctgctgataaagacaaacctgagaccgggccatttacagaagaaagaggtttaattggacttacatttccatgtggctggggaagcctcacaatcatggcggaaggcgaggaggagcaagtcacgtcttacgtggatggtggcaggcaaagagagagcttgtgcagggaaacacttctttttaaaaccatcagatcacgtgagatgtactccctatcaggagaacagcacaggaaagacttgccctcataattcatttacctcccaccaggtcccttccataacatgtgggaattcaagatgagatttgggtggggatgcagccaaaccatatcactcccagaaatgtttttgctcctttacctttttttattctttctcttttgtagaatgaaaaaataatcattttgagagcgaaaatataccatagtgctagtgacacactcccatcaaggaaaataaaagctgtaagatttggtataagcttctcaaatttttttattttattttattttatttttttgagacagagtcttgctttgtcgccaggctggcatgcagtggcgcaatctcggctcactgcaggctctgcctcccgggttcacgccattctcctgcctcagcctcccaggtagctgggactacaggcgcctgccaccacacctggctaactttttgtgtgtttagtagagacggggtttcaccatgttagccaggatggtctcgatctcctgacctcgtgatccacccgcctcggcctcccaaagtgctgagattacaggcatgagccatcgtgcccagctaatcttctcaacttatacctacttttcttcaggtataagcattcaaatgaaataaaaaatttgtttttaagttctgaacagttagcattcttttcattgtatatatgcaaggttttgtttgcttaaatgcattaaataatcttagaatcaaattaagatccagttaccaatgaaaaccatgtttagtgggaaaatatgttgttttctaacatatggttttgtatcagaactcatatgtataagttacggatcctctcccttttactgctgatttcaagtatgtgtcatctacttttttaaagacttaaacctagaagtatgggtagcagggttgaagttttcactgaattagccatgtagctaagacagattacccaactgcctggacagggcatttacaggtgtcacagaacctgagggatgtggccacactcagcctttcagccatgctctgtgtttaattttgtcagtatatccagattcgtcaagctcctttgtgattatctgcaaaactcaaaagactaatgtgtgtaaattaggatgtcaaattttcagagaccaaatactgtatcagcagtgcattgtttcaagattccttggccaggcgtgggggctcacgcctataatctcagcaatttgggtggataaggcgggtggataatttgagatcaggaattcgagaccagcctgggcaacgtagtgaaacctcatctctacgaaaaatacaaagattaggctggatgccgtggctcacacctataatcccagcactgtgggaggccaaggtgggcggatcacctgagttcaggagttcgagaccagcctggccaacatggtgaaaccccgtctctactaaaaatacaaaaaaattagccgaaagtggtggcatgcggctgtaattccacctactcaggaggctgaggcaggaggattgcttgaacctgggaggtagaggttgcagtgagctgagatcacgccactgcactccagcctgggtgacagagcgagactccatcttgaaaataaataagaattttttaggaaagttactgtgaaggctaagttgtaactacaaggttggagtgaaatcagattggaggggtgctgtttgatacccttaatagccaagcatctgtctctgctctagaggtgcacctccccaagatatcctataatttgctggtcagaacatatttttcctctttggaattaaaaaaaaaaaaaaagatttcatgttgtctgtctttctattgagaaggtctcttagaatccattgattagaccagtagcttttggtagtaccatgatgtttccatttgacttttcaaacatttttcagctgaccattaccagctttgttgggggtaaactcaagagagttacatcttttacacattgatttttccagattttgcaaatgtcactataaatggataatattttctaattgggagttgtggcaggggtagttattactgttttttgcttgttcgtgctattttttactttgttactaattgtattttttccaattccaggccatttcataattctgaatcatgtctgataacggagaactggaagataagcctccagcacctcctgtgcgaatgagcagcaccatctttagcactggaggcaaagaccctttgtcagccaatcacagtttgaaacctttgccctctgttccagaagagaaaaagcccaggcataaaatcatctccatattctcaggcacagagaaaggtaaatagcgcttctggctttcagagtctcagcattggtttattattgtatgttacccatgttgataacttttatggtgagaacattaaaacagatcatgaaaacaatcggtgctaatatacaggcactattaaaaagactagtttattttaaattgtgatttttaaaagaataaaatgtaaatttgtttctcaccctgcttgttatggccaatgaatttctatattcatctcctttgttttctgagaccttggccatattttaatgagatttgtgacacttgagggagacctgctattataagaatggtgagatagggcccacagtcccctgtctgaaatccctggagccaactgtgttttggaattaagagtttttgtgattcttgagtagtaaatactgtcttttaccaggtgttctataatgccctcagaagtgtcggaggcagcctcagtactcacagactgatgtgtcctcagcaaaatatatgtctagttcagggtttctcaacctcaacactattgacatcttggagccaaataatttgttgttgcagggacctatcccctgggggcaaaattactccaattaagaatcactgggccagacacagtggctcgtgcctgtaatcccagctacttgggaggctgaggcaggagaatcacttgaatacgggaggtggaggttacagtgagccaagatcgtggcaccgcactccagcctggggaacagggtgagactctctcaaaaaaaaaaaaaaaaagtgtacgtatatatatgtgtatataaaacatccttgtacctaccacccagcctagaattttatcagtacctctgaagtccccatctgctataccccatcctaaccttctcttcgtccccaatatccaccattctgcatttttattgtaattttataacatatctagtcaccctcaaatatgtatggtttaggcatgcctgtttgggaaccttttatgaatggaattatgctgtctgcattttttccacatacttttcactcagctttatgcttttgagacttgttgatgtatgtggtgtagtttgttcactttcactgctgtgtattgctacactgtaaatatactgcagtttatttggccagtctcctatctgtagacatttgggttgttttcatgaatagtgttgctatggataatgttgaatgtacatcttactgggtgtagggcaaagcttctcaaacttcaggtgatctgttagtttagttcttgaattgctaattagaatcacctgggaagcttaataaatctgtgttcaaactccatttcattccagttgaatcagcaatcagcatctttaggggcttaccctggcattgtttttggttttgtttttaattttttttttcttttttttttttttaattatactttaagttttagggtacatgtgcacattgtgcaggttagttacatatgtatacatgtgccatgctggtgcgctgcacccactaactcgtcatctagcattaggtatatctcccaatgctatccctcccccctccccccaccccaccacagtccccagagtgtgatattccccttcctgtgtccatgtgatctcattgttcaattcccacctatgagtgagaatatgcagtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttaggttggttccaagtctttgctattgtgaataatgccgcaataaacatacgtgtgcatgtgtctttatagcagcatgatttatagtcatttgggtatatacccagtaatgggatggctgggtcaaatggtattgctagttctagatccctgaggaatcgccacactgacttccacaatggttgaactagtttacagtcccaccaacaatgtaaaagtgttcctatttctccacatcctctccagcacctgttgtttcctgactttttaatgattgccattctaactggtgtgagatggtatctcattgtggttttgatttgcatttctctgatggccagtgaaaaatatggaacgcttcacgaatttgcgtgtcatccttgcgcaggggccatgctaatcttctctgtatcgttcgtattttagtatatgtgctgctgaagcgagcactgtttttaattttttaaataccccagatgataatgatgtgcagctcatattaaaaaccaatgcattggtgggttatgaactctgtatagtggacgacactaaatgcgctagaataatataatcagagtgttgtgcacacagtgaaaacgttgtcttatgaaacagtttgttttagttatgtgtatactgagtcaggatataaaatgtatttcttggtgtgggtcctgaccaaagatttaaaggtcattcagagatgtatatttaggattagaattgctgggttacaggctgttcccgtgtgtgacttgactaggtttgtcagattgttttctaaaagtttttagtgtacattctcacccacagaagatgagcgttcccattgctgagcaccctcagcaactctgggaggggtgaaatactagctcattgtgttttaaattggcctttccctgattactcaaaaaactgagcatcttttcgggttaattgaccattcttgtgtgctttctgtgaaatatctgttcaagagaaagaaatatctgttcactatctatattagtctgttttcacactgctgataaagacatacctgagactgggtaatttatacaagaaaaagggtttattggacttacagtttcacatggctggggaggcctcacaattatggcggaaggcaaggaggagcaagtcgcgtcctacgtggatgacagcaggcaacgagagagagcttgtgcagggaaactcccccttttaaaaccaggagatcttgtgaagacctgcccatgattcagttacctcctactgggtctctcccacaacacatgagaattcaagatgagatttgggtggggacacagccaaaccatatcaaggtctttaatccatttttctacttggtggttagctttttcgttttctattaataaacattccttgtagtctatacactaatcctttgccagttatatgatgttaaagatagtattccaggatgtgatttgccttctcaccctttcagtagtatattttaatgaatagaagttattaatttgatatggtggatttgatcaatttctcttttttttttttttgagatggagtctcattctgtcacccaggctggagtctagtggctcaatctcagctctctgcaacctccgccccccgggttcaatcaattctcctgcctcagcctcccgagtagctgggattacaggcgcctgccaccgcgcccggctaatttttgtatttttagtagagacagggtttcatcatgttggccaggctggtcttgaacttctgaccttgtgatccacctgcctcagcctcccaaagtgctgagattacaggcgtgagccaccgtgcctgtcttcaatttctcttttttgtggttcgagctttttgttttttaagaaatttttgtcttacttgaggtcataaagacattttcctgtattttttctatagcttgccttttacactttaaatctttgagctagctggattttatttttgtatatttgtgaaaagattcactttcacttttttctttaaacttggatagtatcccagacccatttattgagtcttctatttccccactgacctagaccaccattatttgtcaggtttccatgtgagagtctgtttctgtgttctctgctttattccattaggttatttgtctgtacctgagctaatagtagcaccctgtcttgattactatatcttacaatctttttttttttttctttgaggcagggtctcactctgtgacccaggctggagtgcagtgatatgtcttggatcattgcaacctccacctcccagattcaagtgatcctcctgcctcagccttccaagtagttgggactacaggtgcacaacaccatgcccaactaatttttgtattttttgtagagacaggctctcatatgttgcccaggctggtctcaaactcctgagctcaaacgatctgccagccttggcctcccaaagtgctgggattacaggcgcgagccaccacacctggctcttatattgattgttaatgcctgatggaacaaatctcttaaccagattcttcttcagaatcctgttaattgctttggctttttgcatctttctataaattttagaatctgtttatcatgtactttaacagaaaaaaaaacctgtggctactttgattagaattgtatagactttgggccgggcaccgtggcttatgcctgtaatctcagcactttgggaggccgaggccggcagatcacgaggtcaggagagcgagaccatcctggctaacaaggtgaaacgccatctctactaaaaatacaaaaattagccaggcatggtggcaggtgcctgtagtcccagctactctggaggctgaggcaggagaatggtgtggacccgggaggcagagcttgcagtgagccttgattgcgccactgcactccagcctgggcgacagagcgagactccgtctcagaaaaaaaaaaaaaaaaagaattgtatagactttgtagggcaaataggggagaattgcatccacctttgtagctgagggtggggaatctgcagagcctttgtgtagcctgtttacagggaagtttagttgcatgtcgttttcagtctcagagagacagagatgtgtggaatgtttggagggtaggatgcttcttgattcctcctgtttcctggagctctacctccctttcctcttacacttattgctcctacctggaagctgaaacacagcccagtcactggggcccagctttcggcattaggaatgagggagaaccttgtgtgtgtttacacatccgtgcttttgtaaacatagaaataacctgctctgttgctctcactggattatcccgttcatcaccctagtggttgcctctgggtccgctcatttccacccaccttgcttctagtttcagccacctgcagcagtttgcagaagcattttcccactgacatcctaactgctgcttctctcgctagtcttatgctaattgcttttcattctggagcattcctcgtggattttattctgtgaaacactcggttttggtgtagaagggagagaacttcagtatgtgctcagtacatcatcttgaaacagaagagtctaaaaggcaaacaattgtatttccattttttaaaaatcataatgaccttaagacttttgccatctctaatgtaaggcctgatctagagataattcattttattccactaaaaaatttacatcccttactgctttccttactaaaaaaacagctaatatttttataaaaagaaaataaagactctaggatgttttcacttattaattactggttttaattggtatcaccaaaaaactcgaaaattatccttttggatcgtgccgttttaaggcaacttgacagaacagatcttttttccatgcttgctaatgtgtgtactatgtgaataatcagagatgagtgataaagcagatagtgtccctgctcccacgacagcaatctcaaaccatggtatagaattacaagccatgaaaagtggtacagaggcagtgcacaacatgtgtccaatctgcagtgtctgggaaggcttcctaaggaggtcataatagagctgaagactgcaggatgggtaagggaaacgatagttacaaagtgtgttccatgcccgggaagagcctgtttcagtggcccacctacaggagggatcagagcacatccatggagctgagtgccgcccggtgttactggaaagcagagagggaaggacagagaattacagcagggtgtatgtaggcactacagacagcagaagaggctgaagaggtaggcagtgaccaggtcataaagggccttgtattctatgctacagagctcacattttatcctgtttcctggggaaccattacagatttttaatcaggggaaagacctggccatctctctgttttagttaggagagaatggtaggtatatagaaaaaaggttttgttcgaagtgtgagagtgaagttggaaactagttaggaggcttttgctgtagcccaagtgagaaatggcctaactagtctactagtttaaataatgaaaatgtcagtgagccatttgactttttaaaataagctttattcatacagctagagttggatggtattgtctttattaactaaagcaattttcacatctagctattcaacctataagcaccttcacttctggttggttatgacttagatctgtaaacaacctttctgattaaaaaaatgaattctgagattaataatagtaacccatacttctctgcctatttcctagaggagtggtccccaacctttttgacactggggtaatggtttcatggaaaacaatttttcttttttcttttttgtttcatcttgttgcccaggctggaatgcaatggcgtggtctcagctcactgcaacctccgcctcctgggtacaagcaattcccctgcctcagcctcccgagtagctgggactagaggtgcacgccaccacgcccagctaatttttttgtatttttagtagagacagggtttcaccatgttgaccaggctggtctcgaactcctgacctcaggtgatctgctcacctcagcctcccaaagtgccgggattacaggcgtgagccaccgtgcctggccggaaaacaatttttctgtggggctgacgggggggtggtttcggtatgaaactcttccacctcagatcatcagacattagttagattctcataaggagtgtgcagcctagatccctctcatgcgcagttcacaatagggtttgcgctcctatggggatctaatgctgccactgatctgacaggaggtggcgctcaggcggtggtgctcactccccactgctcacctcctgctgtgccacccagttcctaaccggccatggacctgtactggtccacggccctggggctggggacacctttcctagagaattctctgctgtgtcatggaatttgaagctattacacatcaaaagaacaaaggaggaattacttatggttagactagaaacagaagagtcttccttttaaacagataaagggtttcttttatttgtttgtttagccttagatgtagcttgaaagcagtctaaaaggtagtgccctagagaatgtgacagtagcctacttaggattcttttcagtaccttttgtcaacatgtgactcagggtctctgcctcttggctgaaggttgctgcctgcctgctgctgctgttttgttgtctaatgaagttggaaaatgattctaagaatctttttttctcctaggacactagttaaattgtttattttattaaaataagttttttgccctggtctattacttcccatcaagtgatctggttgcctggtgaacctcccgtagatggttgtgtttgataagcagaagtgggaagttgacctcctttcattttatgaaacatgaacagatttcagatttctccaaagctaaggtgtaacatgtaggggtccgtcccgcagaccctgacccaatgacggatgaataacttacactgacacagatgttatgcttgtcagtccagctgagagtccgggccacttacagactcccaggagagtgctgtaaagcgttgcaaccatcggcctcaactagccaaggaagcttgcatttatttagtatagattaattgacaaaggcttgagtcaacacacctgtgggtaattcacctggtcgcccccaccctggagagggccatcttgcccaccaatgatcaaaggttagtcttaggaccacatgagtaaacaagctctttagataaactactttatattcctttgtatctgtaccttaagctctctggctcctgaaaagagaatctggctaccttcagccaaactttgaagctatgcaaaactccccggccttccaagcaggtttgcttttttctattcctataatttcttctgccatcctgactgaacccccacatctacataaatttattgtgattggccctctatttctgggcttctagagtcgttatataagagtattaaagacattctgttggtatagcaatatctttccagcacattgttcaattccagacatgctttagtatctttttgttttagacactgtttctaatatcctttccttttcccattgagactattaaaatacagagagtacctgtatgtgtgttatgtaaaaacaaatggcattgaacagatttttaggattttatgtttattttgaatgatctaatgtggctctatctcaagttctgcttaatcgtttttgtgtttttcctttaactttttactctatactcctatcatatatgaaactttaatatatttctctaaactcttaacgtttccaagttgaagaatatgactaggccttagacacaacaggaaccaggaatactcttgctagatatgttatctctcacccttctttttatatttttttcttattttatatttcttatttcagaatgttttttctttatgtgttaagaaatataattcctgggccgggcgtggtggctcacgcctgtaatcccagcactttgggaggccgaggcaggtggatcacgaggtcaggagatcaagaccatcctggctaacaaggtgaaaccccgtctctactaaaaatacaaaaagttagccaggcgtggtggcgggcccctgtagtcccagctactcgggaggctgaggcaggagaatggcgggaacccaggaggcggagcttgcagtggagctgtgatcgcgccaccgcactccaacctgggcgacagagcgagactccgtcaaaaaaaaaaaaaaagaaatagaattcctgggctcagtttcttacaacttcagacactagtgatagactgattctcagggagccgagtctggcttagctgctcaggtggctgcccctgcaccagttgctggagggtgtgtgggaagctgtgctgacctggcttgagttaggtgcccacctcggaccagtcatctgtgaccatagtcgtgtaagaaaatggcatctttcccaactatctgcatagaggaaaggtgagggaagtttccaaaagtaggatgctgagcagatttttttaaaagaaagaacacatataatcatagtacattaaattgtaaactactagtttatcgttaactaataaataatttctcctgtatgtagggtattccgttagaagccaagggacataaagaaatgttgagtgcacgacctcaaattactcaaagtctagtgaaaattgagagagaggtaatttatgatagacgtattaataattgtgtttcagtaaagagaatccaggcttaacagtttcctttccctctgctcctgtccataaccagcattcccttccctctcactgtgaccagatctcttttaagttacatgcctagagaggagatggacatttgagcataaatccctcattactagttaaataagtattattgtgtttcctaccaatactaaactagtagtatctttgtaaacaaagaagagcatacggtaacatttccagtcttatatgtatagacttatcaaacagcatgatttttaactctttgatattagaagaatcttctggttaaacacagcatgttgaccacatacagaagcattctatttactctccctcccaagacccaactaaaatgacagaaaaaaatatatatatatacacacacacacacacggtcaaagagaaaaagagaggagacagtattgtgaaagaggcttcagtacacatttggaaggcagaagtggtggaaaattggcacctgactcagcaggacagagaaacacataacctaagcgtttgcagaggggaatctgtgagaagggaaacaagtttcccttgtagaaattctggaagctcaagatttagaggcacacgacactgtgtcggagtgggggtaggatgcactacacatgctgaggagaagggggattagttgaaaatcaacatcgaaagtgtcaaaggccccccaggactcctcctttacaccccacacatccatgtaagtgttatccccatcctccggaaggaaaaaagaataaactgggatttacatttatttccagagaatttaaaccacagaagcctctgttcttatcaggggagtcaggaaaagttgaagcaccagaataaagcaggtgacttcatgcaagtcagcattttcaactcctttccccatcctgctttcagaatacctgcagcctgactcacagcctcagacaggagattggaagatttttctctggataaacaatggcctggggaaaaaaatactttaggtaccttgcatgcatgctgtccttatctttagtgttaaggttggcttaactcccagttagctttttaatactttctatatgagtagacagtacaggatcacccgacatttatgaaaaaccctttataaatgagagggagagtccaaaacaatagggataaaaacaggaacttaaaagaaatagacagtgtaaggagaaaaaaaaccccaaactgcagcctgtgcatacacacatactgtataatcgtcaaagagaggagatagaggaatccatgaaacaagaaaagagttcgcagagaaagaatgatcagagaacaatggaaaacagttcttggaatatcaacatttaaaattaccaaaacaaacaaaagatagcaatagaaagaagagtggaagataatcaagaaaattctccctgctggagcggtggctcacacctgtaatcccagcactttgggaagccaaggtgggtggatcacttgagatcagaagttcgaaaccagcctggtcaacatggtgaaatcccatctctactaaaaatacaaaaattagctgggctcggtggcgtacacctgtaatcccagctactcaggaggctgaggcaggagaatcacttgaacctgggaggcggaggttgcagtgagccaagattgcgccattgcactccagcctgggcaacagtgcaagactctgtctcaaataaaaaaagaaaagaaaattctctcaaagaattaaacagaaatacaaagatggaaaatatgagagaaaagataacagttaaaagatctgactaatgacaattaagtggaggacatagtgacttctagctctaaaatggtggtgtagaagcacactggcttcactcactctgccctgccaccacagaaaaccaagaacatacagcactaagatgatcaccagcaacatccaagaactcagatatgagaaggagacagttcccaggggcacagagaaatgaaagaactccaggcatgctgtaagaatcggacttccgtatctgcaacacccgttccccctgtccgcctggcgccaagtgtgggaaaatctcccccaattcacagtgtctacacaggaaaaagtgagattgaagaagacagccaccttctccaccatcttgggttccctggcaggaggcctgtccctgccttagcccacaggtggcatagggagagctaccctgaggacagccagaggcagaggagggaggcgggattactgttcccagccttggaaaccctgctgtataactcagccaaaggggatgccaaatagagcagctgttcagcaacaccatgttgtaggaggtttattccacaggacccttggcaggaaccctgagccacccttcctgtactgctaccagaatatccccttggggactcctctctcccatttaggatgggctgcactctgctagaacccaggcaaacctgggcttatggtgccatttagtgctggaaaggaggcagcaacctaggctcgggggtgaggaaaagaaagaaaatcaacaggtaaattacagagactctctaagcaaacatatccaataaaaaccagactaaatatcctcatacttctttgaaaaatggcttaaaattttccaaatttaatgaaaactgtaaacccacagattcaagaaatttaacaacatttgagcataggaaacatgaaaactacaccaaggcttactgtaatcaaattgtttaaaaccagtgttagggctgggcacagtggctcatgcctccaatcctaggattttgggaggccagtgtgggaggatcacttgagcccaggagttcaagaccagcctgggcaacatggcaaaatcccatctctacaaaaaaaaaaaaagaaaaaaagaaaaattatctgggcagggtggtgtgcacctgtactcccaggacttggtaggctgaggcaggaggattgcttgagcccagaggttgaggccgcagtgagctgagatcgcaccactgcactccggcctgggtgtcagagcgagaccctgtttcaaaccaaaaacaacaacaacaacaaaaacacagtgatagagaaaattttaaaagctaccagaaaaaaaatgaaagactcattatatatataggacgaagatagagtgatcccagactttatttaagtaacagtgcaagccagaagacaagggacaacatctttaaagtatttaaagggaaaaaaatctatcagcctagaattctatactattgaaagtgtctttccaaaacaaaggaggacacagaattttaaatgcgtaaaagctgaacgagtgtatcgtcagcagacagactacaaaaaatgttaaactaagcccttcaggcagaaggaaggtgatgtcagatggaaatgtggactcacaggaaagaatgaaaagcactggatgtggcacctccgtggttctggacctttttggcacccgggattggtttcgcggaaggtagtttttccacagacccagtggtgcgggggaatggtttcgagatgaaactgttccatctgaggtcatcagacattagattctcataagaagcgcacaacctggatccctcgcgtgtgcagtccacagtagggctcacgctatgcggtccaacgcggctgctgatctgacaggaggcggagctcgggcggtgatgctcactcacctgccactcagttcctgccgtgcagccggttcctaacaagcctcggactctggtaccagtttgtggcctgggggctggggacccttgtggtatgcgttctttcttatctaaatttctttgaaagataattgttttgagtttttaagaaaacaaagcactgatacaccttgtaacatggatgaatcccaaaaacattaagtaacaaaagtcattcgcaaaagactgcatattgtttggtcccatttatattaatgagcagaacaggcaaaagctatggagacaaagtagattggtggttgcctgaggtttggggtggggcaagggctgaaatggggagtcattgccattaggtgcaaggtttcttctgggtatgataaaaatgttctaaagttagattgtgattatgattgcacaactctaaatatactaaaacccattgaagtgtacaatttcaacaggtgaacatgatagtatatgaagagttctagcttaagaaacaactgagtagataaaagggaatctcaaaatacttagtccagaagaaggcagaaaagattgataaaaacagacctacctacaagaaatctactttaaaacataaagccacaaaataggccaaaatgaaaggatacaaaaaggtgtgttaacaattaaaagaaacctggactggctgtataaacagcagacaaactagagtttagagctaaaaaatactatcagtgataataaggaaggttgttatttcgtgataataggaccagttcattaagatgatataatagaactaaatatttatgtacctaataacagcttcaaaattcacaaagcaaaaactgagaggatttcaagaagaaacagacaaattcaattataatcggagattccaaaacttctctcagtaattggtagaaaaagtagacataaaatcgctaaggatataaaaaatttgaacgtaactatcagccaacttgacctaatagacgtttatagaacactccacacaataacagtagaatatacattctctttaaagacacatgaggtctacttttaaaaattctcaaaaatgttggccaggcacggtggctcatacctgcaatctcagcactttgtgaggctgaggcgggcagatcacttgaggtcaggagttcgagaccggcctggccaacatggtgaaaccgtctttactaattatacaaaaattagctgggcgtggtggcaggcgcatataatcccagctacttgggagactgaggcaggagaatcgtttgaacctgggaggcagaggctgcagtgagctgaggttgcgccactgcacaccagcctgggcgacagagcgagactccctctcaaaataataggctgggcgcagtggctcatgcctgtaatcccagcactttgcgaggccgaagtgggtggatcatgaggtcaggagatcaagaccaacctgaccaacatggtgaaaccctgtctctactaaaaatacaaaaattagccaggcgtggtcgtgggcacctgtaatcccagctacttgggaggctgaggcatagaattgcttgaacccaggaggcggaggttgcagtgaaccaagattgtgccactgcactccagcctgggcaacaaagcaagactctgtctcaaaaaaaaataaaataaataaaggatttaaattatataaagtgtgttcttgtgatcataatataattcaattagaaatcagtcacaagaaggtctctggaaatatttggaaagtaaagaaagcacttcacaaataaaaagatatttagaaaatatattaagccgaatgaaaattcaaaacatcaatatttgtaggatactgctaaagcagtacttagtggaaaacttatagtattaaacaccatattagaagaaaagattttaaatcaatgactttagctaagccatcttaataaactagaagggaagagcagatgaaatccaaagtaagtagaagaaaggaaataataaaaagcaaaatgggaataaatgaaatagggggaaaaagcagcagagaaaatcactgcaaccaaaagtagattcatttagaatgtcaataaaatggataaacctatagccagactgacagggggcagtggatggggaggagagacacattaccaatattgagaatgagagaggtggtggcacccctacagattttacagatattaaaaagatggtatgaacaaatatgtaccaacttttttttcttttctctttttttttttggagaaggagtcttgctttgttgcccaggctggagtacagtggtgcgatcttggctcactgcaactgccacctcccaggttcaagtgattctcctgcctcagcctccctagtaggtgggattataggcatgcatcaccacgcccggctaattattgtatttttagtagagacgagacttcaccatgttggccaagctggtcttgaactccttagctcaagtgatccctctgcctcagcctcccaaagtgctaggattataggcatgagccactgtgcctggccaatgttaaattcttagcaagattttagcagttggaatccagcagtgtataaaaagggtaatacatcatgaccaagtggatttcgttggtttaagtttgaaaatcgatggatgttatttactgtattaacacaatagaaaggatgagccatgggtttgtctcaatacatggagaaaaggcatttgacggaacccagtatccattgctgatagaagtgttcagcaaacttggaatagaagagaatgccctttagcctcataaaggacatcttttaaaaacctaccattggcattaaacttaagggtaaaaagaatgacagtttttcctcttagatcaggaaaaataaaatttctcttcatccacttttattcaacaatgtactgaagggtctagctaatgtagtaaggcaaaaaaaaattttttttaagaaaacgaataaaaggaatccagattggaaagaagtaaacttgattttattcaccgacaacatgattgaatttttgtagcaaaattgtatatttacaaaaatactagtggaagtaagtgtaataaggtttcaggatataagattagtattcaagaaacaactgtgtttctttatggctgcaatgaatgattaaaaagggaattttaaaactgccatttgcaatagtatcaaaaccaggaaataccgaggcagaaatctgatgaaacagtgtgcgctctgcactgataactactgctctgtttctaagtgtcccccagagttcatgtgttagaaactgaagccccagtaagagagtgttgagacatgggaccttcaagaggcgacgcgagtgctcacggatggactcatgtctttattgtggatgcgagttgcttataaaagccagtttggccctctcctgctctctttcttgcaatgtgatgccttcggctacgttatgacacaacaagaaggaccctcaccaggtgtggcttcttggtccttgacctggaggactttccagcctccaggagaactgtgagccaaatgaacttttatttttttgaggcagtctcacgctgtgactcaggctggggagtgcagtgacacaatctcggctcactgcagcctccacctcctgggttcaagcaattcttgtgccgctatactcggctgaagtttgcattttagatacagtgttttgccatgttggccagatgggtcttgaactcctggccttatgtgatctgcccacctcagtctcccaaagtgccaggattacaggcatgagctactgctcgcagccagcttctaatgtttatattaatcaattgcataggcagtggtattctgataaagcgtaccgaacggatgaagacaactgcaaacactgctgagagaaatttttaaagacctaaataaatgaaaagatttgctgttttcatggatcagaaaactcggtgttgttaagaaatcaagaaataaattctcagccaggtgcagtggctcatgtctgtaatcccagcactttggcaagccaaagcagatggatcgcttgaggccaggagtttgagaccagcctggccaacatggtgaaaccccatctctaccagaaattataaaaatcagcctggtatgatggtgcatgcctgtaatcccagctcctcaggaggctgaggtaggagaattgcttgaacccgggaggcagaggttgcagtgagctgagatcacgccactgcactccagcctgggcgacagaatgagactccctgttaaaaaagaaaaagaaagaaagaaagaaattctccttaaaattcatctgtatgtacattcattccaattctagtcagaattccaacaggctttctgtagaaattaataagcttattctaaaattaatagggaaatgcagaggacctcgattacccaaacagctttgacaaaagaaaaagaagacttatgtgacatagtttcaatgcgtattacaaaatggcaataaaataatcaaggcagtctgatagtggcataaaggcagacaaacagataattgcaacagagcagagccttcagagatagactcacacgtgtacagacaattgactttcaacagtggctccaaacaggaaccaaaatggcgctggccttctaaatggcaacactggaaatgctgagggttccaacttatatatatataaaattagtgaagaactatcactaaagggataaatcaagaggaaaacgtaagatccagaaaatagattccagcacatacagggcaggagtgaagggatgtcatggacggtaactgcaggaagcgtaggcatgagctactgcagattagagcaggaggagctgagagggagggggtagggggaaggaactgatgtgttggagttcacagagaacattattgataggtgtgtggcagaaatgttgcagaaataatttacaatcggaccatagaaaaactgcatagttttaaaatgtggcaattagtaactccactaaaaaaggattatgcttgcacaaaaaaggagaggtggttttgtcaactacttgtcttgacagtgtgtattatctgcggagtcacagtaatgcaaatctgacttcctgatgaatgtagctgagtggaaatggggtttgctgtgtttgctgtccacattgctcagcatctgagatgtagccctttgtgagagagctggtgcccgaagggggtgtctcttctgcctgtgctctgttactcaggcctgccgttggtcactccatgtgcctcctcagtgtttggttgtgtccagccctactctatggcaggacagtctgctttacttcatttactagtttcctatcagccagtttttaggggaaatcttttctagaataactttgattctagtgtgttttctagaataactttgatcctaatatgttttaggaaaaatataaacataatatgccgggcatgcggtggctcacatctgtaatctcagcactttgggaggccaaggcaggtggatcaggagtttgagaccagcctgatcaacatgatgaaaccctgtctctactaaaaatacaaaaattagccgggcatggtggtgggcacctgtaatcccagctacttgggagactgaggcaggaggatggcttgaacccgggaagcagaggttgcagtcagctgagattgcaccactgcactccagcctgggcaacaagagcgaaactccatttaaaaaaacaaaagacaaaaaataaaattataagtgcctttactagtcttgtttaaataggctgattctttctctttttttctaatgccccctaggaagtaaaaagaaagaaaaggaacggccagaaatttctcctccatctgattttgagcacaccatccatgttggctttgatgctgttactggagaattcactgtaagttaacctagttcgggcccatttataacgtttaaaatagcactcaaacattttccttcattattaaatttgaaattaacatttcaggccaggtgcggtggcacacgcctgtaatcccagcactttgggaggccaaggctggcagatcatttgaggtcaggagttcgagaccagtgtggccaacatggtgaaaccccatccctactaaaaatacaagaaaattagccaagcgtgggggtgtatgcctgtaattccaactactcaggaggctgaggcaggggaatcatttgaacctcggagatggaggttgcagtgaacagagactgtgccattgcactccagcctgggcaagaagagtgaaactccgtctcaaaaaaagggaaattaacatttctatctatacgttaactatgaattcttactgctttttgctttttataaaagtgttagtggttggatatatcgttttcctagagagcagagcctattaattatagttatgcaaaacagacttagaaaaaatagacctaggccgggcgcggtggctcacgcctgtgtaatcccagcactttgggaggccgaggcgggtggatcacgaggtcaggagattgaaactatcctggctaacatggtgaaaccccgtctctactaaaaatacaaaaaattagccaggcgtggtggcgggcacctgtagtcccagccactctggaggctgaggcaggagaatggcctgaacccgggaggtggagcttgcagtgagccgagatctcgcacgactgcactccagcctgggtgacagagtgagactctgtctcaaaaaaagaaaaaagaaaaaatagacctttagaaaatgagatcttttaaaatttactcaaacctacactcaaaagattggtttgttttgtgtattttgtcatttatctctggaaattaattttattgcatcaatttaaaccataactaatttctgaatatcttcttgttagggcatgccagaacagtgggctcgattactacagacctccaatatcaccaaactagagcaaaagaagaatcctcaggctgtgctggatgtcctaaagttctacgactccaacacagtgaagcagaaatatctgagctttactcctcctggtaagagagtggcataaggctggatcagatggagatttgtgaagcacttctagataaaaagattactcctggaaaaatgaaaagctaaactatggttcttgttgataacggtttttccctggatagattctaccttttgtagactgatccagggcagttctgaagcataatttggatctgtgaattatagtaatctcataggtttgccagaaacgggagttgatggatattttggctttttgtttatttggttttttctcctcattgctgtgtttttgttttcatttttcactcttcactgcttttaaatgacttccagcaatcaaaggaaaagacgctggttgatagacatgttcatactagaaacacatttattgttagcgggacaagaggaggttgaactaaaaaatgtttaggtccactcaaaaaattgaaactcgcaagtgtgcagataatagaatatatgtattttaatatataaaacagataaatcatatacgaaagaagcgttagaactaaaaggatttatacctcagaaatggaatatctggaatatcatctacatagtcacagtaatgcaaattttactttctggatgaatatagctggatggaaatggggtttgatgtactttgttttccaagttgctcagtatctgagatataccgttaacctatgagagaaccagtgaattggtatatagtgtaagagttggtgtagtggatttttaaaaatagtttttgttcaaataaagatcagaataaagttcatacaacgcagttggttgatacatctcttgaatctcttttgatctttaggcttcccctcccacacactggttcatgctgtcttttcttgacgtttatttattacagaaacaagatcatttgtcctgtttccctcagtttagattttgctcactacatcctcaggatgtcatttttcaatatgtttgtctgtctctgaagtcatacatgtggttttcaaaagcaatatgatggagctaaaatcgtacatgtggttttaattgattttacttactgtttgcatcctcacagaaacaaaggccatgtgcaagggagaaatagaaatctttttcaagtgatcttgacctttttttgttgagtctagtacaccgttaggaaaaggtcacacttgctcctagaacttttctatcaaccagtaagtctgtgtgtaaattagtaatttttttgaaaaaccaatgtttgaccacaaaatggtagcttattttcacctagtacacatacatacatatatgtgtgtgcgcacgcgcgtgcgtgtgtgtgttttgttttgtttttgagctggagtttactctgttgcccaggctggagtgcagtggcacaatctcggcttgccagaacccccgcctcccgggttcaagcaattctcctgcctcagcctcctgagtagctgagattacaagcatgcgccgccacacctggctaattttgtatttttagtagagactgggtttctccatgttggtcaggctggtcttgaactcccaacctcaggtgatctgcctgtctctcggcctcccaaagtgctaggattacaggcatgagccaccgcgcccggcctgtgcgtatgtaatatgtgatatgtgtgtgtgtgtgtgatatatatatatatatatacacatatatatatatatatacacacacacatatacacacacacacacatatatgtatgtctctgggcatttttaaaagaaaaacaaaacaatgtcagaattttactttgcacaattgtcattgtcttaattgttgcattaagttcctcagtcagcagttttctggagaaagtatctttatcaataaatttgttttgttttaataaatacagattgataggtatactttcaaactaaattttgatagctttattgaggtataatttacatgcaatacaattcacccattttaaatatataattcactgatttttactaaatttatagtttcatgtagatttcagatttcttaccttggtcttatataaattcttatttgactacttgcgtgttcatttttctcaagagttaattcaacttgaaatcagtttaagaacatttcactttctctgctttttttttttccttttatcatataaaagtgctgtttcttgaattgctaatgttatgttttgtttcatattcagagaaagatggctttccttctggaacaccagcagtaagttaattatattatttcttgtatctcttgttctaatttaggttacccaagacaaatctcagtttttattttgctttctaaaataaattacagccatcagaggtaaataactactcaataggtgtttttagctagccacctgattagttgaagaagccgtattaaatagaaattccttgatgtgatacttaatgtaactaaaatttataatgaccttcagaacagtttagttagttttggtaatgttaacatatacaaacgtgaacacaaagaacttgctagcatatattttcctctccatccctcagttttccttctggtactattttactgaatatagactgtggaaaggtgctgaacagttgaaccttgtcagtcttcagagtcatctgaaacttaagttatcgcataaacacagtcagtttttggaaacagtcgttttatttgcagtttctcaattgggaggaaacagtctcctggagttttatttttttatattttattttattttatttatttatttattttatttttattttttttgagttagagtctcgctctgtcgcccaggctggagtgcagtggcgcaatcttggctcactgcacgcaccgtcttctgggttcactccattctcctgcctcagcctcccgagtagctgggactacaggcgcctgccaccacgaccagctaattttttgtgtttttagtagagacggggttttaccgtgttagccaggatggtcttgatctcctgaccttgtgatccacccacctcggcctcccaaagtgctgggattacagacgtgagccaccatgcccggccccaaatctgactgttttaaatgtcaccagatgtctctgacataacaaagcccagaggatctttgattttggtcttaacaagtaacattgtttactttcaggacattgtatatgtatgcttagggtaactttattaaaatatttggtactcaccatatatatatatttcataaactttttcatgattcatagaatcgccttattatgttagattataattctattgagttatctaagagctaatgagatttagtggttttgaaatgagctatcaaagaagcaaactttttgaagtacgttcataaagggcgatagtcgcatttaagcctattggacttgttttccttactttgctcatcatcaatgcagctgaatgccaagggaacagaagcacccgcagtagtgacagaggaggaggatgatgatgaagagactgctcctcccgttattgccccgcgaccggatcatacgaaatcagtgagtctccatcggtgatctaggctgtgtgtgtgcacgtgtgttttaaaaaatagcagagtttgtatttgactttcagtgattgcttttaaaaagccctcaagtttaaaatcgtttagtatggggaaatttaaccaagaaatctgtacccaaagaccactcacctaaaactagttttctgaagattaaaatgtgatgtctttaaaagttaacgcactcacctcactgggcttttttctttgtatagtacaccttttccagagggttcgtctatttcccaagctttctctgtttatctcaatgtagatgacgactaaatctaaaacttagagctttcctcttacccagattatgcattttaatctcccattttacactactctcagcgccttgctgtcattcaaaaggcagttgagaatgaaattcctaaccaggtaagggagaattttaaaaatgatgaccttaaatggagccaggaagagaggaatgactgcggttaccattctgctcccttcagtactgcaggtagagtgtgcggaaggtgctgtgccgtggaatgggctgtgctcctggcacagcgggcaggcagagctcaggagacagcctctggatgccaagctgatggcagaggactccgttttctttagcctttcaatctggctgtttgaaatgggtggtaggcattataattgtgtaaaaactttcatgggaattaataatagttatttcaacatcaaggtttctgttcttttgcattttacttaccatttgtagtaaaaacatgatttttaaaccgtgctttttgatacattgttataccattttagacctggtcacacttaaatttcattcatggacctgctgttttactagacagcttttcaaatatattcatgctatgccaaagaaaaatgtttcacatttattcttcttagttacacatcttttatatctgaaaatagtgttctcattatttagaacaatggaaaagactacttagttcaggttaaaaatcaaagaactgaattagtttgccaggaagaatatctgaaaacattattcctcaaaccttggtaatgaactgtgtctccacagatttacacacggtctgtaattgaccctgttcctgcaccagttggtgattcacatgttgatggtgctgccaagtctttagacaaacagaaaaagaagactaagatgacagatgaagagattatggagaaattaagtatgttatctacattttacatcattgttaaattgttcacggctcttaaaacatttggcccagatggattttaacttacactttacattgtgacttaaagtataaagaataaattgtttccttatagcaacagtagcttcaattacaatctggtgatgtcaccaggttcacccctaaatcccagcactaggtcaggagatcaagaccagcctggccaacatggtgaaaccccgtctctactaaaaatacaaaaattagctggatgtgctggcatgtgcctgtaatcccagctacttggaggctgaggcaagagaatcacttgaacccaggaggtggaggttgcagtgagccaagattgcgtcgttgggctgggcgcggtggctcacgcctgtaatcccagcactttgggaggccgaggtgggcggatcacaaggtcaggagatcgagaccatcctggccagtatggtgaaacccctcctctactaaaaatacaaaaatcagctgggcatggtggcatgtgcctgtagtaccagctgcttgggaggctgaggcaagagaatcacttgaacccgggaggcggaggttatagtgagccgagatcgcgccactgcactccagcctggcaacagtgagactccatctcaaaaaaaaaaaaaaaaaagcgaaccggccgggcactgtggctcatgcctataatcccagcactttgggagaccaaggtgggtggatcacttgaggtcaggagcaagactagcctggccaatgtggcaaaaccccatctctactaaaaacaaaaattagcaaggtgtcatggcaggtgcctgtaatcccagctacttggggagctaaggcaggagaatcacttgaacctgggaggcggagattgcagtgagccgagatcgtgccactgcactccagcctgggcgaaagagcgagactcagtctcaaaaaataataataaataaaattaacaattaaagaatgctaatctagagggttcaaggaaaaatactgtatggaaggattgttttaaacataaagcctgggcatagtggctcaaacctataatctcggtacgttggctggccaagataggaggatagctggagtccaggagttcaaggccgaactatacaacttagaccccgactccaccccctcaaaaaaaaaagaaaaaaagaaaattaacgagacctggtggtgcatgtctgtagtcccagctgactgggagcctgaggcaggaggattgcttgagcccgtgagttcaaggctgtagtgagctgtgattgcgccactgcactccagcctgggtgacagagtgagaccctgtctctaaaaaataaacaaatgtttatatgccccatgtttatttggttttgatttctcagtgctttcaagtataaacctggctcttactctgttattattattatctttttttttttttttttttgagacagagtctcgctctgtcacccaggctggagtgcagtggcgtggctcactgcaatctctgcctctccagttcaagcgtttcttctgcctcagcctcccgagtagctggggctacaggtgtgcgccaccacaccccgctaatttttgtagttttagtagagatggggtttcaccatgttggctgggctggtctcaaactcctgacctcaggcatgagtcaccacacctggcctgctctgttactctatgagcatataagaattattttaggagagctgctacttaaaaaaaaaaaaaaaattaactagaatcctaattgtcatcatttagttgtgacctttagctgtcacatccccagtctttttggtatctttttgttcttagcctcttattattgatcctgtttctttgcttgttgacttgaggttgggtacctacataaaactatttatgtcagtttccttgatatggtcctgtccttttttaccttgagcaagtgaaagtttaatgtggtttttcttactagtaataagaatataagttaggattttatgtccaacttcctaattttaaaacctctttcttgtgactttgaactttcctaaaacaaacatatgattagtttatgtcagagcatagtaatttttatggtaataagtggttttctaaatatattgaaagatgaaatgtatactggaagagtcagaaagaccatttagggtttagatagcctttattatttataatactaagtagtctcaaacttacctattaatagatatattcaaatatatctatttctatattcaaatatatctattttatattcaaatatgtctattttcttgagattacctgattctaaagctgaacatctgagaacctaattaatctctgacaaactggtacagtcttttcaaaatgtgaccattattgagcaaatgattagttaggaggtctaacctaatggaaataatgtgtcttcttgtttctgttacttttaaacttttaatgtgtcttgtttctgatacttttaaacttttattatgtatttaagtttctttagtgttttgtgtttgaaacctgttatttttggaacttagtattatgtttgaaaatcacttataaaaacagtggagttcattaaaaggaataataatatcacaatcaatttacacttaaaatgcttgactgagcttccagctttttgtttattctaggaactatcgtgagcataggtgaccctaagaaaaaatatacaagatatgaaaaaattggacaagggtaagtatttgtgactgtattacgataatattcagtattcagtatttcctggctttatagcatgatgtttattttgcctgccgacatcaagtacttatatagtattctgtgagtggtacccttgggggatttgtgtaaataaataatgcagttatttgtagatgctgttaaaaaactgtactagttgttagcaatgactgtgtatcattattttttcttaagtgtcatttcccatctgtgataattagagggaagaattgcccataaaatatatttaaaagacaataagaatatttactgcatgactataagcaataaaaaatgcatttaaatcatgtcattgtgtattgacttttgagtctactgatcttctgattttgttgtgtaatttgtatttttaaagtatactaactaaactccttttttctgttgcttggaagcaaataaacacctaaatttttaatgttattaaactctggaaagcattctgtgaatttagagtgagggcttaagccatttttgaaaacttccatatgaattccttcctcccttccttcccttccctccctcccttcccttcccttccttccctccctcccctccctcccttccttcccttccctcccttccctcccttccctccctcccttccttcccttcctttccttccttcccttccctcccttccctcccttccttccctcccttcccttccttctcttccttccttccctttttttttttttttttttttggcggagtctgtcactcaggctggagtgcagtgacataatctcagctcactgcaacctctgcctcccgggttcaaacgattcttctgcctcagcctcccaaagtgttgggattacaggtgtgagccactgcaccaggcctgaatttcttcctaacagctaaattcaattgcagcactggttttatgaaagagaattgaagattatcttactatttttgagcatgaatgaacaagcaatacctatccatatggatgaccatcacaaatccagtgttgagtcacaaaagcaagttgcagaataatatgtgaaatgaaactatatgacgtttaaaaattagacaaagtatattttatagggatacatatctgcgtcctttgtagttaaaagtatggagaaatgcatgaaaatgatgaacaccaaatacaggataaacaccaaatacagatcacctttgggaggaaggagactgctgtcggaaagggcttatgggaatcttcaaattatttacagttatttgtatcttaatcagggaagtgtatccttaagtatatgttatataatttttttcctgctcttttttccctacatttttgtaggtctgaaatatttcacacataagttttgccgtaaggattgtctctttcttcccccaccccctttcctcaggtttttgcttttactccttttaagcacgttaggtcatcctgttctttaattctttttcaattgcttgaagtgtaaagtctttggatattgcaaatgctagtgatttatcaaccttaaatctggttgtgtgttttctccctctagggcttctggtacagttttcactgctactgacgttgcactgggacaggaggtagttactttgttgtaatcctgggtgttaccattattttgtcatataggtggaaactagatgaagctgggaagaagcaataggaacctcttttaagttgagcccgttgtaagaatcgctctacgtatgtttatagcacttctgtcagtaaggcggggaaggacttatgagttcaatgtcataaataagcaaatacttaaaaattgtttcctcagcttgaagtgaaaagaggattaattcttagtattggactgactgtgggtgtattaatcaacttcaagataaatctaaaactaggttctaaacattacaaagcattgtgcacaggcagtgtgcaaggcaaggtgccacctgggagtaatagcatggtgtaatacagtacacgtaccgtgagttatcaactgcttggggtttgtaattttctaagagaattcctaaacctggtttttttcaatcctgttttcattataggttgctatcaaacaaattaatttacagaaacagccaaagaaggaactgatcattaacgagattctggtgatgaaagaattgaaaaatcccaacatcgttaactttttggacaggtaagtatgactattccttaaacaccgggagaaaatgtagaaattttaagtctcatggtttcgggggtggggctggccactttggaataaactgtcagtgccgagaaataagatggaagaaagaagaggagaggtaaaaatagcacagtgcagttttagaaggtccttctctgcaaggacatcacttggcaggtgagagaaggcagttaattgaaggccatagctggtggtgtttatactcatcgcaaacgacctgaagcgaacacatgaatggttggctgtgattcgtgtcttgactgacagaggggactggttacatggtttttaaacttgtggatcaatttttatttcaaatgctatccttcatggacaaatttatatgtctatcaaaacctcatttagttgaggaattaatgttaaataacagaccaaaaagcagaatagaaaatgatgcatattggctgggtgcagtggctcacacctgtaatcccagctactcaggaggctgaggcaggagaattgcttgaacccaggaggtggaggttgcagtgagccgagatcgcaccactgcactccagcctgggcaatggaatgagactccatctcaaaaaaaaaaaaaaagaaaagaaaatgatgtatattactacaactgcatgagagaagattcgttgaaaatgataacagtggttttattgaagatagaggtgattataggtgattttcttccatatttaaatttgtttagaatgaggaaaaaataatgtttagagactttatccctagttatggagaacatgttcatagaaataaacttttcaggctaggcacggtagctcacgcctgtaatcccagcactttgggaggccgaggcaggtggatcaccaggtcatgagatcgagaccatcctggccaacgtggtgaaaccctgtctctactaaaaatacaaaaattagctgggcatggtgccgcacacctgtagtcccagctcctcaggaggctgaggcaggagaattgcttgaacccaagaggtggaggctgcagtgagccgagatcgcgccactgcactccagcctggcaacagagcaagactctgtctcaaaaaaataaataaaaaataaacttttcaggtacagttccctgctttttaaaataacatttcaagtcagcatagtgtggtggttaagataagccaggggcttcggaatcgttgatccttggcttcatattctggttctgtcacttcctattaatagctgtgtgcccttggatgagtcacttcacctctccaagcctttgtctgtttatctctaaaacaggactagtaatttctatattgtagggttattttaatcagaatgagctatgtgcatactcaaactacagttgtgggcaaactgtaactttaaaatgattcaggatcataacttcagttatttttctgtgctgttacgtagcagctttccagttttcttcctaactctcaagctaccagctctagttttattgttagggtgtttaatatttgaattcttcaacatagaataccatgtgtttaggaaaaataaaagtgtgactgtatttggtatgttgtatttttagttacctggtaggagatgaattgtttgtggtcatggaataccttgctggggggtcactcactgatgtggtaacagaaacgtgcatggatgaagcacagattgctgctgtatgcagagaggtaggtttgcctccttcttgatatgttatggtgatatgtggttagcaagaagtgaacaaaaggaaatttttctgcacaggtaattgttattgtgggaggtgctttctctgtatacattctctgcaaattactccatctccgtgccatttcatcctacacaggagtttcagccctttccttcaggtataagataatttgggaatgaattgtggacctttgaagatccagattcacaaggaaattctggtagagtgatgatgatcatttaccatccaaacaggacacttttgagagtaaaagggtatatatcattagaaatacaccactcaggctgggcgcggtggctcacgcctgtaatcccagcactttgggaggccgaggcgggtggatcacaaggtcaggagatcgagaccatcctggctaacacggtgaaaccctgtctctactaaaaatacaaaaaaattagccgggcgtgttggcaggtacctgtagtcccagctactcaggaggctgaagcaggagaatggcgtgaacctgggaggtggagcttgcagtgagccgagatcacaccactgcactccagcctgggcaacagagcgagagtccgtctcaaaaaaaaagaaaaagaaatacaccacttagctggaagtggtggctcatgcctgtaatcctagcactttgggaggccaaggcaggcagattccctgaggtcaggagttttgagaccagcctgggaaacatggcaaaaccccatctctactaaaaatacaaaaattagccaggcatggtggtgcacgcctgtaatcccagctactcgcgaggctgaggcgggagaatcgcttgagctgaggaggcagacattgcagtgagccaaaattgcgccaccgcactccatcctgggcaacagagcaagattgtctcaaaaaaaaaaaaaaagaggctgggtacagtgtctctcgcctgtaataccagcactttgggaggccgaggcgggcagatcatgaggtcaagagattgagaccatcctgaccaacacggtgaaaccccgtctctactaaaaatacaaaaattagctgggtgtggtggtacgcgcctgtagtctcagctactcgggaggctgagacgggagattagcttgaacccaagaggcggaggtcacagtgagccgagatcgtgccactgcattccagcctggcgacagagcaagactccgtctcaaaaaaaaaaaagagaaagaaatacgccactcaaccgtggaaactagaactatctcaggtcaagcaggacacttatttgccttcagtatcaataagtctgtgcctggcttcattgagttcactaatggtgaagaaaccggttatttctttatattcattaatgaatttctagacatattattagcttaaaccagtagaattctgccaaattgccaatttaagccaaaaataagccttcttttttccacctatatctgagctttttctacagataagatttgggctaatggtttgcttattgtcattgaaacttctaatgtcataggaatcactgtcacaaagggcaaaactttaagtttataagactatattgtgttttctatgatttggctttcagcagttcttcagtgacatgtgaattacaaactttgttcatgtaaggatgatacatatatatttcccttttccatctgtcattaaggtgttaaaaatattaaaattttaattctgatttgtgttctacctgaggaatagtacctctttggtagaagggaggaaataagaactcttgaatagaatattaatagaatatgatagtccttaacaatgcatgcttggtcactgaaaagctgataaaaacaagaatttacctatttatacttaattttgttttttctaatacatttctttgtaattgatataaaaattaattttggaagttcctctaatttgggttttcttttgtgtgccagaacttttaaactgtgacgagtttgtttctatttatttgtacaagtattttctggagctttgaatctgatgattgcctggtaaatgtattgcggtaacacccaatttatctgtttttccttgaatgaatagtagaagattttggatgagatttttagttgtacagactttgttctcctctgatgggagtaagaaataaaagcacagctaacttacacccgtagttcaaaaacacaagagtgagcagatttttaaaacgtcatctcgttctcgtttgtaaggaaaggagtagtttacccccactttgtgactcagtgctctctgaaatatggcataagaggaaagttattcttgcatcattcatgtccaagttgtagatacagcttaatataaaatcgggcactgaagaacatcttctttctgatgaacagctaagtggaaccaggccacccagaatcttacccgcttctcagtggctcacattgattagccttctgagtatctcatgttcaaatgggaatgatcaaggttttttcattactgttgaaaagatttctgaggagcctgtgcatgtttaccaagtgttgtatacctttaggcatttaaacctgaaagaggcaattttttttttttttttttttttttttgagactgagtcttgctctgtcgcccaggctggagtgcagtggcacaatctcagcttactgcaatctctgcctcctggattcaagggattctcctgcctcagccacccaagtagctgggattacaggcctgaggcaccacacctggctaatttttctttctttctgtccgtctttttttgttttttcgagatggagtcttgctctgtcacccaggctggagtgcagtggtgcgatcttggctcagtgcaagttccgcctcccaggttcaagcgattctgctatctcagcctcctgagcagctggggttacaggtgcacaccaccacacccagctgttttctttgtatttttagcagacacagggtttcaccatgttggccaggctggtctcgaactgctgacctcaggtgatccacccgcctcggtctcccaaagtgctgggattacagaagtgagccaccatgcctggcctcccctggctaatttttgtattttttagtagagatggggttttgccatgttggccaggctggtcttgaattcctgccctcaagtgatctgcctgtctcacccggccaggaggcaagacattatacagacccagctaaacaatgtctctgagtaagatcagagggtaggagcggatctactgactttttaaaaaattttattttcttatataaaactttaaggaggagatctaattacttttcataactttgtatataagagaggatgttttttctttataaataaaagtattggagggtcttctgctgggcactggaagcaatgctcaggccatagctactgcatgtgcctccctgtgtcttttcagggactatttcattaataggtgtttttcttctgttcagtgtttacaggcattggagtttttacatgctaatcaagtgatccacagagacatcaaaagtgacaatgtacttttgggaatggaaggatctgttaagctcagtgagtaacaaatggacaattcacaatcatttattataattttctgccttttgtttaattaaaaacttttcttgaccaatgcaaggattaataatgatttaatataggaagaggtgagacctttgaaaactgagtgatcctctgagggttttaactaatcagtgccagagaaaggactcgctggataagacattacctaataattaccactagataagacattattaggtaatgtcttgtcttgtctttttgagatggaggtttgctcttgttgcccaggctggagtgcaacctccgcctcctgggttcaagcgattctcctgcctcagcctcctgagtagctgggattacaggtgtgcaccaccacacccagctaatttttgtgtttttagtaaagacggggtttctccacattggtcaggctggtctctagctactgaactcaggtatcttcccgcctcagcctcccaaagtgctgggattacaggcgtgagccaccgcggctggccatgattgcttatttttaagtaatcttaatggggaagctctcatacatttttggtgaatacacatgaaaatgaattaaacttttggatgacattttttttttctggctctgccatttactaagtgaataaccttggataagttgtctttatgcctcagtattcctatttgtaaaatgggaataattgtaataataaatgtacctttctcatagggttaccatgcggattaaatattttaattcttataaggtacttaaacagtatctggattgttttaagtactcattttagctataaatattgtttgacctaactgttactcttgtagaattctctcctgtagaatttctgaacttacataccgcagtaagtacaaggatgttctctgcaatattgtaaagaaaaaccaaaactatcttaagtgttgagcagtaagggaataattacatggattattatatttttatattctgtatagtttttaagatgagggaggccgggtgcagtggctcacgcctgtaatcccagcactttgggaggtcgaggcaggtggattgcttgagcccaggagtttgagaccagactgagcaacatggcaagactccatctctactaaaaatacaacaattagccgggcgtggtggcaggcgcctctagtcccagctactcaggaggctgaggcaggaggatggcttgagcacaggaggcagaggttgccgtgagccgaaattgctctactgcacacagcgtgggcaacagagtgaaaccctgtgacaaaaaattttaaaataaaaaattttttaaataggcagatgtactaatatggaaagatctcaagaaatggttttaccaaagtttacagagtatcctgattggtaatacaaaccaaaccgttcatagatattattcatgcatatgtacatgcataaccaacagtctaaagcttacaaacctaaattttaacagtagtcacatatgaaatggaatgggtttaacagtataagaaagaattctaaatactaatcctgacttttccactaaatgaacattgagtactacactaggcatcctgcacctccattacaggtgagattgagaagataatgctggtggcgaccttaggctctctgctgagatgatggatgtttagtgattctggcttctgtttgttttattcaaaaatagtttacagctgggtgtgatggcgcacacttgtaatcccaacactttgggaggccaaggtgggaagatccctcccatgttgcccaggagttcaagaccagcctaggcaacacagggggactctgtctctacaaaaaattttaaaaattaaacaaaattaaaagacaaagtagtttccatgacctgacctttacctgattcactgcatttagttttggtgtctacttttgctttactttttcgtagacctctttcagttttattaaattttttaggatagaatgaattattcagaataaaaggcctcctgataatttggactctgtggcaagtaaaagtaaaatgtgagagtgtgttacatcatgaaaatatttttaaactcattctggtttactttattaatgaaatctttaaaaacaagaggcctaatagtcaaaatataattaattacataatctgaagtgaactcttctgctaaaaccatccatggaagccattaactctgttttgttttgttttgtagctgactttggtttctgtgcccagatcacccctgagcagagcaaacgcagtaccatggtcggaacgccatactggatggcaccagaggtggttacacggaaagcttatggccctaaagtcgacatatggtctctgggtatcatggctattgagatggtagaaggagagcctccatacctcaatgaaaatcccttgagggtaagatgagttaaacaccagccttgttcaatgtttttctttgaaactcttatttagaacttgcacgtgcctggcactgtccaagaatttaaagtagaaggttgataaaacctaatctctgcccctaactctgcatctagaaatcatttgctctctgagttacaaattaatgtgttaggtgaagactttgtaggtttttagtagtaagctgtattgttttgtattttacgtaggaagtttggagcacctgtctctaaagcttctccttcttttattttttaagatgttttgagacagggtcccactctcttgcctattctagaatgcagtggcgcaatctcagctcactgcaaccgccacctcccaggttcaagcgatcctcctacttcagcctcctgagtagctgggactatgggtgcgtgccaccacacccagctgatttttgtacttttcatagagacggggtctctccatgttgggtcaggctggtctcaaattcttgacctcagttgatccactcgcctcggcttcccaaagtgctggcattacaggtgtgaacaactgcacctggccacttctcttttttttaaattaccatatgtggctcaacattatcagttattaaggaaatgtaaatcaaaacctcaacaatcagaggctgaggcaagagaattgcttgaacccaggaggtggcagttgcggtgagccaagatagcactactgcactccagcctgggcgacagggtgagactctgtctcagcaaaaaacaacaaaaaaccccaccacaacaggataacacttcacaactactagaatggctgtactcaaaaagacaattaataaatattggtgaccgggtgcggtggcttacacctgtagtcccagcactttgggaggctggggttggaagttcaagatcagcctgaccaacatggagaaaccccatctttactgaaaatacaagattagctgagcatggtggtgggtgcctgtaatcccagctacgtgggaggctgaggcaggaggatcacttgaacccaggaggcggaggttgcagtgagccgagatcatgccatcgcactccagcctggtcgacaaagcgaaactccgtctccataaataaataaataaatgttggtgagaagataaggaaactagaaatctcgttcattgcaaaatataaaatggtacatctgctttggaaaacaacttgacaattctgtgtgaagttaatacggaattaccagatgacctagcggttcctctgctgggtacagagccaagagaattaaaatcatacatccatacagaaaccttcatgcagccacagaagtggaaataattcaaacctggtgaacagtggaatattatttggtcatagaaaggaaggaagtgccaatccgtgttacagcattgaaccttgagagtactgtgctaagtgaaagaagccgaacaacagatggcagcagattctgaccgtctgtttcctgaatgcttttcatccagttgccaaagattccagtttatgtgggccgttaaagtacttctatagaggtgattagtttagaccacttttcagaatgacattaaagccctctaatgttattcattcatttagccagtattggtttgggtacctgccatgcgctgagcactattcacaatgctgtctaaaagaacccacaaaaattcctgctcttacagaacttgtcttctagtgggaaaagagaaaaacaaaataaatcagaataatgtgtcatacattgaataatggactcttgagtactgagactggcaggaaggaggttagggtgtttactttcaaaaggtgcttagagagctgggcacagtggctcacgcctgtcatcccagcattttgggaggccaaggtgggaggattgcttgagcctaggagttcaaggccagcctaggcaacatagtgagtccccatctctacaaaaaaatttaaaaattagccaagcatgttagtgtgtgcctgtagtcacagctaattggaaccatcatcctgccccagtgcgtgggtcacttgggcccaaggaagatgaggctgcagtgagctgttatcacatcactgcactccagcttgggtgacggctaggacctgtctcaaaaaaaatacaataaaaataaaatgtaaaattaaatcaaaagcgtgcatagggagggcttccctgaggtgacatttggacacaggaagtaagagcgtgatacttacctgagggaaaagcattctaagcagaaggcacagcaagtgcaaaagctctaaagcaggagcgttccttgtgtattgagagatgattctggacctcagcacagctggcgtacgctgagcaaacagcgagaggtgcggtcgatcggcgaagaaaccaggccagaccgtagtgccttatgagagctctggaaggattctggcttttactggaggccaaatggggaaactgttagagagatctgagcagagaagcaaagtggtctccttcagttttaataggatttccctggctgcgttgttgagagatccctgaggaaggcaaaggcagagcagaagaccagtcaagaggctgatgtcataattcaggcaagcagtgatgatggcctagaccagggcagtatcagtggaggtgggaaaaagtggtgtgagtctggatgtattttgaaagaagagtctacatgagagagaaaagactaacgggatctgttcccaagtaactcaactgcattcctgtacaaagctgaagagtcttacagggctgcgtctatagccaggagtacgctcaggcttcagaagaggctcgcctccagtggccttcactgtggcaaaaaggtctacttgaacctcagtgagatcggtaaaatcaccagcgccaagctcctatcagcagatccagaagctgatcaaagatgggctgatcatctgcaagcctgtgactatccattcccaggctggatccccgcaaacaaacaaacaaacaaacaaacaaaaaaaacaccttgggccgggcacggtggctcatgcttgtaatctcagcactttgggaggccgaggtgggcagatcacttgaggtcaggagttcatgaccagcctaacatgatgaaacctcgtctctactaaaaatacaaaaatgagccaggcatggtggcgtgcacctgtattcccagctactcgagaggctgaggtgggagaattgcttgaaactgggcgacagggagagattctgtcgcaaaaaaaaaaaaaaagaaaaaaacaccttggcccacaggcatatgggcataactgctaatgcacacattaccaaaaaggcagcctggatgaggaagatgagaattccaccccagctgctcagaagacactatgaatctaccgagattgaccttcacgtgtatcagagcctgtacatgaagtgaagggggacgtgttcagaaacaagcaggttcttcggaactcattccaagctgaagatagacaaggcctcaagaagcttctcattgaccaggccagggcacatggctctaagaccaggaaagcactgtagttccacggagagtgcctctgggccaagagaaaatcattaagactgtcccaggaggaagaaactaagaaataaaggtctccctctctcgtctgtacatagtggatcttggtgattacatagatccagtcattcaaatacaacaagattttatctgcctgatggggggaaaaagcatattggtaggaatacagaaatagccaggacccagcaatcacccagacatcagtcaaagtttaccagacaggcaaaggagcaggcagatgcagcccataatgagaaaaacttccaggcaactggaacggacagaagttcattaaaacaatctcacgactgcatttcagttgtaagaactttaaatgcatattgcttagtgaaagaatccagtctaaaaaggctacatattatttcaactgtagagagtaaaaatgattagtggttatggggtttggcaggggatcgggggtagagaggatgagtaggtgaagcacagggaatttttttgggcagtgaaattactttgtatgatattataatggcggacactggagagcattcatttgtcaaagcccatggaacaactaggcacggtggtgcacacctgtagtccctgctgcttgaaaggctgaagcaggaggatctcttgaccccaggagttcaaggccagcctgggcaacatatcgagaatgcattaaaaaaaaaaacaagaccataggactgtgtaatgtaatacagagtgaaccctaatgtaaactgagggctttaatttaatagaagtgtatcaatattggttcatttgtaacaaatgtcccatagtataataatgtagacaataataaaactccacattggggaggttgcgtgtgggaactctgtactatctgttcaattttctgtaaacctaaaacttctaaaaaattagtcagttaaaaataataatttaggaccagacgcagcggctcatgcctgtaataccagcactttgggaggccaaggtgggcagatcgcttgaggttaggagtttgagaccagcctggccaatgtggtgaaaccccacctctactaaaaatacaaaaattagtcaggcgtaatggtgcatgcctgtactcccagctactcgggaggctgagctgcaagaattgctggaacccgggaggcagaggttgccatgtgttgagatcatgccactgcattccagcctgggcaacagagcgagactgtgtctgaaaagaaaaataaataggccagatgcagtggctcacacctgtaatcccagcactttgggaggccaaggcgggcagatcacaaagttgggagtttaagaccagcctggccaacacagtgaaaccccgtctctactgaaaatacaaaaaattagccgggcattttggcgggcgcctataatcccagctactcggaaggctgaggcaggagaatcgcttgaactcaggaggtgaaggttgcatcgagctgagatcgtgccattgcattccagcctgggccacagagccagactccgtctcaaaaataaataataaataaataaataaataaaattcaatttatagaaatgtaaaggaaataattagaactatgtaaggattttctaaagggagttgattaaattaggaaacattcatataaggcaatatttacttaagccattacagtaattttatagatctaggtagttattagtaatgatgacctgggataatttgtttttttggtttttatttttgagacagagtcttgctgtcttgtccaggctggagttacagtggtgcaatcttggctcactgcaacctccacctcccatattcaagcagttctcctgcctcagcctcccgagtagctggaactacaggcatgtgccaccacacccagctaattgttttttttttgtatttttagtagcgatggggttttgccatgttgcccagcctggtctcgagctcctgagcccaggcaatccacttgtctcagcatcccagagtgctaggattacaggcatcagccaccatgcccagcctaatttgtttttgtttgtttgtttgtttgtttatttttgggacggagtctcgctctgtcgcccaggctggagtgcagtggcgcaatctcggctcactgcaagctctgcctcccgggttcacgtcattgtcctgcctcagcctcccgagtagctgggactacaggcgcccaccaccacgcccggctaattttttgtattttttagtagagacagggtttcaccatgttagtcaggatgctctcaatctcctgacctcgtgaccggcccgccttagcctcccaaagtactgggattacaggcgtgagccaccatgcccggccttggtttttttttgttttgttttttgttttttaagttttaacaaatctcattttttttaatgatatgtatgacttgaaaaaaatttgagaaacctaaacaggatggtcaatggtgaggttgtggttatttttaattattaacattgttttattttttaaagcaatatgggctgggcacagtggctcacacctgcaatccagcactttgggaggccgaggcaggtggatcatttgaggtcaggagttcaagaccagcctgaccaatatgatgaaaccccacctctactaaaaatacaaagattagcaggtcatggtggtatgcatctgtaatcccagctactcgggaggctgaggcaggaaagtcacttgaacccaggaggcagaggttgcagtgagccaagattgcaccactgcactccagcctgggtgacagagcaagattccgtctcaacaaaaaaaaacaaaacaaaagcaatatgtattgcatttataaccgaagaaaaaccaaaggtgaatctgatttcagaaaagtaacttaaggaaatgtaacatctaaaaataagaggaaagtatcaaatctaaatttaaatgggataatgataaccccagtttagtatttatggtgattttctttaaagaagaaagaatcccttagactttatggagtgctctgtgaccgtgttgagctatcttaagtggatcaaagatgttcttctatttttaggccttgtacctaatagcaactaatggaaccccagaacttcagaatccagagaaactttccccaatatttcgggatttcttaaatcgatgtttggaaatggatgtggaaaaaaggggttcagccaaagaattattacaggtaaatttaaaaatgatttcatttgggggaatagttgacttttttggtaaccgacagaaagctttcctagggctaataagtagatttcactactcattgatcaccagcggtatggcagctgctgcaatttagggtttcatcctaccatgctgagcaaactaccgcaaggacagaaaaccaaacactgcatgttcccactcataggtgggaattgaacaatgagaacacctggacacaggaaggggaacatcacacaccggggcctgttgtggggtggggggagtggggagggatagcattaggagatatacctaatgtaaatgatgagttaacaggtgcagcacagcaacatggcacatgtgtacatatgtaacaaacctgcacgttgtgcgcatgtaccctagaacttaaagtattaaaaaaaaaagtgagggtttcatctgctgtgaataaaattctgacaaaaccgtaatgtgcagtttgtgcatcgtatcaatcctcagacctgtttacagtttgtgcatcgtatcaatcctcagacctgtttacagtttgtgcatcgtatcaatcctcagacctgtttacagtttgtgcatcgtatcaatcctcagacctgtttacagtttgtgcatcgtatcaatcctcagacctgtttacagtttgtgcatcgtatcaatcctcagacctgtttacagtttgtgcatcgtatcaatcctcagacctgtttacagtttgtgcatcgtatcactcctcagacctgtttattgctgttgtgtgtatatttgtcaaactaaaatgattctgctttcattcaactctgaaagtaatgcgttgattatgttagtcttatgaaggtattaatatgtgtttagtttattaaattatgatcgacaagtagtctttggggcttaattgaacaaaattattttgtttctaacctgatgaatggcacttatacatttatttttccccttctttctggcagcatcctttcctgaaactggccaaaccgttatctagcttgacaccactgatcatggcagctaaagaagcaatgaagagtaaccgttaacatcactgctgtggcctcatactcttttttccattttctacaagaagccttttagtatatgaaaattattactctttttggggtttaaagaaatggtctgcataacctgaatgaaagaagcaaatgactattctctgaagacaaccaagagaaaattgcaaaaagacaagtatgacttttatatgaaccccttctttagggtccagaaggaattgtggactgaatcactagccttaggtctttcagcaaacagcctatcagggccatttatcatgtgtgagatttgcattttactttgctgactttgttgtaatagatcccattcattgtcccctttggggtatttccaatacttgaatggcagattggagtttttcagagtatgtgtttcatctgctagtctttctctccttcatagcttttcttttcctggacttgctccttttgagttgcttttgcgtttctcatgcctaggcaagtgtaatagaaattatgtagctccttatgttggcaaaggagctctatatagtttcactttgtataaaagttaggaccagctgttgttacatgtaatattttagttcagaacttgacctgaaggaagggaagaaaagtatgtgatttttaccttttttaacaaatgtgaaaaagtcagttttagaaatttcgtggtagtaagttcggcatttgttacatgtatagagagaagactaataatctctatttataactaaatcattgagatagaaaaagattcccattgactgtagacttcttcccattttgtcttcccttctgcctgtttccccttcaggcttggctctaggaaccaaagtgatttgttgttgttccaacctgggctttgtgactttggttagtgccactaccttcttccctcctttcccccttcaatttggaaataaatttctgtatatgttgcaattttaggtttaggtttgttctttttctttttcattaatcctctctcacctcacagataccccctcccatggcaaataatataataaccagtgaattttcaggaatttaaaaattagcttttttccacttaaaggagaaaaatatttgggactagcagcagaggcagtaagagatgtgaaccttggtgagctctgatacagtgagaagagattatactcatgaaagagaatgttagtgttacagagaagcagccgatagcaaatcgactgtagagacttggcggcggtggcattgccccaggtcgtcagcagtgtggtattatctatgagaacttgagcgacagagtatttcttgatgaatttatagatcatttgagatgttgagttactttagtttagttttgttttgttttttcaaataagtagagactattgtaaaaaacgagaaaggaaaatgaaatgtgcgtgttgatagcaataatttgtttcttttaaagattctaaaaggtctgagacctgtagcattaattatttgagtgccctcccttctcccctcccctcccttttctcttctcttttttcctctcctcttcttctcctttattcattgttttgcttttggagtgggtgttgttcaagtatctgtggtttggttctggcattttgttcccaccatccccttcccccattaacttcccccctgcttgccatcctgcagtagtataaatcatgaataaaaaataattttgctgttgtagtatacattggagaaactggcaggttttatttccattattttatttccactatatctatgataagatgcaattataaggagagaagtgactgttttttattgataaggcaagattttcagaaaaatgagtaaaataattaatgaaacatatttagagcacttaatggtctctgttttcaatataattcttgatttcatttttctctggaatatattggccttctacagctattactgaattatagaaactggtttatttctggcagaaagctgcagtgccacctgagttccaaattttaccattctttgtaaacagttggatggattatgataaagaagatgctaccaatgaaatagaaaaccaacgagatgagaagactgtgatcctcatgtactcagaggcacttccctcctaagtcaaagaccatcctcactgactatgtgccaacgcctcgtttcaggcttgtgactcaacaaagggcttttccattgatagaagcagtttgggatttgtagttgcgacttcttcgatagttacctgcacgtccattgctggcaactgacttgtcattaaaacctggctctttggttaagggagctacgctgtggtttattcttaagttacgtggataaactaacctctaacagaaatatactttggttaattttgaaatgtgtcatttttaaacaatcttaaaagtaatacagaattgtgatttattaattttaaaacattcagaacttgttgaaagaaaaattatatctgaatcaagattcatgttttttatttttattttttttgatacagagtctcactctgtcactcaggctggagtgcagtgacatgatctcagctcactgcaacctccgcttcctgggttcaagcaattctcatgcctcagcctcctgagtagctgagaccacaggcacccgccaccacacccagctatttttttgtatttttagtagagacagagtctcaccacattgcccaggctggtctccaactcctgagctcaggcagtctgcccaccttggcctcccaaagtgctgcagttacaggcgtgagccactgcacctggcctcatgttttttaaataattgccttttatatttaccctttttgtcatcactttagaatgaaaattcccatttaaatctgaaagttaccttaatagtcctcttgtgttattaggacagtattattatagtacttatttattttattttagatttaaagttatcttctctttttcttttttcttctgctgcttttagggacaattaaaactgggaaactatgaaacatggaacattttatcctacctgaaagtaaacgagtaattgtgaagcataagacactgaggctaatacaactctgtcttcatgtgttgactgcctggcacatagtattcattctcttccctttaacatagaagtgtccagctgcgtacagtctagtaaccagcaactgtaaacgaacctgtgcctctaacaagcgattctaaaccacctatgagtatttcttttagggctcacttaaatacatgtttgtatatactgtattctagccagaataattttagatctgatcaggtagtagctaaaattagaaaaaaacaaaatagatgcttaaagaatttgcatccatttttgagtctaaatcttttaaaatatactgagatccacatctagtgaaatgtcagtgtcaaaatattatagattatagctaaaatccagattaatactcatttggggttttttatagtggaacttcatagtaatacaaaaagcagattgtcttcctgtctccgctgctcccacagtaggtattgaaactggtaaaatcagttttttgatagtgtgtgtatataagaaaaaatagatacacacattcttttttctcagtcaacacattgattgaacactctggcaaagatgctgtggtggatgaggttggagttcgaaagaagaagcaagcgctggcctggccttgaaagaaccgaagtctttcccattcacttctctagaaagctgccaagacagaggcagaaagaaatggatgatagttctgtcaagcacacttctgttctcttagaacttagaagtgtttctaagagaacagaagtaataagagaaacagttacgtgtggaattcaacatctttggttggaacgcattggctttttttttcttgttttgatagaaatggaattaagcaaaagtagtttttgtcttttctgttgtcttcaaattttatgccttttatttttaatttaatcccgttcaattatttaattgttatacattgacattaactgctgtattttgactttgttcaataattttgttctttcagggctagaaataaactttttaaaaaaagtgtgcatttttccctttcctaaacttttattctttcttttgatcagcgtaaaagaatattttaatgtcttttgatagcataaaagaatatttaaatgtcttaataggttttcaaagaacatttagtatttttagtgataaatgttttaaaccttttaa

SEQ ID NO: 397 - DNA, 168463 bp, Homo sapiens
tgctataactgctttttccattttattcaaggtgttaactaaaatacagagagctttcaacctactttttcagtcattaaactaaaatgccaaccaagtccagttcacttctaaaatgtattggtacaatccagtaaagaggagatgacaggaaaagaaaagtcaacaacactaagtatagtaatgttcctttttgtttcatgaaacccaaattgttacaaacatcaattttagaaatattttatgtagacattaaaacaaaaaggcaacaagaaatgcaaaataaacacacacacacacacacacacaccaataggtttcacctgagaatttgaagtaattcagagacagatttaatattctttgaccaatagagataccgagaaactgtgcacactaaaatgaaaataagcaataaaagcaaatagtactcaaaatttaaatgacattggttaacaatggagtacgaaaaggttattgaatgtgctaagtctaatgctttaacactcttcaatcattcaccttttaatgcagacctttaattatattcataatcttatcttggtgaactctacacccacacctatgaattctgtcaatttcttagttaaacaaaactctcctagaaacctaggaccagggtcagagatagaattaaaatcacccactctcaggagaaatggaggaagcatttacactgaaagtctgctgaatcccagattctgtaatataaaccacttaataatctatactgacatttcaaagcttaggaaagggaatgttgtacaaccctggacttcattgtgtttattccctatgaggcacagagcaagataataaacaagcccctcaagctaaaagaggaacacagaaacatatatgtgtgtatatatatatatactatacacacacatatgtatgtgtgtgtatatatatacatatatatgtatatatgtatatcacagaaacatatatatttcccaaatttttcttaaaaagcaccccagttcaggtatcttgaataaagaaaattagtcatagacgaaaaaaaagaaaaccttccagttgtctaccaagaaaaaactaatatggatattacatgcatttctattttgaagaccaacagtttattaatttattaatagaacctgtatttttctgtcaattattgtgctttcaattattgtgctttgaattatatatatatatatatgtgtgtgtgtgtatatatatatatatatataattttaacttttgagaatggataattttaacttttgagataaacattcagcctgcataaaacataaatctctatgaagtaaacatcttatacagtttctctctttaaaaatagctttgacatgcttctgatgtccttaaatatttgtgctgcagatgccatagttgtattttttcaaagactggctcagaggcttctgaaatattagatatccctttgctggcaaaacatcagagtgggtattcgatcattacaaggtttttcttaaaccagtgtttctcggattttactgtgcatcagaattccctgacgggcttgttaaaacacagaatactgggcctcacccccagagcttctgatccagttggtctagagaaagcctgagaatctgcatttttagcaagttcccaggtgatgctttgatgctgatagtccagggaccacactttgagaaccactgctttaaaccgttagtttataagttctttaaagagcaatgtaagcttagaatccagaacctacatggtacttactaaactctcttcagagctgtgttccaggggcattccttgagaaaatcatttttttttttaaactttcttcttttagcaacagtaatgcccaggcagctagagagtccttaatattcattgcttagcattttggttttgctgggcctggactgggagtattccctatttctcatcagaagggctgcaatctactgtgtatctccaagatgttctggatctaaactctcccaggataggatctatgcctctgggggaccaaagccacagctacatgtctttacccagtaagtctatctcatccaggaggaagtccatgtcctcccggctcacttgagggctgatcaccacctggcggaagaagttgacctttccccggtgcggctggtagcccagcatcaagcttcccttcttcatcatcctctccttaatggctggggccacctgtgtggggagaaaaggggagaggggtgaaagaccagaacatcaaggcatttcaatagcattttcaccagccattggacatttactgggcatccactggtttggatcccattctcattcacacaaggttgacactaataataataataatttatggaggactcatgagtactgattcaagtgctttagacatattaattaatcttcacaataacagtgaggaagatgctactaatgtgcccatttatggtcgagaaaacaggtacatggcgagtaaatcagtatctcaaggtcccaggcattttctccctaagcccatactcttaagtgtaaatcattattcaatgctgcctcattaaaaacaaatcaggtgtccacagggattacagtctcattctcaaatttgtcttaactaaaaaacaccccagttcaggtatcttgaataaagaaaattagtcatagatggaaaagaaggaaacccttccagttgtctaccaagaaaaaacaaatatggatattatgtacagttctattttgaagcctaagtttattaatttattaatagaacatgtatttttcatcctagaaaaaaagaaagttagatattattctcatatatgaaatataaacaccctgtctcttattaagagatgtaaatgtggtaataaaattaggaagcacatattttaaagatctatagctgacatgagaagtacaggccctgataatccagatacacagatttttctaaaagtttaatgtttgaagaaactagtctaatttaagaaccacatgggaaaatcagtccattttctaatcagtagtatggccaccaaagagctaggttgtaaacttttaaaatagtgaagttcatttttgatacactgagttaaaatattaagaatgcatttttactgtcttggaaatacaagcaaagtttttccacttgaattttattttaactctgaaaactttttgagtgtgtcctatgtgaatatgtggaaagggaatataatgagtttctatccttgccttctcaggaagatgagacttactcctccagaagggaggagtacatatagaaagaacaccaggcagagtgtgcttttaaactccttaggtgaggggcatgaatctgggttcccacgagtctccctctctcgtaatgtgataatcccacaccagcccagtttttgaacatacccacattttgtcagcaagtcaaatgacttcatctgacactcaacacaatcttgatctgttccaaagctgatgaaaaaattgggtgttttagacctctgaagatattatgtgttgaacttaaccacagagccttctcaaaggatgttcaaggttaattttaactcaacacttttttttccacatgtactaattttagaatataagtcttgcaaaacatggactacacagtgcttgcaataacaaaacaaacacctattcaggaaaatcacattgccattctagcaaaaaactggaagtttcttacattatcacaagatatgaaaagaaaatatatgagtgtaaaagaaaaaatgtagaaaaggtgatgttagaggtcaagttagtgaaaaaagcatgggccatcaggttctacaaacttctaaatatatgtgacacattttattctgagctttctagagattagaaaaatgtaactaaacaacagcctgcattcacttgaaaagagtggcaaatgtccagttgatgctggaagccagaagctaggaagtaactctctactatgcttatacatatctgcttcaaacccatgaatttgtatgcattggttgagttttcttccaaatccatgtatgcaagtagtaattctaaaatctagtaaaaaaatatgtaaaacaaagatagatgagtgccaaaaaaagtgatttttgtaaaaactaagttgagtcctttggaaagaagagataaagggggatggctaaacatcattgtgatcacactaggcaagagaactgtaaaagcttttgagaatccagactgattctgcacggagatcgctacacaggtgtctgagtacttacttcacctgaagaaacccgagctgcataagacagatgattcctgaagaatgtagtttatgcaagaacagtggagggccctctcatcatcagacctctacttaagaaaagtttcacttgtttataaaaagcatttggaaatcttcactaggtggaaaaaacctttccatcaaaagatggtaacataaatgtacactgatatacaaatataacattaaaaatttaaatataaagatacaaatattaaatgggaaaatgctcacattatgtatgtatcacattattttctagaattatttgctttacctgactaatcctcctcaccttaggtaggagggcttctcgtgcatatgtggatataaatgggtctgcgtgcataagcatgtgtgtgtgtgtgtgcctgtgcatatatgcacatgttaatatacacactcacatataatttaaacctctgacccaccatattgtactgcttttaaaatctctctggccacagggcaatggagaaccacgctttgacttaggttcatcataaaagtacacttgtttttaattcaaagaacaagtggctttctgaatgcaaactgtgagaaaaagacaacagtagtgccagtgctgaatcaagattgggaagacctggtttacatggaccaaatgtctagctagaagggccacagactatcagttttagagcttacagcttgcggttctgtggttcttgtttttgaaatcaaaattctcttcatgttcctctccttcgtcctccaggtacccagggtataactggctctggcttgtagccaattttaaatgtaaaacaggcatgctcttggctcaggcctaatttgcatagtgtattcctgtttacttttcaatacttccattttttctcccaaaatggtattttatgccttatctttggagagcattagaattttgattccagtacataatatatctgaggctcacatgaggcaattatcaaaatgaatctgtcacgtttgtatttcttgtgaggaagccagaaatactttctaacgtgaacaagaaaggtaaaggaagagggcacctcagatgttttaatataaagatactttggatgtttaaattcttgctcttgtgtaaagcgcatgactgtacttccatgggcaaaacgcagggaataaaaaccaaacttctaggacaaattttgttactgactttctgagattataaagacataactaaatatatgactcagagaactagctaagcaagggtttaacagtacaacacatttttatttatgagtctatgaactataagattaattcctacaggcagttactactaggtaaaaaaggaaggtctcccttgtctatgaatacttcgcgggaaagaaagtaataacatcaaagctgatattcatcaaatctttatcacaaactattctgctggtagtagtagttgttgtttttaacaagtattttaccagttctttacaatttgcaatgtcctctcacttgtctgattcccataaattcaaattaaagcttatttgaaaggaattcatgttttggcaatttagggaccaagcacgttctcactaacagtcagcttatcacctttgcacttaaaatcaaccattttttatttatgaagctccaggcataatccaatgctaggtaatttggatattcctttttgctgatcacagcagagacagtcctaatctgacaggatggcatggtcacaggggaaggaaaatatgcatgaactaaatgtaggtatccagataccacccctaaatggggcgcgcatagaggaaagcaatttggcaggagtgagattgctttccagctctcaattatttttctgctgttttttcttcaaattgtaaatcaaattcttttcttgtgcctcagtgcactggtccctgcatcttaagtggaggaagattctgacatttctatttggatacacggtgacttaatgtacacatttctgtggaatttgtctctccctacccctgagttatgttccatcagtgatttagtcatttaaatagagtctcgttgcacatcgctgtagcaccaaataggatttgatatttaaaagttgcttaaacccaaggaaaaataaaataaaatgactttctttctgaccaagcagggcaattcgataaaaagcttctgaccaggcatcattattgcctttgattaaaataaaatgataatttccataaaatgacatttctttttaagaatttgttatatactcagtgttaacaagaacagtttttcaaaatacaaagtgtttttcagggtcgggcatggttgctcacgcctgtaatctcagtactttgggacgccaaggcgggcagatcacttgaggccaggagtttgagaccagcctgagcaaaatggtgaaatctgtctctactaaaaatacaaaaattagctgggtgaggtgctgcttctttgtaatcccaactactagggaggctgcggcacgggacgcaggggttgtggtgagccaagatcactccactgcattccaacccgggtgatggagtgagactctgtcttaaaaaaaagtaataaaatacaaagtgtttttcaaactatctgtggggaaggatcagttttatttttttcaatgcattataaactaatactttagtaaaatacaataaaaatcaattactagcaaaatgaaataaaaatacaagcccaattttgtttatttttaagttcaatagtaaagctaatctgttaaggttgctataaaagtttctaaatggaaactgtggatttccataaatttcttattgcagactggtgacacagatgggttgggattgctgctgtggctttcttccagtatagtttttctggaacaatcacaaaaactaatttgctttatactttcctcccacgtaatctgggttcccaatgtgtcccactttctatgtcaacttgaggagagttctgctgagtgggatattgaaatctagttcatggaaaaaattggcatgaaatgttcatactttgtatctggcacccaaaactatcactgagacttacatacctccctcccctgtaaagtcatctcttttcttttcttttccttttctccttccttccttccttccttccttccttccttccttccttccttccttcctccttccctccctccctccttccctctctccctctcttgattgcttgcttgctttctcttctttctttctttttttgtagtttggggtcatcttagattttctgaagccaggtggagatacaccacggatcaaggcaggggccagaattcagggcatgaacagcatcaaggggagagcttaagtggaaggatttcagtccaagagaagtattaacatgtcaagacaattcagactttgatgggctttccccgtgcctcccccttctgagggggtgctccaatgcagtggctatctagaaggcagagtttttcctgtctcactgtactcaggagaaattagccacagtcctcaaaagctgaaggctgattaaccatctgagaaaagccaacctagagagtcttgaatgccagcttctgcagatgtgaaaagttagacatgtgagaaagcatgaaattcttttatttgctttattaatttttctggtatttatctccataactaaagcattatggttgccagtgaatttaaggtcttcagaaccatgttagatcacaaagtctcacatcgatttacatctctgtttgccttttagtttcaatttttgtttaagtatattcttcagtggaaagtggatttcatctgtttctggtgatgaaagagctcaacaatatgtctcatacaaatacttcttaaaacctaatgaatattcttatctctgaactacatatctgaccataaatatgaactgaattattctgcctgtaaatatgaactggattttcctttacacgtgcagctcacaacatgtagagctgaaatgggctttggattcagctaaatatatatcctctagtgtgtaacctccatgttagccaggcaggttgttactaaatgaacagctgttgacagaaagcatttccttatcgtccaaacatatgatagtgcaaaaaagaaagtggttgttttagtcttatataaaaaaatttttgtggtaatggttagctttacatctttaaaatgtattaaacggatagtttcaccaaataaaaaaaattgctaacccacaatatagaagcttttctttgtatttccaaatatgtctgagtaatttgtctcttctcccaaatgagacatcttacataccagacatttgccctcccaacacagcttgcttttgtccatagccataaactgcagaaattttgattatctttcatcatatagtcaattttgctccccattaaggaagaaaccagtacttgacagacaagtactttagcaccttcatgtttcttagagcacctgacaatgtaaagaggggaaaataatagccttcttagtttgtgttcaggtaccatctaaatctctctactttgttgttgttgtttttcttcctgatttagtcttaggtaaaatgatctgatttctctgttgtttcatcaagttacacattttccttctggaatagaaaaatagcaagggtgctgccctttttgaaagctacttgatccatgcagtaaagaaaactaaatctcccattgcattgtgtagaaggggtcacactatacaatttaaccttctacggcaattgtttgttaatgaaaaatttagaacatttttcttaaaaatgccaaatcgaatgaaatcattcactctattttcttcttcttctttacattggtgttttggctgtatagtcttcatgaaaaaagaaatgtgaatgtttacagcaactttattcaaagcaacacaaatgtacttcaagtacagaatggataaacaaaactgtggtatacctatacaatggaatactactcagcaattaaagggaataaactaccaacacaacatagaagaatctccaatagattatgctaacagaaagaagccagactcaaaggctgccttctatatgtttccatttatgtggcattctggaaatggcaaaatcaaatggctagagaagagatgagtggttgccaggacttgggctgaggggaagggttgactacaaagggtcagtcctagggaattttggtgagtgatgaacactgtgtcatggcggtgggtatataaacaccagcagacaataaattctgttcgaagctgggcctttgcactcttgggtgcaaaggaagaaggcattttgaacatggtggaacttgaagcttttcttcctggtgggctgagtggaataatgggaactgcatggctcaaagattttgggggctctaccacacatcagattgaacatatttaaatgtacccaacatacttattaaatataattcatatgcaatcatagaagatttcagttgaattgtgatggactaaattaacataatctttcattatgtttgtttttcagttttccttttacattttggatccatttttaaaactagcaagtattttaatgtggccctattgaattccatgctctcaatgtttattttgcctgatgattaaataaacaagctctgttcacactagtgtgatcaaatatctagtttgctcaggagacacccattttatacatgttttcctgtaattatcaataacaccccttttcatggccataagtgtcccagttcagatgataaactttatggattagaccgaccatacacagaccaacagactagcttagactgacttgtgacctaattcctgagattctctgtgactttgggccaatatttaactcctctgggaatcatatttctcttccattcagagccgataatcctttgcagggtccttatgtggactaaatgaaataatgagaacacaataagcatagtgcttggcatactaggcactcactaataggaactaatattatttatttcttaaaataaatttgtatttaatcaatttacactcccgcttggacttttattacattatttcattattatctcttgagacatgaacatttgcaagtgctatgaaaaacatgaaataatttattttctccccgaagtgtctaaactggatttaaatatttatgagacaggctgcaagtttgaagtttcagaaattaaatattgcaactcatgtatgccattaatcttccatttaagttccaggattttttcaaacgttgataaagtcaacttacatttttcctttacaaagtaacacagtcattgataatcttggcagattttttggagggaagttttccactaaaatttattgtgggcagggatgagtttttattatattctagaaatttctatctgttgcataagttgttagaatacaaaaacattttaaaagtaaaaaaagttactttttcttggacccatgaaaaggccatgtacttaaaattcatgagcttatttccagcattgtgcagtctccttgtgctttcttgtcacttatgtctttatcaaagaaaggttgaagaatactatttggtatgtcccaaacgtacaagaaaatacaaatcacctagattcaggccccaatcagagcagctgaatttgaatttcagtcgaataagcctagtggtctgtatatttaccaggccacccaaatgctctttttcatgatgtaagtttggtgaatgatgatctcttacttaggactttgggagaggcaaaggtgaggttggaggtaagaggagtttagtaaaggaaaagcaattttgacagaagaggggagaggaaattgagaatttcctctcgcattgcttatgtcgattttgtaataaaacaaaccagtgaccttcaaagaagttgttagccaacttttttgttaatcataaaatctaataaagtgtttaaaacacttaaccatggcccaggaaacaatgagcctcttagttttgattgctcaaagaatcaatttttctcttctaatatattttctgccatttttaaacctatctaattcttctcttactccttcatacaaccttactcatttcccctgatacctccccaatccataatttagaggtaaaatgcattagtatgagtctctcaagtttaaattatgtaaaattggtggtctatagcccatgaaatcatgtgcatccaagagatcattttagcttggcagaatatgaagaaaaaagccatactttgattggacatacctttttcaaatatgaattttacccttattttcctcctgagtatatctgaaaatcagacatgcgcaaaataaaagaactgcctcattcatgttctttccaatacagatgagcaaagctacagaaacaaagagtttagaaaccccaaaagccagaaaaacacagtgagcttcacatttggtgtttacaacatagtgacaatgatgacagcacttccaataaacctaatgtcagtcatatattcaaggcagctgaaatgaacagtcataaaaacaaacgaaactgaactgaaagctttagctgaacaatggacacaataaacattttatacactctataaagcaaaagcttaatacccagttgtgtctcagcagccacctgagctaatagctcctgagtaactgttgtgggccaactcccaaatgtctgcctatgttgggagatccctgtactgctccctaaatgcagttattcagtagctctctaccagaggtgctaccaactcccttggggcatttggaatcatggcaaagcattttggatggttgcaatgactgtggagtgctacttgcagttagtgtctcatggttaagggtgccaaacacctcacaatgctgaaaataaatctgcccaaggaagaatcatgttatccaaaatgccagtagtgcctctgttgagaaacacttctcaggagccccataattcccaccgacatctctacactttttcttgacatatcctgagacctttaagtttttctcgggagtcattaaccttgctttggcccagagcaaagtaaatgggatcttcagtgcttaaaggtatgttcatgttgttttccaaggattcataacatattcaatgagtatcactccatctgagaggagagaatgagtacaatcccaggttcttctttaggttctatgggcagtggtccaatatttctgaatattgtgtctggccatttcagcaggcatacgatgctttagtttcggcactactgcctattacaataagtgggtcatattcatgagtttttagccacacagatgtcacattcacaccttacccacacacttagtgagatgagaagcacctgaaatacactctatagaagatgaaaattatgattcattttctcacgggttttctcagggcaactttctctgagaattctattacttttcaatatttggcattgggaaattagcagctacaattttctcttttgatttattccactctaacaagccactgacagccaacgaggctcttctgggcataaaggcaaaactcctacctagcagcacaggcacagatgtgggaagcggccccagtgttggcacagcaataattttacattgtagaacctgcatatcaggcttgggaggcctagcttcctgaattacagaattactgattttatagtagatgcaggggcctgacaaggcaggggatgaaaaaagaagggagcccatggcgttatgctgctttgacctaagagacatcttgttctatacaggctgccgagacattccaattatgccttggtgagattcctgtattcgccatcctgcaccctccttcctgtgcccatcctcctgtgtgactatctacctgcccccacctgcctgtgcccacctgcctgcacccatgcacctgtatcttatcttgtttataggttttttccactgattatttgcttcaggagtaaactgaagtctaagttgtctttttgacctttttgtttgtttgaatacagttgttcattatccatacaaagttagttgcacaccacaggatgtgttctcagctctccctataccttctctttgcatctctatttatgtcattttcatgttttactgcacttctttattcagctatagtgcatcctaaaacaccttggtatttcaatctcagaggcaaaacctgaacttttaaagtcccaagtgttatgtaccttactttacttctgtcgctgaatcaaagaaagctaccatgaggatactttaaaataattcttattcctgtattattcataaaaatattgagaaaatgttaagtatgaggtgtttgttcctcctggaaatctttataaatactaataaagagtctttaccattaatgctgtaaatattaaccaacggtttttaaaagcaatccagaccatttacttgagtaatgaaatgcttttgatttgcacattttgagaaaattaatgaaagcaagttacacattattttttatggagcttgctcaacactcctagtgtttaaggttggaaattactctttcctctaaatcatgatgtttctattgtgtccagggggctacaggctacagagggatagaggggctcccacaaggggtaagaagaaagcaaagcaggcaggacccacctctgcctaaactaagctctgctttacctgcttcgtatgtcagagttctacgtaagagtttgcttggcaaaaagggctctggtatttaaaaagacagagtttgaattcgactggtaatgtatttttgttattattcaagatctttttttgggaataactgcaaaatagccctcaagatgtcagctaagggaattcctacatgccacgtctaaggggagaaagttgctcttggagtctggcattctttcccaagttggggaagttgtgagaaaggtcctagagaaacatgtggctctgctgaaaccaagcttcttttgcttaagagtttagggtaagtgatacacgtcaagttatgttcaagtcaagtaatgatagtaataaattactatttcacacaattgaacctctacgtacgtcctaaagcagttacataacaaaacactatcaccttccccccaaaggtctcttttgcttcttccaggtaatcactattcaactcctactttcttactctcccatatatgcccctagggtttcaagttatctaccagccatttgaatgtcttctttttgtgaaatgcctatttatgttctttgtatatttttgttttgggtgatcatctttttcttacaaatttagaaaaaccctttattattaagaacattaattctgactttacgtgttgcaagttatctgcttttaactttgtttttagttatttcctgaacaatttttatatttatacaaacaaacatatatatatctaatatataaaaaacaaatatattatatttgatatatcaaatatatttattatatattatatattaatatatattatatattatatattaatatatattatatattatataatatattatataatatatatttgatatatcagatatataaatgtttgtataaatatatataggtgtttgtattatatatatgtattcctagtatatatatatatatatatatatatatgtgtgagataggtggtttgtttgtataaatattatatatattatataattatgtgtgtgtgtgtgtgtgtgtgtgtgtgtattccaacactgtggtgttatacttaagctctctctgcccacgccaagattacaaaaatgtgtgttattttctgatttgattatgacacttaaacttttaatccatttaaacattcaattttttaccttgcatagagatacactcctacatccccacatttaaccagtagtctcaacactgctgatggaacaagcctgcctttccccagtgtgtattggaaacatgttcgattcctataaataacttgggcctaagccttctattctgtaagactgatctgtctattctcagaataatccaagttgttttatttatataattctataatatattcagttcctagagaactcccctctcaaaatgttcttgccggttactaccaacttagtctcctagaggacatccagaagtgtttttgatgagtttaaaaaatcatttaattattatgattagaattatattaagcccatgtataaattagggaaaaattaatcttctcacctaaaattatggtgtttttcagtttcaaaatgaggtaaatttaaaaaatatgactgcaattttgtttgacacttctctcaaagagatttcttgaatgagagagggcttgtggcacactaatcaccagtggggtgcagtggaagagatcctgtgtggcctccaaggcaaggtcaggagaggtggactattgtccaaattgttctcaggtacactgactttcccaagttcaactctcctaagcccactatgaggaattccaggccacatggagaggctttcctgtaggtgctctgattgacagctccaaatgaggtcccagctaagggccagcattaaccaccaaacatgtgagtaaagacgcttccagaatattttggcccggacagtaaatcaccttcagctattttagtcttcccagatgagactctagacatcatattccctctgtgctctgtcagaattcctgacacacaaaatccatgagcataataaaatactgcttaatgctcctacatttggagtgatttgtaaaacagaaatagttattggaacattaagtggtttttttttttggccttaaacttttatagttttcttccatagatattatactttatttaagttaactcttagttatttaatatattttttttattatggtgataaaattattctgactaaaaagctaccttctgatgtaatttttcattttctagctcccagtttcttaccttttgtgtagttattcaactttgtacatctactgcagtacatttctaaaagtattttatttgatattcttaggttttatagatatacaatcacacaatttaaaatgaacatatttgggtcttctccatttaaatattataaaattcaggtcttttctggtcattatattggctggtactctcagaacatcattaactcatggtggtcaagccagacgttcctaatttgttactgagtttaaggggaaggtatttcatgtttaatatatatagttctaaatatcatacaagaaaacaaaataatataatcatgagataaactctaagccctactattagttttgaaggtcatatattttagcatatttcaagtaattttttttttgctacatttaagtgggagaagtaattttggattactttttttatttacttgttcagagataggaagaaaatggtgaaattgctacttaaagcatgcttctgcttagctttagaaataatgacattctgctgaatggagcaataaaaacagaacctgcgcatgatcttgtatgctacaccagctgactaatccatctcctcagatggtttttcagagtccaaaaatgctacataaatttttttcaacctgtgtgagtggattattttgtggcttcctgaaataatcctctcatcttttaacacagttctgacccagtttgagagagtatctttaatatcttgttctacttcactgacctcaaggcagaatagccagaaatatatgcatttaacaggcaactttcatcttcaagctcacagaagggttggctttctttaaaaaggaaattgaaacttatattaccaggcagctttttagatgattttactttccattttataactccagcaaataggaagcagagatgtggagtgagtgaaggagatatgtggagtgaccaaggtgcctcagaatagcgcataacaattgatggaagcaaacacaagctgtcacagcgcctgcttttacctcaccattgattattcatcaggtgaaaggcactcatcccagaaagaaaaacagaaacacacgtatggaagacaaggaaagtgggttgctagaacaaaacacagaacaatagcccatccagaggagtgggctggtgaggtacttacagaacacaaccactctgagaattcacaacacactctgattccctgagtggatggttaggagcatgggtgttttctagttggtaaatgtgagactgattgttatggttattgcctgttaaaaataaattttattattgttcttcattatttaaatgtccttcttgcctttgcctcataacccacacacagggcctgctgtaggaggagtacatatctctgttccattgctaagtgaccacttctgagctgaaactctaagagtcattgtgtgtttctgccaggctttctcctttccctttggtgcaagaatagcatttcccagacaggggctcctccatcagtctggatgctggggggaagaccatggagcagagcagagctgtgactgacccccagggcatgaagcatgatcaagaaatacacctttgtattataaaccattgagatttggctgggaaaggtgggtggggagagggaggcttatttgttgctgcagtgtaactaagtgaaacctaattcatatgactcaaactaaggtatatttggttagatctaggtgagttctactttagaggaaatcctggtaactgttgtttgtttgtaagttatagctgtaattaattttccctgtattcaaagcccccaaaccctgcattcagatactatgcatttagacttccttaggcaaagtcaaggcaacaagctgatgattctaagctattattcaaggagtatctaccatcataaaggtggtttagtcatatagataatatcaatcaataatacaggagatggcaaaaattttttgtgaagagccagatagtagctgagtatgatgacccctaatctcagcactttgggaggctgatgggagagggtcatttaagaccaggagttcaagaccagcctgggcaacattaaaaaactccatttctaccaaaaactttaaaaaaattagccgggtatggtggctcatgcctgtagtcccaactacttgggagaccgaggcgggaggattgcttgagcccaggagtttgaggctgcaatgagccatgatcacaccaccgcactccagcctgggcaatagagtggcacactgtctccaaaaagaaaagaaaaagctacatagtaaatattttagactttgcaggccatacagtttctgtggcaaccactcaggttgtaagtgaaagcagccataaataatagaaaacaaatgagagtggccatgttccaatacaactttatttacaaaaaaatgacaatgggatgtgttttgcctgtaggctgacccttgttgtagaataagaaacacgaacagcggcgaacgaaatctaaataacaagcctaatgtagcatgttctacaactatgtttatatggttttaaaattaaaagctatccaggagccattgaagaacatggttaagttcttggttttcctatatgtaaaatagagacagtagaagttatttcataagatttttgtaggaattaagatgaaatataaagtgtgcatgagtgagcaagtgcttaatgaattccagcttctttaatctttctgtgtgctactattcaggactcaaagtagattattagtgaaggcctatttaattcatgccaagttaatgaatgaggtcaaacagtaataaggtgaagcacagaatcctttaagtcgacatttgccgagcaattcaaacttacggtaatgaagaataaatattaatatatgtcatgatttacatgtctatcaattagatccctaattatattgatttgacatggaaatgctttatttttattgcgggggtacatttggaatgatagaaaataattatctgtgttccacacccaaatcatgaaattctttcctgcatggacaagggatagaaaataaaaccctattgctatctgctatattaagaagctgctcaattaaacagaagtcaattttgttattcattaaactcagattgagacatcaaattttctttcagaaagcagtggatctcaatatgttgctctgtgttctgttaaataccttccatcatgaataattagtgtcaaatgtgctcagaagctcatggccaatattcatcatctttggtgcatgggccatagtgacaattgttgagatacctgaactttttctttttgtaaatctaaatgccaccagagaaaaatatatttgtttttccaatacattctctgcctgatttaacgtttaaaatttatcttcctaggcctctacttggagttcatcctgttccaaaatattaaaattctcttcccttattctttccatttcttcttcttcttctccttccccttccccctcccctttcccccacccctcctgctcctcctcctcctccttcttcttcttcttttttccttttattgcactccagctctgttgcccaggctggagtgccatggtggggtcttggctcaccgcagccttcgcttcctgggttcaagcaattctcctgtctcagcctcccgagtagctgggattgcaggtgtgtgccaccatgcctggctaatttttgtagttttagtagagacagggtttcaccatgttcaccaggctggttcgagacctcaagtggcctcaagaggtctggcaggccacagcctcccaaagtgctgaaattataggcatgagccactgcacccagcctccatttcttctccattgttaaaattacacactttaaggtaccactcactgcagacctactgagcctccagtctctaagaagttgtttctagaaatacaatttttaccaaattttcccatgattttaatgtgaaaccaagtataagaccctccttattaaaggaacatgaagaacatgagagatgctaatagtcatcaccatcaatattttcacaggggcataaaaaacagcactagggctgtgataagggtaataaggtgacaggtgcaccaggtgagacaggtgatggggtgataaggtgacaggtgggccaacaattgttaggaggagttttcttctctttttactttgtacctttcctttagctaagaacagtgtctaatcctgggccatcagatttcttacacacagaaatgccaacacataaaagtgacatataagttggagatgcaagaaaacaatggacattaagataattgacaataaaaatttccattaaaataattgaaaatagtgaaccagatctatcatatctacaaaattattgtctataaattcaatgttgtattttggtgttcctgatggccagcaatgcaggggagtgaaaatgagatatgagagtttaagcattaaagggcagaaggatactgagaaatccctcagtgaaacaacgcaatttaggccaggaattttccactctttatcctcacaggccctttttggtaccttgtgtaattatagcagacatatagggatgtctctgcaacatggtgcctgtcaggttcctgcgtttttctttttgcctctcagatgatttttactatcacaggcctggggaaagtgatttgcacatgaagcattttagcagaccaatcaattagaatcagcctttttctgtttatgtcaacagccaaatgatcgtgagaatacccaggccatttgttacctcccagggatttagcatccagcaccttgggttgtctgaagttctttccagggagctgcctccagaccttagacacaccacgagaaaatgtctccttggctactgacaataatgaatcaactgcataaatatatctgtcaaaatgatggtgcatttgtctatctgaatactagagaaggaagggtaggagagagtgaaagaaaggtggaattgagtagagtctgacacctcacaaacttagcaattttggtaaaggataaattcacatctacccatacatttctttggacatctgtgcagaatcctcaaatccaatttctttggaaaagacagtctccaatatattttctgaatcaaatggatttttagtttgtttgtttgtttgtttgcttttaaagttaatttataatttcctttgaaatgaagactgtagacatggccatatctaagagaatatgaatgaaagatttaaataggggcattcatggtcaatccacttcctttgtttatcctatcctgtaaatattttcagtctactacccatctgtcactccattctcctgattccagctcttatcaggattgtggcctgtggtttaactgactgcctttgccagagagttaaaacgagtctgttcctgattcacagcaccagctagatcactagggccactaatgatgagtttagcaaaactccctgccaataacatgaaaccattcaatggctgaaaaatgcttcctgtctgaattaaccccccaaatatttacaagtacagcctacaaaaaaattcaacagcatgcaaacttaattactcaacagtgatgaaaagtccacttattcttgaagccagagaagggaagttaggtgagttagaaagggatgacttggtgttttctcaccttcctcctggaccaaatcaatggcatagacactatggattgatttggaacaccatctagtgaaggatatgaggaagcgcatggacgtagaaaatcccacatcaactcctggttcgattcatttaacatttcctttagactattttaaatggttctgaaatgaataaggatgtaatttttttaagttatgaaaaaaacaaaacagaatgaccagtgtgtactccagcactgaccagattcagctaatgagtccacttgcctctttttctcttagcacttccccactgactacagtaaggatgtaagaaacacccccatagagttgatacaatcaagtttccttctgccggaatgtcagcatctggaatggcaccaaaggatttgagaagaatgatgccaggacaccagattttcaaacaagcatctatcagccatggtatttttcagttaaacaatatatgtgtaagaggctttagctatcaaaaaatttaaacattttctggaactcaatagcttttatcgtcagaaaatcggtaccaacagcacctatttcacagtgtgctgcacacaaaaaacattcaataaatataatattgttcaataactagaggtggcagctagaatttttaacctgggaagaaagctgaatataattcaaccgttacattttgaattcttctatataaaactgtgtcctcaatttatttatttatttattgaacttctcaactccacatttcaatgtcttaccccttgggatgttgatccatgtgctgttagcactgaataaatattatatgactgcctctaaacttcccacagagggaaaaaaagacaaagcaaaacaacaacacaatccctcacattcaatgttgtggttcttttactataattatcaattcccgaatcaatcttgccttcatgtaccctagtctgactttcaggaaacctcactgcactgttcctgattggaatcttgctttgtgttttctagcggttgctctgaagtcacatggtcagcctgccatttggggtatcatagtttctgtgagtaattgattctatccagtcttaaatggaaataaatgctgtgtttgtattgctcagcatgttaaattttccttttaggtgaagcagaaaaggttacataaggtctgaaagcctcaatcataggccactaggaacacagtgacctcccattacactcttggtcttctctctaaaatcagaagaaaagaagactggccagaatgctggagtgtctctcactttctcttttcaactcttctattgtttgaacaatgactaattagctgtcactatctttaatccagcaatgtactgactaactcatgcctatttttagcaacaggtgaatcttaggacatttcttcaagaagccagcactttagactaatgggacctactttgatcttagagaacagaacagttttcaaacattccaactgtgcttccctgattttgtgtgtctgtgtttgtggtccttgaaataatagagaaggaaggtttttacctagcaacacattttcaatctgctaggcaacacctgagaagcacctgaaggcaggcagaagtcctctactgagtggtttcattcgccccagctgaacagctgacacgagctcccgaggcactctactgaggataattagacttatactcagggaccggcaataaaacatgaaaacaactatgatataaaatgaaatgggctatctgtcataactgaagaataaactgtgatggagatttaaatcagggtattctacagccaatgatgagggccaatggaaaagagtgctttgggcaggaggttttgtactttagacaaaggtcagattttgctgtcattcaatcagctgtgtgttgtgtaggcaacttattatcattcaggttacagtacaagaatttacaagtgactcctcctcctctttctccttcttcatcaaagtaaattagaaaatactgcagattatccccatataatattcctctcactcttgctctgaaatattttaatgaatgggacagaaggcgctaaaattacaatcagaagagcacataactggagatgctggtttcttacaaaagtacttatttctttatgttgttgttctggtgtgattattgatagtatccttttcagtttcaaaaatgtcctgagttgggcaattcatcctctggtcaccagacacgcaccaacagtctatctcatgaaagctgtaacagcacacggagtggcacaagtgggtatgatgcatcgtccacatccactgacatcaccgatactgtcggcctccctctgcttaggcttccaaaacaccaggtctaccgagatgcccaaacaacattgcaaaggcaaggttatgagaaatgccacactagctgtggaaagagtaccagttgatgtttccagtgtaatgaaatgatgcaaacgcccactgtataaaaatttccgtctatcccttctctcctcttgcagccactttttttttttaacacaattgctacagctaattgtcaatattaacaacacacgcacacacaatataaaatatacatatacgtatatgtaatttgtcctgcggcttcatatggatttcaattcatatcttcttcaaactaacttattttcagcttgactaaaaagttgctaattcattcgccttagctcatttttttattttcaatgaacattagtctctggtggatcctataataaagcattatacattttaaatatttttgaaagacagaggacattatctgaaacacaaagtcaacctttgtaataaatataaaagaagcgtgctttgagagaaagaagtaaagaactattgagacaggagaataggaattagggtaaccggggttaaggcataaacaaaagaacaacaggtgcagccaattcgcataagcaaaagaacagcaggtgcagccagttctaggcaagattgggcagcttacgggccatatcctcgctcctgtgataacaagacaggagtttccagttcagcctctgattgagggccaagcctcacttcagcctctgattggtcacaggccaatccttcaaagggcataaccaattggaggcctctaaagggcacgtggggggtgttgccaattcttttggctttataaagccctgggaccattgtggtaaggagactcttgagccgcttgctggtgtttgtttctattctgtgagttgtcttcgctcagtctgtgctttttctttccttactccgttcttctgttgctttgtctttcattgcttcttttattccttcgtgtcttctgttcaacattccgagaacctgggtaactagaacctgggcaactagatcttgtaatgctatttgcctatgaaaataggcaagctggaaatatctagtagactagaaaaaaggctttctagaacttgagtggaggtatctatagaagataggctaatgtgaaaactgaaagactgaaacagtttgaggaattatctccctataagcccaccccttcatctagtcttaactacaatcgtgtctcatagacacggagatctatgcactgagaaactgaactagatttctgctgcgctggtgccccccgatggtctcgccatttcatggctcatagtttttagaggaaagtcccttggaaagctttttttgtctctgactaaacacagaagtaggattaaatggcagggctaaatctagcttcccttttcatccccaaccaatcttgtttctctccccaatatcccattgaatggcaaagggtaatgaggctgaagatgaaaagaacaacagcaaagacttactgatggctgtctaaataagataggacgattctgaaattaaacccagtaggcagaatgcttctaaaggctacccaggcccatgtgctgaaacctatttcgttaaagtactgctgtggtttctcattccacacacacagtggtacctgactgagtacttcactgagaagcttgagcagaagatgcggctctgatgtagtgctgttaagttctctcaggtaactttagggttttcgacagcttttccttttaaacttaagggaggctagatccacaaaccgagcactagcacaggctggcacgaaacacagcttaactttcatttcaggcgttgtaggggcctatctctcttgctgacagttacgggtgcagtttaagcacaatctatttaagtggtgcaccttgcatggagatagacatgtatggtgaaagaggatgggagtaacaatggagtctgtgccgcagccagtctctgcttttagataatgctctgtatctagttactataaatttgggatagccctggcgatgaggatgctgtgggacactgtttgcttctttaaatcaccataaccactcataaacccagtctcgaggagttatgcgagtgtttttctctgtcctttctcttaacctgttccccttaaatatcgttacaagaaaacgtccactggagcatacttcatagcactgtgacagtagcagaagggagaaagtgactgttctagaggaacttcccccagctcttagttcctttgagtatttagaaagtggagtccaaagatttgttagcatttgagatgttaatggcaggttaaaacaatctaggctgctggaagacaagagttttctatttaagttaacaagataattaagttctcaaataactaaaagtggctagaagtcaaatcagtataagatgatggcaagctggtagggcttctgaattcagttgagaacacaatcctcgttttttaacttggttttgaacacttcattgtcagcagtatttaaatattaaattttaaaaatagattcctaaaggagagtcataacgggcatcttcttaaaccagctactctttaaaatcaaaatgctgtcactgccaataaataagtgcagtgtctttttcttatgggtgagtcagttatttagtctgatttcaatcttctaagtaaccttgcgaaatattaaccacgctacacaggccccacccctgactgcaggcaagcagaaattcccttcagattgtgtgaatggagatagttccaatctacgttacatgatctatacacaatagtatgttttctgacatttattcctttgattcagaaattcttcctcaaaaccatgtattttgaattctagtttcaaatatgtctttgaaaatatccatggcaggtttgtgcataatttgcattttgcttatttaccttggttgaggtttttccttagtttattttttaatttttaggaaaaaattctcaggttttttcaatcctaaaaaaccaaatttaaggaaggatagtttctttgtagaaaggtgattaatgaaaaatccctgttcttgctattctgtcattgagctctttcaaacaagcgtcggaagaccaacagacttaaagataacttgttttcttacagtacttaagatcactcttgtttacttgcgggatgtggcttagagaatcccagttcatatttagataatatgaggaaaccaacgtgaatccagtgggcacaagtacaataaatgaaaacttaatttgctttttaactaaacttacaaatacatgtgttcctatgcaagatttatctaattcataaattgcaagaaaacaggctagcttccttgtacacttaaatctctgaggctcctcactcaacttttgttttagtggaccctgcaaatgaggtaactagaccattgatgaatccagaagagggaagcaattgcctaaaatgacatcactactgttagcacgctaaaagccatggccacctacggattttcccaaggaggactgaggtggtgagggctacttgcattaccaattgtattctatattttccaccttcaaatagtaaactaaattagtcacacaggctttcctgaaaaagcgtctgattgctaatgtgcctcccaaataagtaaaaacccttttaagaaaaatagacaaggttgtggattggcttttgaagtatggcttcatccttttttgctttcctcatggattacaagttcaatgtgaggggcagaaagcctaccattttattttttcaagatgtgtaaaggagaaccacatgcaagccttttgtgggggaacaaactataattctgtcaaactgatgaaacaagttatcaagtaatatcttagcttccttcaggaaagaatatgttggggctacattctgataggatatattcaaccataagccttaaaagcatgaatcctaaagggatatagaaaaaagcctcataggaatgccaatgacggactctcgaatcttcaggagttctgggagcatcaagaatatggagtccaaattctaccgctaagctgacagatgacaaagagtgtattacctcaatggctaaatatttaagcttcatggagtttggaagatagttgactgtaaatgagccaagaatacaaaaaaaaaactgcctgtgaaattatactgcagacataaaatctcaactgcctaagagctctggttcttctaaaagccgtggctgacagagcaaattaagcagtgagatgtttactatgtttaacagagataaactggcaaatgtagaagatgtaattacccagcatgtttttctaaaaatgaattttaactctgttctatgagggggcaaaaactgcagggcactgattttttttctgaaagtctcatgtgcttgggtaggatttttaaattattcagtaacttgataataaatggtcaaatattgaaaaaccaagagactttcactgaggaagcagaccaaaacgggggagcactttagcattttcagcatctctgaaaagatttctggttgaagaatattgtttgatctagcaagatatccagaggatttagcctacccagggacaacgcagtgcttcacatagagaaaattagccagttaaagctgacttgggactctatagtgaatgtcatacagatgacctcccaccacaaaaactaacctgtaccttactgtaaatcatatcatttatatttgtcttgcatgcaataggagataattactgactaaaatattcaaagatgtttacatggtgaaaccatcagcttgatttattaacctggatgcttttcttattaaatagcaacaataaatggagagttccaagccagcttcttggaagaagatactattactaaaaaacttgtttttctatgtagatattctaataagctaaaaacttctctaagccagcactggaataaatacaaagattattcacacatctaaaaatattacagtaacctgaaagataagtgaagacttctccccctaaggaatttcttgggcctgtcctaggagggctatctcctttgcaatatgttacgacaggaaatcgtccatttttgcttgtgtgtgtgtgtgacagttgtagaaaatatatactagcctaatagcggtagtgtttaaatgtctgaatcccctgttagactataaactcattcaggtctgggagtcctccttagaatagtgtctgacacattggaaatgttcaataaataattgttaaacgaatgaatgaaacaaaaggcaaatgtctagatacctatgttgtgattagaaaaagatttaaacaaatgccaaaggtactttttttcctaccaagaggtcatcatttgcatacataacattcatacacagttccaagtcagctttaaatggctggttcctctgtgtgagccactgctatggtccctggtggtagactcccacaagctgcctcctatatgcagattaagacctcagctgcttgatagttcacacagtcacctcacccaggcctcgcaggagaaaccttgggactgtgcaggagacctagggctgtgcaggaggagtttcacaaatgttttggcagcagggaaccagcagcagcagagatgaaatgactcgccactcttcggggcacaggatctagctatgtcaagcattcattttcactttattttgataaaatgtttttatggaccatgacaatgaacatggagcttggtaacaagagaaacgtaagttctgaaactcagctactcaactgatctggcctcagtttcctcctacataagatgagaataagaaggaaattgactatctaggattcgttgccaagtccaagtgagattgtggatgtgtaaacacttgtcaagccataaaacactctataatgtataaagttataaaggcatctttgtggtagaatgactgcaaatatggtaccaattatccttctaccactttttgcactgtgcctttgaagttcctactatcaacaggtgaagtctattcctcatctctgtaatctagcctggtcttggaatttgctttggttcatagaaaacagcagaagtaatcgtgtgctaaattctgacccaaggcctcaaggtaacttcctttgcaaatacatttgctctcggaacactaccactggcagaacaagcctggattagcctgattgggaagtagagatcatgcggaggagagtttagttgtcccagatgaggccatccttgtccacccttcagcagcaaacacagccaagatccagcagagctccctacctgacccatagctgatggcttgtctctcttacacttgccaagaccagtagatccatccagattcattaggaaagataggcttgattgtgtttaaaccactggagtttgggggtagtttatgtagcaataactcagcactagcctccaaccagagtccatgggggggacatgtcaaaggagaggggtaataagtagaaaatgtgtgggtcttgagaatcaatgacagctgtttcagcattacccctcagcttcctccatttccagggtgttggtggtagtcacaacttctggctcacctcgagactaaggctgagaacttctgatctcagtagaaagactgctcttaattcagagtgccatgtgaaccgctatacctctgctcccaaaatgtgattgaaaaaataagaaatggcctcctggaccttcatcaaatatctaagtatgctgtctcaatcaagagtcaaatactcagatctccttttaaatatagcctctgaaatcaacctacccagcctgacatttaaaaatcagctgataaaggcaggaagggattagttagcaaaagtgggaaagtgaatagatcagaggctagatcatcagaagcctataaaaagcataaatgcttaggacaattcgcatggaaagtgaaaagaattaaagacatgaaagggaaaccagttagtctctttatgagcaggtatatccttgctcacagaactctggctgtgtacagccttaaagctaatgtaatgctattagtaaatattgaggatgattacaggcccatggattagtggatttctgctttaagtttgctgtttattttctagggcacataacccccccacagagaatgagtaaacacagaaggacctagaattccaatcatccaaatagttcttgggattagtagatcagattcacaaaatcacaagaatttgaaggagttctacaactcctacaaatgtagtcccctcccctgtttaaacagttctagtccgtatcttctggatcccaagacttccctcttctcttaccagaatacactaatagcaaagctgctcagattatcagcagttcagcaaaatcaaaaggaatatctgagcttaagatgggtcagttacccagtaccaataaatgcagataacacttattgagcatgttaccatgtgctgagtaccatggtgtttattcattaatccaaatttgttttctcaattccatgagttaagtattaaactaattttatagacgaaacttctcaagatgcagcagcttgccccaaaagcttcatagctttcatagtttcctgcacagccaagagcaaaaccaaatctggatgataccaaactactctctccaaccatcaaacatcatgccttggctttactcaacattctttgcctttgtagtacattcctatctgccaagtactatccacatacagttgcatgcaccaagtatgtattcttagtgaacacctttgacagcttggtggagcactccactctctgaaagagcccctccttagctgatgagttttctctgggctattctttgcagcctccctccagctcttccttccgtcagatctccatttcctacactttgctccgtattgccttttatctttcccgtcttcccctcttctcaggaagaaccacaatgattgtgcttgagaactttagaatcagactggctctgagtaactgacaaaaaaacatgagatggtaactacctcatagagggtggttgagaggactctaaatgagatcatatatgtaatgggcttagcacagtataagataacatggtaaatgcttaaatataaatgtggaccttctacgaatatatcaacttggtggaagaagagagtaaaaactattcctggattcttatcactgagataaaggttttcatggtgactccattcaagaggactccattgtatttccataaagcaagtatttatttattgcctcataatgaagtactttcataaacagaatcctatgccatccttgccattaggcagcactttgtaaaagctggtacaagtgtcgcccttttgatagtcttccctgagcttccagtggaatatataggggatttgagtcaacatttgatctccttctaaagtcccttcctatattgcagaggcttacacatttccaaaactctcttgcagttagtctgatgtaatttaaagtgagccagccagacatacctgcacataatttcaaacttgagttaggtgggagaagagtcataatgattaaaaatccgttttttttccagtgcagatcacgatggagctggttggatttagtgctggcatctcgtaaggcaaatccacaattcgacaggcctctgcagattggagcagaagcagcagctccctgggcagcccagttctagggtaggacttagacatctgtctctttagctctcacaatgattatgtaaatctttaattatctataaatctttttcttccaaaattagccagagtatattctactccctgcacttgatttctaaacaatagctaagaggagctcttgcccttctttctgtacctccagtacttgttcctgctcataattcttgttacactggacattttattacagtaactcttagaaacatttatcttttcctcaagttgaaagcttgatggaaggtgctatgtcattttcacctttgatatttcccatagtgcttggcacaaagcatttgctgaattgaactgagacacgttcccacagtaacactgtggtaagctaaagcctaattttgaattgtcactaggttttattccacattttgtacattgctgaactatgcctaaacctgttttttaaaagtgaccatctttatttgtggtagattaggttcttcagaaatacgcatatgtatcctcactacttcacttccttagaagtaacatttccctgctcgactgccactgggtttgtgcatatggctggatttggctaactgtagcatagtctccaatatcttttaaggttgggcttagttatgagattcactatggccaagctaatgtcggcagatataacagactcacaaaatgctcttatgcaggtggacttgtgctctatgcctctgtcactcataagaacatgcctcagtaagttgaagaaagattcacggagccacagccactgccagccaagtccagcctaaattagctacctaatatctcctttttacctgcagattcatgagtgataaatgcttattgtctcatatcactaaagttttgtgattgtttcacagtattgtcaataagtcatgtttctagagaaataattctttcaaagaaaacttggatgtaccagaaagagaaggcataccctggtatgaagtttaatgcttccctgtaggacacttccttcctgcacaatcatcttcctcgaggttcatctccttcgtttccatagcaatacatattactcataccccagttacttactggcttgaccttacatctctttgtgccttatcaatagatgttcctcaatttttgcttctcttcattaagctttagtctcttttaaatatcattttcagggacttgtatcactctgtgaaactcctaaattctgtccaaccctgaacttgtcatagccaccaacttctagctaccaacagactgtgtctagctggcattcctcctaacatcttacataaaactctccaaaccacatccagcaatatttccttctgtttcctctttctcttaccatcttccaggccatctatacacaaaatctgttatcttcctctcaccataccagactccaaatttaataattactacgtatcttaagtgctctgacaaacattccaaaggatttaggctagtgaagcttctaatttgaaggaatactatttgaaatcattcttgtaaagcaatgagtggttttggttatgtgacttggccctgaattgattctctaatcttgggacttctccacatgtttttcttcaggtgggggcagggtgatgatgggcagcctgtggagcctcaaatatactgataaagatgtcaagcagtcatttggtagaaaggaaaggacatagggaaactggccattcctgcttcaactagaaaattaaaggctgatgtcctgtgctgttctaaaaaatcaatggctaataaatatttacctagactggcaaaacaaggattaaaatttaccatgcagaacacaacccacaaaacattttgcaactagtattgtatattttgaatggaaaaaagctatcgggtttcatataggcatttaatgaaggatctctgaagagaccctggacgtaaatctttatattgtatgctttatttactttaataaaattccagctttcctctaaatcaggctatatttctatcacattatatattgagagatgttctatcgtggatagcaatgagaattctgagtctccagggaagaagacagctagagcctctcagagctcctcaacaagctaagctaaaattgactcaatattggtgaattctagacacaaacaactaagttaaccaaatatatgtgggacttattgacaaaacaagtagccaagtcttcttccaggcacccagtgtcggtggcgcacacacattttcgcagtcaattaactacagaacctgggggatagatatgtttatttttactgcatggtatattttagctcctatactagccaaatttttagtgcaaagaattattgagtaagcttccttccctgaatctgaagctgatctttgttctgtgtccaggaagtctgagtctaaaccaaactttatccaattgaaactatcaatcctcatcagtctgtagtaactttttaaaaaaggaatgagatttttttagacatatccatttgtgtgtgagggaagtagacaaagtaacatcattagaccagtaagtaaaaaatctggaacactttttctaccttatcactagagcatcccctccacctagtagctctaccaattagattcaaacctatggtcaatattttgaatggcaatcttgaaacagcacaacacaaatgctgcatttcacaggatatataatatgaagtttatatgcatgtgtatatgtattatatgtatataatatctggggccgtgggagtgagaatctaatagagtatctgaaaccaaggcacaaaagagccgagacagtgagtacaggtcttgcaatgtgacgtgggtaggtgagaggtctggatgcaggagacagtctacatcaccaaatatcttgactgccctgcttaggaacccatgttttatagagaaggcagcaggaaagtctttacatagtggaatttgaaggagtcaatggctgtttatgcaaggcctctaacagtgaagagaagaggggcttggggtagtgacgatgctaggagtaagtgaattatgttgagaaggttcatggcagtaatctaggtgagaaaagagaagtgaggacatatgctttaaaaggcttccttttctacctggtagttcaatatataagggtccttcgaagactgaagttttcatgcgatttttgaattgtcaagcatgaaaaaatacacaaagcatatctgaactcatgtacttcaacaaacaacttcaaagtcagattagaaacttaacatttttataataaacttttaacttttgtgggcaccatagtaggtgtatataattctgggggtacataagatgttttgatacaggcatgcactgaaataagcacatcatgaaaaatgaggtatacattccctcaagcatttatctattgagttgcaaatgtcccaaccacactttttaagttatttaaaaatgtagttattgaatagtcactctattgtgcagtcataataggtctccttcattctttttattttggatccattaaccatgcccacctcccagacccccactatccttcccactctctggtaactatctttctagtctcaattgtttttgatttttagatcccacagataactgaaaacatgtgatgttagtctttcttttccttgctttatttcacttaacattacaatctccagttcatccatgtttcaaatgactggatctcattcttttatggttgactagtattccattgtgtatatgtaccatactttatctgtagatggacacttaggttgctcccaaatcttagctattgtaaacagtgtgctacaacaaacatgggagtgcagttatctcttccatatactgatatcattttaggttgacaattaaaaatctagcaccataaataggtaaagtcatgtgtcaagtagaactctgtatgtgtatttatacatatacatactcctcagcttacaatggggttacatacccatgatcccatcataaattgaaagtattggccaggaacagtggctcacgcctgtaatcccagcactttgggagtccgaggctggtggatcacaaggtcaggagattgagaccatcctggctaacacggtgaaaccccctgtcgctactaaaaataacacaaaaaattaaccaagtatagtggccggcgcctgtagtcccagctacttgggaggatgaggcaggagaatggctgaacccgggaggtggaacttgcagtgaaccgagatcatgccacctcactccagcctgggcgacagagcaagactccgtctcggcggcggggggtgggggtgggggggaatattgtaagtcaaaactattacacctaacctaccaaatatcaccacttagccaaatctaccttaaatatgctcagacttagatgattttgcccaactatagtctaagaggaagcctattttataatagtgttgcgtatctcagaatttattgaataccatacgttacatcaaaattgcaacagtttctcacattgtaaagttgaaaaatccttaggtctaagcattgtaagtcttaaagaccatatctttatctatctctccatctatagagatatagataacataatccttagtcagcttttgaccagaaaattctaaatgtgaagatatcagaaaatatcaccttaaaatgatataatttggttatccatatttgaaaaatgattttataaattctcttgataataaaaaggaaaaaatcttcccattgacttttttcttaacaaagaataaaatacataaaatatttctactaaacaaacctcaaatctctaaatgaggatacaggatttaaaatactccgtaatttggtcagaatagcatagaaagttttaacattcataaaaatgcaaatgtacattatatatacttatgtttattaaatatattaacgctttactgaagtgattttatacttaaagtttttcaaaacttagttcttaagtaactgaggacatgaagaaaaattctcttaagagatttttagatccgagtcattttccctactcaaatttgtaagaagatacacagtagaaactaatttctaagacatgatctgatagattctggtgtgtagactctaagagaaaccatgcaaaatttgttagattacacttaaaacataattctcttgagttatgtaactcataagaaaagcgaaactacaagactccagtgcattataaactgaatcaaactgagctttttttcctgtaaaaatggaagtagagccaagtgtagttacattttctttccaactctttcgtactacttggtcccttgttatttttctaagccccttgctgagcattttattagaggaaatcactcgagaagcatgtcccaagcaccaagaacagtggaacacaatagatgctcaataaatatattgtttgagtaggcaagttcccatgtgaattctctgatcatcttacacttaagaattgttaactcacatgatagacatgattagtaccaaactaaactgccacagtattctagtccacctcggtatacttcagtgtcggctcaccccaggttgtactgacaatctccattcggaattaggcaagtgatattacagttgactaaagcaagctctgctgtggcactgccaacatttgaattatccctacctacccctaaaacagtgaggcactaccatttctagaacatcctgcaaagaggggggacattttcataagaaacagcataatccaaggacagattgcaggaaaagtctgacaatgcaggtttagccatctgtagtcacaactgcaaattgactttttccttccgaactgatgatttgaccagcagaaccaaaactaaatagcaacttacaacactaactgctagatttacgcaagacagaggtagttccctcaaaggcaacattagaagagccatcaaaatgttcatctcccctaacatgtcttccttaagctgtccttatcccgaattccccacatggatcaccactcataagaagtggtggctctcggctcttcctgcacatcaaaagccagataaaaatatgatcctaggtttttactgcagaccaactcacactttcaggatgagtagtcatattctgtaaaactacaggtgggataatggacaaagaacaaaccatgatgtcttcaggaagccacaataagcatataagttgcccaaatgaagttcatgccttattttgctgaatgaatcaataaattattttctatgcatctactatgtgataacattgtgaaaacatacaaggacaatcaaccccattattaaacattcagtaccagggcttgcttcatgggtgtgcaacctgtgcagctgaacaaggccctgccctcagaagggcatgcttggtttaatgctcagctgtcagcatcttaaaactctgggtaattttgaaacaaggagccccacatttttattttgcatgagtttttgtactagccaggcttggaagggttgaaactcaaatatgaccctaatgtgacacattgtccccaccttcatctcccctgcaatctactgtatcataggggaattgtaatgcatcatccctatgcttaaaattcatcagccattttctcctatgcattgcataatttgtctgtttctctcgcctctagcttgacataatctttcccaactcccctcccaaatattgctttattatcgtaactggcaagacgggaagaaaatgtgtcataagagtatatgaaaaggggtactcatgctcaggtgccaggaaataagtcttgggaaagctgagaggctgaccttctaattttaaattggagtcagacataaaaattgactgtattggttaaatgatattggttaaaagttataaatggcttacaaaagactgcatcattccccattcagaggaagaaacaagtatatatctgaggcctccaggaggaaattgaacatggggcaccaagaatgaagaggtggtagaatataggcacaaggcatcagggatgaaagcagagagaaaatactaggaggtaggaatgctaaattcactctcattaaccctgagcatcagggatgtcttgaagatgtgcaaccagcacagtcacacaagctcctgagctgacaaggggccccatgcttggtaatgctctactgtggccatcttgaaatttttagtagtttctggaaaaggaaccccacatttacttcacatcaggctctgcaaattatgtagcctgtcccacttagcactatgtgaagtggtttacatgtactatcctatttagtccctgaaaatccataacatatcattactgtgattttttttctcttaatgaggaaacaggtatggagtggtaatgtactgtaccaaaaggcacaccacaaagatgaagccagaactttcatccaggtttttctgactgccaagccagtgtgtttttgatgacagtgataggctggctttccaagtaaagacaggagagagcaggtggctcagtcagctagactgcaggggacataaataggattagcagaggacaaggtaagaaggttgagtaaatcagatcactgtagtccctgaatgatcatagactttcctatgggacaaggggggaaacatgagtgacatattgagagttggactttaggaagtctattattgtgatagtgttaaggtattttgttaagcaaacaaaaaggcatggagaagatatctggggctcatatagtccttcaaatatgaggtaacaggatgaataataatgaaagctaatgtttatcaagcatttactctgtgccaggcactattctaagcactttggtataatgcttaaatactgtaatccccatcaaagttctgtgaggtgcaggtagtttttaaatatcctcctgttattgatggaaaaaatgaaaaggaaagcaagtttcagtaacttgttcatggtcatgcagccagtgagtggcagaggcattatttacttcagaatcagtgatttaatcttcaataagaatatttaaaagatgccctttttaacttaaagagttctaaaacatataaaaatgaaaaatattaaagaatgctattttacaaaagatccaggaggatagagtattagcagatttgagaacctatcgtaaaggaaagccatttaaatcctttggttcttggcacaaaaacagaaacgcagatcaatagaacagattggaaaactgaaatagtttttaaaattgtaacataagaccccataataaagtgttaggaggaattaattagaaaaacttgataatactttgaggaaatgatcaggttagattcatactttgcatgatacactaaaataacttctacatggattaaggatttaaatacaaaaaattgaatgacagtaaagccagcaggagatggaatagaatatcaggtttataagaaaacagtaacttcagctttgaagcagtggaataaattatgaaggaaaagattgacagatttgaatacataaaaaatttaaaacttgctgttttttcatcgtacagaagactaaatacaaaggatattattactgaaggccatatttgcattccatgctacaaagacagctttaaaacccaaaccatgttacccttattcaaatttataaggaaaaacatcagatctcaaaatataaatacttaaaatatgaaaaaaatgaatacactgacaatcagtaaagagaaattgttcagcctaccaacaattaataaatatgtgcaaaataaacttgagataggattttttaccttctaaataactccccataccccccccccccttatccttataacacccaatgttagttagattgaagcttgtgtactcattccttactgctggcattgcaaatgtatacagacttcttaaaaattagtaatacaaagctaatcaggctcaaagctgcatgagttttttcaggcagcaattacattttgagcactttatcgtctggaaataatagcaaaagcagatgtgagcaaaagatgttcatctgttattgtttacaatagcaaaaccctggaaacctaaatgccccaaattgagaatggttttataaattatgagaagggactacttgttatagagggcaagccatttgaagatttttattttcaggagtttggtccaaagggatgaggaaagagacagtgaagtagcttgaggggaaaacattaaggaaaaattgtcatttatttcattgaagccttggacatatttatcaattgagggggaacaagatattagaggaaataagaatgaaattttgagaaggagaagagggggagagagaaggggtggggagggggaggagaggcggagaaggaagagtggcgagactggaggtgcaaagacctctgaggcacaaagaagcctcaaaggcaaatgtggaaaagtttgctttggagaagggatgtgacttcctctgagataaagatgaagaaagaaacatttgaagtgaagagaaggaacaatttgatctctgagaatttgacttaggtgagtctttcttggtctggcagaaccggataccctgacacctgtgatgctgtaactctataacattttcacagcatttgttcactccgcatttagtgtgtcattttccagctgtgaacgaaaacatgagcaaaagtgccaccagggggcaggctgggcactggcaaaagcacttcaaagagaccatggaaaaagtcttttcctttcagcccaggggtctattctttgtttttgcaacaacaaactgcatcaagtccagagcattttccttaatggttgtgttgtgggtatggattttgctccatgaactcaagtgtgcaagaaatgtcacagtactgtactttattttctctaaataaaattaaattcaactgcaagccaccatcctaggcaaggctgaaagtcactcagtcattattacagctcccacagccccaaagcattctgtagagatgaggatcttattcagtgctcgtatttaggtcatcggtccatccagcgactagtgaaatacttatgacctgaaccaacatgatgtcttggtacatggtgacagtgctgtatccttatctgttaggataggggcagaagttccaatgtctggaacgtatgcacacacgcacacacacacacccagatacctccttaggttacgcaaagagggaagctgaggatgattcctatctgtagaaattgtctcctgtaccctcttctggcttgagggaaattcctcctgcttcccccctgtgcctgcctctttgtctcctctatggtctaatcatgggccagcttaggctacaaagaacatctaggaagatagacatcttcagaacacacaaacttcaggagaggcattgaagcccagaggccccatctagttcttggaatccggaaaggagaaaacacaagatcaaaatgcacccacacccatatgtctaaactgtgttgccacatttgccacaaggtcaccgtccttaaaacacccactacttgacagatctgacagtatgagaccgttatcttctagtagatgagagagctcaagcatccctcagtcgatagtgggccaatcccagaactgctgccatggaggagcaaagatgaagggacaaactctcatctcaaggagcttccagtgacacacaggtaatcaaggactgacgaatttaggtaagatattacacatttctaaatcacttaccaatattgaaaacattaaaaacaaagggttcacgtaatcatctgtgtattatctagcttctcttaaaaataagacccggcaaccctggcctgcattcctgcatggcagtcatgattaggagctgagtagaggttgttccctttagctgggaccaatatacttcagtgtatcacagtccccatcactccctactatgttatgctcaggctcctctcatttatgctacttgtctagcttctatacgtacttgggtttgcaactcgactgagtaaaccaaataaaatcagagacacagtggtaagtggcctataagcattaattaagcttctgcctttcctcgatgttcactctgatatacttgggaattcagaattatttcacgtagaccttacacgaacagacgctaaagaaacagacttaaatgataaacttggctcatgtgcaaatgttacacagaaagccagtggcactccgtacagagaatagtatactcatgcctcatgtatgtgtgcagaacaatagatgttcatgaaatgcagatttagctgtgttccttggcctcatctcccatgactgtcatcgagggtgcccagtggatcagtaggtcacaagtgaacaagtgtttactgttagctgtgggtggccactcccacaaaaattcctgagaactggtctcatcctaacctcaggcccatgagctcagagaactggtctcatcctgacctcaggcccgtgagctcagcctcagcctgcagaaatgccagcttcattctttattttaattttcaagagataggctaaactcagaacttatgccacaataaattagaacaatccaacagaaacaagagaagagaggctgttaagctcaaggaaagaaaaaaaaatttataatgaggacatctgtacttatctggcttttctggagagttcaagttactatccacaaaacacatctatgaaaatgtttagaccacaaaacaatatattaatcagcaaataagcaaagtaataacaaattttatgcgttgaaagatgctattaaatacaaaggaaaactcatcatgaacttcccgttaaacatgcgcatacaacaagaattttattggaactttttgttggttggaattgtataaatccagtggagtatatttagaaagacaataattaactagaaaagagattgagcataaaagcgagaaaagcactgagtattccctgcccttcagctgaaggaacactccagcttcttcagctgattgctgaagctggccataattatcagaagtacctaagtggcttcttgacccttagttgcagaatggcataagaacaaaactgataaccattagaatgcatgacaaattgtacataatatctctacctgacagaatacttaaaacaacattttatcttaggttttaatggtttggggaaagagcatacggtatctacaaaattcaggacattcattagttaagcattcttgaaatctacaatgccagccactatccaagtaaggggagcctcttaagtcacatttagagctattttctttaaaaggcactttgatattagactctttaaacataaattttaaagtacagcttgaaagcgagtgataactactaggaaacaggatttttgaaggatatactataaattctgtagcataaggtttaaaaaagaacctcatctttgaacattttttaaagtgctgcacctttaaagacacaggtgcttttagttcacagtccaaaaatgagtgactgaatatactaatgtcaaagacaatgacaaaatcagagttctgaaaaatacacagctttcaattaatttgtgaacatgtgtgcatgtgtgtatgcatatctacaagtccctaagagatcaggagacgttatacacaggattgctgttatttctagccgctcctaagtccagatattagacatgcaaaaagacattcaggaaataaatggggcaaggaaagagatactgaagccctccctaaaatccaaagcagcagcctgtgtagatgtcttcactgtgaggtttccacggaagcacatcaccctactcagattatgcagtctcatcttcaagtgccgttaatcagaaacctgccagggagaatactaaactctttctaaagatatctggaatatcatcaagttttatcaccaaacaataaaacaaacccgtcaagtagattttaagatttatttctcctctactattaaggagaaaggagcctgttataaatgactaacattagtcacaaatctgcaggtcagcaaatggaaaaaattgaaataaccatacatgaatacgaaaagacagcttgttaattacttttaagaacgtaaattgtgttggcatagtgtacttatttatgaaatattgacaaaataagaaatattctacatcagaatactgagtaatgatggggcaaaacaaactagtggaattttcaattacattctctggggtctaacatttcccatcttatctttgcattctatcctcaactttctcatcctcaatatctgaccactataaggcagcttcagaagaagcaaagatacaaacttatttcaggaagttactttagaaagcaaagtgtatagggctgggtgcggtggctcatgtctgtaatccaagcactttggggggctgaggtgggtgaatcatgaggtcaggagtttgagaccagcctggccaacatggtgaaaccccatctctactaaaaatacaaaacattatcagggcatagtggtgagcagctgtaatcccagcaacttgggaggctgaggcaggagaatcggttgaacccaggaggtggaggttgcagtgagccaagattgtgccactgcactccagcccaggtgacagagtgagactctgtcttaacaaaacaaaagcgaagtgtaactctaccacaatgcccgaagctttcagggaaacctaggaagcctattgaagatcactaggaaccaccactagcaatgcgtctaaacttaaaaccaatgcagatactgtgtgttaggaaggaggggagagatagggaggaatgacatattggacacaatacctgggaacacatcatgagaaaatagtttgcaaactaattaattattgtataatcatgatccttagagtggtacaataagaaaagattaaaacattttaatatttaaaaccttaaaattcatccttataaaaactttgttgttaaatctacatgctatatttctaaggtaatacatgtagataatttttaaatggtaaaaacgtaccatattgggattaatgcttatttttttctggcccttgggggaatacatggttaaaacctggataactttttgtctagataaagcactcaaggaaatctggcttcattggatcaattactccactaaggtatctttttaatgttatcttattttcacaaacatacattatagaaaattttcaaattgcagagaaatataaaagaaatcgcctgcaactttatctctaaaaatattttggcacctcttatgcacccttaaaacatagtattttacatgtacttaagtatacttaagcataaaatttcgatattaatatactacagtggctgttttaaacccctttttaatatgaattattttgaaacacaatcttgtctggacactacaaatttgtttataagttatgtactaaaatttagccagctctttatagttgaatagtttcttctgaaatatttgctattttaaaataatgcctatgaatgtcttagtagcttctcctccatatttctataacttaatacatttttagaaaaggaattgctgaaagataagatatttgatatgttttataatgttgcttttcagaaaaatggtacaaaatttacccatgaatagcttacaggaatctcctgacgctcaccaacagtagacatcaacattaaaaactacagtgatttgtcaatttgattagtgaaagatatccagtacccaatttccagtgtttcctaactcctctggcccaatttactcagacatggagagctttggatgccaaagagacaagattcgattggtaagatatggtaagattttatcctgtgagacagtggttctcaaggaaatggtacaacattcctagggaatacctaggaaatttgggtaaatgtttcagattttcatgattttgagagggttgctactggcatttagtaggtggaaaccagaggtgtcagctgccctgcactgtgtagagcaatcttgagtgacattgaactgtgtcccatgttttacacaactttcaaatgtcctagtagaaatgtatgaggtaagaagcttggttataattattcaagcgcagaacctaactgtttaacataccaatgccaaatattttgtggccatttttaatagttttctactaccatgtaaagcaagggaaaaatgatttcttcagagtattcgcaaaagttcataatttttgaaaagtatatcattaataccacactgttgctgttttcatcactaacatcacctacttataatagtctgcattcatagactacattcactgtgtttctaagagtatatgcaagaatcttatcacttccttatgtattccaatactgtcatgctcaagtatttatataataaaacttttcttataaactttctctttcatattgtatataaagtcttatgttgccttttacaaaactgtatagggaggtcatgtatttcattggtttcattttaggagagtaaagggtatattattctcctaaatattatatttactataaatagtggtcattgactctgaccgggttgagaactgttgctatatgggactagggaacaggaagcaagtcagagacttccagcagaagagtgacatgaagaagcagagacggaggtaaagaggggcttgacggtaaagaaaataaactggaaaaggagatggcaggaggcagagagaccagaaaagagacaaatacaatctaggtagggaagtaatgaagacctaagatatcataatgagtgagagtcagaggaggattttacggagggcgtcttgaaaaagtgaagtcgttggaactcaggcatccagtatcacagtgtcattgcattgttaggctacagtgattgtgttctcaaatagtctcacgtacgtgcacatacttgcaagcatacatatgcgctcatacccttcaactctccagattcattaccaaataatccctctccccttctgccgccaaatggaagatttatcgcaccagcgattctgaaatgtgacagctcaacctgacgttagtctgaatcagaggggcaaagccttatttgatttgtgattctctatccaagataaaccctgaaataaatttcaagtgtgctttaagtacactacaggttataaatcatatacttgtattctcattctacagtaagcataaaacctcataaactatgtgatatataatctcccttcccccttgccaaattcatgcacacttcctgacttgcagggagagaatgataggaaattaagaaactcagaaccagtgataatttgtctgcagcatgcattttttctattcagtagcaactataacaaatgaagttgttactagatcaggcaaggggaaaccatggttgtaaatggcagaaaagcatttccaaaattaagggatggagagtccaagatggctgacagtaaaaaaaataaactggatatttactgtatgatcatccattttggcaaatattggggataagagaatgtcccaattcctgttcaattcccaattaagataaaaagtgcactacaggctgggtgcggtggctcacgcctgtaatcccaacaatttgggaggccgaggcaggtggatcacctgaggtcaaagcctggccaacatggtgaaaccccatctcgacaaaaatacaaaaattcagctaagcatgatggtgggtgcctgtgatcacagctactcgggagactagggatgtgggaatcgcttgaacccgagaggcggaggttgcagtgagcagagatcgtgccattgcaccccagcctgggcgacagcaagactccgtcttggaaaaaaaaaatgcattatattctgtatttgagattagcttatatatccatactcaatttcaatttctctaaaaacaaacatgagtctgtctagttattctaatccctgtcagtccaacagtactgagttagacacaaatatcacattcttcattgtttttcgtaaacaatttctagcttagtgagaaaaatggtgaccctatctttctcaacttgtaatttctttctctaccctactaaaaaatgtcagccacatcccatcatagtgaaaaaatgttcctctaaacttcaccactaaattctcacattgtccagttcctgtttctctttatgggttacttaacatctgaaatgtattcttaagcactttgctattttgtgtgtgacaaatacaagacaaatccccaaagtctatgctacctgcctgaaatggataagggcacagatataacaccatccatctctccacatctttgctccctgagagggtttgataagaggtgtattctgtattggtcatctattatgttacaggttaggaggtttgagccatgaataaacagaaaatgacctgaagctaaaaggacacgctgccaagtgaggcaatcagtgaccatgacttaaaggctatgttctgccctcttccttctagttagactggggcaaaaatcccaagctttctgccgtggaaggcaaggctcccatgaccctccctctgcctgttactcttctcacctcccatcactgcttctttgcacccctgtggtctttgaatcacattctcccctcttgagcctctgagttctcatgctgtgattcttcctggaatctgcttctttaaaattgtcccctgactgacatctgcttattgttaaaaactcagctctagtatcacacattggggtagataccctttctctctactttcactgcaaacagttaatctccattcaggtacttcttggttaccttgtgattgtctctttactcattgtctctaggaatattgagtttctcaagggcagagacacgtccttttgatgtttgtatttccagtgcatagtatagtggacactcagcaaatgtttgttgcttacctgagtagggagtcttttgttttttgtcttctaaggggaaaataggctatggacaatgaaaattgcttttaaaaaaaaaacgttttccccctgagggtaaggagaggggtttgcaagtcagagcttttactaaccagggtcataaagtcagctgtgctgacttgatcccactcaagaggtagggaattgcctgattttaatggtgctagcccataagaacttggactctacatgtcatggccacataatccccagtgaaactcccatgggttcactttcagtatgcattatgttcatgcatccagaaagtgggatcaagtagtgttactcacgagactccatagtgcttggaaatctggattagaggcaggattataactggcagggccatgctaggcgaggagtagatgagacacaagcagtccctggagcctggggcctctcctcacacggtatcatcagccccaacagctgtgtgtgaagacacttccaagcacattttgttcgatgatcagctgaaacccactgcttagcatctcttttcttttatgtaatccccttgggtgtaagacatagggcctttgttgaagacagtctcacgcttacaaaaagtatcagatttagacttctaacattatttccaagtaaggtggtacaacagtcagagatgcagtagcagagttgaaataaatagtcattcatcacacaactttaaccttgtgtcccatgaccagatgtcacttcctgaagtacactgtgagccagaacttctaccttacagacaacctaattgttttgggtgtgtgtcaaccatgttaatttgttaaatgtaaacaatgtctacaactgtttggcctgtcattactttttaacaaactagaagacacttctctagataattctgtgcttgctaggccctcttatttataggatcaacagataatgtacactgaatctacttcatcaaaaagaaaaataccatttacttattacttaccaaattaagttttgcccagaactcgggtccttcttccatctctctgaggctcggtggaatgtaccaaaagcaaatattggcatattcaggctgagaattagaaaaaatataaagttgttatcttaagatttatcttagaatgcaatgaaatacttttaaaactcttagctagtttcttcaagagttatcatgtgtataaaattttaacatcagaatcttatagagtaacaatcccttctgccttcttgataacatcctatttaaaaattttctactccatagcgtgcacctagcaggttctctttcatcttaaatgtgcaaagatcaggaaaaaacagtaaagtttgaagctgactcaacccagctctgatcgtcagttagtgcctgcttacatacatgctcagagatgccctggatcctctctctccaacactgatccttaagttatttgctataccatcataggcttccaataattcttcttaaggcagccaaagttggcccctacacctggcaaatgcaaaagctttgattacctgtgagatgataacagcgtgacctgcttgggcttcactaaccagcactactatgaccctagccaatactgcttttgaaaaaagaacatcaccttgactcccggctctcgaatatcagtaaaagtgcgaattagctaggggacctattcaaaatgtagattctcataggaactcaggttcctatgttcaaaatgtccaatgtctaagtccatcctagaaaaggctaaagaattggcattttatgaagcatgtcaagtgattctgaagcgggcagtttatgttctatcagaaactctcatctacactaagtaatcataacccagttatcttccctgccagtctgtttttctatcagacatgacttgcttaaacatgggactgtattgtaacaggctttagcccagcctttgtcacgcagacaaggctttgtcctcactggacaaaaacataggaaatgcgatgactactcaatgactaggagatctgggacattatgttgggggttcacaaattagacatatagaattgtattcaggaaagattgtgtcatatgcatcttcctcatttgatgcttcacactgacaatatttgaactgattttcattttctgccataaacagtttgtaataaccaatgttgcaacagttctcaataactgtcagaattatgctccagtatataaagtttcaaagcatttcatcaagaggaaagacccatcatctcatatcttaataaaaagtagtttaaaatgaaacactgtaattcaactcaattttcacaaacatctattgagactacagtcattcttacaaatctacacaatttatacctggatctctgaagtattgaaagtaatggcaaaaaccacaatgacttttgcagcaacctaatataatagatttatctaggatagactgtactgaactcccaaattctttgagcatttaatgtgaacacatttttcaaatgaagtaactatacctgactagaaagtagaagaaaaatatagtaattatctgtcactagattgtgttatgtcagttatcaatttattgcctctcagccagaaatctaccctttttgagtgtcctaaaataatgtaggtggactctgcagatatttctcccatgacatgtggtccaatcttagactttgtcagcagagggtgctggagagacactggagaaggaaggaatgctttcctggtgtggtgtgctcactttcatgggtctcctacagaatctgtggttcatttcagcagtactggtgaccagaaacataagtacacccccacccatctaccccagtagcttcccccagtacacccctttcaggtggcatcacgtggcatcacagcagacaggcagcaagtggagagcccataaatggcttttcctggcatactcccctcaggtggtttcaaaggagagagatgccagctaggcaccttgccttggatgacttctctggcactccttctaggtagcttgcagtgatttccaagttgtggcatggcccctgtagatggcttccctcagctcagcactccagactagatttctagtgagtaccaccaatgtaacatctcagtaaacttttctgctatcccatgagccaaggtcatactctctctgaagaggtctagacctcagtcctgggaagggatggactctcccttgggcgctctatctcagtgccaggtgtggtggctgctctctatatcagctactcctgttcatttttaggtttttcattctctatgaggcaatcctccattactccaatcccttgctaataattattgatattacactttcccactttaccatgcagttcttgtcttctgagtggactctaatatgtcaccaaatttgttattccctttcatttgcataggaacattacaaaacagtttacgatgttttatctattatgggttctatattttacaagttaggacttagatctgattccttttgcccaaacagaaacttactaaaaaatgcaaaaggtctatcactaagcacttttagaatggaatggcttcagtgctacaacatttgaaagcttataaagcccttctgacacttcacttcattggaagaaatttgatgtttcatttggaatatctttgctttggtcatttccaaaattaagagttgaaaaagtctttgaatttttgcaaaaatatatttgactttttcctgtctctgcctctgtagcttgtattttacataattcttaaagagacttcaaagcactaatgagtattttcagagtaaatcatttgtataccccttaattttaattgcctacatatgtgaaagtctgacttcttgggtgtcctgagaacacatttagtctatgttctaaaatccacaaaattaggaaggtatttacaggagtccaagtatctagtgaagggtacaaaaactctggagcagcaagtgcattgtcataatctttaaaaaattcatgataaaggagtaatgtgccattaaagaatgaatacattctataccggttttcaaacaaaaaacattctaaagttctttatcaatttcaggaagaattatttagcaaattttgagaccatttgggaaagaaattagtggtcactaaggtagcagctcacgttctctaaaactgagttatgtcaaaagaaattcatctcctttgctttacaatgtcattagatcagaataataggtaacaaaagctaaagctagcactattctgttttaataaatgtaaatgcagaatccagcacacagattcaaacaatcatgcaaatatagagtgaaggaaaagctggaatggtgaattttaattgacttcaagcttataggtgttaagattagactattgaaaaatttcaaaggcagcactggatagcaaaaaagcctaagttttggagttgcaaggatgtggctttgaatttcaacttcatcagatctttgggatgagtatcaaactttctgtttctgcttcctaaactataaaatgtagatgatgtctgccccacagggttggtttgatgattaaagagaaaacgtgttttcaaaatttagtaccgtgtctggcacacagcaagcactggtcagttagtgactattatttggggccataatggcaaaaagagatgtcttttaaagtggatgagtagctccattaaaatgtgcactagtgaggtacatcactatgttaatttcttggtactatatttgaagggaaacattaagaaataatgtccagcgaggggtaaccaagctgttcaaattaataagcaaagctttctatgttatagatattgactaggcatcaggacaagaaaatgacactttctgaacttggaatgaatagaggacagggtgtactgaagagaggtgaagctagaaacgaagatgggagtcatgtcatgaaggacttctcgtatgatgtacttggaagcttgggcttgattctagaggaacatggagtcactggagagtttcactataggaaatagatctcatctttgaaaagctgctctagcagcagtgtggcagttaggctggagggatctaagactggaagtgggacacaagttagcagacagtacctagatagtaccaacctgaagagtgatgagatcttgaactaaggcagtggctttgggagtggagaagactaagcattcaagatatacttagcggggaagaaaaggagatagtaaaaacatcaagatttttggttagtggatcatagttctaatgaccaaaagaagaaagtagaattttggtaaggaaaatactacacttaagtttttagaaatgttgaatttgaggtgtctgtggcatctaggtgaaaatttcaggaaatattcatatacaaaggcctggagtttaggagctaagttgaggatgaagacatacaaagaggctattgataacaaagttctgaatgtgaagacatttcagggagactgtggccaaagacaaagtgttagaagaatatttaagggagtgccctgatgaaaagtcccttacatggagactgaaaagaacaagtcacatggaaaagagaaattgggaaaggaaatcaaagaaactaagacaggggagactatcaagagatggagtgatgaatgggtaacatacaatgctacagaatttcagcaagatgaagattaaaataatgtgctttggatttagcaattaggaggtagttatatagttttattagattacaagataacaatgtaagaaaaatcacaatgtgcttgatacatattagtaggttcactattagaacatgaataattagagctatctggaagaggaatgaactagtgaattctctgcaaataggaagtattcaatcacaggttgaccacctgttaacagatacattaagacaggtttgctgcattgtgcaggaagttgactatatgtcctcgaagatcttctataactcagttgatgaaacattaataactcctcctagtgtagaccttgagaaaagaaaaagttgaataattaggactctcccaagagataaaaaataaaatatgtgaattgacagtgtaagaatgaatatacctctaggaaaacatctattagatcttagatccaacacagaaaaatagagatgattttcaggggcctatgaataattcagaattcacttaaaataatacatttcttgaagatgattgaaagttatttttattctttccaggaaaaaatactcaagtactgggtattgtcttgttatgttcacttacaatttccaatgttccactttctccttgctgttagacaacagtgacacatactctctcaaatacatgtacatatacatatatagacatacaaatgcatataagcaaaaagactatcaactttatatgtgacattcagggtctaattctgctttattctcagtgtaataaaaagaaaagcggcaaatgcagatcacatacaaaaatccttacaccaggaattctggaaaaccatttagaaaaccacctgcactgcttgtgggccagctggctcccacagatgaaaaaatccaggggcagaaggctgactaaaatcccaccttagctttcattgcaaggacatgagtgtttgcaatttcctaatgacgatggtaagtggtttttcttttctaagactttaggaagaatatataaagaactttttaatcggcccatcttttttctcatcacttccagctctgtcaaaagactgtacagtttcaaggtgtataggacttttcataagcactatagctcccaacaccagagaaaataacacaactcaaattgagaaaatagaggaaactcaaacccgagaaaatataaagtgatcaaactcaattcaaataggactgctgtttctcccatacatgcttagctatccaccactaaaaactatagacattttcttacatgtttataatgccattatgcctcacaaaattgacaattccttgacaccatctaatagccagttcatattcaaaactccccaactgttacaagaattactttttacagttggcttgttcaaactgggatttcaacaaggtccatatgccttatttggttatgcctcttcggtctctttgaacctaaagagattatcactactccctctgttttcctcacatcaccggcctgttgaaagaaaccaggttgttctgcagaacttctcgcactctaaatttgttgtctttatagtactaccagaaagttgtttaatttttaatcattttggtatgcatgcaagatcttccatatgtctagctttctagcactttggaagcttagaactttctagtctgatgcttcctttgtagatactaggggaatccatgctctagattctctggaaagtatttcccaaacttccctgaggactattgtcatatttcactttggctactaaaaacagtttccaagtttgtcttgcttatttttctcttgtcctcttcactattgctttttcaacattcctctcttctcatgacatcaagaataatcttttaacatgcaagtcagactcctgtcttcttaaaacatctccagtgactacattcgggatacaggctaaaggcctcaccttgacttacctgaccaccacctgctctggtctctgcccacctctgcaattccatcacctgctgcacactccccttcattcaatacaactttttttggctgctcaaagacagaactctcttcagctttaagccttgcagttgtttaccaattctgccagaatatctgtccctcaaacatccgcatggcttgctgtttatctttattcaggtctcagctcaaagataaccttaaaatcccctacccagattactcaaaccaaataagccgtccccatttcagcattctacacttttccccccagtacagtactatatctataacctgtctaattatttgtatactagattatctcatgaacatgttttattgttttaagactacctgatttccctgttaattaatttgcttaattagtgcctttcagtttccacttgaatgtaaacatgaaattgggggaccttttctgttttctatctcctgtgcctagaaccatgcatgacatagtaattgttcaatgcatcttattgaataaataccaaaaaagctagatttctttttctttttttttttttccccccgagacagagtttcactcttgttgcccaggctggagtgcaatggcgcgatagctcaccgcaaccaccgcctcccaggtttaagcaattctcctgcctcagcctcccgagtagctgggattacaagcatgagccaccacgctcgactaatttttgtatttttagtagagacagggtttcaccatgttaggctggtctcgaactcctcaccttgtgatgcctgccttggcctctcaaagtgctggaattacaggcgtgagccactgtgcctagccagctacatttcttatgtatagcacaggttccaagactggaatctctaggttatttttacattaggttaaaaactgctataatacatatactataacaaaatctaagaagtttgcaatttatatttcttaaaaaccagaattacacattaaatatttatattttctaaacatgttttagaaaaaaatattctctacatttgtaaccacctaatttcttacacatagcaaacaatccaacatcagcaaaatgacttattttcccattgctccaaagctaatatgctcattattttataaaaagagaaaactgtatgcagtactgtacattcacttaattgatttttcacatgcaggcaccactacatcacagatgaatatttgcagtacaatcatgcaatttatataccaagatagaggtcataatttattcaatattatccttggtaattattattgagcattttaattttcaatacttaaaggcaagtatattctgtgaatccaacaaaggaaaagtactcactaatagagtaaattaacataatagactatgaattaagctaatgacttgtttttaactctgcaacacaaaaaccaatgaaacatataacagataagaaaattaccaccttcatcactgttaactgacaaaatcacaagcacaattatgcaatcacttacttccatcagtaacttgaatccttctcttttcttgatttcatctactaggtacctaaaattaaaagtcacaataatatttataatctgcaatgtaaaagtgtcatgaacatgactgatatgacaaaactgattcagacagggcttggagataagaaagatacagataaaggtcaaggaacaggcagagctatggatagataaatactccagacctactgtaatttccttggcctgagtaaaaggatgcatctttttgatgatgatatctatctcacatgttagcatcaggctttaaccctggtgtgaaaagccagataaagcaggctggatatatatctctgaacatgtgggtcttacattcatactgtaaatgggggatttaaccataggtacttacattaaatagctggcttggaggaaagagttttttgttttgttttgttttgtttttggtgtctaatcctgcttgtaagttcacttaaaatcaagaaagatcaacataatcttttctaagtccagcacagagaggaggactgataatcagtatcatgttaaaagtaggctgattatcctcagcaaactaacacagaaacagaaaaccaaacactgcatgttcttgcttataagtgggagctgaacagtgagaacacatggacacagggaggggagcaacacacactagggcctgtcaggggaggatgaggggagagtattagggaaaagagctaatgcatgtggggcttaatacctgggtggtgggttaagtgcagccaaccgtggtacatgtttacctaggtaacctgcacatcctgcgcatgtaccccaaaacttaaaaaatacaagaaaaaaaattacctgaatatgaggggaaaaaagtgggctgtagccattgatataatatctataaagtcattttgaatgttgggggaaagagaattgtcacacctaagtaaagggcatagatgaaatatggaatatgagtgagaaaagactaaaacaacattgagaacatggtgccctatataatattgactcctctcttctaggcttggcttttgtctgtaccaaaagagaagtctgaaatggctggccttgaaaactagtgattcacgagcctttgaaatattcacaacacttgacccagtacttcaaatctaggactcaaacataaggaaataatagagacgctgacagaaatgtgtttgtcagagcatttattgtgatttttatatataatagcaaaaaatcacaccgaacatcaggaatgcctttgaaaactagattccagtaatagttatgatcctatgatcatgtcactaaatcataaatattcaactaatatttaaagacacaaccatgctcctcttgggcctcaagtctcttacctgtaaaactggactaatacaatcttcttcaatttgaaatggttttttaaaataataaacataaatgcagactataaaaactggaaagggattattacgtcattttaggaaggccattctataatgtgaatatggaatacactagtttttaagatgttcctttttgcaaatttatacagctttttatattaaaatattgatgtttgtatatttcaaagatattatctatatgcaattgtattaaaaattgtcaatattaactagtaatatgggaatccttgagcgataacgtgagcatacacatgggcacgtatgctcacaaagtaccagatgttctacatatgccattctctgaacactttttcagaagacatgtagctataaagtttttaaaccatctatcacactggctagctttcataaaaagcaattccattgctcaacagatatcagaaaagttattcaaaatcagtaataatcaaagaagtgcaaattaaaacaatataggcatccctcgggggtattgtaggtttggttccagaacactacaataaagtgaatgctgcaggaaagttcctcagtgtatataaaggttacatttacagtatactgtagtctgagtttacaatggcattatgtctaaaacacaatgcacatgccgtgactaaaaataccttattgctaaaaagcgctaaggattatctgagacttcagtgagttgtaatctttttgctgctggagggtcttgccttgatgttggttgctgactgatcaaaaggctgaaggtcggggtggctgggacaatttcttacaataaggcaacaatgaagtttgccacattgcctgactctgctttcacaaaagatttctctgtagtaggcaatgctgtttgaaagcatcttacccacaacagaacttctttcaaaattagtcaatcctttcaaaccttgctgctgctttgccaactaagtttatgtaatattctatatcctttgttatcctttcaacaatattcacaacatgctcactgagtagatttcttctcatgaaaccactttctttgctcatccataggaagaggctcctcatccattcaagttttatcatgagactgcagcaattcagtcacatctttgggcttcatttctaattctatttctcttgctgttttcaccacatcttcagtgacttccttccctgaagtcttatacccctaaaagtcaaccatgagagttggaattaacttattctaaatccccattattagtattttgagctcctatgagtcatcagtgttttcagtggtgtataaaagggtaaacccataaaattttcaattcactttgcccagatctatcagaggaatcactgatatcacggctatagccttacaaaacacatttcttaaataagacttgaaagtctaaattactccttgatccatgagctgtaaaatgaatgttgtgttagcaagcatggaaacaatattaatctccttgtacatctccatcagagctcttgagttactaggtgcgttgtcaatgagcagtaatattttgaaaagaatctttttttctgagcagtaagtctcaagtctcaacagtgggcttcaaatattcagtaaaccatgccataaagagatgtgctgtcacaggctttgttccacttagagtacaggcagagtaagtttagcgtaaatctgaagagtcttagaattttcagaatggtaaatgagcattgacttcaacctaaagtcaccagctgcattagctcctaacaatagattcagcctgtctttgaagctttgaagacgggcattgacttccctctggtcatgaaactcataggtggcagcttcttccaatataagactgatttgcctacattgaaaacctgtttaatgtagccacattcttcagtgatcttagctagatcttcagcataacttgctcagtttctccatgagcatttgctgcttcaacttgcacttttatgttatgagacagcttctgcactcgaacctcatgaaccaacctctgctagcttccaactttccttattcatcttccacacctctctcagccttcatagaactggagaaagttagggtcttgctctgaattgggctttggcttaaggcaatgtcatgcctgctttgatctatccagaactctacaaccttcatagcagcaataaagttgtttcgctttcttattattcatgtattcactaaagtagaacctctaatttccctcaagaacttttcctttgcattcataacttggctatttggcaaaagaggcctaactttgtctgtcttggcttttggcatgccatcctcactaagctttaaccatttctagattatttgaagtgacagacatgtgactcttcctttcatttgaacactcaggccattgtagagttattagttggcctaattttgatattgctgtgtctcaggaaattggaaagcctgaagaggagagagatgggaatggccagttggacagcagtcagaacacactcaatattaagttttccagcttctatgggtgcattctatggagccccagaacaatttacaacagtaacatcaaacagaactgatgactcaaacatttttattatgagaattaccaaaacataacacagacatatgaagtgagcacatgctgttgggaaaatggcacttgatagacttgctccatgcaggattaccacaagccctcaatttgtaaaaacaacaaaacccccaaaacacaatatctggaaaataaggttaagcacataaaatgaagtatttcctgtattaaccatgtttcccaatgataccagaaataaattttagagtgacaacatccagtggtggtaagaatatgatagaaagttgctataaaccttttaagtaatactcatatcttatcaagcaaaccagttttgaaatgctggtctacaaagaaaaaagttatcaatatcaaggatagatataacagcatatatgtgcacatatatttatatgtactatctaaatgtctgtactgtgggtatataggtatattccatacaaaataactagaaacaagattaatattcataagtagggaattaaaatgcggactatagcaacataatgtaatatgcagctattaaaatgaatgaattatatccacttaaagcacaggatgatcatgataaattagtaaaagataaaagtgaggttctgagaaatggggatgatttgattcaatttttacactttttttttttaaatctctatccacatgtatatacaaagtatggaaggatacgtcataaattgtttacctgagggagggggaaacaagatgcaatgagggtgtgtggttttccattccctttttatatctcctttcaaagtttcatacatgtggttacttatatagtttttgaaaaagaacttaaaaatacaaaacaaatagatgaatatacttcctacctataggagaaaagctttgtgaaccatcctttttctcccttttcaggcacaaatgtactggcaatctgttaactcaaaagcttgttatgatttcatcctgaactgagcctatgaagaaagctttctccagaaatcttgggaataactttagaagattctaattgtgcagctaaataactttgtgagtctaggcaaattcctaagccttcctgagcctgcctccacttcctcatgcacgtaaagatgtacaaaaaaattggtaaaatccttcccttacaagttatggctacacaaaacttgcatgtattaaccatagtatcattttaaaatgcttgtcaaactggctaaatgtgctcctagaggaaaggcatcctaaaacagagctgaattatttctgttaaaactctttttgctaaccatgtagatctgggctttgtgttggggtaatgttcctatcgcagtcactttcagagcctgtaaagcccagtgatatggtttggctgtgtcctcactcaaacgtcatcttgaattgtagctcccataatccccatgggtcatgggagggacctggtaggaggtaattgaatcatgtgggtgggttttctcatgctgttttcatgacagtgaataagtctctcaggatctgatggtttaataaagggcagttcccctgcagatgctcttacctgctgccatgtaagatgtgcctttgctcccctttcaccttctgccatgattgtgaggcctccccagccacatggaactgtgagcccactgaacctctttttctttataaattgcccagtctcaggtatgtctttactagcagcatgagaacggactgatacacccagtgtaacactccagctgagttgaaagtagaggtgattttgaggcaagaggagatgcagctattactataacaaaggtcttacaccagagttttcaaactgtgatccgtggtataccaccttaataggttttccacataaaaagtcccactatcaaataagtttgaacactgctaggcatatcaattagattgatttttgtctatgcttagaagtacacttggccaggcatggtggcttatgcctataatcctagcactgtgggaggctgaggtgggcagattgtttgagtccaggagttcaagaccagcctgggcaacatggtgaaaccccatctctacaaagaatacaaaaattagccgggtgtagaagtgtacatccgtggtcccagctactcaggaggctgaggtaggaaggaggatcacttgagcctgggaggtggaggttgcagtgaaccataattgtaccactgcactctagcctaggtgacagagcaagatcttctccaacagaaaactatacttgccttaattcataaggccatttgtcaagctggttggattgttcaataatatcaggaaccagttatttaatttcagctagccatgctctgtgttagggaggtttcctctcatgttcacaagacagctgctacagctccatatgtcccatccttatacagcagtgtccgaagagcagagggggctatagcaaaagcactttaagttctatttaggtaagaatattttccccagaagtcttcacagtatcttgttgactgagccacataccctcccctaaactaataattggggaagatggctgactaaaccaatgttcccagattgaacattgctacgtgaacaaaatcaaggttctacaggcaagagagaatggtccttggtgagcaaatcaacagtgtctgcatattgattaaagttaaaaaatgcttctatattacaggccctctcaaagttttaaatatcctaatgagtacttcgaatctctaggagaggaataatatagtagttagcatctcccagacacatttaaccatggaactattttttgagggatgatctattaagatctcttggaagtctactggccacagcatactttcacaaatgctggtttataagtgtttctactaaaaagtaccctatcctcttcttaaataaatgcttaaatgaaatgtgttgttggaaggaaagccaaaatgttttaagtcacctctgcttatgtttctagggatgacttattcctcgtaacttttttttcaatatatgaaaacagcctaaagacaaaatacatttaataaactaatcttatacatggtgcaagccggaaaaaaagtacgttcagtttggggacataatgcagaaaccataaactactatcaaaaggcattcaagtaagtggactcgaaaagcagtaataacttcatgaaactctttgtcctttccactaaccttggcataaaagagagaaaaaaatacatattgagttttcaccaatcctactgtggggtaagaacatattagtattctggcttgatcttggcatatgcattaatgataaacttgctgcaaaacaatttttcttccttacaaagaatctcagttctgattgggttatataaatctccccctttgtttttatttttcttgtccttttgcaagacattctttcctctctgcaaatagcctctccagtccctttcttacttcagcagccgcttagcgcctccctgaaccattttggaccaagtttctctcctagtctcatcttctcatttgaaatctcttctgatgcattgagcctcccagaactcctgagatttttccatctgctttccgtatgctctgcatagatcagcacatgtcacatgacttgtggaattcatcacagacacccacgtgctctattctactgtaattgtaacttttaaaaagatcaccaatataaagataaaatgaaaacaaagactgttccctagtcttccagactctgtacctcccatcacctagagaaatacactggcacaaaagcaccattgtgtaactgctcaccttttccatactgataacaatacacccctcggtatccatgcaagtctatgaaatgatttccatttgagagattgcagagattgtgtgtcaagggaatagatagataaatgatactctggagaccaaacaaagtagcagagtgggagttcctgagctgtttgttgttgaaaagacttagacatgactcttctagcctgcttgaaaaatcccttagtggatatccatttaacctgaatgccataacaaaggcctagaaggtgccctcagcaacaggtaaccttgtatagtaaaacattttttactttcctaggcagatatcagaaatgtacagtcactggctttgtgccatagtggtagttttaaacctgagccccctgggtttcaattatgcccagtaatcacatgttgctttaggctctcagtgtcactgattttcgaaccaaagaaaaacaaaagcattttagtaattaatattttctgggagaaatgttctctcttcaattgggttgacagggtcaaatggaaattaggaaaagccttagaggtctcctaggcactaaatttttccttgctaaatttctgacaacccataaaattggaatcattgtcctcctgaaagtgtctgctcttactttcccaggggaatatgaagagggctatctgatcggtgcagtgatcattggtctatcaaaatctcatccttaaatcttagtcaatataaaaacttcaaagttaagctccatttagattcaggaacatggaaacattatttctatggaatcagtgtaattcttcctgtatcattatcaaaggaaaagagttgcacagcttttccagtattttagagacctgaccctagggcctagggaagtggatattttagctataagagcctgccaataacgtgctcctcaaatactaaaacaatcatcacgtgcagctttactttgctggagttatctactgaaagaagttacgcttcttggaaacaaaacaatgtttctgtaacttagaattattccaggtggagccttccaaccatgggtgaaatgcttttgatttggtaaactctgaagcaagttgctgggcatcagtgggcttcatgggaaatatcttgaccctgtcggtggtttgaacagattatgctacttcacattatgcacatggttagaagactgaaagagttacgattatagctggaagagttaagattatgactcacagaaccagtggtgttctagagctactttgtagtggttgagagtccactgttaaatattcaggaatttcctcaactacaaccattggtagcttgcaatttgctatgacagaaatatttacaccatgaaaattggcagacactacaaactggggctttctttaacttctgaaagaaaatttactgccataccactgcatataggcttaagcaaacagaatagaccccagaattgagaaaaatattctatctttcctaaaaagcagaactacaaatgaatcagtaatttgaaaagaaagaaatcatgaaaataaagcccttctgttgctaatttactataaatcttaattctagagaaactctttccaagttttataatttcacattcataccaaattacatgcctcaaagtactctgcccttttccttggcattggaggtagacttttgcccaccccaggaatagactgttggatatcaagagtgtggaaagttaaggcaaaaaaactattatgagtaacagcaggaaagaggagggattatttttcaaatacttaaacataggtcacagtctgcagcaatgctcactaaaatgttaattcaattcaacttgacaaacatttacaaacaataagtgtttgttgaattgaattgaaatgttaacatttatcctcctgtgatatttctctgcagaaattagaaagtattcttagactgtaaactaaattccaccctgagatgaatgttaactttataataaatacaatcataaaatatctataaccttatttcaagacacctcccattgaattatttcaaagcttagacaaaataatgcagagattctaccccatttaaatagtgcaagaaaatccacaaaaagggaacagagcttcctggacttctaatttagtgagcagctataaataatttatggtagaccgtagactgtcttgttttttcaccactgggttatctccccacttctaatagaagcacttcaaccctatctctaacaaaggtaccttcatctaggatcagtacacattctataagaagaattgacacactccccagtgccgagagagagcaggtgaatcatcgttactactgagagcatcacattgccctggaaaccatgactgattcagagatggatatttacttcactctcaaataattaaactttcctcgggattgttgagagaggagtactttatctttttgatcttaaacttgaacccgaaagaatatagatctgacactctttgcatccatcttcctccataggaataaacccaacctgaaggaaagcagaactgaaagatgcagagagactgaggactgctgatactgttgaagcacctagaccaagccttctgaaagtcatcactacactagtcttaaaagccttaaattacctttgtttataataccttgagttaatgtttccatcgcttactaccgagagtcctcatatagtattcacaggtttttcaaactacttcatacccataatcaccagaattactgacttctaaaagtcttctgaaaatgccaaagccatgtgtttacctgtccttatatccaagccctttgctatgtaactttgcaattcttcctgctaaaaggcagagggcacttcccacctcctcacattgggtttagccatatgattttctttgaccaaaggagtattataacgcaatcagctacagatataatacaatcaggagtttaaagtgggcttacataattggtttgccttcttggccttctgtcatggccatctcaagaatgcgctggctagtatgctgatcaaggaatatgaaagacgtggcgagtagactcaaacaccccagctgctgtgatatgatataaagtataaagtcatgctagccaacatttagacctctagggggaaaacaattgttgttttaacacattcagacagcttgttgctcagaatacccacactactcccagtatagaaagaagaaattgctataaatctctaagaaggtcctacatgattttccaagcagttaagtaaataataactaaaacttaaatagcatgtaggacatcccaggcattgatctaagtgttctacatgtatcaattcctttaatctttacagtaactgtttgagatacgtgttattatcactttcctgggacaaaactgaggtgcagagagactaagaaacttgccccagtcacacaggatttaggtcttgaatccaggttgtctgtacctctatgctattaggctagatttgttttttgcgttttgttttgttttgtttttgttttttttttgttttttaaactgtaagaaatgatagggactgtgtttttccagagtcaggcatcatcatgttcagctagttgttaccatgtgggattgagagcattctaagctttgagaaaagcaaaaaatccaggttttttataaatttatttttttaaaagcatttcaaatattgaaatgtttgaatgtttaacaccatgaaagttaaccttgaacagtataagctcaacaaaacacatttaaaactaaatttggctatggcctgtccaccactgatctaagtttagcagttcagtcctattcaagtagcaatgtctggcacctatatcttgagcttttctaatgttcttgaaagtgtgacaacaattttatttctaatgtttactacaaggcaagtaaacatggtgcttccacactgcctttcccttcgagacttaagctgccgccacaactcacagatcatttgcttttcaggtccttaatgtcacatccagacttttgtgtcacctcacatccagagacttgggcctgctgctccttccacttgggtcattcttctccccttctgttttagtctgttttcacgctgctgataaagacatacccgagactgggaagaaaaaggtttaattgaacttatagttccacagttccctgaggctggaggaggcctcagaatcatggtgggaggcaaaaggcacttcttacgtggaagtggcaagagaaaaagaaacgcaaaagcagaaacccctgataaaaccatcagagcttgtgagacttatgcactaccatgacagcagtatgggggaaaccacccccatgattcatattatctcccactgcgtcccgcccacaacatctgggaattatgggagtagaattcaagatgagatttgggtgaggacacagagccaaactatgtcattctgccccttgcccctccaaatctcacgtgctcacatttcaaaaccaatcacaccttcccaacagtcccctaaagtcttaactcattctagcattaacccaaaagtccacagtccaaggtttcatctgagacaaggcaagtctcttctgcctacgaacctgtaaggtcaaaagcaggctagtaacttcctagatacaatggggatacagatattgggtaaatacagccattccaaatgggagaaattggtcaaaacaaaggggttacaggacccatgcaagtctgaattccagcagggcagtcaaattctaaagttccaaaatgatctcctttgactccatgtctcatatctgggtcacgctgatgcaagaggtgggttcccatagcctttggcagctccacccctgtggctttgcagggtatagcccccatcatggctgctttcacatgctggcacacagtgtaagctgtcagtggacctaccattctggggtctggaagatggtggcctttgtctcatagctccactaggcagtgccccagtagggactctgtgtgggggctctgaccccacatttcccttccacactgccctagcagagggtctccatgagggccccctcccctgcagcaaacttttatctgggcatccaggggtttccatacctcttctgaaatttaggtggaggttcccaaacctcaattcttgacttgtgtgcccacatgctcaacaccacatggaagctgctaaggtttggggcttgcaccctctgaaaccatgggctgagctgcaccttggccccttttagcaatggctggagcagctgggatgcagggcaccaagtctgtaggctgcacacagcttggggaccctgtgtgtccccaggcccatgaaatcatttattcctcctaggcttctgggtctgatgggagggactgccatgaagacctatgacatgccctggagacattttccctattgtcttgaggattatcattcagctccttgttacttaggcaaatttctgcagctagcttgaatttctcctcaaaaaatgggttttttctactgcatcgtcaggctgaaaattttctgaactttgatgctgtttcccttttaaaagggaatgcttttaatggcatccaagtcacctcttgaatgctttgctgcttaaaaatttcttccatcagataccataaatcatctctctcaagttcaaagttccacaaatctctaggacaggggcaaaatgccgccagtctgtttgctaaaacgtaacaagagtcaactttgctccagttcccaacaagttcctcatctccatctgagactacctcagcctggaccttattgttcgtatcactatcagcatttttgtcaaagccattcaacaagtctctaggaagttctgaattttcctgtcttcttctgagcccttcaaactatttcaacctctgcctgttacccagttccaaagtcgcttccacatttttgggtatcttttcagcagcaccccattctactggtactaatttaccatattagtctgttttcatgctgctgataaatacatacccaagactgggaagaaaaaggtttaattggacttacagttccacatggctggggaggcctcaattcatggcggaagccgaaaggcacttcttgcatggcagcagcaagagaaaacgaggaagaatgcaaaagtagaaacccctgataaaaccatcagatcttgtgagacttattcactatcagtgcagtatggggaaaatagcccccataattcaaattatttcccaccaggtccctcccacaacacctgggaattacgggaatacaattcaagatgagatctgggtggggacacagagtcaaacaataccaccttctcttcattagatctcagttgaaagtcacttcctccaaggagcctctgccagtgtgcctcaagaacacactagagaagccctcctgattgatcttggactctatacctcaccttgccaaaaatgagggtcatttgtgcatctcagtaggctaggatcttggagggaggtgataggactgctctgttcataattcctaacacttagtaggtactgagaaaatgtgtattggatgaaataatgcacaaatgaaaacatgtacttgcaacacatttcaagtattactttccttaggtcttcctattacagacacagatagacacacacacacacacacacacacacacacacacacacacacacagaaagagagagagagagagagagagagaggctagtacctagataaagcaagagcacgattaactctttcttcaaggcctaatgtacccagggccttccaggtcatccagaacttgaatgcatctggtcttctgctacactggatagacttgtctcctgtgtcatagctcacatcatagaatttatcctgctggaagaggtaagatgccttggcagagtagcattttttaagaagatccttcgaaaaagaaaagattacaagactgttaaactttagaatataacttgattttgaaagcaaacacatgtacacacacaatgtgtatattctacctgtgccaagtgtacatctcactttgactgccttacatcagacacaatcagtgtacattgactttcagatacacattacccatggtgttaccaaacaaaacttcagagttgacaatgctaaaatccatcttcacaattttactgagtattgagaagctgagaagaccatgtcattatcattatgacatcaaggtggcccagtttttcagtgtgaataaaactgtctataactcaaagtgctctccattggccagaaaaaaaaaactgacatatttacatatgttatacaatttcataagcaaaaaaactaggttttaagaccttctctccttcatattcatttgaaaaggctagacccaacataactcagggataaaaacccagtgaaagagctatggaagaggtaaacaagagccaacaagttttcactaccacagaacatcagctataatcccacagggccttttgtgtttgtctcatgctggttttatttgcaaccaaattccatttgcatttactgacttgttatcattaagaaatgggtgataatttactattcatcacgattatagggcctttgcctcgacctcaaatcattaaagttgaagccatgttgtcttcaatgtcatctagtgtctacaaaagccaagatttcctaatcaatcatttacagccctgacaactcccccaaaatattttagatccttatgctcctcagtggagccaatgtactcaatgtccttgaaccactacatcctgtctcatctatgtcttgtcttataccatttgcttgaatctaactctctattttattatgatacttgacactttcaaaagaatatatgcagtctacttataagctgcgaagtttactgacactaaacatagcctgccttctttcccaggtctgccctgctatcaggtcccatctcaactttttcttccccttcagcttcatctgcccatctccttgggctcaaaggagtaactggtatttggctgcatttgttggccttggtcctgtgctttccgcatgcaatgagcagtcactacctatattctctccttgtgtggtcaagcaggttcttgggagcaggaatcatttcctatccattgttacatccatgcagtttaacactgtgctgggcacagagcactctcattaagctatcaagacaatgattccactctcaatgccctgacatgtggtatgaatagaataaacacagttggatgagcttctcatttggtgaattttccaaactttaacaatgcaaaactactagtgctgtacaggaagctacaaaaaagcttctcagtagacatggcggtcctagaaaatgtttccttctgatcagagaatgtattaaatgtgcttcatttgactaatcagcttgtgctaattagctgaatgaaaaggaaatctcaagatatcacatttcaaatgaaagcataagtttgctgacttaatgtaagcaacattgtcttgtgtagatactactctggatctaaatatattctattacaaaaaagtatgattttatactacagagaaattatataccaaatataaccaagaattacaatatgcccctcatccagtatccacaataaactgagtataaaactgataaggctgggcactgtggctcacacctgtaatcccaacgctttggagggctgaggcaagaggatcacctgaggccagccgtttgatacaagcctgggcaacatagtgagaccccatctctacaaacataaaaattagttgggcatggtggcatgtgcctgtggttgtggcgtatgcctgaagtgggaagatcacttgagcccatgaggtcgaagctgcagtgagctgtgagcacaccacagctcaccagcctacgcaacacagtgggaccctgtctctagaataataagaaaaataaatattagtatgccttcagcctggttctgatgggtattcttgagagatacagggaaagagcagattgctctgacctgaacactaaagtagaaaaatcccttacttttaagtcttagattttatcatcaatatctctcctctgatcacagttgccactgctgcatctccctgccctcaaaagtcaggaaatttggttgtttccatagcaactacactgaccatatattataacactaaaaggccactgcatgtactttaaggacaaatcatgcacacatgttcacgacacaggcacacacacttgcattatgattataaatttactgtcaccaaccatgaaagattaaaaatccccaaagcaaacgaactttggacatttcttgagcaagttttaggggcctatggtagtgattgaaagggagaggacgctcatccattatcagaagacaaattgtatcatcataagcaagtggagaacaagagagccaagaaagcaaatagcagaataaacaattgtcctgcaatagtgacagttaattttatggcactaaaaaattctgccttgggaaggtttcctaaagaacaactggaggcttgggatttactttatcaaaaataaactttcctcccaaagatttcactttgcattttagtttatgtccttgtattaaaatggatgagatgtcctttagttttaagacatcaactaagagaagatgctcagatgtccagagaaaacattttagaataagtatagtaaaacgtaacattgttgaaaatagttattattgtgctatcaaagagaagcaccatatttatcttgctcatcttcatactcttaatcctagcaggacaataaatattagtaacatggctttcagagacaagtatccaatgaaaagacaaattgctttatattgatattaattcaactctcctcagcggattagtagacattgtattaggacttgtacagtggcaaatgaggtttaagcaaaaggagggagtatttttataggcttttgtatatttaaaaatctagtcatatataatcttcaggcacagttgaatccggtactaagtaatatccatcatcaggaatatgtcctttcatcttgttctattgtagcctatattggcctcactccctacatatggaaagctggtaggaagcctgaaaaccaaagcttccaggtagaatctgtgagcatggagaggaggctctgtttgaagacaggaaatgacaaagagacaacttctgctggtggtgctactaacaaagattctgtttttgactaacatttagttacttagtctgcgtcctctaggtctccaccttgacatttatctttctgtaaatgcatcaccctattgtagcaagaatcttgctagtcagtttggaaagaatcccccaccccgatatctccctttatctgaccaaattcttcatccttcttacttatctgactattctagcctgccttcagcaagaatcttgttagatgtctaacctgtatccttttatttctaatgttttcttagtcattttccacccactgactcccaacctgccccttggctatgaatccctacttgtccatgctatattcagaagtgaatccggttatactgaggtctatcttcctcattgcagtagttcctgaacaaagtctgtttttactactttactgtctggttctggttttctttaacattacccatgtagagagagactcttggcctcctaacctcactatcttatatgaacctttttgtgaccaaacctagcaggaagccaattggcaaaagagcctggagaatatggcttttaggagtctggaccttttgcagcgcaaagcagaggaaataaagaatggattggattatacagtaaagagaagccaatgacaagcacagaaaccacaacttttactttccctctttgcaatcacaacacctaacctagcgcacataataatgaccagagctaacatttattgagctcttactattttccagacacttcatatgtaataactcacttaaatttcacaacccagtgagataaattctatttttgtcaactccattgtacattttgcaacacagcaagttaattacctaagttcatgtagctactacatgatagggctaggtttcaaaccaaaaatgcttagattcagggcctgaacgctaacctattatactttattgcatcaacagtgggcacttaaatacgtgtgaaagagggtgctccatttggagaggctggtgaaaaggaaaatggcagaagagagaacactgagctagaggtcaaaataactaagatcctgtttcaaactcttattttttcctataaacatgacctctggtcttagcaccagtaatatcctgtttttaaagcattttgagatctttatgaatacttgtgaatctggtaacattatggaaaatattcactcattatgtgaaagaatgaatccgtaggttgtatattctcctgaccaagattagccaagccatctttgatttctataggccagatcagaatctgcggtctctttttggtcagtgatcccatgggtctactaagtcaggattctgtgcaccagcagtccccagccttttttttttttttttttttttttgggcaccagggaccagtgctcatgggagacagtttttccacagatgtggggtgtggtgtgggggagatggtttcaggaagaaacagttctacctcaaatcaggcattagagtctcataagaatcacgtgacctagatccctcttacgcacggttcacaatagtttgcactcctatgagaatctaatgccaagactgatcttgcgggaggaggagctcaggtggtaatgcttgctcacctaccactcacctcctgctgtgtggcccggttcctaacaggccatgaaccggtacaggtctgtggcctgggtgggaggatccttgctgtccacaacaacaaacctttgtatttcctccttgcaatgatgtttttcagctcatcaaagaaaagctaccaaaagctcttcccgtatggcccttcctatattctgtcctatgtcaccatatttacatgcaaaaaaaatggtctaaatgacttagaaaataggaatattaatcatcttttaataattcatctaaaaattatgtattgaggacctattatataacaagcactatcatgccaggagcctcggtatacaagcccatgaaggtgctaagtgtctgggttaatatttgttggcgtaatgtgcaaaatcaaatttaggttgcaaataaaagacttggctgtaatctaaaatataaaagtgaacttttaaaatgattatgccatctgatattggctttctttattgatcaaatatttgggtaccttaatataggctgaaagctgtgctaagcactggagatgtaatggtaaataaaaaagtcaccatccttaaggcatttcagatgggaataggagcagaaaaaacaagccactactgtccagtgctagaataggaggaagaacaaggcacaacagagcacaaacgagggtcatattcaccaccttagaggtgtgagagatggcttttcagaagaagctgagagctgaaaagtgagggacagctggacagatgagagaacagaactaattgagtacaactggagctaattaaggaggtgggccatagctggagagttcaggctagaaatctagagtagccaagtcaccacgcatcttaaatgccacaataagaatgattagtgatggaatcttccaaggctcctacagatattacaacttaaaacttcattactaatctggcagaataaagtgagaatcagcagatgtgaattctgcttttgatttagttacttggtgtcagagctcaaagcctgtcacttaacatcttgggcttcatttttctcattggcctaatgaaaatgctgttacttgttctacccatcatacataagtattatgaaaatcaaaggaactaatgttaactgggaatactctttagtcttaagccaaaaatcttacccaccactcttcctcttctcgaacattccagtatcccctgacccctcccagctgtcactgcctgttcttcctttggtttactttatttccccaggcaagctacagaacagaacatcagctctagacttccccactgtttatgaaatgaacatattacaaccctcacccaccttcctttttaatggaatgtatttgccagttatacagttatagaagtaggctgagttgacgaaaatattacaagaaatcttaaagcaataggaagttatcaatgctctacatccttcaaatggaatggatcctgacttaattaagctcccatacttgatgtccttggtagatgctgtgggtctttacaagtctcagtgtagtttaaatggaacactctaaaggtatcacataaaataagaatgacccagggtagggatgctaggtggacttgagagctaaggagccatcaaatggccaggtgtaacttgagttttctccagtttccttaagcaaagagggaaaaatggttaactcctgtgtagttggtgtgggggatggaagagagtaagcagaggacaatagtgaatgtgcggccgggtgcagtagtggctcatgcctgtaatcccagcactttgggaggctgagtcgggcagatcactggaggtcaggagtttgagagcagcctggccaacatggcgaaacaccatctctactaaaaatacaaaaatcaggcaggtatggtggcacatgactgtagtcccagctactcgggaggctgaggcagaagaatcgtttgaacccgggaggtggagattgcagtgagccgagattgtgccactgcactccagcctgggcaacagagagagaccccttcgggggggaaataaaagtgtttttcccaaaaggaagcaaatcagactgacccatgtaaaaggtcagtgtattaggttgggccatgaatagtctgagaaggaagaaaaaggaggaggggagggaaagagcgagggaatggcagggcagagaggtggaaaaaggaagagagaagcaaaggatgaaccggccgggcccagtggcctacgcctgtaatcccagcactttgggaggccgaggtgggcagatcacttgaggtcaggagttggagaccagcctgaccaacatggttgaaaccccatctctactaaaaatacaaaaattaactgggcatggtggttgcatgcctgtaatcctagctacttgggaggctgaggcaggagaatcgcttgaacctgggaggcagaggttgcagtgagctgagacagcgttactgcacgctggcctgggcgacagagcaggactctatctcaaaaaaaaaaaaaatgaggatatcattcaaatgtgagatttcaagtgctaaagtataggtcaatacaaagcgtctgtgtaaatgggtgcattttgagcttgtggaaaccagcagactatttggatgtcatctaacatacagattcttacattagcccactacttttatgaatcttttgccttttttgtctaaaatgctgatgtatgaagttagcaagtgggaaaaataaccctctcttcatttctctaaatgcaagtccacccactacttttatctttctcttttttcttccctcactgttataaatattccctctttctggctttcaaatgtatacaacatgttacaagtcctatgataagaatgagagcaggtcatcaaaataattcgaaaactcaccatctttgcacttatgttcacctcactctcctgtgtctgttcttctgtgtaacctctgttttcccagtctcatgcacagtgactaaacggtggtggagagtgtgcttcatatactcaactctactgtaagagctattcacttataattgggaatttgccttcaactttaaccagccaggactcatttcctgagtgtctactcacaatatttctgcattttgctgtatttatgttcacctataatccaaagcaggtattctttcatttctgacatcttcaaataaacatcttgcattttttcctatggcatgtctttaattcatttctttacttggatttatttagttagttcattttctttctgctgtagatttttcattctttgtcagagtagaaaatatttaaaatcatccggtttgcatacagcttggagagagaacttattttttataaagggtcacaattattttttgaatttaccatcaaatctgaattcctatttgccttttcatctgcaatttgagaggctaattcaagaggcagacacattgtgctccattggatgtttcaatgtaggaggttcaaatcatgatataaacgcttgcttctattaccagttctgaatcattttttgatattgactcagctatctttcccattccagtcaagcattttccaatcactggtatcacctatagatcaatctccactcaaatcctcaatttgttctccaattctcacttccttcccatgatctcttgtactttctggaagatgttttgtacagaagtttgctgatacttgttttaatagtttagaggtgggattgtagagaactttcatttaagttcatatttttatattacttggatttattacaagtatatattaacaaaaagtgaaatttttaaacacaccttttcctccaaaaaatcattgcataacattcatactgcaagaagggtctctatgcatattctgtggggatatatacatattttttgtcttatttcaatttaaggagcatgaggctataaggagacaacaatcttgctctaatattttctcaaatattctgaagtttataagctatgtaatgaagtttgctgatacatgaggtgcttgtgattgaatttctgttctggtgaacagtctgccctgttctcttctgccatatagtgacatgtttgagcttgttgtcttgccattttgacatctcctttcctcgagtttattttgatctccagtttctcaaaaactgtgtgctatcagccctttcacaaactggcttgatggtctgcctggttcaagccgtttccagaaagtttctgggtgctgtgtgctaggtttcccacgaaatgtgatttcctctcgcttcagttaattgatataatgcttttaacttcacagctatctgtgaaaatgtgttctttgagaaaacatcagcatttcaattcatgagactatgaaagaaaagttacatgatatatatagacagacagatacataggtagatatagagatatatatatagagagagagatctgtgtttgtcttccacctttggccctttggttgatatgctcttaaaaattcttaagttgctttacaaagctgaggtcagttgcttctttccttaatacatttgacgtttttgtggtggttcaaaatcctcactttcccactgtgtatattgctttacgtaataagttatcaaagagatcctacagccctgtgtccagctcaaggcagaagggcaggaaagggcatgtttgtgcagtgggcaatactccccaggtccctcccatgagcccccagtcctctcttggccgcaccctcctctggctcgcctttcttctcgcttgtcatcctagctactctctctcccagtcacccacagtagtctcacagcaaaatgcgcaaaggaaatagcagccttccacgcaaaatgagagggggagggggaaggaagtccctccccctcctgctacaagggtggggctggaaacacaccagccttcttgatagtggtttacgcattaccagctatgaactgctaagagctcacaggcactggatcagtttatcatctgtaaaaaaccactgacttctgaaatattctgaacacttagtgttgagatcaagactccccttccccttccagaaaccctcttggaagattctagaaagctttaagtttcagggctgcagacccgttagggattttcagagaactgctagcatactttagtacaagatctgagatattttctcccagagtgtaaatcttccttaaatacccctaactaagggttagaatgagctgcttagaaaatgaggagactgaactaagatatttttagaaatgcaacttaataattttaaaccataacgctgcctacaagagaggaaagttggactcagtttcttagagaatgtgtaagtgcctctataaatagttaagaaacatttgatagtgcagagatcacttggcaatacctctgcatgccctacaagcatttaaaaatagtacaatcggtcttctctcttaggacagatggagatttttcgattttccctaggcaacaatccacacaccttctctattaaagataatctaaaacagtgtttttcaaactctgactagaattcacagtaagaaattatttttaaatagtgacacagtatccgccctaccacacatgaaactgaaagaaaaatttcatggaatagtacacattattaccacatggagtgcatactgattttttctatttcagtctattctgttctgttaatttaaaggaaaaaaataaaaagctggcatgacttacaattgactgtgtaactcaagaacaattggtacagtgattgttaaccctggataacattagaatcatatggttttttttccccccaaaataacattgcagggttcctactcaaggccaaaaaaccagaattttcagtgtgaagtaagggcagtgttattgtttaaaatgtttcccagtgatgctaaggtgcagccaggattggaaaccactgttctgatgggtcttgatctcacattgaaaaatcctgatctagaagtttaagtcaacattacattcatgttgggactacagaagtctgaagtgttgagtttttctgataacataaaccagggtgattatctgacttacttttttgctactagtacccattataagagttttatttgtgtgaatacaagtgaagaatggctttattccgtgcaacccaaagagaatgtgggttacatgtggtccatgctgaagtcttaatcagtggaaggaaaaaaagaagctccaaactataaaacctaagtctatgggttatgtacaaacaaaaccaagaaccctaacctattcaaccttttgctttgctatgtatattagtctgttttcatgctgctcatagatataccagagactgggcaatttacaaaagaagtttaatggactcacagttccacgtggctgggaagccctcataatcatggtggaaggtgaaaggcacattgctcatggcaacagacaagagaacttgtgcagggaaactcccctttctaaaaccatcagatcttgtaagacctactccctattataagaatagcatgggaaagacctgcccccatgattcaactacttcccactgggtcctcccacaacacaaaggaattgtgggagctacaattcaaaatgagatttgggtggggatagaggcaaactgtatcactatgttactgtgatatggaagaagaaaaacttgtgttcagaagctagtatcaacagataggggaactttgctcacttggctctgataggaagaactgtgatccttcctcttctcatattattgctaactctgagtttctgggatccatttgaggccctactttgttgagaaagggattttaggtagcctacaatatggtaggattgggaggaggacaggaggaaggagagaagagagatagaagtgagggaggtagggtagatcggggaagaagagaaggaaggggaaataaaaaggggagaatgtggaacagaagaaatgaggttcaaagccaagagaaaatgcagtgaggaagcctggagtgactgcacacacactccatgagaaggcacatgagaagggaaacagaagagattacagaatttgacaaatttttggcatatctgggaactgatgcatagtatagcaaaggcattcagtagtcatttgctccttctgaacttcaggtatttgctatgtaactgtcaactacatcaccttgcttcatcatataacattttcattcatctgcaaattgaggataataatattgcactgcagcccacctcctggagatatttggattatttgtggcatgattaagtaaatgcctggaaaaaatatatttattaacacaggacatatttcttcagtctagatggattaattgcatctctccaaaataggcagacatatagaaatgttctctttcaaactggacaaaacagacacagagtgagtgttctgctttggaatgaggctggaagagcaaatcttcaccaagagcacaatacttaacaaaatcaatctatgtccccagcttattgtgatgctgtcaacaaaggcatggttccttctcaaatagaattttacatttcaattttacctgtagcagtaaggcctgtggcctacatttcttggagtttgagcattcttgagaggtctggcctctgaggcctggagtataggtaggagattgatttcacagacaggaaaatgctatgcaggaatgcaagttctgaaacacgagttccctggtcgtctttgtataaatcccattgaagatttgtgggatattactgacattactataatcatgagcagtcctatttaaaactatccttaaatagcagttaaacatttaagaagtacttggcagaatctttggatagaacaaaagatgtagtggacaatagcattttttcaaggacttatgataaaatgcagaaatgcgctgaaatgacaaaaaacgtttccactatactaatggctatttgttcaggcagaaagagcctgtgcattagcatgtgggttactcctcaacatagacataacaaggaaaaaggaaattacatttatcgtgtgcttactacttgattaacaatgcactgcacacgtttgaacattatctcatttaatgttatattagtttttcaaaacagaaggtgtcttcattatacagataaaagcatcaaggttcagaaaggttaaatgacttgtcaaagtcacacaaggcagtcccaagcagaggaataatttgaacacaaatcttgctgggtttcaaggtccataggttcatttacccactgagaaatcatagttaatcccagaatttcccagttcaaactatagccttaaagactggtaaagcaaacccacatctctggatgttctaaaacaaggatgagcaagtgagtacaccttatatatcctatataggatagatagaatcttatctgtatagggccaggtagtaaatactttcaggtttgcaagccatatgatctctatcacaaccactgaactctatggttgtagcatgaaagctgccatagaggatatttaaatgagcatgcctgtgttctactaaaactttataagaacaggtgacaggccaggtttaacccaagggccataatttttagaccccatgctttaagacattccagtgaagagacattccataagatagtcatttccaaatttgtagaggcagaaaaagttaaacatttatatgaaggctgcaaaaccagagacattattcttgattaaaaaaaagaataagagttcaagatcagcctggccaagatagtgaaatcctgcctctactaaaaatataaaaattagctgggcatggtggtgggcacctgtaatcccagctacttggaagactgaggcaggagaatcacttgaacctgggaggcggagatttcaatgagccgagattgtgccactgcactccagcctgggtgacagagccagactctgtctcatttaaaaaaaaaaaaaaatttttttcattaaggcaaatttttaatcccttttacacagtaaatacttagccactaaaagagatacttaaactgggagataaaatggccatggtttatttgcctttctggatttgagaaacattttacacaattcccatagagaatggcatttgaaaatcaagacccatactggcttataatttctaattttcattgttcccccgatgccccaagaagaaaaaaaatttactctgtgataaaactggttaaatttgtgttcattttctgttttactgcaaacagcaagtggaagttactagtaaaggaacaaaaaggaaggcagggagggaaagtagacagttctctctggtcggttaggaggagggctatgtgatgacatttacgattctctggcacaattctaggtctccaggtatgagaattatggtttccaaaccaaacaagaaaaccgttgtctgacagattgcaagtgtcccgaagggaacaagagaaccagatgtatttagaacaaccatgactgcaaatcctgggggagagtgactatatctacagaatttctgtacaaccttggctgaaagagggaaagtgtaatgagaaaaacctataggcaagagtctggggaccgaattgagttaggtggagatttataggtcagtttaacccgactggctgtggaaatgagttagaattagcaaaatcatcagcattactacttcattttgtataggttccaaaggggattaaacaatcaggttttatctttctaaatcaatgttttctatttctgtacactgttacggctttacaattcagttttaggtgggaaacagggttgatccattacctgccatcttgttttaggcacacataagctgtgtggttaaaagcatggattgcggactaagcatgactgactgaatcccagttccatcctttatgagcttcatggccgtgagcatgttatttatgctttctgtattcaggttcctcgtctgtacagtgggaagggggaatagtccctacctcatgggatttgatatgtggatttaatgggttactatatttatccacttgttttatctgtttattgaacttgccaggcctgcactggacatgagaacaggtaagggagcctctatttcagtatagatgagaggctaatggctccaccattagaggaatttgcgatatgtactgaacaaatgcttggctagagaggagacccctaatgcatcctggaaaagcagaaaggccccctggaagagttgaggcttgagcctcaactgtttcatgagagaaacagtaggacttaggactcaagtgggcaaagaagagtttctggttttccacacagaaggaacaacttggctgtaggaaaataaatgcattcttaatgtgatgttaaaatccctccatatgtgatctgaaattgcttccaagcctcatctcccagcacatcgttccctagccccagacacctggcacatgtcattgtccagatctgactttgctctccccaagaccatatattcttaatttgttttcttttttttttttttttttttttttttttttttttttgagacagtcttgctctgtcaccaggctggagtgcattggcgctatcttggctcactgcaacctccgcctcccagtttcaagcaattctcctgctgcagcctcccgagtagctgggactacaggcgcatgccaccatccctggctactttttgtgtttttggtagagacaggatttcaccacgttggccagactggtcttgaactcctgacctcaggtaatccacctgcctcagcctcccaaagtgctgggattataggcatgagctaccacacctggcccacatactaatttctgacagttcagtgtttgtcagaaatcaggggataactgtattgtatagcatcttagggtgaagagtacctattcctgtcccatatccaatcacttatatagtccccaagcctatcactgctcagcataccctctaaaaagtcagcatgggctgacatacagtgcccataccccagtgacctaaaatgaaccgtagacattttctttctcccctgccttacaaaatccatgaacccattacaatgatgagagacaatatgtcttctctatagtctcgtgtagcctggcatgcgtgtctgtttttggttctaaataattatgataaatgtcctgaatgtaagtgacaacctttctcaaaattgtctaaagctgtagaggcattgagaaaaataaatccccatacagggagtgttaaactccatgagttcatactaattttattgttatattgtaaatccaatatcagattctagaatatacttaagattccagctctgtgaaattaaccttgccaccaatcatgggtaagtcatttcctcaatcacaagctttttaaacaaagaagacatttgaagaactctacttccctagagattttccttttagatttcaattgaactttttaagtgcaggggccctatatctttcaaaattgggaaatgaaatctattacagtggctaatcctctaatgcttgatgttgctacctcacaggcagaaaacaatcttttccttattacatataaatttctggttcacactagctctgaaaacagctatgtatttcattgcatttcactacctctctggcaagttgaatattgaaatggcacaaagattctgacagtgctataaatgaatgcaccagtatttctagaactggatgtcgagggtataatctgcactatggtgctgtctaagactgataataaaacagaagaatactatttcaaggtaagatcaaaaggacatataatagtcatatgtgctactttgacaagggcataatgaaatgtactgggaagacagacagtagccttacaaaagagaagtggtgaacttctttctgtgataactgctatggaactggagatacggaagatacaattcttgtttttttagtttctggactacatttaaaattcggcaatctgctagtaaattgccacagcaagacatggaagatattcattgtagacacaatttagcctccttgcccagttcacaatgaccccttacttcccctctcatccatagacatgggcataatgaacccttgctccatcccgctgccctaccaattggaccagaggctaagaagactagaaatgtggaattaacactgagagattctaatttagctttgctggtctcttgggcagagatgtaaacattatactgtggaggtgccatattttacctgtcgtgagaacttaaaagcaaatataattgttagaagttttaaaattatatcactttggatgtacaaaaagggaactttatttttctttaaaacatttctgatttggagccaccattacttctaatgcataatatttagtctggtcactttcagaaaaactcaaattgactagtcagaccattcagaaataaaacatggttgattaagatttttttttcctgagaataatttctgcctccccttgttctctatttcatgttattgtgaatttctcaaatgctgctgagaagagttgccagttaaaatacaaaatacctcattaaatttgaatttcaagcacattataaatttataaaagccattaatataagtatgtcctatgtaacatttgagatatacttacactaaaatattgtttaatgaaaatcaaatttaactgagcctcctgtgtttttatttactgaatctggcaaccctacactgaggtgtgaaatttccttgtccaatttggtcactgcagttgtgtgttgagctccacccttagctcatcccaagatggtcttcccaccttgctgcttatacctgaatatctgctatggcctctgaatgtcagatcacttgaggcctgcttcttgcttcatgcccctatttccaggcttcattgtgtcttgttcatgttcagtcagttttggatgatcctccataccagccattctgaagcctgcaggaacacagggggctatcccaggcactcttatgcctagataaaaggccatctctagtttctgcttgaacatattgacgtgggagattgagggggaggcttcccacattgagtttcacctagaattcgagctgagaggaaagaacctattatcatttcatttacagggaggttctattctttcttggtgccccgggtttacacttatacttaagaattgctttctcttcagagagtcctcttccctccccaactctgaggcctgtttatctacttgggaaagagggtgtgaactaaaaatggttttttgtataagatgtccttccaagaataactatgaagtgtaaaaggtaaaaatttgtcactctttatctctggtttcattctgatcattgagtacaataaaaagaaccagaatttcataacacatcttaagcacttgggaggttaaaatcactttcataaatcagcctttgctcagagtaaactcagcctttgctcagagtaaactaacatggttattacagattaattggaaagtaatttagatgagcacactccaaaatggaacttaaggagctgagccaaaactgccctcaaatgtaaaatagcattcttacagaacaaaaacataaatcaggagaaaatgaatattaattacataaatttaataaggacatgaaaaataaatgcaaaaagtgattcctcatggaaagaaaagtaattggaaaaaattttaattaaaaattaagatttcaggcaggaatacaagataaaaatgagataaaaataaggacatggcatatattatgctaagatctttgaaaatcttagcaaaatatatttgagaaaatattgtaatggactcaactagagcagaaaattaatagttcaatgaaaatgtaaaaactgaacacagaattatctaccccaaaatttctgagcaagagttttataattaaatttcctgaacatttctaaaaactgatgcctgttattgaaattatttttttaaagaagttttaaaactgcactcaaaatactatccaaccaagataaaaacacaaagaatagatctatattatgtacatggaggcaaaaatcatccactaatatatttaaaatagtttactgcagtaaaatgaggttaatcagtaatacagaaaatctgttaacataaatttagtttaaggagtaaattgatagaattaccttatttgataatagaaaggtatgtggtaaaactcaatactagataatttctcaagatttataaagaatgtataacttagggcaacttcaataaaatcacaaagacaagaatgtcttctgtttaccgaacatatttttgaaaattctatcagtctattataattgtaaccaatatgaagctagatattagaatgaaaaaatgacaatttatactgataaaatcatattcttggaaatgcaagagaataacttaaaatctctcagaaccaattagcaatctggtgaagtagttaaatataagtaaatatttcaaaagtttttcttacatcagccttagcagttagaaggtttaaaaaataaaatataaaatgtataaataaccctagcaaaacatgcaggatcctctattagaaaagccattgatggggttgtttttttcttgtaaattggaaacaacaggtgctagagaggatgtgaagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacatgtatgtttattgtggcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaaattggaaatcatcattctcagtaaacttatcgtaaagacaaaaaaccaaacaccacatgttcccactcataggtgggaattgaacaatgagaacacatggacacaggaaggggaacatcacactctggggactgctgggtgtggggaggcggggagagaggagggatagcattaggagatatacctaatgctaaatgacgagttaatgggtgcagcacaccagcatggcacatgtatacatatgtaactaacctgcacgttgtgcacatgtaccctaaaacttaaagtataataataataaagaaaaaaagaaaagccattgaaactgaaatacttacaagtaaactgatataatgtgtgtcttttttttctctttttttatacacacggcagaggaggaagcagtagatatgaaactggtcatgaactgatccctactaaaaccatgtgatgggttcgtggaagttcatctctacttttgtacatatttgaaatttatcataagaagttaaaaagaatctttgtgtgaaataagatctgaataaatattactaggttggaaggctaaaatcacacaaagatgttaagtcttctcaaattaattcacaggtttaatataaaccttagaaaaaatccccagtggaagttttttaaacttaagtttttgaaaactggaagaataaatagatgataataagtcattttttaaaagagtgaatatagacttaccctactagatgaaatatattctgaagctataatgattacagcaaggtggacttggcaaaacaatcaacagctgtttgattcaatgaatgggattatttcagaaatggaatatcaagttatcttcttgccttatccagtcttctgacccttaattaaaattcctctacttttctcctccagtttatacactaatgctatgttttattacaaattattttcactttagactattccacatttcctgtagttgatatgcaggttttgtacaatattaggtttcacttggtacacctaatgggataatttgctcatatggaagtctggtatcacttggaaactttctctatagatgaatagttaacatgtgtcacaaaaagatgacaaaattccacaacaagaatagatggctggatgatatttccaaataccaatatctcctaattgaagaagacaggtttagcttcccatgtttctggcagtcactgatcacctcagtaaccactgttgtaagaggtgtctggatggggactgagatgagggaggaggtgttgcaaattttgttataggaggaaagcttctaaaaacatatatggactttcatgtaatgcaaactgctgagctgggctgaaggtgctgaattagctgctttcgtggtaatgatggccgtgattaaagaaatattctcaagcttctttaaacccaaggagcctctgttttttagatcataagaaggggtagaagtggataaagaaagcaagatgctggttatataagcaaaatatattaatctatacttatcagcctagatatatattaatatgcatctcaagaaaattttaaatgatttaatattggctggtgttttacaactaattttcgcattcttaattatgcttgactctgacagtgtgatcatataatacttttaaaatatggaaagaaaataccagttaactgatatgtcacctctgctacaagtttcttgaccagccttttcagcagtgttctcattttatttacattctccaactcctgctttttaatcattacataactaaataatagcatatgtttgcttaaaatgttactaacctttgacttagggtagggagcatgtcttattcactgaatacgcagtagtctctacatattttcaggttgaatgaaaggctgaataaacaaatgcttatttccagtggcagtattgaacagctgctaattattaaaaattcagaacgtggcacatatcaattctaataaaggaatagatgaattaaagaccttcccactgaatacagccaagaatcctggaacaaaatataaaaactgcatctaatgaaaagcctagcagacctccacaagacagggatataaactactgggaggtacaatgagggaaagggaactcagggaggtaagctagagacgttcctactccaggacactttcagactcagggaggacagccaagacaagaaccagaatggtgagaagggagggaacaaagattgaggtcctgtgtccaccaagtgtggagacctggagtattatcacttctcactagcagatatcctaaagacttcaggaaacaaaattcaaaagtattcattgttattaaggccaagaaagaaatcccttttcttgtttgggacccaaaggtctccaccatgaagtggaggtacaggctataccctgaagatccagaaaaatgtcaagcattggtcctgaactgctaattccctcagatacacataaaaatgaaaatagagattccatttttataagaaagatcaattcaggtctcaaattattcctaagggtaaattttcaaataaaatattaagtaaaccaccaaagattataaggtacctctctagacaataggagagccaggaatcatggacacaagaaatagtaataacaccaaagggaaactagatattgaagttaacagaagagatggtaaatctatgcttacagtgttcaagtatataaaagctaatcttaaaaacgccaataacctagagatgacagtatgtaggtaaaaagaatccattagaaattataaagctagaaagacaaaataacttgagatggctttcgcagcagattagatacagctgaagagaaagaatttcaagataggtcagaagaaactgtacacaatgaaacatggaaaaacaaaattaaggaacatacaaaatagagagtaagaagaaaagaaaggaagaagtcttaatatgtatttaattgacatgccagaaaaggagagagaaatgaaagcagggataataattacaaaacgtatcaatctacagattcaagaaacccagtaaagctcatgcaagaaaaactaaataaaattcatatttggaacatccttgttaaatagtagaaatatttttaaagcttgaaaattttaaaagaagccagaggaaaaaaagtcattttatcattaaaggaatgacagttaaatagcagatattttaacacaacaacaaaaggcaaaaagagaaaaaaaattaattagaaaaagaaaaatatcaccaaagtattgaaagaaaattactgacaatcttaacaccagcaaaaatgaaaaacatttttaaagaagcaaaatataacaatatgctaccatttgacccacaagaaaattcctaaatgtggtcttcaagaggaaggaaaattattccggatggaaccttagagataagaagtaaagatatgtgcacaaaaatactcatagcaaatttttataaaagccttgaaataaatgcccgtcaacaatagaatgaataaggaaattgtgatatattcacatagaatagtataaaagaatgaaaataatcatcagattgtgccacaaaatggataaatcttaaagacataagcttgagcaacaacaaaaatccaagcacaagaaaatacatactatatgattctatttgtataaaattcaaaaactaaagtaaattatattatttggtataactacagagcaaaactaataaaagcaagcaagaaagtatcagaaagaaacacgtgaagatctctgggtttctggttatgttctttattttaatctgtgtgagaatgacctgttcacattataataaatcaagctgttcatttattttatgcatgtttttatatctatctatcttatacttcataattttaattttaaagtaaagcaaacaactttcaaattcccaactagcctaccagagaatgaactaccagggaggacattgagttccttttgcaattaacaaaaccctctaaattatgattttcaatcagcatcataatgacctaaaggtatgtttgctgtgcaagggtacatgcacatgagtgtgtacttgtgaattatatgcagtttcacatcttggaagcaggagattcaagaccagggtaccacttttattttctgatattttttctgtgggcattgggatccctacttaaaaaataagcttgctattttagagtttttatttttctgcccaaatcattatttattatatgccaccaacaatttctgaacaaattagggtttaaatacaattactaaaagtttatataaaatctattttcaacttctgagctacttacaaaattagaacacttattcacatggacttggattaacactttgaatcactatggaacaacacattcagcaaaaaattgactccctgtaatcttttgcccatgaagcaacaaagctagaaagcctaattagaattatcaggtatgttttaagatatcttccttggaaaccaatatgacaactaaaattctgcaaagaaaaacaaatagaatgatttattccaagaactcaaaagggcctcaactatcatatcagagtagcgataaaagagaaggccttaacttgcacaggaacagaaaaccaacgctgcaggttctcactaataagtgggagataaacaatgagaacccatggacacagggagcggggaatatcacacaccagggcctgtcctcaggtggggaacaaggggagggagagcattacaacaaatacctaacacatgcaaggtttaaaacctagatgatgggttgataggtgcagcaaagcaccacagcacatgtatacctatataacaaatctgcatgcttagcacatgtatcccagaacttaaaaatagaaggccttgttgccgtgagttaataataaaataaaaggcaaaaaaggcagatacttggaatccattaaaaaatagtaaaaccaaattctagcctacctgaagcaggcacagcatgcttattatggcataaatttttcttttacgttcattccaggcttgttttattcctttaatcttatgtctcttcctttcttagattttaatttatgtaatctttgtgttgtgggaccctaatcagttttgtttcaagctgagatggaaaacatttagtgtgtaaatagaatcctctctctgggatatttttcaactgctggtctttatcaaattaaagatgacaaaaggacacaaaggcagaatttcatatttttctttctggttattttttagcaaatctgaagtcctctgtgatgactggcagagaagcaaaggttggcgttccatactgaaacaggctggctgccaagatgagtgaattctttacctgggaagggcattagagagatatctacaccctcagggttctgcacaaataggcagaaaatataaaatccaataataggcaaaaccccaactcatctaagccaaactgacaaaataaatgtagtttaatcagtaagaccaggtggcagccacccaagagttttgaaggaactcaaggatgaaattgggagaccgttggccaagatgctggatccaacattataaacagccatttccagcaaactggcagattgtgaatgtcattctgttcattagaaggggtcaagagaggacccagggagccttagaaaagcaagtatctcttctacttgtccagtctccaataaaagacagcatcattagatactaaaacaaaaataacttcctaggggaaagacaatatggttttctgaaaaaggaaaccatgagtcactgatttattattggtctctgaggcatgtagataaaaggccaaatgctggcacaacccagagtcaagatttttaaagtgccaacgtgggatgggatgagagaaggtaatggctacatcaagccatatggataagacaaacaatttccataccccttcaaaaaatttcctatgtattttccaaagcaagaagggtcatgctttgagacttgaaagatcaggatgcatgataaaggacatactacttcacattgtgggtaaaaaatttaaaacacattgccatttggtggtattggaaatagatacagatttagtcacttcaggaaacattttttaattgagaattaactgaggcttgggttttatactcagtagtagagcgatagtggtgagtgagacccattctgtcctcaagtagctcccagtgtactacacagatgattctaagacctgtgcccagttcaagccctgcattaggaccagtacacatttatgactaggtggtaactgatgattgagatcagatagtacaatcacaattacataacaaatctcttggggccacagtcagcaatagaagcaatatactgagctgtatggggcatggatctaaagcaaaatgcaaattcccttgttaaaatgaatggcaatggtaataccaacaaatcctaaaaatgttattggtttgtttggtggagaaatagataatggattctgaacacatgaggctctaacattattatccctttaccttatagagaaagaaagcagaaatgacagaggtgtttgtgattactgatgaaatcgttttttaacgtgatgcacctacaaagctttgtggaaagaaaattacccgttgcttattataattttaaaaatacaagaattaagagtatttatcaatcaggaattgaatgaattctctctgtttgatttctcaactttgccaaaaggtctgggaagaattttctgagctcaagcaagaacagcccagacacagagaatgattttggcagcacgaagcacaagagattgatctctctcctacaagtcaaatgcttctcttttctaatcagttttaaacacctaccttcccctttttctgctacattagctggtaggctgtcattctaaagaaatttataatgtacctgtacagaaaaagtgtgagtgttccctggcaggagagaaaatttctttgatcagattgttcagtattttcaaaccatctaatggcatttccataggagctctatgaagaaaagcaagagctagaaaagaaatccccacaaaagcagattcagtttgttctagtttctctgatttaaaagaaaaatgtactttctttcctttttctctttacttgcacactttttaactggcatgtaataattgtcatttgtaatatcaatcattcagaacagaaacgaaaatggggctaagtaacctgcttctcaggtatattttccagcaaaaattctgtcttttcctggtgaccacactgggaaatgacattagtctcctttttttttcctttacgttgtactatgtggctcagcacatcctcaataactatgtgttgaatgactatcccactcttttttctgctactccttctccaaaaataaaagtggggggggtgcgggggagggtctatattccaagcctcctctagaatgaagatgaaaggaaaggaaaagcattgcaagcttatctccaagccctcacatttaaaacctaggcaatttacaattgtgtgtcaatacactgagccaaagatccctgagaaggaggtataaaatgtcaatagataaaattagaaggaaaatgtttgcatctatgtcattaagtgtacaaatgtcttgcctatcaaattgacaaaactatgcctgtgatgtcaaaggttagaacacagacgtatgcatgtacacacatatgcacatatatactctactctgctcatgagaatgtaaatgcttttgaagaaagattaggaaacctgaatttaaaaagcattatgaaagctaactattgctcttccacttctatagggatttatgctaaaggaatactaaagaggaatcatttatacttaaaaggccatctgattagcatgtttcatgttctcatacctgttgagttttttttaaactaaaaaatctgtctcataaacactaaaaatcaaaaatctgatactgacatttttctccatctatgcaactgattcttagaatatattgccttttattttagatcaaagcatcaaaactgtctttgatccaaaacagccacgcaaatcccgcatttacctctgaagtcaacctatttataatcacaggttttttttaaaatccctgattttctttttattcctgtgattctttttattcctgtgattcaaagaggattagtgatagtacaactttgagagcatcagctgtgctttgttcctgaagcagtcctatttactaacacaggaaattaaaaatgcaaaaactaccagtcaatcaggaaatcagcattgtggatgtcagggctttgtaggtacaaattggggaattagttttttccatgaacagcagtatatttactaagtaatttcttttaaactagagttatccttttacatcaacagaagaaccaattagaatcactattcatcaattattgtcctaacacaagccttgtgttaggacctaggcaatagagcttatcaactaatcaactataattttaatcattgtatcttggagttttcaaaaggaataatttggggtaagggaaaaattcaaattcttagttactgctgacatgaaggcagatacttctgaggatgattaatgtatttaatcaaccattcagtttttaaatagatattagtgggttttttttcccctttttagtgaatacttgctaggcactgacaacacagtggtgaatataatgacattctttctcctcatgtagcttccattctagtgggagagaatattacatgaaaaatcataattacaaatagtaattatacacactattatgcaaatagtaactatataagcactttaaaggagaggaacagagtctgagaaacaacactggggaggtgccagtttatcttggtaagtctggggactcttcaaagaagagggtgacaataagctgtggcatgaaggatgaaaatcattcacatgcctcacattttgtatggctcagaacacagttatccaaaatatggcaccttggaggtcactctctgatctcctctcacctttcttccctgaaacatggtcataaataattatttgacctacctcccctaaaaggaggctgttaagaacctcattctggaggggtcctaccctatgcctggaagtcgagaagactggacaaacaggccctgcaaagtccccccctgccagcttatgaccatacttctgcatgattgtccagaaaaatatagttttccctgggcctttggatcttcatctctgaaggttcttgtttcacaaaaaattttggttaaataagtttgttatgcttttcttttgtcaatgtctttcgttatggggaagtcagccatgaaccttgcaaattggggtaaggaaaagagatgactttttctttcttacatgttcttccctgtctggttagcatcactctttctggtcttcccaccatctccctggccattctgactcagccttcatggggaatccttcctcctctatctaatctctcaatgctaaagtttttcagggctaagttctaggccttattttcttctaattccaaagatcctcccaaggcatctataacccattcctatgacctcagatatcatctatgtgttaacaattctgtaatagactttaccagtccagacttcttttcttagatttgggtccatatgccaacttcctatgtgacttcctcacttgaatatacctcttaagaacctcaaatttactatgagcagcactaaaaggtgtttcactctcaactctttcctccagtgatcttcatcttcctaaatggaatcattcgttcagttgctgtatcagtaatcaggatgattacatgacacctgcttctctctcatctcccataattgataattgataataattgataattgagccctgtctaattgatagctaaaatgtatagtgaatttcacattttcccatctctcttgccatcaactctggcatagatactgcaagcctttttcttagtcttccatctattcttgttcccctccaattcattgtcctaaatgaaaattttttccaataactcttttagttcttctgttgttctaaagatcaagtctaaaatcatcacaatggtctctaagacccttcatgatctacccactgcttaatcctttagtctcatattatgtcaatcttcacattattctctatgcctcagccaaaatacgcttttttcagtttctaaaataattttttttaaaaagggcgttcctttcttaaagaattttcacatgatgttccttccacctgagacatcacctgctgtgtattactgaagtactatactcttctctgtattagacaagggtgcatttggctgcaactaacagattacccaatggagatggtttcagtagtaagaacatttaattttaaccacttgatatcgcaaagtctgaaaggagtcacgttttgggggtgcaacatttcaaaattaccccaaaccaagactttccctttgtttctgtcattctgtgcatattaattttttaaatttagggtaattgccttatggtaacaacccgtatatcatgtctgatgcaactgcattcaaggtagaaaaatgcgagaagaatgctctcgtataaaattattctcaaggtcctcaccacatttccctacatcacattagacataactatgtcatagaaactgcaggggaggctagttaggtgaatattgggagataggcaagaagagaaggaggctggaatgcctgttgatttttacaatcaacagagtctgacatttgttagtgcacttatcaaaacagcagttaaaaaattaaatatctgcattttgttcattgtcttccctgtgagattataaactctttgactctggggaatatgtctgtctgattcaatgctataagagcctagactcgcacagtgtcaagcctacacagatcatttatgctgattgatggaatgaattaatgatatggaagagagtaacagaggcagaaaccaggtacaaaagagatagaaaactgccaacacaaaacttaaactgattgccacatctcatatctcatggtttagctttcctattccatttaaattgaaaacggtcttttcattaaaaaaaaaattggcaactttttgaaagtgctcagttctttgcacagtgaatagaattcccctaacctcttaattcatgccatgaaaatagacatgggttttattgtcactaagattcaggaatgaattctttaaaaaaaaaaaaaaccctgttaaggagttatatgatccagaaaaatttaaattgcctcaagtacagaaatgtaattcagttgttgtctaaattactcaaatatcagttaataagaaaagtatatgaaagctagaaagttacttaagagtagtcataaaatttttagtctaagttctccactccttagcatatcacaccaacagataagtttgtcagattggccgatttaggtagaaagcaaatgtaaaatacctcactcataaaggatgcttgatacatttttgttcttatacctagaccaaaagaaaacttgggtttattcctatctctgtcccatcctaaatgtgtacctatgggcaagttgattacgttctttggttcacaatcaatatggtaatcttaaactaccttttagttacaaatagtcataccacaattttgaaacttaaatttaaaaattaaatggtattgaatacattcaactctatccaacctaataaaacattaaggaactgattcatatttctggtagtgtctatttctatagaagcaaaacctgttcctagtttctgatggacagtctgatcatgtcaaaacgcacagggcactaacataaatatcacaatttctttaaaaagttgtaaatagctacacatgcaagactaggtttcaagttttaaaaatagttttcatttcaaataaaattccttaaaaacagaaaatgactttaacattggcaaagggagtcccctaagaaaaaaatgtaaacagatggctgagaaagatcacccacatgctgaacacagatcttgaggaggcatttctaagaatgaagtagcacttcccagcctgggccacttcccacaaggatccttatttaacccatggaaaacacagagtttatacctccggccaagaggagcctcaactttttttccacttgcctcacagtgatccagacagtttccaactctccctagcattccaaaagaagctaagtaccaaccacttgggatgagcaatcccctaataaattagtgttcgaagatcagccctgaacaaatgtcttcccatataaacgggctgttaagccctagctaagcgtattaagtattcaatttaatgtatgacacacatctgttccactttctcagtgagcagaagtttcaagataacttaaatcccagacttaatcaaggagaaaaaaatcttggcaatgtttaaaactgagttttaaaatataatccaaatgatggtgagagagagaccattttgctgtaactaatgagattatataatacctaaatcaaatccacaaaattacctgagcagaatcactaaatattttatctaggcttatttgtctttcatgtagagaccatcaacacatttcccaaacaccttcaatttacgcctcgcccaagtcaccaagagatgagcaaaaatgaagcccttggcaagcacagtggcttaacccccttgaagcccaaaggaccacaagaggaaaacttacagatttgtctttcacaaggagagcacagcactggatcccagccatcagcatcttgtgtgggttccaggccacagagtcagccctattgtttaaacaaagggacagagtagggagaggactcaattagtttctacaggcaatggaatactatcattatcaatatctgcattcagtactcatacatagtttactgttctatagaactccttatctgagtggtttaaggaatttggagggattttttgttgttgtttatttaaggaaaacaattactttgttttttcctattttcaaaatatcacttagtccaaagagatccctttgcctgacaaaagttggctgtacaccaggaaactacatttacctgtggatgccatgcagaagcttgcggtgcttcctcgacatcaaagctgagccaccccaagaagcctgttgagatatttacagtaccagaacaatgttatttcaatgttatttgtttaccagtgggttgtcatagaaaaccctcagtgaggacctcaatctgcattatttgatattttatgtcatgttaactaatttgtaccccaggaaattctgatcactggctctactcaggcaaccagaacctcatcacaatagatgggccctcactgacccttagaattataaattcatgcatcataaattggtatattaaccaactgagctatgtgtggatggaagaggttcaaagtccatgccctcttgaagcttagactctaacatagacaacatcttcacaatgctaacattttgctattcagtgtatgatgagacatgggctaaggactagtattttatataatgaatgaggcatattattgacaaggtagatagaaggccaactaggatgagctaggcggaaatatctgttaatgaaaaattagatcattttagctaaatggctttcagaaatatctacaaatgagagagagggcaagcttgggacaaaaggaagttatccactggagaagtaaattttgtgagcaaaggagaggggagctcagataaaatcccatagtcaacaggtctggagcaaagggagaaaaattgatgtaagaaatacaaaagtcagtatgcttcttgaaaatggtgcagacataaattttaatttgtaggacattaaaggataactgtattgagagaatttgaagggactagcttgggctgtattgaatgctttccaagttgatttaaaccttacagcattccattaggaatggagttatgatcacttccactttttataaagttcagaggtgttcaggtaaattgtccaaggtctcgccaatgacaaaaatcagatctgagattcaaagcccattctcctgtcatgttaacatcattacttaaggaaggtgacaatttggccaaactggggagtatagcatgtagaatgagggtgacagagatgctttaggcaataggtaagttcaggggttgcttaggatgtagcaacttctatttttggctatggaatttaaaggcataggtagaccttaatatcatgtaaaaagaagtggcatggttggctgcaccacagatatggaagataaagaaaatgaagtatctccacgatcctcagagtattacaaaatttgggcccattggtagccaataacaagaaagtacagcacaagcaactttgtggccttaaatcccacttaaaaacaactttcattgacagctgagactagggtgaagtgaatgagtcagggtgcataattcaaggaagaactcatctcagagctggactcttgcaaggccctaagagtgaatgcttcttaaaatttgagccctgccaaccccactggcctcatattagcaccagccttgtcccatggactaaaggctccatcaactccatggggtccccagaggcctgcgagctctgatgtgtttcaagggtgttgggtgttcaaatcccaaggattcccaggtaaagagttagtaacttggcattatcagtcaaattcccttcctgctgcatttcctcccttacttggattcacaatggaccacgtgtgactcaggctgagccacaaaggcaaatgccctcagcatctaggaaaattttatccccagcctacaactgaggatctccagatctggattttgagaacttggtccttgcaaatattaagatgtgttacatatcacatttttcttgactttcattacatattctaaatcctaaattacctacttttctcacttctcttatcccccaacctctctgagaacctatcagtgacaactacaggaaggattaattagtccagtcagccacacctgtttgctcgctcacactttccacctgcctcataccctacacttctactccttcatgctccctgagctagcctctgcctccactgcttctccaaaaaggtaaataatctcccaattctagtgaactggatttaagttttgaaatcacaggaacccttccaaggcattagttcaccacttcacaaagtactttggcagggttaggaacagctcatccataaatttattccttaaaaaaaaaaaaacacccctgatgtaaatgccctactttaatttgctgcactctaattcctaactccagaaactgtgaaattatcaaacctatcacctaaatgatggagtttggctttccatctcaataaagactgtcatttattaagctattactatatgtgaggcaccacagtatatcattttatatatatttgtctttaattagttaataaattaatagtagaaccaatcttgaaagggaagtgaaggtaagaatggaattgagatttggcagcctctaaaggccatgattttaaatacgtttgtgccttctatggcacttggaatgaggaatgggtgagagaataggaagctttgttgggaatgagaggctttccagcagctacaacctctgattttgaagaagagctagaccagcccgacgttttgttctcagacagaaactagcataacaattgccctcatgaaggaagagaacagtactggagtgaaagagtctaataaaactagtttttcttattcggttgtttaaaaaacgcattatattaccaaattgaagacagtatcaaatgtaagcacccccattttttgtgtactactaataaaaattgacatcaaaatatcaatttcagagttaaaatttttttaagtaagtgcatcttagaattaataaaacatggtatgtatgcagagcagcatggttttactgaaaacccagaagaacaagtaaatgtctttttatttttaaaaagagataaacatcagtttaatatttgaaagaagctttaaaatactctagaagatttcaaacaggtcaaagcaattattgcaatttgttaatattttctttaataaagtacctatggcatatgaagtttcttcaagataagctacatgttcctgtagtaatattttattgatttgacacccacaatactaaaggatgggtaaacatgtctttaataagccagataggcttgtgtcaaatttaatctaatactataggcatttgccagatgtatactatgcacaaataggataatttggtgtggtttacattcccttataaagatgttttcttcaaagactcaacctttaatttttagaaaacctgaagagcttttcattcataaatcacaattttctctaagccccataaatctcttaatgtcattcccaatttaaaagctgctgtggtgactgttttacataaactatttacttttctccattttatacaaactacataaactatataatccatatgtgatgtttcttttatgagagtacaatatttaggtagaactgctgatgtatttgattttcccccttatttccacagttacaaaaatgctcacttcatattatcttttaggatataatgtattgttatgcttctaagtctataaaaatcaataagatataagttgaaatatgaacagatacaaatgctaaaatcccgttaacgagtcacggataatctacctcaagtattgccattggcatactaatagaagcaataactctagtaaactttatactactgttgcttttacaaatgttagtattcagttaatgtaaactttgaatcatatcacagacactctactaggtgatatgatttgattgaaataaacactttgaaagcataaaatcatctaaactacaaaattatgtgggtatatccccccaaatgctgtttccttttgttcagcaagtcaaaaaatatttcttctgccaaggaggatctgaaactatcacttaccagaggaaagctcccaaaacaccatgtgcaattgtctctttggttagaatcaaactaattaactgctggtttcacacaaaaaaaattaattttaaaaaagaaaattaaaaagctccacaagtgttcatagttggctgaattcagcattctaacccgggataagtagaatttttaaagttaccttcgatttaaggaaatatgtattttgaataaccgcaggacttacaaaaattcttttaaaaagccaatcctttgctagaaaataatggagtatattatcccaacccccctcaaataactatctgatagatccagagaaaatttgctttagttatagcatgcaattatgcattgtagcttttttgcattttccagctgtttggaatcataattttagagctagaaagataccttacagcccacatctaccatcccccctctttacaaatgaagaaattgaaatccaaaaggctaagatcgcaatgaagaagaggcagatcagaatttcaaaccaaagtctctcggctccctaacctaaaatgggtgccttacaccaggctgcttcaatgacagtagatttgaggaccaaagatggctcatgggagtaaaagaagcaaaatggaatccagaaagctaaaacaaaatatacacaaagtcgtggaatcttctcatttatactttacaagaaagtggcatacttatttcccccaatttgagacacaaacaaaagcgttggggactccacatctagtttctgagaataagaaaaatttctaccaaggctacaaaaagaccaaaggttaaacaggtatgtacacataaatgaacttacatctacatgaagccagaggctgtgcctctcgcagatgtctgctatttcatccagagggtcaaaagctcccaacacagttgtaccagaagtggcacagacaagaaacggtgctgccccctgtaagaaggatccacacacacaaaattatcactgtcatcactaaatttgtcctgtaatagctggaaaatataaagggttatgcatccagagagttatttgggttttttggaggtagtcattaattcaatgggtgtttttaaattttgtgaatatgtggcctcttggcattataaacagattaaggaaacagaaaatgctatggcaatagcattttctgtcccaactcagtacatcttcagtattattctcatgttttttgtaatgttttgttctatcaattgtccagatagaaatttaataacttcagctgcaacagcaaactgacattttgtatgactcctaatttcttcctgaaaaaatacatttagcctccattgtgccatcattgtcatcttctcaaaaaaaaaaaaaggttggaagacagagctcccggagtaaaccatgcaggcctgtttgctcatctccttgtaaagtaagtgcagttataaaacaaagaatgtagaatattctcaggtacaaattcagcatcagaggagataaggcaacctcactgggatacattctccaaaataggtgctgcaacagagaaatccattggcatgtgctggaaaagaaaatctgtgtcacttctatcatggttattcctcctcatatagctgatgactgcatcttgtggcatgaacgggtactggtgggaaatagagaagaaaagggagaatgtgggtgcacacaaacagatgaatggttatctcggtcaagctagtcacatgctttgtccccattaaaggactctatgccaatcagatagatgaagagtacatgagattgtttccaaatggattgctccaggatggtggtagagatgtgttgctcgctgtgtaggtgaagtttgcagacaaatgtgggggtgaggggagcaagtagaatattaagattctagagcacctgagaaatagacaagaatatttactgcctctgaaagtttagtgcctctaaaagttatttttttctccatttagcatggagccattttttcccctcagttttataaagtgcatgctcattgcaatacatttttatgtcctttaatgccagggattattgtgtttgaaccaactctttccaatttaaccgacttttgacagaaagatgttatttctcaatggaaagtggggcagagcaagaatatgtggttcgcctctctaaactgagatgcatacggatcaaagtggtggtatataacaaatccatttgccatcttgggagacagctgtggcaaatagaatcaatcccatctacccaaaacttttagagccaagtcagtaggtgacagagccctggagaaaccagaggctttgaaacttcttccctgtattcaaactactgacaactatggctttatcataccagtgacctaaaggacataagaccagctttacaccaatcattaaaatcattaaaagcaatagaaaaataatttactaaaaccatttaagttgtctttaatggttgcgcttttcctcataaactatatgacatcctgacagtcatgagaaaatacatttgcaagctattatagcctattaatgagttttcctcacctttaaaaaaagatctcattaaaaatacaggaccagaaattaaacttttgcgatctggatttaacctagactttcttccccatatctcctgctgttaatgagaattcagtagaaacagtattgatggcatgctgccagtgagctgtattgtctaagaaaatttgtcatttctaacacaactctaacaaaatgtctctaaatattcaatgttcatcctagtttgagcttgtcagtaagccctttaggacctctgatgctttgtgtttttcaccatctatgtaatgacatcaagacaaggtcactgcaacagtttttcaatggattgtcataggccagggagttgaatcccagcagaaaaaatagttgatggtactattcctcatatctgaaacaacataagttaaaagcttgaaacaaaacaactaggcctgaagctactgagaaaaaatgaaccagtcatcatgtattattatctcagaatggatgcaaggtttgtccttggtgaatccaggctcaagtattagctgacttgaaagaaaactgaggagacgtactaactctaaccccattgccctacttttaaatgtgcctaaagcaatttttacttttcaaaaacttacttttttgagttctcaactttagtattatgtccgtttcatgtactttcactgtcaaaacaaaaatttgagcgacaaaaatgataatgactgtggtggaataaaaccctctatgctagaaacatgaattcctaatgacactaaaaaaaaatggggattatctttaggggatgctaggcaacaaactcactattttaaaaattgataaataaggggaaagaataagacgtttatcctgtcttgcctgtgcagtgtttccttagggaaacaaaatgaggaggaatatttttctttatagtagaatgcctgacaataaagaaggaaggagagaaggaattaggacatcacttaatgaaataatgggtctagacaatgatcatcaatggcagcaaaaaccactaagtgagaagctgatggagtggagggtattgtgatggatggactgacgataccagaccccaccaatcaatgttattacaaaagagacacaggatgtctcctgatggcaggagccaatgaagcctccctggttttaaaaaaagaaaaatacaacttaaatctcattgagtctcaagatctaactgccaaattacagaaaatataaagaacaaaccggatggtgcagaggaggtgagcacttagggtctcaaattcttgatgtaatccacaaaaatctataatgtggaaagctatatgggacaaaagacctgatcttttcaacaaatcaatggtagtggggggaaagaggaggaggaggaagctatagatcagaaaacatttacatttgacgtatcaaccaaatgcaatttgtgaactttatttgaatccttgattcagacaagtcaactattttttttaaaagggcaatggggaaattttaatatacactgaagatttgatattaaaaattatattttaaacaaaactatggtatgttgtttaagcaagtacgtatccttcataaatatactcaactatttatagatcaaatggtattatgtctggggtttgcttcaaacctatctagtggtggtatgagggtatgtggtacagatgaaataggagcatgagcctaatgactgctgattacagaatgggtatatgaagcctcatgatattagtctcttggtttttgtgtgttttggttttttaggaaacatttacaattttttgtaatgagaagtttaaaatttaagaagtggggaatagggaatggagaaagggaggaaggaaggagaaatgagggagggaagaaagacaatcatgacacaattaatattccccaccaacaagcattaacaacataatgcaaattatttttgataggaatttatgtaaaaagaaatgaaactaaaactagaaaacaatatctgtggttctcagcagaacgaacttacaagttgttactcagaattataccagagtcaaagaaatctgatcatgcaaaccaccagataacaataaagttcacttgtcattggaatgtttaaaaaaaaaaaaaaaaaaaaagtaggacacacacctgaagtcaatacatctgcaataatggcagaaattttaaatacagaagttcaagccaaatattgtgatctagcattctccaggactaggtagtttttatgaaaacttgaaaaaaaaaagtacaacaacagaactataatattcaaacttaaaaacattaaaaaacccatccttgttaaagtatgaactcctatgaggatagatacacttgtatcccagctcaggagccaggctttttatttttcagtagtcatgcctgcctttgttgctacctattggaaggttattggagaacggtctgaagctccatcagcaggcagcggtgggatgggagagaagcagcaaatctagcaggcttttggtccaaaaagcaaaatggctgagaccaaaataatgatacacctttttttttttttttgagatggagtcttactctgtctctcaggctggagtgcagtggtgcgatttcagctcactgcaacttctgcctcctggattcaagcgattctcctgcctcagtctcccgactagctgggattacaggcatgcaccaccacgcccggcgaatattttgatattgttggtagtgacggggtttcactgtattagccaggatgggctagatctcctgacctcataatctgcccgcctcagcctcccaaagtgctgggattacaggcgtgagccaccgcgcccggcctaatgacacccctttttaaaatgcaggtgttaaggccagccttggctggagcacagcaggtgcccagagccatgccttgccttctccaatatttcagttctaatatattctagcagctaaggaagaaaggatgttctgtcactgaactactagatacagacccaacaggggttgatagtaatagatgggtttgggattggaagcaacctgggagaataggttggtcaagaaatcaaaaatcaccctgaatacagcccagagaaaattggtttgtcctgcagatttctcagagggaggaattataaggagaggagaggctagggccctgctggagaggctggattgatccttagagctgcttctagccaagaatcctgaatacgggtgatttcagtgttttaatagtctccagccacctgggaacaagaatatccgggaaactccacagaacatggagagccaagcacttggaaatagaacatctgtaaatgagttttcctattttaattccaacattctctctcctctctcccacacatagaaatggttttggctgtttgcattctctccttgctattccctctctttcataagcgcgcgggcgtgcgcgcacacacacacgttctctctccctctcgctttctcccctctcacctcttttctggcttgccagacttgcttctccagttcctcaggtatcattttacctctaagggacaaagatttgagactttcagttatgtttagtaattaacagataatgatactgctttataaaccatataaacttttccctccacccaccaggcttccagatcctgttcccattaccttccatctgtttccacaaagcaaacattctcagtgccaatcccaagaaaagaggctgccttcttcatagagtaatgacactgaattcaaagggacagtggggaagggggagacatgaaaacatagcacaaaaaaagcattgcttattatcaaaggtagatgaaagtatggctgagcacaatctttgggacattattgcataaaaaagtaatttaattgagctccttagcatagtggttgagaacattcactttggggtcagagaaaccaggattgaacgtcaagtattccagttacagctatggaatcttgaacaaataatatacactctccaagcctcaatttcctactctttaaagggatcatgccaataatgcctactccatctgctcgtgctagacaaaaatgggttaataatatatgtagagggcttagcacagagcctggcacatggaacaaactaggacaccggaggctgttgttttccatcccattgagaaaagtaaagtttctcctgatgctcctcataagacttagtattaatggaaacttagaatctagtccactgctgacttgaaaccctctaaggagagggcaagactctatctcaaagattgcaatcacaggctagagaggaatctaattatttcctagagcaaacaatgagttataagtgctgatcagacacttgaccaatcttgtttaatactgaacacaagactgaaacacccaagaatgtggctaaaatcctaagaacaaaagtaataatagacaaactactttactcagctatggcatgagtgaggctaatagatgaatatggaattaagtctggtctatttcttattgataaatagtagtgtgtgctttacattattgggccttctctatactacatgaagcccataaaataattagcatgcaaacattggatatgtcgctcttcatacattagtgaggacaggtggtcaattaattctttttcttgccagaaaaatgaaggtgctaaaggacattattgtaccaaaaaaaaatcttagtaatttgtaggtatgaatacattaaaagagtagtcatgccttcacacttcacttgatatattccctcaaatgtggtaatttttttccttttgtcaggagagttttattgggagctctttttttaactctgtaaaaataaatgcagaagtaacatcaggaaaaatgaaaccgttctaaataattaatttccaaatatcaaataggacatgtccaaaatgcctgtaggatgcttttatttcaggttgttaaaagaccatatgcatattgaagagtaataatgtacaagaaagtgtaattaattctctacttgctccaccagcctatgctggctggcggtaacctgcctgccatagctaaggtgacatagctcgggtgaattatttctcaccagagagttgagctctggcaaccaaacagctattgatttcataatgataaatgctagcctaccccactgacatctaactataaggaaaagcacaatgctctccccctgagaaatagcaaaatatctccaaccaatgaatctgctgaataaaaatcttgtaatcagaattagaaaagtggagctatctttaagtacctgagggcaaaatacaacccaatgtcaatctgagatagatagatcaaaaaaaaaaaaaacaaaaaactgcaaaactgaagtttaaacatctgaaagcttcagagaaggaagagccctggaagggagaacaaaagaaggtgatgcttcagacatgctgagtagtttcaaggaaaggaaaaacctagaaggctggaattcagaagtaacaactgcatttagaaacaaacagtggcgtttctatcattggcaaaagataagtcagttgttctaagactcaacctccccacaggtttcataaatctacagaagacgaaaaaaactctcagcgggtgttcatttctataaagataaaatagcaagtgcctacatgaaagagagcattgagctggagttttactttctggctcccacaaggatttttttctatgaccttgagcttctcaatgaactgctgctttctcctcaatgtacactgtgccctggacacctggactccagtgctgactaatttgattctcaagttagctggtagagagaacggggtatataaatgtacactgtgccctggactccagtgctgactaatttgattctcaagttagctggtagaatggggtacataaatgttacattttagagaatgaacaaaaagagtgtccaagggatgtctctaacaacacacagctggtttaattccccaagaggccagaaccagaagccagatagactgaacccagcctcatgctctgcaggatgtcctacgaagcacctgcttgcccgtggagaagacctgcaatcacatcccatcgcaactcaacctcagccctcacccagcaatcaggaggaagagaaagaggcacctagagtgcaaaatttagaggcatgaccctgagacacaccctacataactcacttgcctctcctggcctaagccctgctagagaggagctagcccattgattactggcctgggaggtaagggtttctttttaccctactttttagtggcaaatcataattactgctttatgctaattccagaagtgatctgaaatatacaggaactttacaaacacgggatttctatacacccaagaaatttatatcaaagtgcaaaccaagacatagatttattacttttatttctccaaaagtccccttctcttagatgcctatttagcactagagaggcaaccttggatatattgacagtgcaaaggtctttgtcatgaccttgcaggtctttatcaatagtaaaattacaataaaagcctaacacatgcaaaaacaccttcagtggtgggtacgtatattctgcactggatggtgcaagatagaaatggagtaatttggggtagcacaaaaactggaaaagactacctaatataacagtactgggccatggaccaaacccttaaaagaaaataagggaggtatagcaaaaagactaacgcagagtttaagactgtttactaaacacaaccttctttaattctttaatgaaatagatggatttgttgtaataagtagtaaaggcagtcaataaaatatgaattaaaatagtgcaaatgctataacctgactctttgagtagggaaaggaatgagctgcaaagtagtgtcttgaccaatggagtcaaaatataaattcaaggctacagtgtgctcgaagtgatgtaatttttctgtggaattcacacctagttcttggtttttctggctccagcttctgctgacatgttagccaaggcatatattttgcctctctttggaaagtttttaaaaaccacttagttatggtttcacaactacataaggtttcaatttcttttcactcccaattcataagccccacctgttactgatctttcccaggcgtaatctctgttctaggcttccacgtaatatcttttccctttccatggtaattattccagaaaagaactccagcaagctttaaaccaaatgaagaatgaaaaaggcaaaagtaaaaaacctgagctgataacctgggcgctatttaatcagctttcccaagcttggaaatagcagtttgaatgcagaagagactctgcatttattatccactggggtccctcacattgaaacatccagggctgaagcatgaagaaggaaactctattcaataacaatcccaaataatcaagtactttttcccagctgtccacattaccaaacattcttctcttggtacagaaggaatgacttatgaacaagagcctcgaatggctgagttaagaatctcaggctagatgattcctcccagttgcctcctgtcactcaactcccactttgcacttagtgctgaaagatccagagcaaaggtcagagtgagaggaaaacatgagagtggtcatattttctcctactgaggagaaattagtgcacaatttgtccttttgcaataagaaactaacttttgtatttagaagaaaatgatagatacaggaaagcctagctggaaataacagactctcagttttttattttgtccacttcatgttagtggcaggatacctgatattatctcagaaggtaagaagctaaactcattctgccaagaacctgggtgatgaagcagtggtagaatagacggaggcatccactagaatcacacaagaataggaaagggaaaaaatctcttccaataaaggctgcacttaagccgtgccatctacttctgcccaccttgttgcagctggaacattctcctagtaacaattatagttaatattttaaaaaatctattatatcccagatgacactttacatgcaattactcatttaacatttgccaaaactcactaatcagcaactactgcgtggttgctggattgttctaatggttccagttgttctctgttccgtgtattcaaatcctttgcctggtgactttacagcaagtccccccatgaggttgtggggtctttcttcccacatcttgggtctgggctcacagatgggattttgccaagaaaatgaggcagaagtaacaatggccagttctgaggctaagactcaagaggcctgatgtgttgccatgcccttttatacctgcaccattgccatgaggacacacctagactgacctgatggagaatgagagacataaggagcagagaggcatcactggaatcatcccagctgagccactcgtagatgggccatcagccagccaacccctagacatggaagggggcccagccaagagcagcaaatctgcccagctatcttgagacttataagtgataatatacagttatagaatgataactctatatttggggtgatttgttggttataaaagctaagtgataaacttatttttacaaatttaggaaactgaggcacaaagaaattaactcactcaaggttactcagacagtaagtgacagaggcagggactgaatccaggcagcctaactcaaagcctatgcgcttatctactgtctgacccacctactttagtggagagtaaaataagagatggagaactgtggcaatatctgtgtgtgtgtgtgtgtgtgtgttttcattgttactgtatatctttcttttccctggaaaagtaagatacacatcccttatattagccaatcaaagcaatcattttaaaaggaaatgtgagtagaagacatagctgagatccacagtgttcatctaagtactaacaaataagacattcaaaaaaagagattcacagagatagcactttcaaattaaatattcttttcttaaaatgttgttacagactataaattttaaataaaggtaattatacaaaattggaccaggcgttacaacatcaaactcgttagaatttactttggaatgaaatactatgttatactgcagcatattagtcacatgggtataggacaaaatcacatcaggaatcttcaaacaaagccctcttaaatatgctttctcagaaaatctatattcaataccaaaaataatttttacctctgcagatgtgaaaaggattaatcttggcgaaccagacagccccttttccttaatatcaggacaatatttgtatctagctaaattcattgcatacatattggacactgagccacctgcaaaaacaaaattaaaatggcatatttatagcatgaagttatagctcgcaaaatgctgaatacagtggaaagcatgaatggccatgactgctctagtctaatgaaaaatcaccgtgaaaagcacatgaacaccgacctccctgctcccattattctgaatattttattacataccctaatctctaattctagaacttttattcttagaagataaattttggtttattcccatgacaggctttttttcaaaccaaaagtctcaatctgtgagctctggacttagggcctttacctaggtctccatagttaatattctttgtcacctaatcaataaaattgaaataatatttgttggtctctggctacaaaaaaggactacaggataaacaaatgtaattcagaaatcttctcaagtaaaatttgattttaaaatttagaggacttacagcccttccaaacttccagcatcaaatcgattcatttgtgttagatataaatcctaaactgtaggcacctcattcattaagtatgtatgtcatctatttagcattaatacaaaatattatcactctggagaaaggcataagctagattctcagcaagtagaattattaatatccaactttttgtcgtgtataaatctgcaaggagttgttcctcatggataaatttttacgtggttgtattggaaggttgatatcaataactaattgtactcacctgggttaaatattccatccccttctttccagccaataaattcaatcattttcttcagaaccgcttcttccactaacagaaacactggggacacctcatacgtataactagatagatataaaaaacacttcacttctatgactagagtcaaaacattcctttggtgtcccaagaaatgcacagagttctattaaaccaagtggctgctgaagtgtaggcagtctttggaaatttatccattgaaaatagagaattactccatcagtgacagcactagtcatggttagataaatgccaatagcttgtggcctcagggatctgcaagttgctgcagcagtctttcgagaaaaacctcaattccgtgaggagcaataaaggcaatgcatttgcgtgctatgtattagccatgagcagtggccatttcactctgtggatgcttggaacactgacttggatgctgttgatggtcaaagaaaatccattgtcatggtaaccaagttttatcagattactgccatgagtatgctaacagtcccctctagatattctaagtggagactactccacctgaaccagggcttcctctactacactctctgtgtctgtataaatgaggagtgttttgtgagacatctcttatgtgataattttactgcaaagcactacccaaatcccttgtcaatgaaggatgtgttgctccgggctggaacgctgttgtcagagcattgatgttttagcccctttagagattgccttggctgcagggagctacctcctccagggtcacacccattcttgtggtggtctacacctgataactgctggagatgtaaaggcctagccgtctgggcctaactccagacccctcttgaagggccactgtagttccagagatctccgagcgtcagccaagattgtcatggagcctgcgtggcaatttgactcctatacttgccctttcttgcatcctcctcctccttccccaggtcgtcactcatgttgatcccaagggtactccttaataaacgtcccactcactaaacaccatctagagcagcattcttgggaacccacattgtaacagtcaccatgccttgtttgatatttattttctctctccagacaacttgagggtgactacatatctatgatctccttttcaattgagggattacattaaattgtatctgaataaatgtgtactctaaatatgtaagttaagcagacacatttagatttatagtcacagaatttaatgcaattattttaacatctggaaaggaaaactttggattgaggcataaaagctggtcacctactatgtatcacctactatttatcacctacatatgtgtcaactctacagatgttatgccatcttaaaaataagatagattcagctgggtgcagtggctcatgcctgtaatctcagcactttgggagttcaaggcgggtggatcataggtcaggagttcaagaccagcctggccaagatggtgaaaccccatctctattaaaaatacaaaaattagccacgcatggtggtaggggcctgtaatcccagctactcaggagactgaggcagagaattacttgaacctgggaggcggaggttgcagtaagctgagatcatgccactgcactccagtctgggcaacagagcaagatttcatctccaaaacaaaatttaaaaagatagattctgtttcttaaccacgttatgaagccagtgtacatacacaaaaagtatgaaaaaagcatatatttatgtgaacctacaaatatatataaaatagttactttcataataaaaaaaaaaagtatttagcctgtctttgaaaactggctcaattataaacctaggaatcagcctggagggtggaggaaaagataagatagaacacactcatgggttggcatattttgagtggatggtttagcttagcagcaatttaacactcctttaatctgaaatatttagagatttttgaacttagatgaagagttagaaaacctgggatatacaagaaaagattgaaaaaggtgtgtaattttactgtctctcctgacttaccctcactgtaactgattgtaacctggtatctgctgtcatcactccatcaaaacctccctaaagttgccagtgacgtccatgtagctaatccagtggatgctgtttaggctcttagttgaatattcaacaacatgtgacactaggcatgctctcctcgtggctgccacagctagccttttgtttttttccttctattctcgccattgtaagctgaccctgttcctcctaaccattaaatgttagatgtcctcaaggcccagtattgagccgccttctctccccactctatactctgtcccctaggcagtggttctttatcttggcttcccattgaaatcacttgttgaactttctaaatatatcaatgcatggggcacagccacagaatttcagatttaattggcctgggttggcacccaggtatcaatacatttttataaaattctcaagtgattttcatgaatagtcagggtggtgaatcactgacataggaagtctcatccacgtccaccatttcaattaccataatttcactgataattcttaagtttatacctttcatatagacatcagaattccaagcccatatatttctcagcttagttcctatgcattcttggatattttaaagtcactgcaaactcaaatgcccacaactgaaaatgtaatgcttgctcttgcctccttcaccatatacttgaaaaccagttccctctcccagtgcttatttctatgaatgatatgaccatgaacctagctatgaaagccagaaacccaggcattgtcccaggagtcttctcccttttactgttattttcaagctgtgtatcccatcctttctgttttattttttgaactcattctttcccgctctattcctatctcttctctccaagtccgagctactttcctctctcacccgactaaagtaatgccctcctaacgggtcccctccaacctatttatatttttagagattttttcagtaagaaaatggcacctagtgacttagaaaccttcaatggctttttgttacatttagaaagactcataaacatggtcacctgggccctatatgtctggcttctatctctctctctctttctctagtcttattctccactacagtcctgtaactctctcagctgtacccacactggcctttcagttcatagagaatggcatgctgtgtcctgccacagggcctttatacatgtcattctgtctatttagaactcatccctcaccttatcacctaataacacttattcagtgtcaactgtcatctttgcagagcacactctcctgagcttccaactaggaaaaattgtcccattcatatgaatacttagaacactttgtacttttccttcagatgagagtttggattttacattaatttttgtggaccacttcgattagcatttttataccagatattatgctccatgagggcagagtcaaggtttatttgtgttcaatatgtctctccatcacttagcacagaaaatgacttttcatgcaagaacaaataaaaaattgcctaatcaattttctcatctgttaaatctcattaaatgagataataatgactgccttttccatctcacggtaccactatttaaatcaaatagctatttgaatactgataagtatcataaaactattccattatttgcgatggcactatgcaaaagaaaccattaaatagagatttttgaaataaaatttcatctacttaaagtctctaatccacgtttggtgtgaaatttctatagcatggcacttacacacttggattcaatgcttcggtcataaatcgggccaccaaggagtaataatcaagtccagcatacaattggttgaaaaatcttgggtggtctgtaaatttaaaatggagtattcatctatgcagcaataaaaaaaaaaactactgatacagcattaacataaatgaatctttcagaaaatgaaagcagacacacacagaagagttatatataacgtaattccatttatatgacattcaaaaccaacaaagctatctaaggagatggcggttagaattctaggtactttgtggaaagaattatggattgggaagggacttcagagagcctctggagtgctagaattggtctatatctagatccaggtgatggctccatatgcacagctacgtacaaattcatcatgccgagcaattaagatttgtgcactttactgaatataaattatacctcattctaaaaaaatccaaaacaggatcatgcgcaaggaaaaacatgttgaagacacatcgtagagccctttctactggtcagtgtttgtaagtaaaatctgagttgtcttttaagagctttgatttacttgctcctcttttttacaacccagacccaaaccagaacccttaaataattatttgaacactatttgtccaaggatcacagggtactgcctttttttctgaaaatatcaatattaacttctcacttcatatacatttcactcacagcagagttcaccccaggctatggcactgagcagccttttcatttttcagattggacccatgcgactggcagtatatagatggagtaagatgtgactcactatgcggcttacatacacttctgattcaatttgcttgaaatgcaatcgcctttaagagacaaacaatggcttgttccaattttaatttttttcccccctcctataaaaggtctcataaaggttcttggctttacaccatgtgaataatcacaccatacacccggctaactggcttggcattctcaatctcaggaagctcagcatgacagaacaaagaggcaggaggtctatttctacatttgagtatttgggaatcatttaatttggtgacctctcattacaacttacagcatctggttttagtttattttagttttttttttctctctttaggggttcaataaaaaaacaagtctcaaaagaaaatgtcttttcagcttaaacatggaaaacttcctctgatctggcaaaaaaaaaaaaaacggcattgctacaagtaattttaataagttttttttagttctgtgttaatttatgattgatttccatggtaacatggaaaatatccagtaaactgaaaaatctactgcattaaatgtcattctgcacttttgacatgcactggtaataataagatacatatctctgcttttgaaatgctaactgagtttttgatacatacaccagactttcccaaaggaatataatccaattatttttagccagaattttactatgttctttccactaaacttagtccagtgtcagaatttacaaagtaatgcctgtatgatcttaagcgctagatacctttacattacactgacaaatattttggaagattattctcccatttttgaaacttgttcgctggatgaacaggatattaacaggtaagctagaatggtgcctcagtgtaagattgacatcacattactgcacgtacaaagttcacagtagttatgacatcactgtgaaataatctcatcaaaaacttggaatgtattcatttgtcttatatccatctaagggcttttatttatttgtttttggtacagccagatttgatcaaatagtttggcaattaccaactgccaagagttaatcagtgtcttccaaataaatcatttctgtttatattaaagataccttttgaacactttttttgcatactctgggccatcaagatttaaaatcccttaacaaatttatataatcaaaatactatttgccagtttggtctaacacaagaaatgataagtagcagtgataatatatgatcttgattacaactagtatgtgggggttggcaaggagaagaggatatttacatacaaacactaacacctacagttttcctgtcaacttatctttggccttggcaatgaatctggattagggattaaagggaccattgcaaaaacatcagaactactaattttttgatccagatttctcgttccataagcattgctatactcagctttgagaggctttgcaaacataagaacttgtcagaggtacagatcaaggaagtaaattaaagttcttactagttttgacactgtagtgtatgacatcccgacagagttccaatagtttatggggtggctcgcctgagtctctcatctccaaatcaagaagctgtttcagttgttcaggaggcctccattcacacacctggagattcaaccacaacacaaattgagtatccaccatagccaggtattgagaggatgttacaaacgtggactctaccattacaaagcttctgggcagcgggtgatttaaacatgcaactatagttcagacgaaaagaactattacagtaatgtagatgttgatgggaccaatgaggggcgccatcttagatttgcaaggtaaagggagatttcctagtgatactgatatctaagttgttacatagaataagagtagagcgaatcaaagtttagggaggttctagatggaagtgacagaagtaacaaagatcaaaagtaaaattaaaaaagataaaaaattcggatcctatggcacatctgtaaaatcaagtacatttggtatggcttgaacatggatttttgagaaatggagaggaaataaacaggaatgctgaagcagtttttctctctgtgtgtacccggccctatgcagtctgctatcgacctagcagccagaatgatcctcctaaacttaagccatggccattcctctattcaaatacatctgatggctccctgtttctttcaaagtaaaacctgaggtccttacaaagatataaaatgatcctttacgatctgcttctcctggtttcatttttcctctagtctcatctgggactactttccttctggctaactctgctcttgacaccctagcctccttactgttcttaactacacgagggaggttcccatactggggtctctgcactgtgtgtgccctctgcctagaatgtttttcaaaatatcctcataactgaatccctcacttatttcaaatctttgctcagaagtcactttctcaacaacagcaatcctgactcccttacctaaaattaaaatctacccattacctctatcaatcccctttaacatttcctactattcctttttacaaagcacttatcaccctctaatatactgttacttattgtatcctacataatctccatacaagcagatctgtctttttgctcactgatcccaagtgactaccacagagtctgcacataatagtgctcaataaagatgtgttgaataactgaatggataaacagagataagcaaggctcagatcataatgggctttatgtgacatattatagagtttggacttggctctaaggaagccattaaaatgtttaggacaggggaatgaaaggatcatatttgtgtttggggcaatagctttagttgttatgtggaggttcccaataaaatttgaaataagaggttgctgtaataagccaggcaagagaaggtgatgatctggatgacagtcaatgctgtattaaatatgtagtttttagagatatttaaaatgcagaatcactagaacctggaaatcagttagattttgagggtgagatgaatgagccaaggatcatcccaaggtttccagcttggacacaagattggatggcagcaatggggatagcaggagaaggatctggttggggtggtgtggggatgatgaggtgaaagcaggtttaggacaaggcaccttcagaatatccaaaagctgtatagcagttgatctgaggctcttgcaaaagattgaggacagagttccagggagacactatgataatgtaacagtagttgatgtggctcagagagaacctacagcagggcagaaaggagcagaatctttctgggcatcaccaacacttatgaatgggcataggaagaggagcctgactgtcctgtggagggcacgccagagaggtagggagaatcctaagagtttagtgctaccataaccaagaagaaagaatgctttaggaaggagatgttcaccactgtcaaatactgctaagaagccgaattagatagacttgaagtgctcatggaatttatcaacaaggaggtgttcttggcaagagcagcttgacttagagaggtgggggcggaggccagattgctttgaagtgagaatgtaggaggtgaagaaacggagggagggaatatagataatctctaaaaattttggctgtggaggggaggagagagatagggaagtagccagggagtgaaaagactgggaggctggggggaagcaggaggaaataccaagttgtgcaagtagtatgaaattaaactatgatgctataaccatgacaggcagaggtaaattggaaatgcctgagacaatcaaaaggaatgactactggcgcattcaacaacatggatgaatctcaaatgcattttgttgagggtaaacagcaagactcaaagcctactaaaatactattccatcaacatgacattctagaaaaggcaagtatcatagggaaagaaaatcagtggtttcaggggctagaggaaaggggaggattgattagagaggggcacagaatagttatataactattctaatgaagatatagaacagttccatcatatcgtagtaatagttatgacttctgaaactcatagaaccacaccccaaaggggtaaattttactgaatataaattataattcagttttaaaaactggctgatgaagaattttctgctaatgaaactagcagtgatcactgcaccaagcttgggtatatatctgcaggctaccttttaatggtgctctgttggatctcaaacaaggtaggctaagttagtggtatcaaaacttcacctccttcccccaactctagcatagctttcaatccaacttcccgtgggtagcctgcacatctattacattgtaattgacttgtggttccttaattgacaacttaggatcttaagatcttccgtttctcatcttattagtcccctgtgtgagctctttttttctgggcaaaaaatggtccccttgctgtgttaagtacatcttgtccttttgcaatgctctttccattattgaccttcctgctttcttcctccagaaatgagtaccctaacgccaaactttctcttcccctgccactgccccccaaaattctcacttgccctttacttacattccacatctgagctcaaagtactcgctcctgagtgaaatcccaaaaatctgttccagtctcaaagcatttatcacatccttactgggaccccccgctgccttttctaatgaaaacatatccttccaattagattataaattctgttcagagctgggcctttatattgtttttctttatattctctagggctgaatataaagctttagtcatagctaatactcagttaatatttaatgactgaataaaggccaataaaaaaaactgccagaggagcagtgtactccaatgtaaagcagatccaaagtatttcacaagtacagagaagaacagaaattatataattataaatatgctatctgggcaaataccaaacaccatcaggattttgccttgaacataacttccaaattcatgcatcaatctattttcctactagttttccgaaaggcatgtgatcaaaaattcagaataaatatcacctcactttcaaaatcttttaaaaatgatacttatttctaactaatataactggaataaaaatctcttccttacatccatttgttgataatccacctccaacatgaaaaccaatgtgataaaggttgattcggtaattttaagaggcatatggaatagttaagagtgcagattgtgaagtgatactgcctggattttagtcccggctctgatacttgtgtataatcttgggcaacatatttgacctctttgtgcctgactttctttcccagctctaaaatgggggtaatagtatctgccttttagtgcttttgaaaggattaaatgcataaggagtagtccttagaacatagtaagtattcttaagagtagatgtcattagcggcggttctaatatcaatttgaattgaatttgagcctgaatttgaaatctacaaccaataattggtaccagaaaggagtcagacttaaccacctaagatttctaggctaaatttagacaagctcttcataaggaccttaagataaatttaaaatgtttttacatccttttccatcttttgcttgattttcatgaacaacatgaagagtgtgcactagaaaatggggagcaaagagcattagagagttgcgtaagtgagattagcaggttacttatctatgttattatctagggtgcaggaagtttcatccctgtgcttcatgtccttatgtgattaagctctagggtctcagccaatcttcccacgaatgatgactggcagagtaaggaggcaacccttcaaggacagcaggaattgcctgaaggacagcctacacttttatatctggacatccttttgagacaaaggcatagaagaaataaaaacttggccttcccatttgctttctattcagccatactgatttggggaacatctatctttcccatttctgcaatttcttacaggttttaatttttaccttctcattgacatctgtagctttcaaaaccacctcttccattattagcctacaggcctcttcaacaaatttttctccagcttttgcatctgttgtaggaccattcagcacaaccccatccacaagaacagcattcttcttacttggaatcatctcttgttgatcaatatctcctggaagcaagcaaacaaattgtgtttgagagataatctaattacaccacataacaaagcacgggacaaaatgcatcactatcccagcttcagatggcacatcttttaatacatgaaggcatcatttgaggtgttgagctgacaatttcttatgacacaccatggtatgatagttaaggaaaattttacaaagaaagctcacaatttatggattaagtaaatctaccttattatatatgtcactctgtactgggctgagttagtcatggagtatatgacctcctaattcagtgcaatttcaggtctgatggggaaaggtaccattcacatacaattcccatgctagatggtgtttgaagttgaaaaaaaatgttttccataattagaatgctgattcacaaagcaactgcccctaggagagagtaaatattcattggcatttctacacatgcacaaatgattaagtgatttccctaatcctttcctcagagacagccgtcactctaccacaggagagttcgagatggaggaacaggagttaggcatttggagaaaaggatgaggagaaagcccttcagattttatctagaattaacaccacctctatgctgtcagtatccccttaaaatataaataatacaatatcatacaatagtggttttaactttcagaatctggtgcattgagtagacaaatcctataattaaggtagcaagcttttagcttcatttccttgtacaaagtcctttagcatttctgagccctaggatgaagctttgggcagagataaagaaaatagcacctgtccttacacaatttattttcctcaaggaagagataatgcatttccagattgaaataacaaattgaattttatgaagatccatcttgtattggatgtatctgaattatcgaagtatctaagagggatcacctggtcaccttcaacaaagtgaatattgaaatcttcaaaggcaaagagctagctgcttccttcttgaactagcacacatgaatatgtttctccaaatgtatgtcccctcttcctttaggtgcgtgtagctgttggccaatttctctatgaactagattacaaagtttacacaaaagttgtatttttcattcttgcagcatcttgtttagcatcagggagtgtggaggagaccaagaaatgtaaatgtaacctattttactcattcttgcagtcacctttcaaacacatgtacaaagagatcttcgtaaacataagcccatgtctgtttcacacacacacacacacacacacacactctctctcacactcacacactcactctctctctctctcgtaatttgtcagggataccatattttcccttttaacaaatcattccttaaaaagcagcagcgatataaacttgtcactaatcttaattgtatgttttaattctatgtttaaatgttcctctatattacagatactgctttgtccctgagagcccctaatttttcagccattttctacatagagagtgatagaggaaagaaagcagcacaatgatttgttaagcctgtattaaatgcctttaaacttttcaaccttgcagcttaagcacaggcaaaaggatgagacggaacatgttcaagactgtacatgccgatcattgactaaatgttaaaagtcaacatgaaaatctatatctgagaagaaaggttactgcctacccaaaatagccctccacaaaaataattctggcaactcaatccagatattcaaccaatttccagcacaagctttgattcaatcacattctctttttctaatcagtatgtttctccaccttataatgtatatgttcatttaattgttgaaattgacagaaacaatttttaaagtacttttcagcactgtacctcacacagtatcttctattttaaatccatcttaaatattccaatggtctacaaaaaaaaacccttctaaatatatgtatttcaaacacttctactcttagtgagggctctaacaatattaacatttatcatttcttagactccaccttctcctcaaagttaaacgttctgataaaattctatggctccacaaacactttaattctgttattggcaaacacaaatggtgtctatgaaagcaccagataaaaatgttacaggaagatcccccagttggggaaagatggaatctgcagcaaaggatcaatcttttgtcctctcactgaaaaagaagccatttagagctccaatgaagaatgttagttccagccctcactttcacatgaaaggaaacatttaacatggtttagggccaaatattgaaaccctagaattgagcttttagatggaaatgctctgcacctgaaggtactttcctctcctcccaaattttttaggccctaaaaatagagtaagaaagagagcaattattccaggaactctggttatgtgagtaggcagtgctattattaagcacgcagaaaaagttaagattttttttttttaacctcattagtaggatttcaagcttttattacccagggaataacagcagctctatagcctgctcattatgtttctctttctctttctctcaccccgttccgtgtgtgtgtgtgtcacacacatacacacacacgataaaataaaaaatgtcaacacccactcgtaaccagaatagcagtgaaatttaaattatcactgtcttcacaccaatgaattaaaaaaaatccccataattcacacaattatctaggagaaaatactgtaaaaatctatacagaaatgggtctagatgatgtcttttctttgatagacacattttatttttatagccagatgtgataatgtgcctctttctcccccagcatttgtccaggtcagaaaaggccctctggagactctagaataggtcaagctgtggtctcctgaggaaggatattcagaattttcattctaactgctagagtttatagtggctcttaatgaagtctttcaatttgaggaatcttccatgaagactatacctaggatatgactgcttttcatcacccccacttttactaccttagttcaaaccaccttcaaatgctagggttactgcagtagcctcccaactaaccacctttcttcgccctttcccctcattttctgtggactattctcaacacagtacctcctacgttcccttgaaaagataaatctgatcacatgatgactcctgcttaaagcattcaatgactcctcatcaaactaaaagctaacatccttctaataacctcaaaggcccatttccctattatctcatggacctcaaacctcatcttgttactgtcctccaagctcacacagctctatcatctgtggtctttttcaccatgctgattctttccttaaacatcagtttctcagggaggccttccttgactacctcatatgaagctgcaatcacctctctgcactactttctctgctttgattccagagcagtgactaccatgggatatataatacccacgtaaattaatatatatatatatatatatattttttaatatctgtctctccaataaagaaaggttaagctctgtgagagcatgagtttgtgtctgtcggtttcactgttatttccatagcacccagaaagtgcctggcagtttgcaggagtttgatgaacattttttgactattaaatgaaagttcttcctggttcctttaaccaaccagtgataatgtcttcctcccttgagatgccgtcgcaggttgtctgtatgcctttctgaactgatagcacagcaaggagactggacctgattaagcaggggaaacctttggctggggatgcaatagacatagaacacagttaatgggctagagaagagacagtggaggctgaaagaaccccgggaacagtcagcaaggcaaacctgggtttctgttctcttcattattaaaggaaactggctgcaagaccctccctttcctttcctctcgattcttgttaccgcagccactttttctgtgcccttattttatggtagtcatttgacttctagaagtcagcgcacggaccacaggctcactccagaaaccacacttccaaatttgaaagccagtcaattcctaaagactccaacttctgcattttttaccaattcctcccctccatagcttccaaaattctgtataggatcaacttttgctttgttcagagagatacattgttctcccttgattaacaaacaattcagcttcaaatattgtttcagattttgagagatagcctcttcctctgacatagaattaagtgaattaatacagataatgccttaaaacagtgtctggtacatattgggaactaataaaagttagctaacagtagtaaataacaacaatatttattcaatacataaatgacaccaggcacggtggttcacacctgcaatctcagcactttgggaggctgaggcaggcagatcacttgtggccaggagtttgagaccagcctggcaaacatgatgaagccctgtctctaccaaaaaatacaaaaattagccaggcatagtggcacacacctgtagtcccagctacttgggaggctaaggcacaagaatcagttgaacctgggaggagaaggttgcagtgagccaagatcataccactgcacttcagcctgggcaaaagagtgagaccgtgtctcaaaaataatagtaataatagtacataaatgcataaaggaaacttgcatgtgatggtaaactgtgacaatagaaaggggaggtcttctcagattgatcaaatgaccagggtaataaactctagaccaagtggctggtgagttatcacctctggaagggcaggaagagaggaccacagtggttgggggttcccctgtgagaagagcagagcttcctccaccatgttcagaacgcaagatggtagctgagtagttcagcccacactgggtaggcagcttcctagaccttctgccttgttgctttccaccttgccctgtgtttacctgtgtagaggttttatttcttataccagattataaacctacagaaaaaagccatgtctcattttactgaccattccagaaacagagttcagcaactggctttcaatagctctctgaggactgactggctgactgtatatttactttggaagtcatcttatctaaccttttcatacaatccaataattccctccacaacctgtggcccagacatgagaagagctgacttctagtcccacttgatcactcccaagttctctgatcctgaaataatacaacctctctgtgcctgttttctcatctataaaaattggagcccatctgaggaaagtgatctgctagcttccaaaaaattcctgggaaaattaatgaagattcagaatccggattcctacccaaaaggattctatgtggagcctaggatctaaaatttcaggaagtattcccatttatattaataatactgaaatacactaatatgcagtgggtatggaaatggctattctgggtgacctctaaagtccttccaaaacttcaaatcttcagttgtctagcccctctctctactcctttaataattatgtatttatcttaaatatgcatcaatctccgagaagttaagaactgaaaaattacaatactacatatatatatatatatacacatatatgtatatatatacatatatatgagagagagtacttactatgtgccaggccctgttctaaaagttttacagatttaacaaatgtaattgtaacaaactcgttactcagtttttcagatgagaaaactgaggcacagagagggtttaattcagttgaattgccttgcccaaggtcacagaactagtgagtagtgaaactgaggtaaatttttactgagtactaaatatttgctgaagttctatgaaggatcaatgagattctgctttatgggtatctaccattagcaaggcatcattagggagttaataatgacagcaagacgaattactgtacttgggtaattgggggcctcaaagtgctgaataacagcaatagaagataataagtgtcaagtagtgccacgtggaagacaccaataaaatatgctgaatgtaaacaatgtagacatttgaaattaagggttgtggttataggagaagctgaggtgtcagggaagatttctgaaattagaagacctgccttctctttgaacatatgcactaataaataatatacttttaaaacctcatcacttctgaagtaacaacttcattgacagctgcccagacctcccaccttgtcactttcacaatggtcacaaaacttttcctgagagtgactccaaatatgcatttctgtcatgtctataggcttttatagtaaatgagttaagtacatggaatttttcttccacaggactgtaatccaaatatgtgaagactttttatcaatgcttttaattgtcagttaaaactgctctcagttttttcagtggtttccgatagtccgtggtctgtagtctggaccaatttgcttttatcttataaaatgaggcatctcacaaaattccaggtgtgatctcaccaactctcaacatggtgaactcatatttcccatgctctggtcaccatgatttcattaataaagcttttattgacaccatagtggattccaaagcctgagctttaagtcctggcccaaattctaactctgcttctgtgaccttactcatgttatttaacctctgtgtgatccgtatttcttttctggcaaatggggaaaacagctatgagtcattgaaagggtcaaatgtggtaatgtgtgcaaggtactaaacaaagtgccagggacagtgtaaagaactcaataaatgataactattaatgagtttcagtctatatgaactctcttttggcactcacgttacactgttggctcaggtagaagtcataattagcagtcttagggttttgtcagaaagtctgccagtaaaagccaagtttcccatccaagtctctttaattgttcagagcaagttagcaatagaaaaataatgtttgctttcaaaggacagaaatgagaaacaatgaatcaaaagtgaatccagacatctggttgggggaggccaaggagctcttcagaaagttagtgcaaagacgctggggaccaagggaggcagaagggtcaggacttagagaatcccgtaggccggtccaagagagtctgagaagcaaagtttaagagctggggtagtattaattaataaattaataagagcctcacccagcctggtgcctgtggatacagaagtaaaaaacagtctctgttctcaagttgttaaaagtctagaaagcgaatatttaagaaaccagggcaaagaaaaattgagatttaaaaaaactgaagatatattttctcttctggaggtttctaagtcaggcatttcttccaggctcaaaagaatggatgcctaatttacctgatgtacctggtacatcagcctcatagattgtttgccacacttttgaatttcacactggttttaaagctattttagttgtcttaaaaatgacatgccaatgagagcgggtaactgtgaacaacctacaaagaagatgactatgggaaatattaagaaataacaataacacaaagccgtgagaacagaagctctgaagctttgggtaatggcgacaaatgtggcaacttagtccctggatctagccctgtgatttgatagaatcataaagaaggcttagggattgaaccatttccacatccaatccacaaacatgaattcaaaggagtaaacagaaaactatgtttacaactttgtcagcaagagatatgggtatctattttattttatttttttttgaaaagagcaagacgagaattttaatcatttctttagtctcatcttggggtcaaattctccttagctgaaatccacagtgagcagatacttctcttactcatactttcatgagatagtcataaaatattgaattgctactatgttcaagacattagggcaggcactatagaaaacttcaagaccaaaaagacacacagatggtgaccccaaaatccaataagggaaattagacatgtttattaatacttgaaatcctatccaaaaggcataaagtttgataggtgaagtcagataaaacatactgaaatttcagagaagggtattgtttctcaatgtgagaagcaggaagtccttctggatgaggtggcatttgagacagacctccattcatccaatcagcaaatacttatatttagtgcctattatgtatagaactctgtgtaaggcatttgaggttgagcaatgaacaagaaaaatttacatttagttggggtggataatatatgcagttaagacaaacagataaattattaaaataatgcaggctataatgttctaaaggaaatacctgaatgacttcatagaataaggacaaggagctattgtagatataatttggaaaaaatgtttctgaacagaagatatctgaattgagttgtaaaagagaaggagagccagacacgaaagatatggaaagagaatgatccaggaagaaggaacagaaaatgcaagcaatcaataagctggcttctttaagaaatggaaagagataagtgtggcccaagtgtgagggcaagggaaaggaagggtgaaattagatttggaaatagggactgggagcagatcaggtaaggtcgtattttactctaaaatcaacaagaagccacttaagggttttaaacagaggagtaacatgaactggcttacatttatggaagattcctctggatgccgtgtagagaatgaactgtcaaaagacagatgtggaaatagggagactgcttaggtcacaactgtagaagtccaggcagtagacaatgggaactttggtctggatggtggcagacgagatggagcaaagtgctgcaacttgggagatatttaggtgataaagcttaaagaacttgcggatagattggatgtaggggtcaagaaagcaaaagaatttaaagtaattcttaggtttgagacccgagcaatgagacagatggtgactagtgaaccctctatactgatctggggaatgctggggaaaagcaagttagacaaatgtgtggctgggacataggaagatcgacattttgacaaattcataggaattggtcatgatgacatagagacaagattcatgccatggacattcatgacagaaaaagcaacatggactaaggcagaaaagtgtgtgtgtgtgtgtgtgtgtgtgtgtgtgtgtgtgtccaagaaactcaagtacttctgtttgtccaaggggcagggtctgtaaatgagggaaggagcttttgagaaagaggcaaggagaccaaccttgcagggacttcagtagaaactgaggagttcagctgttacttactgagtgggcaataggaggccactgaaagctgttgatgggataagaagactgccttagaaagatgaagcgggactggtgtaaagtttaggtgtgaaaccaagaattgaaggaagagagaaatgatggcaataatccaggccagggagagggaggaaatgaactaaatagtagacaggatggtaggtttacattttattttatactctctcctacaataccattactgaatttgagccaggtatcccatatctttgtaaagagttctacaactgtcaatggatagacagcttttctctcctccagtaagtctatgttctaaaaatgatcattagataaaaagtgacagaataagatgggagaaaatcactctgtgcatcagcacctttcttgaaaagcacagatgaacatgtaatatttctgggagggaacatgttcccgtcacccagagttttacattatgagactacgttgtgttagaatctcagataccactcagataattctgattctactgaaacaccaaggcatccccacaaaccaaagagccaggtccataaacaccatccagcttctgagagaacgtgctcctcagaagggagtctctgaaacagccagaaaaatagctggcagtgtcctaccaatagccaataaatacatagtacatcataaaccctgcttattttaatttcagtaatgtttttctttcactgggcacaaggccaggaattagataacctaatcttttcaagagagtagatttttcagagacacttactcctattgcttgagtaaatattacttgataaggggcatgacgtgctgcaattgtatatcttagattgtcatattaataaggcagctctccaaaccacctccacccaccaaaccatttctaaatcttttgaacttctataatgggtacaaattcagcttgaaaacacttatgcaattgggctccatgaaaaaaatttgacttaacatagccatttagtaaattttatccctgtccttcagtcccagtttggagcactttactcgatcatatcctttaatgtggcttagtggtagctactgcaccacagagcagtattttcctcaggagctgtatcttccttcttctctccattaaccactgtcaccccccatagtcatagtttctgttggcattttcctcctctgacatcttggctgtttgtcctttcttattcttcatccttttcttgtctatatacatttataaaacaccaggtttcactcattgctttaatggtaacttctgtgttttctgagattcagggctgagtaaatagaaggcctgtttttagtttgcttgtttacttgaggccatttttggtctaactagcatcccaactagaaccacccttcccctaggacatggtcttggtgatactgtcagttaaatacccttttgtgggtatctccaagttctaagttttccagatctcaagtcaccttggttcctgtcttatttaagacctaattatttatctttctctaattctgtgagctttctaagatactctcaataaactcccccttttggtgagcaagagtcattctgcactctgtgaaactagagagccatatgaatactctgagtagcttggattctgtagccatttccaactgatgaaaattaaaaccaactagacacaccttactaagtatactctcttgaccttcagagtctctcatctatttacactgttttccaaaacttggaggtcaaccagttactgtcagacaataaatatgctgttttttttctaactttcttcccatgtataattctggatgcttgaggtcagtgtgtatagtgcagtcatagcaaaaagagtccagggcagtgctgccaaaaagaaatataatgcaagccactgacacaagccacctgagtaattctatcttctctagtagcttttctagttgtagtgtggcataaatgaaacaaaaatataattgcacttataaaataataatggttaacatttaatggatacttacaatggaccaggtattgggatatacactttatatatttatatacatatatatgaggttatttcatttaatcctcataactgccttatgatgaagatatctttattaactctattttatagataagaaaactgaagttagagaaagagaattgcccaagtcatatagctagtaagtggtggagccagaattcaaagccaggcagcctgattccagatgccatgttaataattaccatattctccttttttccaaaaaaggcaaggaagaacatattgctttctgtgtcttatcaaccacactaaactatttggatacatttttgtactcctaaagcaataagcgattatcttagaagtatgtattaaattgcaatgtgttacaattaatatatagttttaaaaccaatttgctcaagtgttgactacaggactttaaatgaattccatttaaccagcaatttaaatgaaaatttaaataaatgctataaatgggtgcctcatttgcatcatctgttgatttactctgatatggggattatctttgcccagggttctgcctccttagggctttggtgaatcattttctaggtgaacaggaggcacttactctcagctctcttgcttctcaatgcacatgttgtaacattcacatgtggccaccttcagatacagaaaactgtacttaccaaattcctttagagttactaaatgtgattggaaagtacatattgagaagctcattggaatggcagtaaaacctttccaaggggtacatttaaattaaaacagatggtccaaactgccttctagggagggaggacactgttacctgcaagaaaaatgcattgctgagtagggtttgcaaatctggggccagagcttgaatttcttagtgaagtaggtagtgaagagggtgaggctgaaactcatccctttatgccacacagattcagcttcacctctatataaaattggagcaaatgtcctaaaaattgtagcttcctgggagtcatcacagtaacacaaactacattatagattgtaccgctggagtggcaaatgcaggtgccctgaggaatgcccacacatctcactgctactgtaatgttgagaaatgaagtactcgcagaacactgcctaacagatcatagtgacactggcctgggttattcctcagctgaaactcactgagagatgggtttggaaccatctaggatatgggccaaggatgtttttggccatttatgtgtaagattttgggatcttagagctttacaagcacttacagatcagttagcaaatgtcctcatgttgaatttgagagaaccaaggtttgatgacacagagattgcttgaagcctgtgtaaccccttctaaagattcaccagatccactaagtgttatctacattccaccactcgtaagcatctagaacctatttcatataatcgtagctagcatttatttagtgcttactctatgccatgtttttgtaggtcctttgtaaacagcagcacatttatacaaaacaacaactctttgaaaatacaaacaactaaactcactctggttaagtaaagcagaaaaaaacctgcttgaagggtatatcagctgtctatagttgtaccaaaaaaggaacccaaaatttagtagcttaaagcagcaccaacgtacataattgcttcggggtaattctggtcttgcctgggctcactcacacaactgcatccaacctgtgcattggctcagagctcagctcagccaggaagattgagatggctgggtctttctatgtaggcttttattatcaaagagataagacttgtcttcctcataaagtaataccagctttgaagacagtgaaggcaaaagctacagcacctcttgagatctcagatgatttgtcataaatatcacttctgctgtctagtggtcaaagcaagtagcaaaagcagccagactcaaggatatagagaaaaaaaaaaaaaaagctcacctcttgatgacagaaggcagttgtcacatcattgcaaagtggtaagcatactaggaagaaaggattctgaaaccaattttgcaatctatcatagtccagtctctgatcaaaattcatattcctctcatccacaaaatatcctcattcccatatgaggaccttccaaaatcttatctcattatagaattaggcttgaagtccagaatatcgtggtctgtgtcttgtctataggcagacaagactgttcagttatgttcttggtccagagacccctaaactaaaaacacaagttatcagatgtcgcacacaacatacaatagtcatgcaggccaggataatttctgcagacactctcacgaaagaataggaggcagagggtaatcactgtcttacagcagttctgaaatcccgctgggcacatacttcacatattaaataggatctgatttgccctctcgggtggtttcctaatccagtattctctgtggcccttggctccacactctggcagaagtgaagcagtggcccagcctctctgaagtcaaatgccgtgatgggtagatacagacataccagcatattgcagtttatcctcactctcttctcatctagatgcttggttattgatcctagagatatcattcacacacaagaaaaagcttctccagcccatttcactatcacagtttggcaattggacacgcctggattaccagattttcctacaagctccaacttggccattcttgccagttcctcaggaagctgatccgtgacttttctctgatttccaattctcccttatgaatgttttcttcagttcctgctacaattgtgtgtaaggtctaattcctataatacattccatattctataatgttctatacatataatatgttactgtatttaatcttcacaacagccatgcaagttacatactaacatccccgttttataaatgaggatattaaatctgagagaagttaagtaacttgcccaaggctacacagctagaaggtatcagagatcaaattcaaataggtctatatgattctcaaacctatgattgtaacccctattttccatttatggaaagagatgggatagggacagtaatgtgtactgataaattggtttctgaagaaaaggctctgattggtagcattcgcctatttctatggtgtaaagacgccgatcatggctaatttcagggccaattttaaaactggctcacaacatttctgaatatttaacacttgtaatgaacaagtatgaggtggtttcagcatgcctctgcatggggagccaagaaaacaaaagttcatcaattgaaaaaataacagaaacggagtagagtgtttcttcaggtgtctcttccatgcacaggctctctaatttccaaatgttagcatctcatatttttgcctgcagcctattttggtcagaacctactcttgcccacttacatgccaagtgtgaagatctaaaaaataaatatccatagctcagcatccttcaaccaataagtgatagaaactgatgtattaatagccaactttcttgttcttcacatgtggtaacactaatgtctgtcttcttcattaacacccagagttacccagcaggattaagctttagttacccacagtgagaaataccttactttattatgcatcctctattggctgtctccctgaaatcaccttacaaactaactaaccacactctaattcttgattcagagtctgattctgaaaaatctaacaaatacctattattttttgaatcccaatggaccagaaagacactgtactaggcacttatattacacgtttttggacaaatattcatagcaccctagaaggcaagtatacccagttctacaaatatggaaatatgaggatcagagaggttagttaactctatggaggtcacatagctgatatagtaaatagcagcgctgatattcaaattatgatcaattgtaacatctcttctctttccatgaatctatgcagcctctctcaccagaaagattgaactaacacacatgaaacaataaaagaacaattaaatgctaagctgacatattgtattgaacaattttgggcaaaactgtcatcaaacttatgttccgcaattactttctaaaattctcttttttgtgccatcaacttgaaaaataaggccactgactaatattagggaatccaatttttcataagttttctttatcctctatcactgcatcatacaaattaggtactgaaataaaactgagtgtcatgacagaatataccatgatgaaaatgcatatgaaggaaatacattgcttgggtatatttttcggcccacatagcatctgaaaaatcagatacatcataaaataccaactaagtctctattgattttgtaagtcaacacaaagtattaaaagatcaaacaacacagcatacagagtgctgaaatgggaatagtcttatcagctaacaacatcagcaaaggaaggactttgatttgacttttgtctgttaaaggggcaaaatctgaagtgtggaaatttaagatggttaatggtgtagtattaccatatagattttaatatttaaccataatagattttaatatttaacagtggcttgctgtcatcaagtaatttagatagttgctctacaatatttaacatgaagaaggtcctgaatgctgaaattattagcactacaccaaaaaatctcagatgctggtagaaacacacataaattccaagtatgatttgatcagtgtcttacaggttttgtttcttacttttaattacctgtcctggtgatatgcacaaaagggaaccctctggagtttggggtgagagttttagccctgactctggcccccaagtagctctgtggctgcaagtactttaacctttctggttaaatgatactctcagttaaataatgctctacaaaacaccttgtcactctaacaatgattctatggctaaagcctaattttaaaattaagttcttatttacgtaactaacaaagatcacattctaccatttctaaaagtggtccttattagtgctcttcagaaccataaatttctaaaatcgtccaggaccttcatggaagtagctcagggaaggaagtgatggagaacatgagcaagtagtctttttggcccatgaggcctactttaggtatagaaatgcaattttaactgaagtatctctgtaaattattttccttaaacaaacaggctggaatgaatgcatgaatactttggcttaaattataatatgactgatagacatttgatacccatctcttttccctcttcataaaatgcataacttatctactgagacttacttatcacaggacactccactcagaggcctgagacccagctttgaacatatttacctttggcaactgcacttatccaaagacagtgccagtggcagtggcactagctgaagcagtcaattccatttgttttaagcgtattgtggtgctatcatttttatgacactagggtatatagagaaaatatagtatccttattatgttctttaattaatcctgtcttccacatgagcccacattgctgaaaaaaaggtaacaacatttattttatttagtccaatctggttaaaacatgatatatagtaagttaaacagttcgtttaggcaatgttctgtttaactgtgtaaacatgtttgatatctcagatttccacttctctgaatacttttcttgatgacttctaggtatgtggggagtaaagaatgtctcactcaacctcagagtggaggaagagtggtggagtccttggatcactgcagtgtgtactgactggtacctttgtccctgggcaatctcacttgtctacatctttagagcattcatacctggctgtcatgtgggatgcatactcatggcttcttatctctcatgttagtcagagactggggttctctctgaatgaggtggtctcactttagcttttggtgatggtatagacatttctgggcttatgccccatccttccttggctccccagtagagaaaatgcatcccatagcttttgccttcatcctcatcagagaaagcccactgggaggaccaagggtactcaattaatctaccttcctctgaggacaaaaaggcttttctgaatcatttccaccccttgaagagatcaatacaggctctccctctctatcctactttagtgagccatcactttggctttgataagtctgcaaggtgatctcctccaagagaagctgataaaggcctatgttgttgcttaccatatttccataaaactatcatataaccatccactgtctctccacccctgcttccatcccaagtaataagaaatcaagaatgtgaatttctgcactcgtctctcttgcttaatccttctttctcttctcattgtcacttcctgccagaaatggagatttttccgtgactttgcctgcattaaatattactttttcttgatgctagcctcatgggtagccattgaaggtgcacaaaaatatcttttctgcaccaggaaaaaaactctgtaattttgttctctaggcaaaattggttaagttaaagggaaaataaaagaatgtagaaagcccaaggcaatagtcggaatgataaaattattgttttgctttgaaactcctattttgactgcctgaatctaaacagtaactgcctttctctttgcattctacttacaaagatcagaatctttcacagccagacactgctggcataaaggaaggaggtattcataaaggcagcagaagaaaagcacagtaattttttaaatacattcctgaaaacacagtcctctgcctctgagttatacatctatggattcaataaatattttaagatattaaatatttttaaaaaccaacaatgacagtgcaataaaaaatacaatttttaaaatacagtaaatatttacatatcatttacattgcattaagtattgtaagtaatctagagatgatttacgtatacaggaggatgtgcacaggttatatgctgatatggtttggctgtgtccccacccaaatctcatcttgaactgtagttcccataatccccatgtgtcatgggaggcaactggtgggaattaattgaatcatgggagtgggtttttcccatgctgttctcatgatagtgaataagtctcatgagatctgatggtttttataaaggacagttcccctgcccacactcttgcctgctgccatgtaagatgtgcctttgctccttctttgcctatgccatgattgtgaggcctccccagccatgtggaattgtgattccattaaacctctttcttttataagtaacccagtctcaggtatatccttatagcagtttgagaatggactaatacatatgcaaatactatgccattttatataaaggaattgagcatcttgtggaggattttggtatccacaggaggtcctggaaccaattccctgcagattctgagggatgactgtactctaaaattttatggaggtgaggattaaatgactgtaaatttgttaaaaatggaattgtactcaaattgatgaatgttgtggaatataaattagacctcaagaaagctcctaaaaaattatatgcagtataaaaaagagtgaaacataattggccacccccttttcagctgtactatggactcttactggtgttgcttatgagagcagtgcaaatggagaaagtaaggaaagaaagcataggcattgtccttttccctaagggttagagatcaatcacattcccagtgcagttaagtgagtagaaagctgtaatattcctttcaactgggacttacctcacaattctgtttatatgtgtatctcttgagcaataaaatattatcagcttttccaaatcatgggcataaattgtaattatgcttgtatacatttacataaaaatattttcatttacatacactttgtatgcaagcttcctatctgacaaaatcatataactagaacatatgcaagaatacagaagaatgccaaaaattagaacaatgtgaaagtaacagatacttaaactcttatagtagatcttaacattttcagaggcaacctaaattacactatatgtaattccaaccttttttgggctaaaaaactagaagacaaaacaatggctaagcttgttaaatgcaatacacaaaagcatcaagtggtgattaaggatgctactggaattcaagagaaggaagaaaatatcactgaccttcatgggagaccctgatgagggagatggcaacagtataaaaaaagatataagaactcaagaacagcaatctgagattgttcaatgaagggacaaacaactggacacatctctactctttagaaaatattacgttatgatcagtgctgtctagcaatgtcaaaatacaacaaaaaaatgataaatttgttaagggactgctatggtttgaatgcttgtctcctccaaaaactcatgttgaaatttaattgctattatagcagcattaaaaggtggtacctttaaatactataaaaagtaattaggtcatgagggctccagcctcatgggtgggggttgaagttgttacaaaggcaagagtgtagcctcctgttgctgtcttgcctgtctaccttccatcatggaatgatggagcaagaaggcttgccagatgttgacccctcaatcttggacttcttagctccagagcagtaagccaataaaattgtttattataaattacccattctgtggtattctgttatagcagcacaaaatagactaagacagtttgacaagtttctaaatagttttacacacttttctatccttaaaatatttattttttttaattaggtattttttattgtggtaaaacatgaataataaaatttaccatcttaaccatttttaagtgtacagctcagtagtgttaagtatattcacattgtttatttggacatatataacaatgtttcacattgtgaaacagatcttcaaaatattttcatcttctaaaactgaaactgtatactcattgaataattccaccttccccctcgcaatccactggaaatcaccatcctgttttctgtttctgtgaattttactactttaaatacctcacataaatggagttatagtattggtctttttgtgactgacttcactctgcataatgtgatgaaggtttatctacatagcactgacagaatttcctccctttttaataatattccattgtatgtatacactacattttgtttatccattcatccaatgatggatacttgggtagcttccacctctttactatcgtgaatagtgcttctatgaacattggtgtgcaaatatctctttaccctgttttcaatttttaaggtagatactcagaagtagaattgctggatatggtagttctatttctattttttgatttttcattttaatgctattttacatagcagttacaccattgtacaatgtctctaacagtgtacaagtgctccagtttgcccacatactctccagcacttgttattttcaggtggttggttttttttttatagtagccatcttaatggatgtaaggtgatagtgtggtttcagtttgtatttctctaatgttagtgatagtgagcatctttgcgtacatttgttggttattggtgtatcatctttgaagaaatgtcttttcaagtactttgcccatttttaagttgagtgatataattgttttgagttctaggagttctttattcacaatattatccgacgtattatttgagaatattttctctcatcccatagattgccttttcactgttgattgtgtcttttggtgcacaaaaggttttacgtgtgatgtagtctcatttgtctatttttgcttttgttgcctgtgctttggtgtcatatccaataaatcattgccaaatccaatgtcataaggctttctctttttgtttcctgatagaaattttatatttttgggtcttgcactacttctttaatccactttgagttgatttctatatacagtataataaaaagatccaatcttattcttttgcatgtggatattcagtattcccagcaccatttattgaagagactgttctttctccatagagtggtcttctagcctttatcatagatcacttgactgtatatgtgaggggttatttctgatttctctatcctattccatttatcaatacgtctgtctttatgctagtaccacagtcttgactcctgtagctttgtagtgttttcaaatcagaatgtgtgagtcctctaaatttctttttcttttaaaaatcattttggcttttcagattccttgaaatgccatgtgaatttaaggataaatttttatatttctgcaaaaataatgccatttgggttttgataaagattgtgttaaatctgtatattgctctgggtagcatggacgtcttaataatacaattttctaatccatgaacacagtatgtctcttcatttatttgtgtctttaatttcttttagcaatattttgtagtttttagtgtataagtctttaatctccttcattgggtttgttactattttttatgctattgtaaatattttaagtttttaaataaaaattttaattacttggctttttaagagattagcagtgagagagctgtggaaagacaactggtatcccacttgtctaagtccttcaactctaaatatcctatttgctcatccaactccaaatgcttccacgtcttagtctacaaaattctgctattccactgccaataaggaacaggaagggaatgagagggatgcattccatatgatcttggtgggtgtgaggacaacactttctacggtccgtctctaacttgaaaagcaacagccacagtagtcacagatcagacaacattaagtagaatatttgaaccgcatatggtgacctgagatgaagcccagctggggaaggaagatgccttccctgagacaatcccatttcatgagaactttgtgatatacttttcaaaaattagcatcaggcaaaaactcatattggtgatctctgattcccttcctgtgcaagtctgcagcacctgtcgaagggacagtccttaaagaggtggtggcaacagaagcagaaccaaattcagttccctaaatccacgagagatggaatctgagcacaggttcaggaagttaccaacctcaaccactataacttcatcagtagccaaaaaaacttaatctatttacctcctacacttatttttctatcatattttctatctgtgctgtttccattctgagcagaaagaatctttgataccgccctttttcagttacactatattacgagtgataaaagtcaaaggtgtcccttcctcattatacattgcatttgttatttggtttggaggatatatttaaactaatctttattaaaaatcatactccccagagattttcatgcatatgtatacatataattcaatgtgataaatatttattgagggaggaaggtagaaaatacttattatgccaggtacttaataacatatattctctatcaaccctcacaaaaccctaggaggtaagcagtgttgtttcttatcacctttatcgtatgggggcagtgaactgatggctcattgctattagagtcagaacccaagcctcagtctatatcagaataatgttcaaactttgtttttcccctttgctctcctgacaagcacctagtatttgttcaataccaacttaaccaaatataaattgatcaagatgatcatttgtaaaaataagtatttccagtcactgatttcctgggattagtaattctggcgtgttccttagcaaatttctaactcctcattatgccttagaacattattaatctttttccagaattgcactgttcctccattttttgcttctatatttttaattaatttccagccaattatttttttcttctgtcttatctatgatttaaagatgttaaaataagtatccagcaacagaggattaattagaaaacattttagattccaatgtaagaattttttaaacaatagaatgacattcatgcctgtataagatgatgaaaaccaaaccagatggataaagctaaaaagcctggcctaaagtaagtgagaaaagcatttaagcaaaacaaaagcttcatccccaccaagttttgttttctttttgacagaaacaatacaaactcattacagaaaatacagacaagcgaatgaatctaagaaaaattctattatcaacccaatcacccacaactacttttaattcctaggtgtaaatattttccattccagtttcatatgtataaatggatgattatttttcaacaaaacagacttctatataaactatctttcaaactactataaataagacagcatttacatttttattttaaattttattttatacattttttataaaattaaattttatatatttacttttaatagaggtgagatctcaccatgctgcccaggctggtttcgaactcctgatctcaagtgatcctcctactttgtcctcccgaagtactggagctataggcatgagccaccgtgcccagcctatgtttttaaactaatatttatttctaagcaatttaatgaatatgaatattttactattggcagagaaaagaaataattgccagaaaattaataaagagatcaaaaacagattagcaataaatttgaaaaattctaaatacacatcaacaaaaggcttaaaatataaaagtttgcaaaactgccccataatgcatcacaatgaaaattactaatatttgaactaattggtaaatgacaacatcaatttttaccaatcattataatggttcatgaagctaatacaagaactgtacttgatcgcctaataagaagcccaatagataaaatgacttcatgcttttttctggaatttgaggattagattgaggaatgtactgtagtcaagaggactagatatatccaaaagaagaagcaatatggagccatttctgcacaccaaaagacaaggtgttgatttctcaccactaatttttacagtatccatagtttctgcagaagtaagcaagaccgtcccccatgagtaactgtgcagttttgcattataaagaacaaactatggacacaacaagagcaaacttgggctggtgagaagaggacagggcaaggccaagggatggggagtggggtggaatagcaatgtctgacaaaggggcatcattgaaggaggggactctgacctaaccagtgctgttggagcctgttgaggtagaatgacttctcagcatggggttagctttatgctaataattcatgttgtaactgtttgctcaccacaactgcgttatacagagaagactagacaattctgattgctttgcagcatccagcctgaatggagcttctgggtcccaatctatattgttgtgtgcaaggtcacagcctagagctcctggcaggcagcataagatagacagtggacaaaaccacagacaatggagttgatagggtacattggagcttcggtcacaaatgcagtctgctacttctttctacttaataatgataatcataataacagcagcacgtacagaatgagccagtgctaagtgtttacaggtatcatctcatgtcatcttcaccactactctgggaggcaggctctgttactagttacagataaggaagctcgacctcagaacttgggcagcatgcccaaagacatagttcagtgcccacagtgcctagacttcagtaactggtagagcctggactccaacatggtgtgtcacctcacctcattatagctgttacttaatagagtacttagcatatgcagtcaaggactgagaaggaggacacactagggttgtacaaactggagttaaaaagaaggtgctgtggtttgaatgtcccctccaaaactcatgttgagactgaattcccaatgtggcagtactaagaggtggggcctttaagaggtaattggattgtgaagcctctggctctttgagaaagcatttatagattattgagttaatgaattaatgggttatcataggaagggaacctggtagctttataagaagaggaaaagagacctaagtttgtgcattagcactctcagccccttcgccatgtaatgccctgcaccaccttgggatactgaaaagaatccccacaagcaagaaggttctcactagatgcacccacttgaccttggacttcccagcctccagaactgtaagaaataagttcctattttttttatgaattattttgttataagcaagagaaaagagactaagaggcagtcttcaggaaaaatgttgaaccgtgagcacaaaagtagtgaaatccagattgtcaattttacaagctgaatggccctggttcttcaacaggtaaattttaagaatagaaaagaaagagagaatctatacattaaaaagacatatcatagtttctaaatggtaaaactaaattgttataactagcaatgcatatatgaatggtaaaactattttaaaaatgcaagaaagtaatgacagtcaatgcttggtgttcacaggggattggtttcaggtcccctatggataccaaaacccgaggctgctcaagtcccttacgtgaaagggtataatatttgcatataacctaagcacatcctcctgtatattgtaaatcatctcaagattatttataacacctaatacgatgtaagtgttatgtaagtagttgttatactgtattgtttttgcgttattttttgttttttatttctatttttttaaaatattttccttctgcagtttgttaaatatgcagatgcagaaactgcagctaggaagggccaactgtactatcaaaatcaggatgctggttacttataggggagaaaagagctctgggaatggggcacatagaagagccttcttagacaatggcaaaattatatttcctcatctgggtggtggttacgagtgtacaaaataatatttgggtgttctatgtgtgcatacctcataattcaaaaaagtttaataaacagaaaacagaatcaccatcgtggagttgcggagaccctcaggaatcctcagaagctcatagtgaaagccaagtgggaaggagagagaagaggggtgttccaaaatccctgagtgtcagcagcagatttagtagggacagattctgagacatttttttcaggatttttcccattccatacctattatccccaagtgggacgcaataggggtactgccttcaaatcaagagattaggacttctcattagaacttcttattctttcttcaagagaaggagtatattagggctgcataacaacaaggagacagtctcaagggcactcaacaagtttatcagagtgcctatgagggaagatattaaaaatgaagtagggctttcctttaagactgaaaaagagttccctacatgaaaagtaatgtggctggtggatcctggaaaaagggaccctgaattccacttctgtcagaaaaccaaagaggcaaccagatgttagaaagaaaacaatgtcatatgttcccagaaacagtgcggaaccaacagtaaaatttttgcaatatatataaatgtataatattaaaagtttactcattcatacctctattcgcaaatgttaatttaaaaacagagaaaagttgtattagtacattttcatactgctatgaagaaataccgaagactcggtaatctataaaaaaaaaaaaaaaaaaaaaaaaaaaaaaagaggattaatggactcacagttccacatggctggggaagccttacaatcatggcgggaggcaaaggaagaccaaaggcatgttttacatggtgggaggcaagacagcgtgtgcagtggaactgccctttataaaaccactgagtccctcccatgatgtgtggattatgggaactacaattcaagatgagatttgggtggggacacagccaaaccatatcagaagccatcttactttacaaagtttctcgttcctggagctgcctttgcagacaaagaaatgatattcaatggtggccaccttgcaaacacctcaagcacacgtgcaaaacaattagggaacacttacacaggaggtattcgtgaactgtcagaaaatgtatacataacaaagcaaaagccaaaagcagaaatgagaccaaaagttaaccatgacttacagcaaagcaatgtatttaacgtggcaacatgctgaaaaattaatattcttagtcactggattccagttaactttttttttcctactttgagtttctttttaaatcacgcatctcttttaactcaattatgcaattttggaatgctgagaggttggaaactactgaaatgttcaaaaagagttagaggagggcaaatttagaaaattagctgagaagacaaccttaagtgcccagtgacaggtggtacagtataagtgatcttataatatacatagtttatatttcttatactgcattccctccttgtaaaagcaatgcaaattcctacataagaatcagaaatataatcaaaagaatttaaggaatattcacaatcccatctacctagagacaacacctattctttgctatctagccacctagaacctcttgcaatgtgtagtcattgtccaaacatgaaatgcattcacatagtattctatactctaccataatttattttagccatccagctattagatatttagatgttccaaacaatgcctctttgtttgatatgtaaatggttactaatttttactattacaaacagcttcaaggaggcaaaggtgaatataaacttaagatttaaatgcaaaaatgaaaagaacttaagatttcgggaatcatgcattgtcatgattcttgtcactctaaatcattcatgtatgagtttactgaacaaacacatgttaaatatatgtacctattatgtgccaggcactttgctagatgctggggatgcagtaaatagacagatgtgttccataccctcatagacatcagggaagaaatagatatatagaattacaagcatgtaaaaaagaatgatgatatgggcaatacagcctttaccaaacacattagaaaaaccagtgaacagagataaaaatcttgaaacatctgtggtggtaactccattatgccagtgaccaaaatcctttctgaaaatcgcctccctatgaatcacctggactcttaattcattctcctgttttaatatgtaaattaactactcattctttcctaaaactgaaagcccaaattacaaagactcagcagcagaccaaatgtatagagtgtggggtaatcatgcagctagtggatattcttcatcaataggtgaatatgagattgtgcttggtagcattgtggagttgagtgaacatcaccatgggctcttcctgtaaaatcacatggtgcttaacacatttcaataacctcattaactttcacatacaattttctgaacataataagtctataacctactacctgccatgcattgtgcatattattcctaatcttcatgataatcctaaacagtagatatttttatccctaccttacaaattaacaaactgaggctcacagaggttaaatctggtatccagagacccaatctgaacaggctgtcggctagagtatttactttgcattcttccttccttccttccttccttccttcctgtggttaccaacaagagaacagctgtggtgagtctgcctgctcccagggtactgccttataaaatggattcatctgtcatgatctgagaggaacagaatcagtaaacctaccccaagagaagggctgttatagagagttcatcccttgggatgctgcccttttccctcagagccaagctgctttgatccttagcaaccaaacagcagagcacatatacatgcccctgagagaggggcagtgagctgcctcctcaggactgccacatccagccctaccatgagtgcgaacctcccaaaactgacagcttttctccccatccttcccactcaaagaggaaacaatgctactgtcatttcaaggaacttaaagccacacacatctcagggtcttctccagcattcttcctgtggtcccagcagaggcaggcaaaggaggctgttccaggtcactggcccatattctgtaacataggccagggccagggattaggtgttaggagtgtaggggtgcgggactctggagtgagagccctgggtttaacgcccagagctgatctttaccctctccaagacttggtttccttaaaataaaaaaaaaaataaaaagcagatcataatagtatccccattgacttgttaacgaaggttacataagatggtatttgtagttcggcacagcaatagtagggaccatgcacccagtgatgaattttgcctgttgggggtttcatttaaatgataagaaataaacaaaaaatgaaaaagtcacagagaaaaagagaaaatctagagtggggtaaaaaaaaaatacagaaattttggtcccaaatgtcatgatttcaattttattacaacatgccagtcttataatggtatataaaagccagcatttcaacaacaaatttttgacccaccatgaaaactagagttttacttctcttttaaacatgttttaacaagaatcaaagctattcaggaagaatggaaagttgtgctattatttcaagtgatagagaaaaaacattatttgagtctgaagaatcattcatttttaatataatgaaaatttgaatctgatataactaattgcttaaacctctcttgcatgtactacagcaagatcataaaagatatcaaagcataaagagcagaataagaattctttatctgcaacaggattccctatggtattcttccgtaatgtataggtctgtaacagatattcaacaagagaatttaagacaagatatcatttaacatacgaattcaatgttaccttcaggatctcatcatacatacttggaggattacttagtctgacagatagttgtcttgtactcttttaagataccatagcaagcatttggcataattaggtgtgttgctgccttatcacctgctcaaggataaccagagagcaacccaagaattgtggtgttttcagaaattcagatttaaggcaaactttgaactttactatttataaatcatatattcagctaccaaagccaccacaagctacagacatgctttgttacaaggtacatgcttaatctaagaaaagtagataccttggtttttttgttactgtttttaaaagtttctatcatatttctgaagactatgctatatggctttaaaacaagaattaaggttaaaaacaaaacagcagggttaaggtcagataaaactattttaaccatccttccttcacataaagaagtctcctgtattattaggattcctaaataatctatacttttcaatccattctcaaatagccaaatatttattttatttatttattttttgagacagagtcttgctctgtcacctaggctggagtacagtggcgcgaatcttggctcactgcaggctccgcctcccaggttcaagcgattctcctgcctcagcctctcgagtactggattacaggcacccaccagcacgcccggctaattttttgtatttttagtagagatggggtttcaccatgttggccaggctggtctcaaactcctgacctcaagcgatctgcccacctcggcctcccaaagtgctgggattataggcgtgagccatcatgcccagcctaaccaaatatttaaataagtatgtgctgaccctagaaacattaagagtctgacaaaatgccttagcagttttcagtgtcagttgtttttcttctttttaagttttattgtttttaattgagacatcataattgtacctgtttatgggctacaatatgatgcttcaacacatacatacattgtttaatgaccaaatcagggtaattaccatacacctgtcatttcttggtggtgagaacactgaaatcctctcttctagcttttttgaaatatacattatcattaactatattcaccctactgtgcaatacaacactggaatttattcttactaactgcagctttatacccattgacctacctttctacagccctctccgctccccagcctctggtaaccactattctaactttctacttctaagtgccaggttttattatgccatatataaaaataataatgatagtacaagttttaaagtttttttaaaagagcgtcaggacagttatgctggaaactctccctgggacattaaaaggtgaaatatttgtttcagccaaatggtttctgcctcaccaactactgtgcaaaattcccagccctgaaaatgactgatccgcaggggaccccagctgagttacctgacctacctgttgagcagatgcccccagagagcttcaactttgagacttcattaagctgtgttcagcacaattcaaaaaagttattgatacaaagaggagttattcctggaggatcactcctaaaacgccaacaactagttagtgagaatacctgaataacaataatgataacctttcaaagaagcagcaactattattttacagaaatagaactaagtggcacctgagttataaagacagtttggaggaattctgctgcatacgatctttaaacaactaaggtccccgttctcaatctgcagctctgaaccaaagaacattaagggcatcacctactctgagatgacggtggcctcttttaacccctgtttatagaatagctggctgcaggtgaaaggactgagatgatgctgtccttgtcccccagaaagaagcaaaatcatcttttttacagggcaggtacttccaatctaactagggaaacatgcggcagttcgccaagcagtaaaatctcaatacgcatttatttaacaaacgcccgttatgtcttaggcgcggttcttcgcgctttataaaagttaactcatttgattctaaataataaccttttaggtacggaaaacggagaaaaaatccatgaagatggggactttctacccaccccagccgctttacaaagaaataaccaaacttctagtccccaggtcaaaaataaggagattaaaacccagacaggggaggttaaggacaaaaaccgcagccgcgctgagtcgttaccgtccacaggacactggcggtccgagtcgctgctcatctccgctcccccactccaggctgccccgggcgcggctcccgcagtct
